US007510834B2

(12) United States Patent
Inoko et al.

(10) Patent No.: US 7,510,834 B2
(45) Date of Patent: Mar. 31, 2009

(54) GENE MAPPING METHOD USING MICROSATELLITE GENETIC POLYMORPHISM MARKERS

(75) Inventors: Hidetoshi Inoko, 19-35, Ryokuen 1-chome, Izumi-ku, Yokohama-shi, Kanagawa-ken (JP) 245-0002; Gen Tamiya, Isehara (JP)

(73) Assignees: Hidetoshi Inoko, Kanagawa-ken (JP); Tokai University, Tokyo-to (JP)

( * ) Notice: Subject to any disclaimer, the term of this patent is extended or adjusted under 35 U.S.C. 154(b) by 10 days.

(21) Appl. No.: 10/674,124

(22) Filed: Sep. 26, 2003

(65) Prior Publication Data
US 2004/0197797 A1    Oct. 7, 2004

Related U.S. Application Data

(63) Continuation-in-part of application No. 10/257,511, filed as application No. PCT/JP00/07621 on Oct. 30, 2000.

(30) Foreign Application Priority Data

Apr. 13, 2000  (JP)  .............................. 2000-112699
Sep. 28, 2002  (JP)  .............................. 2002-327516
Dec. 9, 2002   (JP)  .............................. 2002-383869

(51) Int. Cl.
*C12Q 1/68*   (2006.01)
*C12P 19/34*  (2006.01)
*C07H 21/02*  (2006.01)
*G01N 33/48*  (2006.01)

(52) U.S. Cl. .......................... 435/6; 435/91.2; 536/23.1; 536/24.3

(58) Field of Classification Search ........................ None
See application file for complete search history.

(56) References Cited

U.S. PATENT DOCUMENTS 5,683,880 A * 11/1997 Kamb ........................... 435/6
2004/0038272 A1  2/2004 Jou et al.

FOREIGN PATENT DOCUMENTS

WO   WO 94/25625   11/1994
WO   WO 97/31011   8/1997
WO   WO 02/50307   6/2002

OTHER PUBLICATIONS

Barcellos, 1997, Am. J. Hum. Genet., vol. 61, pp. 734-747.*
Braun, 1997, Genomics, vol. 46, pp. 18-23.*
Zhao S et al 'Human, mouse, and rat genome large-sclae rearrangements: stability versus speciation.' Genome Res. Oct. 2004;14(10A):1851-60.*
Adb-Elsalam 'Bioinformatic tools as guidelines for PCR primer design' African Journal of Biotechnology, vol. 2 (5) pp. 91-95.*

Barcellos, et al., "Association mapping of disease loci, by use of a pooled DNA genomic screen," American Journal of Human Genetics, (1997) vol. 61, No. 3, pp. 734-747.
Cox T C et al., "A very high density microsatellite map (1 STR/41 kb) of 1.7 Mb on Xp22 spanning the microphthalmia with linear skin defects (MLS) syndrome critical region," European Journal of Human Genetics: EJHG. England Jul.-Aug. 6, 1998 pp. 406-412.
GenBank Accession No. AF003650 Homo sapiens clone CxM18 MLS syndrome critical region microsatellite sequence, sequence tagged site (Jan. 5, 1999).
Gyapay, et al., "The 1993-94 genethon human genetic linkage map," Nature Genetics, US (Jun. 1994) vol. 7, No. 1, pp. 246-339.
Van Heel, et al., "Identification of novel polymorphisms in the β7 integrin gene: family-based association studies in inflammatory bowel disease," Genes and Immunity (2001) vol. 2, No. 8, pp. 455-460.
Immervoll, et al., "Fine mapping and single nucleotide polymorphism association results of candidate genes for asthma and related phenotypes," Human Mutation (2001) vol. 18, No. 4, pp. 327-336.
Hirota, et al., "Genome-wide microsatellite association studies for parkinson's disease by using the pooled DNA method," American Journal of Human Genetics, (Nov. 2003) vol. 73, No. 5, p. 469 Abstract 1754.
Shiina, et al., "Molecular dynamics of MHC genesis unraveled by sequence analysis of the 1,796,938-bp HLA class I region," Proceedings of the National Academy of Sciences of the United States of America. US, (Nov. 9, 1999) vol. 96, No. 23, pp. 13282-13287.
Shiozawa, et al., "Identification of the gene loci that predispose to rheumatoid arthritis," International Immunology, (Dec. 1998) vol. 10, No. 12, pp. 1891-1895.
Yoshikawa, et al., "An efficient application of maldi-tof/ms coupled with microarray for detection of microsatellite polymorphism," American Journal of Human Genetics, (Oct. 2001) vol. 69, No. 4, p. 464, Abstract 1651.
Oka, et al., "Association analysis using refined microsatellite markers localizes a susceptibility locus for psoriasis vulgaris within a 111 kb segment telomeric to the HLA-C gene", Human Molecular Genetics, vol. 8, No. 12, pp. 2165-2170, 1999.
Keicho, et al., "Fine localization of a major disease-susceptibility locus for diffuse panfronchiolitis", Am. J. Hum. Genet., vol. 66, pp. 501-507, 2000.
Kimura, et al., "Mapping of the HLA-linked genes controlling the susceptiiblity to Takayasu's arthritis", International Journal of Cardiology, vol. 75, pp. S1QS-S110, 2000.

(Continued)

*Primary Examiner*—Jehanne S Sitton
*Assistant Examiner*—Stephen Kapushoc
(74) *Attorney, Agent, or Firm*—Carol L. Francis; Bozicevic, Field & Francis LLP

(57) ABSTRACT

The present invention provides a gene mapping method which involves analysis of a DNA sample from a test subject and from a control subject for the presence of an allelic form of a plurality of microsatellite genetic polymorphism marker, which markers are located at intervals of about 50 Kb to 150 Kb on the human genome, in order to identify regions of the genome associated with a characteristic of the test subjects relative to the control subjects, e.g., a region containing a pathogenic gene or a gene relating to human phenotypes with genetic factors. The invention also features genomic regions so identified that are associated with susceptibility or the presence of psoriasis vulgaris and with rheumatoid arthritis.

7 Claims, 26 Drawing Sheets

OTHER PUBLICATIONS

Mizuki, et al., "Localization of the Pathogenic Gene of Behget's Disease by Microsatellite Analysis AV of Three Different Populations", Invest. Ophthalmol Vis Sci. vol. 41, No. 12, pp. 3702-3708, Nov. 2002.

Matsuzaka, et al., "New polymorphic microsatellite markers in the human MHC class II region", Tissue Antigens, vol. 56, pp. 492-500, 2000.

Ota, et al., "A Second Susceptibility Gene for Developing Rheumatoid Arthritis in the Human MHC AX is Localized within a 70-kb Interval Telomeric of the TNF Genes in the HLA Class III Region", Genomics. vol. 71, pp. 263-270, 2001.

Mizuki, et al., "Microsatellite Mapping of a Susceptible Locus Within the HLA Region for Beliefs Disease Using Jordanian Patients", Human Immunology., vol. 62, pp. 186-190, 2001.

Matsuzaka, et al., "Identification of novel candidate genes in the diffuse panbronchiolitis critical region of the class I human MHC", Immunogenetics. vol. 54, pp. 301-309, 2002.

Matsuzaka, et al., "Susceptibility locus for non-obstructive azoospermia is localized within the H*LA-DR/DQ* subregion: Primary role of *DQBI\*0604*", Tissue Antigens. vol. 60, pp. 53-63, 2002.

Niizeki, et al., "Polymorphisms in the TNF region confer susceptibility to UVB-induced impairment of contact hypersensitivity induction in mice and humans", Methods, vol. 28, pp. 46-54, 2002.

Oka, et al., "Identification of psoriasis vulgaris-susceptible gene within HLA class I antigen", The 22nd Annual meeting Pf MBSJ, IP-1334, Nov. 22, 1999.

* cited by examiner

7th Chromosome

9th Chromosome

10th Chromosome

11th Chromosome

12th Chromosome

15th Chromosome

18th Chromosome

21st Chromosome

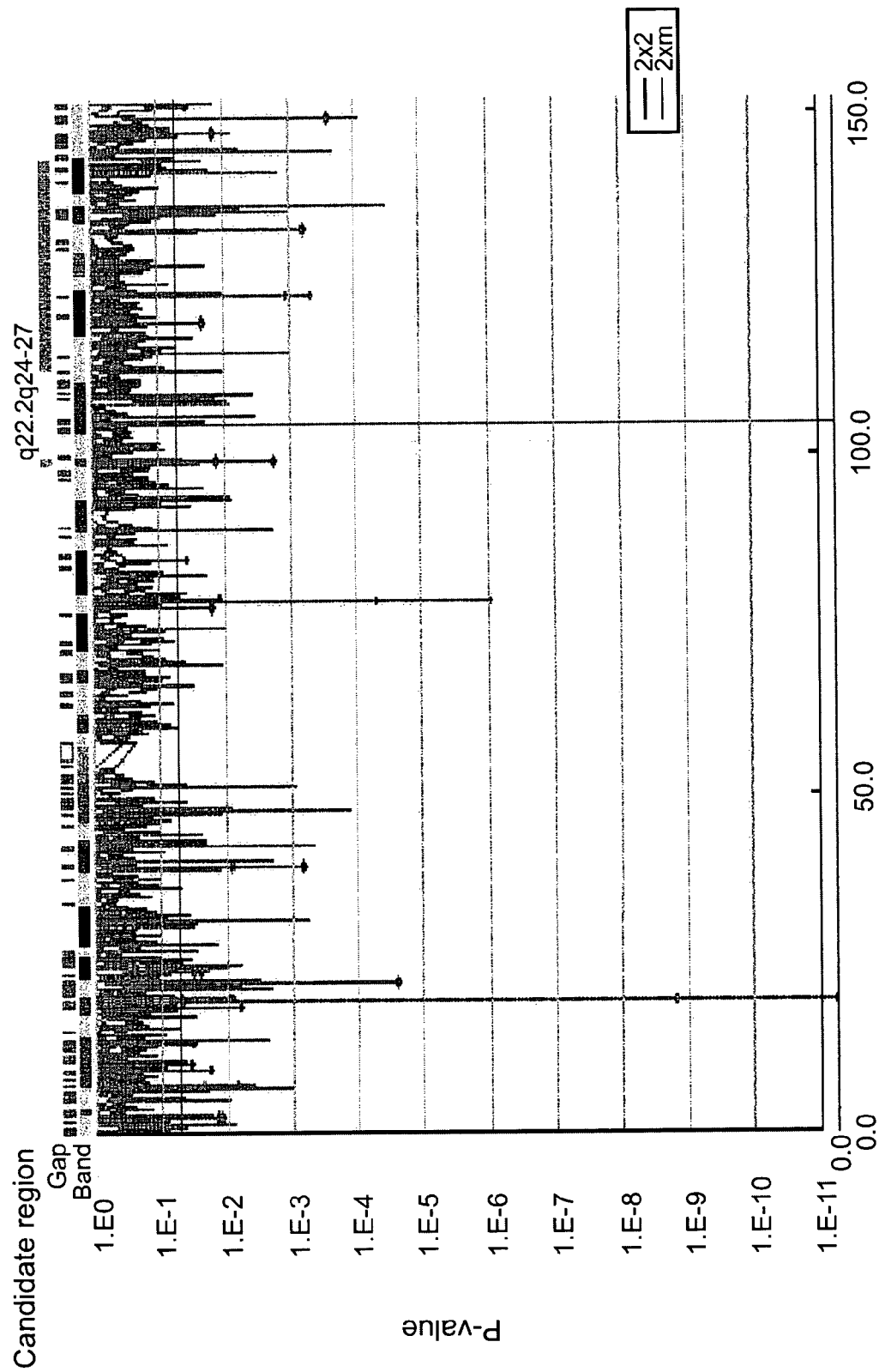

GENE MAPPING METHOD USING MICROSATELLITE GENETIC POLYMORPHISM MARKERS

CROSS-REFERENCE TO RELATED APPLICATIONS

This application
1) is a continuation-in-part of U.S. application Ser. No. 10/257,511, filed, Mar. 7, 2003, which application is a §371 national phase application of PCT/JP00/07621, filed Oct. 30, 2000, which application claims the priority benefit of Japanese patent application serial no. 2000-112699, filed Apr. 13, 2000; and
2) claims the benefit of Japanese patent application serial no. 2002-327516, filed Sep. 28, 2002, and claims the benefit of Japanese patent application serial no. 2002-383869, filed Dec. 9, 2002;

each of which application is incorporated herein by reference in its entirety.

SEQUENCE LISTING

The present specification incorporates herein by reference, each in its entirety, the sequence information on the Compact Disks (CDs) labeled Copy 1 and Copy 2. The CDs are formatted on IBM-PC, with operating system compatibility with MS-Windows. The files on each of the CDs are as follows:
Copy 1—Seqlist.txt 23.250 MB created May 19, 2004; and
Copy 2—Seqlist.txt 23.250 MB created May 19, 2004;
where "N" appears in a nucleotide sequence, N=A, T, C, or G.

FIELD OF THE INVENTION

The present invention relates to methods for gene mapping using microsatellite genetic polymorphism markers. In particular, it relates to a gene mapping method, which uses a distribution map indicating the nucleotide sequences and location of each DNA sequence in a group of DNA sequences including microsatellite genetic polymorphism markers that are located on the human genome.

BACKGROUND OF THE INVENTION

Mapping of pathogenic genes or genes expressing specific phenotypes has been accomplished prior to the invention by comparing the genetic polymorphism markers in test subjects and those in control subjects, and then determining whether there is difference between the frequencies of scific alleles in the test and control subjects.

Such methods of analysis of genetic polymorphism markers include detection of restriction fragment length polymorphisms (RFLP); detection of a variable number of tandem repeats (VNTR) which are scatter within the human genome; detection of the presence or absence of microsatellites markers; and detection of the presence or absence of single nucleotide polymorphisms (SNPs). In particular, methods involving detection of SNPs and microsatellites have attracted attention.

However, there are problems with use of SNPs as the genetic polymorphism markers. For example, because the SNPs are single nucleotide replacements on a genome, generally only two alleles exist, and further only those SNPs existing within 5 kb to 10 kb from to be-mapped genes correlate with the gene. Therefore, genome mapping performed using the SNPs as the genetic polymorphism markers requires an enormous amount of SNPs as markers and an analysis thereof.

Microsatellites avoid some of the problems of SNPs. Many alleles exist for a microsatellite genetic polymorphism markers, and microsatellite markers show correlation to a gene even when it is positioned somewhat far from the gene to be mapped. However, use of microsatellite markers is problematic where there are many microsatellite genetic polymorphism markers used, analysis becomes becomes difficult in terms of tremendous time and labor. In addition, when too few microsatellite markers are used, correlation cannot be found and thus causative genes may be overlooked.

Currently, the field is focusing on specifying a genetic mechanism that defines individual phenotypes through collection and comparison of genetic polymorphism information on a group of subjects, and identifying the susceptibility gene for hereditary diseases with multiple factors or phenotypes. However, the conventional methods utilizing microsatellites or SNPs can work for only limited regions and genes in the human genome, and even for the entire chromosome, only low resolution methods can be used. Therefore, there are many cases of neither being able to identify the susceptibility gene nor eliminate the possibility that other genes are involved even if that identification is successful.

There is a need in the field for methods of gene mapping that address these problems. The present invention addresses this need.

SUMMARY OF THE INVENTION

The present invention provides a gene mapping method which involves analysis of a DNA sample from a test subject and from a control subject for the presence of an allelic form of a plurality of microsatellite genetic polymorphism marker, which markers are located at intervals of about 50 Kb to 150 Kb on the human genome, in order to identify regions of the genome associated with a characteristic of the test subjects relative to the control subjects, e.g., a region containing a pathogenic gene or a gene relating to human phenotypes with genetic factors. The invention also features genomic regions so identified that are associated with susceptibility or the presence of psoriasis vulgaris and with rheumatoid arthritis.

An objective of the present invention is to provide a genome polymorphism analysis method, which does not have the same defects as in the gene mapping methods utilizing the SNPs or microsatellites as described above and allows clear identification of the genetic mechanism that defines individual phenotypes through collection and comparison of genetic polymorphism information on a group.

Furthermore, an objective of the present invention is to provide a protein, which is encoded by a gene that is identified by the genome polymorphism analyzing method, and antibodies against the protein.

The present invention further provides a forward primer, which has a length of, for example, about 15 to 100 nucleotides, and which can be used for detection of a microsatellite genetic polymorphism, e.g, the forward primer has a nucleotide sequence that is the same as, a nucleotide sequences extending in the 3'-direction from the 5'-terminus of the DNA sequence of a microsatellite genetic polymorphism marker located on the human genome.

Furthermore, the present invention provides a reverse primer, which has a length of, for example, about 15 to 100 nucleotides, and which can be used for detection of a microsatellite genetic polymorphism, e.g., the reverse primer has a nucleotide sequence that is complementary to the sequence extending in the 5'-direction from the 3'-terminus of the DNA sequences of a microsatellite genetic polymorphism markers that are located on the human genome.

Furthermore, the present invention provides a distribution map for the DNA sequences including microsatellite genetic polymorphism markers, which indicate the nucleotide sequences and location in each DNA sequence of a group of DNA sequences including microsatellite genetic polymorphism markers that are located on the human genome at intervals of 50 Kb to 150 Kb. The distribution map can be provided in, for example, in computer-readable format (e.g., embedded in a computer readable media), for access by a computer, which can be programmed to facilitate analysis of the distribution map.

Other features and advantages of the invention will be apparent to the ordinarily skilled artisan upon reading the disclosure provided herein.

BRIEF DESCRIPTION OF THE DRAWINGS

FIG. 26 shows a profile for the rheumatism susceptibility segment in the Y chromosome analyzed using a method according to the present invention.

DEFINITIONS, ABBREVIATIONS OF TERMINOLOGY, AND DESCRIPTION OF TERMINOLOGY

Figure 1:
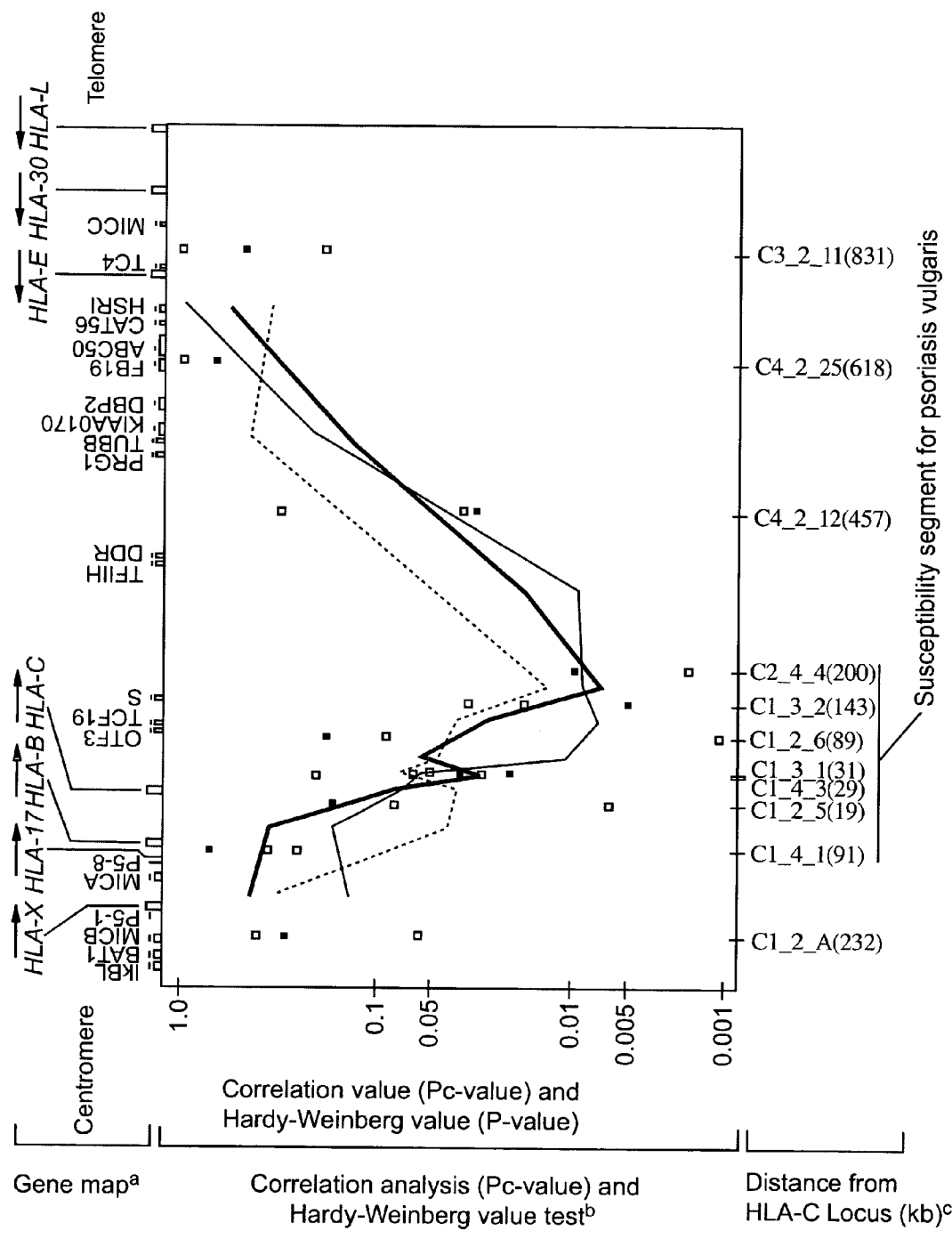
FIG. 1 indicates P-values obtained by the correlation test and the exact test of Hardy-Weinberg proportion with the locations of microsatellite markers used for gene mapping of psoriasis vulgaris.

The term "forward primer" herein denotes a primer having the same nucleotide sequence as the sequence extending in 3'-directions from the 5'-terminus and may include part of the sequence of the 5' terminus, of the DNA sequence encoding the microsatellite genetic polymorphism markers that are located on human genome.

The term "reverse primer" herein denotes a primer having a complementary nucleotide sequence to a sequence extending in 5'-directions from the 3'-terminus, and may include part of the sequence of complementary to the 3' terminus, of the DNA sequence encoding the microsatellite genetic polymorphism markers that are located on human genome.

The term "distribution map" herein denotes a map indicating the distribution of DNA sequences including microsatellite genetic polymorphism markers, which are used to indicate the nucleotide sequences and location in each DNA sequence of a group of DNA sequences including microsatellite genetic polymorphism markers that are located on the human genome in desired intervals. As a group of DNA sequences including the genetic polymorphism markers, a group of DNA sequences composed of the nucleotide sequences referred to with SEQ ID NOS: 1 to 27088 are described herein. The distribution map can be provided in, for example, in computer-readable format (e.g., embedded in a computer readable media), for access by a computer, which can be programmed to facilitate analysis of the distribution map.

It is noted that the nucleotide sequences having the sequence of SEQ ID NOS: 1 to 27088 are located on the human chromosome as shown below. The numbers to the right of "autosome" denote sequence numbers.

The first autosome: SEQ ID NOS:1 to 2203
The second autosome: SEQ ID NOS:2204 to 4561
The third autosome: SEQ ID NOS:4562 to 6438
The fourth autosome: SEQ ID NOS:6439 to 8005
The fifth autosome: SEQ ID NOS:8006 to 9641
The sixth autosome: SEQ ID NOS:9642 to 11422
The seventh autosome: SEQ ID NOS: 11423 to 13352
The eighth autosome: SEQ ID NOS:13353 to 14629
The ninth autosome: SEQ ID NOS:14630 to 15734
The tenth autosome: SEQ ID NOS:15735 to 17011
The eleventh autosome: SEQ ID NOS:17012 to 18202
The twelfth autosome: SEQ ID NOS:18203 to 19560
The thirteenth autosome: SEQ ID NOS:19561 to 20427
The fourteenth autosome: SEQ ID NOS:20428 to 21178
The fifteenth autosome: SEQ ID NOS:21179 to 21732
The sixteenth autosome: SEQ ID NOS:21733 to 22478
The seventeenth autosome: SEQ ID NOS:22479 to 23137
The eighteenth autosome: SEQ ID NOS:23138 to 23801
The nineteenth autosome: SEQ ID NOS:23802 to 24313
The twentieth autosome: SEQ ID NOS:24314 to 24953
The twenty-first autosome: SEQ ID NOS:24954 to 25307
The twenty-second autosome: SEQ ID NOS:25308 to 25634
X chromosome: SEQ ID NOS:25635 to 26697
Y chromosome: SEQ ID NOS:26698 to 26801
Not identified locations: SEQ ID NOS:26802 to 27088

The abbreviation "MS genetic polymorphism marker sequence" or "MS marker sequence" herein denotes a DNA sequence including a microsatellite genetic polymorphism marker.

"Genetic polymorphism" herein indicates that two or more forms of an allele exist on a particular gene locus with a frequency greater than 1%. A gene locus may be any region on the genome, and is not limited to the genetic region which is expressed.

The term "microsatellite" denotes a sequence having di- to hexanucleotide repeats. The microsatellites are known to exist at a frequency of one in 2 kb to 3 kb on the genome. The number of repeats within each microsatellite may vary among individuals.

A short tandem repeat (STR) refers to a short sequence that varies between alleles by the number of repeats of the sequence present, e.g., the polymorphism is due to variation in the number of repeats across different allelic forms. Genetic polymorphisms of microsatellites are generally determined by the number of repeats therein. A representative example of such microsatellites is the CA repeat (Dib C. et al. (1966) Nature, 380: 152-154).

For example, according to microsatellite analyses in the human HLA region made by the present inventors, microsatellites with dinucleotide repeats were found at a rate of one in approximately 8.9 kb; with trinucleotide repeats, one in approximately 12.9 kb; with tetranucleotide repeats, one in approximately 6.6 kb; with pentanucleotide repeats, one in approximately 12.6 kb; in total, one microsatellite in approximately 2.4 kb (Shiina T. et al. (1999) Proc. Natl. Acad. Sci. USA, 96: 13282-13287).

With this invention, these microsatellites are appropriately selected and used as genetic polymorphism markers. According to the present invention, a microsatellite marker for mapping a genomic locus are selected, and a distribution map for DNA sequences including microsatellite genetic polymorphism markers can be generated. The map indicates the nucleotide sequence and location in each DNA sequence within of a group of DNA sequences that including microsatellite genetic polymorphism markers located on the human genome in intervals of 50 to 150 Kb, preferably 80 to 120 Kb, more preferably 90 to 110 Kb, is made and utilized.

In one aspect of the invention, the inventors generated such a distribution map of region on the human genome, a where a group of DNA sequences including microsatellite genetic polymorphism markers on the human genome are a group of DNA sequences made up of nucleotide sequences referenced with sequence numbers 1 to 27088. The sequence table with the sequence numbers shows chromosome numbers for the respective DNA sequences, locations on the chromosomes, and distances from before and after each DNA sequence.

It is noted that "additional information" (<223>) in the Sequence Listing provided on CD-ROM, and intended as part of the present specification, provides information about the location and characteristics of the marker. Examples of such descriptions are set out below.

"<223> Marker ID" in the Sequence Listing denotes a specific marker symbol. This specific symbol is an identification symbol attached to each microsatellite genetic marker by the applicant; which can be used in implementing the present invention and obtaining additional experimental data if necessary.

"<223> Located on chromosome" in the Sequence Listing denotes a location on a chromosome. For example, "<223> Located on chromosome 17" means that a corresponding nucleotide sequence exists on the seventeenth chromosome.

"<223> Distance between a terminus base of telomere on chromosomal short arm and 5'-terminus of this base sequence:" in the Sequence Listing means the distance between the very end base of the telomeric short arm of a chromosome and corresponding base sequence 5'-terminus. For example, "<223> Distance between a terminus base of telomere on chromosomal short arm and 5'-terminus of this base sequence: 72160696", this means that the distance between a terminus base of the chromosomal telomeric short arm and the 5'-terminus of this base sequence is equal to 72160696 nucleotides.

"<223> Distance between 3'-terminus of neighbour sequence of sequence listing upward to telomere on chromosomal short arm and the 5'-terminus of this base sequence: 107571" in the Sequence Listing means that the distance between the 3'-terminus of the neighbour sequence located on the chromosomal telomeric short arm, which is listed in the sequence table, and the 5'-terminus of this base sequence. For example, "<223> Distance between the 3'-terminus of neighbour sequence of sequence listing upward to telomere on chromosomal short arm and the 5'-terminus of this base sequence: 107571" means that the distance between the 3'-terminus of the neighbour sequence (appricon) positioned on the chromosomal telomeric short arm and the 5'-terminus of this base sequence is equal to 107571 nucleotides. It is noted that when this number is "0", this means that there is no neighbour sequence.

It is further noted that the MS genetic polymorphism markers are provided over a genomic region such that they exist at a rate of one to approximately 100 kb on the genome. This emanates from the fact that the microsatellites located within the range between 100 Kb and 200 Kb from a target gene indicate linkage disequilibrium, and that correlation with phenotypes such as diseases is found by mapping, thereby allowing identification of the target gene region. That is, since the microsatellite genetic polymorphism located 100 kb to 200 kb from the causative gene indicates linkage disequilibrium, the distribution map for MS genetic polymorphism markers located at a rate of one in approximately 100 kb can be used to to reliably detect the correlation without overlooking a causative gene and conduct most effective causative gene mapping with minimum labor.

With this invention, a rate of one in approximately 100 kb usually means an average rate of one in 50 kb to 150 kb, preferably one in 80 kb to 120 kb on average, and more preferably one in 90 kb to 110 kb on average, over a genomic region of interest, e.g., over a gene (e.g., including introns and exons), genetic locus (e.g., a region containing one or more genes), or one or more chromosomes.

With this invention, the phrase "substantially located at a rate of one in approximately 100 kb" refers not only to the case where the MS genetic polymorphism markers are located at a rate of one in approximately 100 kb throughout the entire region, but also the case where some of the markers are located at a rate of one in approximately 100 kb. For example, when MS genetic polymorphism markers are located at a rate of one in approximately 100 kb in a certain region, and markers are located at a different frequency in another region, then as a whole it does not satisfy the ratio of "one in approximately 100 kb", however, as long as the MS genetic polymorphism markers are located in a certain region at a rate of one in approximately 100 kb, it is included in the definition of "substantially located at a rate of one in approximately 100 kb" according to this invention.

Incidentally, if three or more MS genetic polymorphism markers are prepared, the ratio thereof can be calculated; however, locating 5 or more is favorable to calculate that rate, more preferably 7 or more, and still more preferably 10 or more.

Moreover, to make a distribution map for MS genetic polymorphism markers, which are used for gene mapping, the MS genetic polymorphism markers to be prepared preferably have high information content available for analysis. The larger the allele number, for example, or the higher the heterozygosity, the higher information content available for the analyses.

The "allele number" indicates the number of alleles of a certain gene, according to the present invention. That is, genomic sequences at a specific gene locus having different nucleotide sequences are referred to as having an "allelic" relationship; the term corresponds to genotype, and the number thereof is referred to as the allele number.

The term "average allele number" refers to the average allele number of all microsatellites used in the mapping method of this invention. Provided that the allele numbers of the 1 st to the n-th microsatellite are denoted as m1 to mn, respectively, the average allele number of n microsatellites is expressed by the following equation:

Average allele number: $(m_1+m_2+m_3+ \ldots +m_n)/n$

The term "heterozygous" refers to the state of a gene in diploid organisms, such as humans, having different alleles on the two strands of chromosomes. Further, the term "heterozygosity" denotes the degree of heterozygosity. When the allele number of the x-th microsatellite is denoted as $m_x$, and the frequency of each allele $Fm_1$ to $Fm_x$, respectively, "heterozygosity ($h_x$)" of that microsatellite is given by the following equation:

$$h_x = 1-(Fm_1^2+Fm_2^2+Fm_3^2+ \ldots +Fm_x^2)$$

The "average heterozygosity" of n microsatellites is given by the following equation:

Average heterozygosity: $(h_1+h_2+h_3+ \ldots +h_n)/n$

Use of a genetic polymorphic marker having an average allele number of 5 or more, or preferably 8 or more, and an average heterozygosity of 60% or more, preferably 65% or more, or more preferably 70% or more, provides for more efficient mapping.

Gene mapping according to the present invention is generally conducted by comparing the frequency of MS genetic polymorphic markers in healthy control subjects to that in randomly selected affected patients. That is, the frequency of each allele of microsatellites in healthy control subjects and the frequency of each allele of microsatellites in randomly selected affected patients are compared by correlation analysis.

Herein, "randomly selected" indicates that the selected patients do not have to have a blood relation (siblings or filioparental relationship). It is preferable that the group of patients consists of patients without blood relation (siblings or filioparental relationship) to each other. If a microsatellite is within 100 kb to 200 kb from a pathogenic gene, the frequency of each allele of that microsatellite will be statistically different between healthy subjects and affected patients. A correlation analysis can be performed based on a known method (Nishimura Y. (1991) "Takei no Tokeigakuteki Riyoho" (Statistical Utilization of Polymorphisms), Saishin Igaku 46: 909-923; Oka A. et al. (1999) Hum. Mol. Genetics, 8: 2165-2170 (1999); Ota M. et al. (1999) Am. J. Hum. Genet. 64: 1406-1410 (Ozawa A. et al. (1999) Tissue Antigens 53: 263-268)).

A "computer-based system" refers to the hardware means, software means, and data storage means used to analyze the information of the present invention. The minimum hardware of the computer-based systems of the present invention comprises a central processing unit (CPU), input means, output means, and data storage means. A skilled artisan can readily appreciate that any one of the currently available computer-based system are suitable for use in the present invention. The data storage means may comprise any manufacture comprising a recording of the present information as described above, or a memory access means that can-access such a manufacture. A "computer readable media" refers to any suitable media on which the genetic map and its associated program for analysis and display of a genetic distribution map of the invention can be stored and, in most embodiments, executed for analysis.

To "record" data, programming or other information on a computer readable medium refers to a process for storing information, using any such methods as known in the art. Any convenient data storage structure may be chosen, based on the means used to access the stored information. A variety of data processor programs and formats can be used for storage, e.g. word processing text file, database format, etc.

A "processor" references any hardware and/or software combination which will perform the functions required of it. For example, any processor herein may be a programmable digital microprocessor such as available in the form of an electronic controller, mainframe, server or personal computer (desktop or portable). Where the processor is programmable, suitable programming can be communicated from a remote location to the processor, or previously saved in a computer program product (such as a portable or fixed computer readable storage medium, whether magnetic, optical or solid state device based). For example, a magnetic medium or optical disk may carry the programming, and can be read by a suitable reader communicating with each processor at its corresponding station.

Furthermore, not only causative genes for diseases but also those related to arbitrary phenotypes with genetic factor(s) can be mapped, for example, by randomly selecting individuals having the phenotype of interest and control individuals, and then comparing the frequency of MS genetic polymorphism markers among them.

Target Genes to be Mapped

Target genes that can be-mapped according to the present invention, include any gene of interest, including pathogenic genes and genes relating to human phenotypes with genetic factors, and are not limited to a specific range.

Diseases that have or may have genetic factors include monogenic diseases that are caused by the abnormality of a single gene, and polygenic diseases, the onset of which is triggered by the additive effect of multiple genetic factors and/or environmental factors. That is, with this invention, the term "pathogenic gene" refers not only to a single gene which can alone cause a disease, but also to a gene which is related to the onset or progress of a disease together with other genes, environmental factors, etc. Moreover, the term "pathogenic gene" herein includes genes that define the drug sensitivity of a patient to a treatment for a certain disease.

Examples of polygenic diseases include the so-called "common diseases", such as, for example, diabetes, hypertension, chronic articular rheumatism, gout, hyperlipemia, arteriosclerosis, schizophrenia, cancer, heart disease, cerebral infarction, and azoospermia, which include most of the lifestyle-related diseases. Moreover, autism, manic-depressive psychosis, epilepsy, or the like may also be included. Mapping according to the present invention allows causative gene(s) for a disease to be specified and the molecular mechanism thereof to be elucidated, and is expected to be applied to diagnosis, drug development, and development of preventive measures for the disease.

Moreover, genes relating to human phenotypes with genetic factors include causative genes relating to height, weight, skin condition, skin color, hair color, intelligence, memory, personality, and such, and the present invention may be used to map the genes. Therefore, genes expressing detectable phenotypes can be used as target genes of this invention. Furthermore, the gene mapping method of this invention can be applied not only to humans, but also to all kinds of animals including mammals, birds, breeding stock of domesticated and non-domesticated animals, and the like.

The invention has been applied to the mapping of genetic markers in human subjects having psoriasis vulgaris or having chronic articular rheumatism (RA). These populations and conditions are described in more detail below.

Psoriasis Vulgaris

Psoriasis vulgaris (MIM 177900) is a common skin disorder characterized by inflammatory cell infiltration and hyperproliferation of epidermal cells. The familial nature of this disease, which affects almost 2% of Caucasian populations, has long been recognized. However, in the Japanese population, a lower incidence (0.1%) has been observed, with most psoriasis vulgaris cases being sporadic. These facts clearly suggest that psoriasis vulgaris is a multi-factorial disease triggered by the involvement of some environmental factors in individuals with a particular genetic background. In fact, through recent linkage studies on the entire genome, several susceptibility gene loci on chromosomes 6p21.3 [human leukocyte antigen (HLA)], 17q25, 4q, and many others have been identified (Tomfohrde J. et al. (1994) Science, 20, 1141-1145; Matthews, D. et al. (1996) Nature Genet., 14, 231-233; Nair, R. P. et al. (1997) Hum. Mol. Genet., 6, 1349-1356; Trembath, R. C. et al. (1997) Hum. Mol Genet., 6,813-820).

Among them, the HLA locus is believed to be one of the major genetic factors predisposing a subject to the disease. It is well known that psoriasis vulgaris is associated with several serologically defined HLA class I antigens, such as HLA-B13, -B17, -B39, -B57, -Cw6, and -Cw7. This has been verified in many different populations throughout the world, including Caucasians and Japanese (Brenner W. et al. (1978) Arch. Dermatol. Res., 28, 337-339; Tiilikainen A. et al. (1980) Br. J. Dermatol., 102, 179-184; Ozawa A. et. al. (1981) J. Am. Acad. Dermatol., 4,205-230; Cao K. et al. (1993) Chin. Med. J., 106, 132-135; Schmitt-Egenolf, M. et al. (1996) J. Invest. Dermatol., 106, 711-714).

Among these alleles, the most consistent and significant correlation is observed with HLA-Cw6. However, this correlation is not as strong as that between HLA-B27 and ankylosing spondylitis (MIM 106300) (in this case, since up to 100% of the patients carry the allele, the HLA-B-27 is likely the bona fide cause) (Moller E. and Olhagen B. (1975) Tissue Antigens, 6,237-246). In actuality, only 10% (Japanese) to 45% (Caucasians) of patients with psoriasis vulgaris carry the HLA-Cw6 allele (Tiilikainen A. et al. (1980) Br. J. Dermatol., 102, 179-184; Asahina A. et al. (1991) J. Invest. Dermatol., 97, 254-258). Therefore, there is a possibility that the HLA-C gene itself is not the primary locus responsible for psoriasis vulgaris and that other gene(s) located nearby harbor the true pathogenic mutation/allele with strong linkage disequilibrium to HLA-Cw6. In this respect, fine mapping of this putative susceptibility gene locus, using high resolution genetic markers around the HLA-C gene, is needed.

The present inventors have completed sequence analysis of the entire 1.8 Mb HLA class I region, from MICB (major histocompatibility complex class I chain-related gene B) to HLA-F, and have identified more than 40 new genes within this segment (Mizuki N. et al. (1997) Genomics, 42, 55-66; Shina T. et al. (1998) Genomics, 47, 372-382; Shina T. et al. (1999) Immunol. Rev., 167, 193-199). Then, for high resolution mapping of a gene presumed to be the "psoriasis gene" linked with major histocompatibility complex (MHC) in Japanese psoriasis vulgaris patients, the present inventors narrowed the target to this gene fragment, selected a total of 11 highly polymorphic novel MS genetic polymorphism markers existing at regular intervals throughout the entire 1060 kb segment around the HLA-C gene locus, and performed correlation analysis thereof. Thus, MS genetic polymorphism markers are estimated to be distributed at a density of one every 96.7 kb.

Statistical analyses of the distribution and deviation from the Hardy-Weinberg equilibrium of the allelic frequency at each microsatellite locus were carried out using these MS genetic polymorphism markers. The results revealed that the pathogenic gene for psoriasis vulgaris is located within a reduced segment of 111 kb spanning 89 kb-200 kb of the telomeric HLA-C gene.

According to RT-PCR analysis using keratinocyte mRNA, this critical region for psoriasis Vulgaris included, in addition to three known genes, i.e., POU5FI (OTF3: octamer transcription factor 3) (Takeda J. et al. (1991) Nucleic Acids Res., 20, 4613-4620; Krishnan B. R. et al. (1995) Genomics, 30, 53-58), TCF19 (SC1: cell growth regulated gene) (Krishnan B. R. et al. (1995) Genomics, 30, 58-58; Ku, D. H. et al. (1991) Cell Growth Differ., 2, 179-186), and S (corneodesmosin gene) (Zhou Y. and Chaplin D. D. (1993) Proc. Natl. Acad. Sci. USA, 90, 9470-9474; Ishihara M. et al. (1996) Tissue Antigens, 48: 182-186; Tazi Ahnini, R. et al. (1999) Hum. Mol. Genet., 8,1135-1140; Allen M. H. et al. (1999) Lancet, 353, 1599-1590), four novel expressed genes identified by the genome sequencing of the entire HLC class I region, i.e., HCR (helix coiled-coil rod homologue), SPR1 (skin specific proline rich gene 1), SEEK1 (specific expressed gene in epidermal keratinocytes 1), and STG (skin specific-telomeric gene) (AB029331, AB031480, AB031479, and ABO31481, respectively). Accordingly, seven genes involved in susceptibility to psoriasis vulgaris were specified.

Among them, the S gene encodes a 52 kDa-56 kDa protein, corneodesmosin, which is expressed in differentiating epidermal keratinocytes, and thus a candidate gene related to psoriasis vulgaris. One, of the four novel genes in the 11 kb critical region related to psoriasis vulgaris was expressed in most of the examined tissues, including keratinocytes, and encodes a plectin-like protein with alpha-helical coiled-coil rod domains. Plectin has been proposed to provide mechanical strength to cells and tissues by acting as a cross-linking element of the cytoskeleton (Liu C. G. et al. (1996) Proc. Natl. Acad. Sci. USA, 30, 4278-4283). Furthermore, it is of particular interest that the plectin gene is responsible for the development of epidermolysis bullosa simplex (Pulkkinen L. et al. (1996) Hum. Mol. Genet., 5, 1539-1546). The other three novel genes show no homology to any known sequences in DNA databases. However, it is noteworthy that all of the three were specifically expressed in keratinocytes and skin tissues. Thus, in addition to the S gene, these four novel genes, from their expression pattern and/or predicted function, are genes related to psoriasis vulgaris. As described above, the inventors have exemplified that usage of a group of DNA sequences including MS genetic polymorphism markers according to the present invention allows highly efficient gene mapping In carrying out the methods of gene mapping of the invention, the inventors identified genetic regions associated with psoriasis vulgaris in humans, which regions are described in more detail in the Examples below. The inventors identified a region of about 111 kb extending from C1_2_6 (89 kb telomeric HLA-C) to C2_4_4 (200 kb telomeric HLA-C) as a common area critical for psoriasis vulgaris at a confidence level of more than 95%.

Thus the invention features methods for determining the susceptibility of a patient to psoriasis vulgaris, as well as method of determining-whether a subject may be a carrier for this condition. The diagnostic or prognostic method can be carried out using methods well known in the art, which methods involve analysis of the relevant genomic region in a nucleic acid sample obtained from a subject.

In general, the method involves, analyzing a region of about 111 kb extending from C1_2_6 to C2_4_4 for the presence-one or makers associated with psoriasis vulgaris. Preferably, the marker is at least one of allele 303, allele 357, allele 255, allele 259, or allele 223 (see Examples 2-3 below). Detection of one or more of these markers indicates the subject carries an allele associated with psoriasis vulgaris. Where the subject is homozygous for the market, the subject has or is susceptible to onset of psoriasis vulgaris. If the subject is heterozygous, the subject can be a carrier for the disease.

Rheumatoid Arthritis (RA)

Rrheumatoid arthritis (RA) is a progressive chronic inflammatory disease accompanied by proliferation of arthrosynovial cells and destruction of joints, cartilage, and bones, and a systemic autoimmune disease, which is as typical as systemic lupus erythematosus. The ratio of the RA patients in the entire population is approximately 0.5 to 1.0% worldwide, and in Japan approximately 0.7 million to 1.0 million patients are estimated. There are people with a distinctly high disease rate such as Native Americans and people with an exceptionally low disease rate such as Nigerians; however, considering the difference in diagnostic criteria or the like, it is thought that the difference in disease rates of differing races is generally small.

The RA rate increases over age, but decreases after the age of sixty. In particular, the women's disease rate is two to three times the men's disease rate, and people of ages between thirty and fifty tend to catch a disease. RA onset, however, does not catenate due to sexuality. Such difference due to sexuality is considered to emanate from some resistive reaction against the RA onset occurring in men; it is pointed out that as one cause, male hormones (androgen) may be of influence. According to this, it is considered that the threshold for the accumulated risk factor that causes RA onset on women is lower than that for men.

While an understanding level for immunological aspects such as cytokine cascade has been drastically enhanced due to the progress in molecular biologic techniques for RA, the complete picture of fundamental causes of the disease has not been directly identified even though some circumstantial evidence has been identified. However, it has been insinuated based on epidemiological data collected so far that RA has a hereditary nature. The hereditary nature includes familial accumulation and disease onset match rates for monozygotic twins.

In the case of diseases with hereditary nature, the disease incidence rate for a family within which that disease is inherited is expected to be higher than that for the entire group.

Since the familial disease incidence rate is approximately 8%, and the general-group disease incidence rate is approximately 1%, an index representing a familial accumulation level: $\lambda R$ (=familial disease incidence rate/general-group disease incidence rate) is then estimated as approximately 8. In other words, this means that the familial disease incidence rate is eight times that for the general group, insinuating that genetic factors are involved in the onset of the RA. In the case of the disease of interest not having a hereditary nature, incidence match rates (an incidence rate at which both twins suffer from the same disease) for a pair of monozygotic twins and a pair of dizygotic twins are almost the same and low; however, the stronger the hereditary nature, the higher the match rate for both types of twins, and in particular, the higher the match rate for monozygotic twins.

Aho and Simlman at, el, have reported that the incidence match rate for monozygotic twins is approximately four times that for dizygotic twins, which insinuates involvement of genetic factors. On the other hand, since the incidence match rate for the dizygotic twins is very low, it is expected that causative genetic factors or a plurality of RA susceptibility genes exist in the chromosome.

In the first step of identifying the susceptibility gene for the rheumatoid arthritis in which genetic factors are suggested to be involved, genetic correlation analysis is carried out using a method according to the present invention so as to restrict candidate causative gene regions.

Identification of MS genetic polymorphisms, according to the present invention, may be carried out by: amplifying the DNA sequence samples through polymerase chain reaction (PCR) using a forward primer and a reverse primer corresponding to each DNA sequence in a group of DNA sequences including microsatellite genetic polymorphism markers located in desired intervals; performing electrophoresis using a high resolution gel such as a DNA sequencer; and performing measurement and analysis of the DNA sequence fragment including microsatellite genetic polymorphism markers, which are amplified products.

According to the present invention, before identification, a distribution map for DNA sequences including microsatellite genetic polymorphism markers, which are used to indicate the nucleotide sequence and location in each DNA sequence of a group of DNA sequences including microsatellite genetic polymorphism markers that are located in advance on the human genome at desired intervals, is made and utilized. In actuality, the inventors prepared a group of DNA sequences including microsatellite genetic polymorphism markers on the human genome, and made and utilized a distribution map including the group of DNA sequences made up of all or a part of the nucleotide sequence referenced with sequence numbers 1 to 27088. Usage of this distribution map has enabled gene mapping throughout a genome according to the present invention. It is noted that Golden Path (Dec. 22, 2001) is used as the human genome reference sequence, which is utilized for making the distribution map.

A method according to the present invention can be easily implemented by utilizing DNA chips and mass spectrometry. Specifically, for example, by loading 1000 or more MS genetic polymorphism marker DNA sequences onto a chip, ionizing by laser irradiation, and then measuring the molecular weight using the traveled distance in a vacuum tube as an index, the number of repeats of the microsatellite, i.e., polymorphism, can be measured easily and quickly (Braun A. et al. (1997) Genomics 46: 46-23). More specifically, for example, DNA MassArray™ (MS chip) (Sequenom Co. LTD, San Diego, Calif., USA; PE Biosystems Co. LTD, Foster City, Calif., USA) may be used.

Moreover, through a method according to the present invention, using a forward primer and a reverse primer corresponding to the MS genetic polymorphism markers located throughout the genome, a first screening may be performed, and a second screening for the MS genetic polymorphism markers indicated positive by the first screening may then be performed. The second screening uses a different sample group, performing an analysis as with the first screening. The additional test through the second screening results in a drastic reduction of the number of the MS genetic polymorphism markers indicated false-positive without carrying out forced correction.

When the position of a target gene is restricted by mapping using the MS genetic polymorphism markers according to the present invention, candidate positions can be further restricted so as to specify the gene locus by a different mapping. For this purpose, for example, analysis using SNPs is effective. Since SNPs exist at a rate of one in 300 to 500 base pairs on the genome, with a high frequency of occurrence approaching several hundred times of that of MS genetic polymorphism markers, the SNP analysis after the mapping according to the present invention allows identification of the target gene. Specifically, after the analysis using MS genetic polymorphism markers, the polymorphism frequencies of SNPs in the candidate segments that have been considered to encompass the target gene are compared, for example, through correlation analysis between a group of patients and a group of healthy people, and such; and then, SNP markers with linkage disequilibrium detected by haplotype analysis are detected through linkage disequilibrium analysis.

To facilitate understanding of advantages of the mapping method using the MS genetic polymorphism markers according to the present invention, SNP (single nucleotide polymorphism) analysis of the human genome is explained below. The SNP analysis is a method for mapping causative genes of diseases using, as genetic polymorphism markers, 300,000 polymorphisms, which are collected based on differences due to replacements, deletions, or insertions of a single nucleotide in genes throughout the genome.

SNPs can be the cause of diseases with multiple factors, such diseases as the so-called lifestyle-related diseases. However, since the number of alleles of an SNP is generally only two, mapping capability is low (Kruglyak L. (1999) Nature Genetics 17: 21-24). In actuality, through analysis by the present inventors, microsatellites with 5 or more alleles that are located within approximately 200 kb from a target gene show a significant correlation, whereas the SNP analysis makes clear that only a part of SNPs that are located extremely close, within 5 kb, to the target gene showed significant correlation.

As mentioned above, this may be due to the fact that the capability in mapping SNPs is low, i.e., the number of alleles of an SNP being generally only two and its heterozygosity being 50% or less (normally 17%). Thus, according to the method of the present invention, the most effective strategy for genome mapping may be to identify a target gene by first performing mapping-using a distribution map with approximately 30,000 (density of one in approximately 100 kb) MS genetic polymorphism markers located throughout the genome so as to restrict the target gene candidate segment to 100 kb, and then performing SNP analysis.

In addition, to identify a target gene from a determined sequence, for example, an exon region that may possibly be expressed can be predicted using a computer program such as GRAIL (Uberbacher E. G. and Mural R. J. (1991) Proc. Natl. Acad. Sci. USA 88: 11261-5) and GENSCAN (Burge C. and Karlin S. (1997) J. Mol. Biol. 268: 78-94), or by performing a homology search of an expressed sequence tag (EST) database for a nucleotide sequence, in which repeating sequences are removed.

Based on these results, PCR primers and probes are prepared, and intracellularly expressed fragments are then identified by RT-PCR and Northern hybridization. Furthermore, once an expressed fragment is obtained, full-length cDNA can be obtained by 5' RACE, 3' RACE, and such. Alternatively, cDNA can be isolated through screening of cDNA libraries or CapSite libraries using a fragment of the gene as a probe, and such.

Through large scale sequence analysis of the human leukocyte antigen (HLA) gene locus, along with many genes, the present inventors have identified thus far microsatellites that can be used for mapping (Mizuki N. et al. (1997) Genomics, 42, 55-66; Shiina T. et al. (1998) Genomics, 47, 372-382; Shiina, T. et al. (1999) Immunol. Rev., 167, 193-199). Using the distribution map according to the present invention, the first screening in which gene mapping is performed throughout the genome can then provide the same results. Moreover, the gene mapping methods according to this invention can be applied by restricting this HLA region.

With this invention, the term "HLA region" refers to a 3.6 Mb segment from the centromeric HSET gene to the telomeric HLA-F gene. In addition to the causative gene(s) related to psoriasis described above, those relating to other diseases are expected to be present in the HLA region.

By implementing the gene mapping method according to this invention on the HLA region, it is possible to effectively map the causative genes for such diseases. Specifically, in addition to psoriasis and rheumatoid arthritis, examples of specific diseases for which causative genes are expected to be present in the HLA region include rheumatism, Behcet's disease, juvenile diabetes, Basedow disease, cardiomyopathy, diffuse panbronchiolitis, Buerger disease, Takayasu's disease, narcolepsy, sarcoidosis, Harada's disease, myasthenia gravis, multiple sclerosis, etc.

A causative gene for a disease specified using a mapping method according to this invention can be used for testing, preventing, and treating the disease. Genes relating to phenotypes other than diseases may also be used for tests such as genetic diagnosis and for gene therapy. Cloning identified genes can be performed by methods well known to those skilled in the art. For example, a cDNA library is made from cells in which such gene is expressed, and then prepared by performing hybridization using, as a probe, a gene fragment that is identified by mapping. The cDNA library may be prepared using, for example, the method described in the literature (Sambrook J. et al. (1989) Molecular Cloning, Cold Spring Harbor Laboratory Press), or commercially available cDNA libraries may be used instead. Alternatively, this preparation is made by: preparing RNA from cells in which the gene is expressed, synthesizing cDNA by a reverse transcriptase, synthesizing oligo-DNA based on the nucleotide sequence of the gene (or a fragment thereof), and amplifying the cDNA through PCR using the oligo-DNA as primers.

The nucleotide sequence of a full-length target gene is determined to find a translation region encoded thereby, and the amino acid sequence of the protein encoded by the gene can be obtained. Furthermore, the cDNA obtained may also be used as a probe for screening a genomic library to isolate genomic DNA.

The term "gene" encompasses both cDNA and genomic DNA. Genomic DNA typically includes exons, introns, a promoter, and enhancers of a gene. This term also includes alleles and variants.

Cloning a target gene can be carried out with the following exemplary procedure. mRNA is isolated from a cell, tissue, or organ in which the gene is expressed. Known methods can be used to isolate mRNA; for instance, total RNA can be prepared by guanidine ultracentrifugation (Chirgwin J. M. et al. Biochemistry (1979) 18, 5294-5299) or the AGPC method (Chomczynski P. and Sacchi N., Anal. Biochem. (1987) 162: 156-159), and mRNA can be purified from total RNA using mRNA Purification Kit (Pharmacia) and such. Alternatively, mRNA may be directly prepared using QuickPrep mRNA Purification Kit (Pharmacia).

The obtained mRNA may be used to synthesize cDNA using reverse transcriptase. cDNA may be synthesized using a kit such as AMV Reverse Transcriptase First-strand cDNA Synthesis Kit (Seikagaku Kogyo). Alternatively, cDNA may be synthesized and amplified using partial sequences of a target gene as primers according to the 5'-RACE method (Frohman M. A. et al., Proc. Natl. Acad. Sci. U.S.A. (1988) 85, 8998-9002; Belyavsky A. et al., Nucleic Acids Res. (1989) 17, 2919-2932) that utilizes 5Ampli FINDER RACE Kit (Clontech) and polymerase chain reaction (PCR). A target DNA fragment is prepared from the PCR products and linked to a vector DNA. The nucleotide sequence of the target DNA can be verified by well-known methods, such as dideoxynucleotide chain termination.

The isolated DNA, as described above, is inserted into a suitable vector. When *E. coli* is used as the host cell, the vector is not particularly limited as long as the vector has an "ori", which is for amplifying and mass-producing the vector in *E. coli* (e.g., JM109, DH5α, HB101, or XL1Blue), and such, and a marker gene for selecting the transformed *E. coli* (e.g., a drug-resistant gene selected by a drug (e.g., ampicillin, tetracycline, kanamycin, or chloramphenicol)). For example, M13-series vectors, pUC-series vectors, pBR322, pBluescript, pCR-Script and such can be used as the vector.

Apart from the vectors, pGEM-T, pDIRECT, pT7 and such can be also used for subcloning and excision of a cDNA as well. When a vector is used to produce a protein encoded by a gene, an expression vector is especially useful. For the purpose of expressing in *E. coli*, the expression vector should have the above characteristics such as being amplified in *E. coli*. Additionally, when *E. coli*, such as JM109, DH5α, HB 101, or XL1-Blue, is used as the host cell, the vector should have a promoter, for example, a lacZ promoter (Ward E. S. et al. (1989) Nature 341: 544-546; Ward E. S. (1992) FASEB J.6, 2422-2427), araB promoter (Better Metal (1988) Science 240, 1041-1043), or T7 promoter, that can efficiently promote the expression of a desired gene in *E. coli*. Other examples of the vectors include pGEX-5X-1 (Pharmacia), "QIAexpress system" (QIAGEN), pEGFP, and pET (for this vector, BL21, a strain expressing T7 RNA polymerase, is preferably used as the host).

Furthermore, the vector may also include a signal sequence directing the secretion of the polypeptide. For producing a protein into the periplasm of *E. coli*, the pelB signal sequence (Lei S. P. et al., J. Bacteriol. (1987) 169, 4379) may be used as the signal sequence for protein secretion. The calcium chloride method or electroporation may be used to introduce the vector into host cells. As vectors used to produce, for example, proteins, expression vectors derived from mammals (e.g., pcDNA3 (Invitrogen), pEF-BOS (Nucleic Acids Res. (1990) 18(17), p5322), pEF, pCDM8); insect cells (e.g., "BAC-TO-BAC Baculovirus Expression Systems" (GIBCO-BRL), pBacPAK8); plants (e.g., pMH1, pMH2); animal viruses (e.g., pHSV, pMV, pAdexLcw); retroviruses (e.g., pZIPneo); yeasts (e.g., "Pichia Expression Kit" (Invitrogen), pNV11, SP-Q1); and *Bacillus subtilis* (e.g., pPL608, pKTH50) may be employed besides *E. coli*.

In order to express in animal cells, such as CHO, COS, and NIH3T3 cells, the vector must have a promoter necessary for expression in such cells, e.g., SV40 promoter (Mulligan R. C. et al. (1979) Nature 277: 108-114), HMLV-LTR promoter, EF1α promoter (Mizushima S. and Nagata S. et al. (1990) Nucleic Acids Res. 18: 5322), CMV promoter, and the like. It is preferable that the vector additionally has a marker gene for selecting transformants (for example, a drug-resistant gene selected by a drug like neomycin, G418, or the like). Examples of vectors with such characteristics include pMAM, pDR2, pBK-RSV, pBK-CMV, pOPRSV, pOP13, and the like.

Furthermore, in order for a host vector system that aims to amplify the copy number in the cells, to obtain a cell strain capable of stable production, a method can be given amplifying the vector with methotrexate (MTX) by incorporating into CHO cells deficient in nucleic acid synthetic pathways, a vector (such as pCHOI) having a DHFR gene that compensates for the deficiency. Alternatively, in order to transiently express a gene, there is a method for transforming COS cells that have the gene for SV40 T antigen on the chromosome with a vector (such as pcD) having the SV40 replication origin. The replication origin may be one derived from a polyomavirus, adenovirus, bovine papilloma virus (BPV), or the like. Also, to amplify the gene copy number in the host cells, selection markers, such as the aminoglycoside transferase (APH) gene, thymidine kinase (TK) gene, *E. coli* xanthine-guanine phosphoribosyl transferase (Ecogpt) gene, and the dihydrofolate reductase (dhfr) gene may be included in the expression vector.

Alternatively, a gene can be expressed in animals by, for example, inserting the gene into an appropriate vector and introducing this vector into a living cell via the retroviral method, the liposome method, the cationic liposome method, the adenovirus method, or the like. Thus, it is possible to perform gene therapy for phenotypes of diseases caused by mutation or polymorphism of the gene, and such. The vectors used in these methods include, but are not limited to, adenovirus-vectors (e.g., pAdexlcw), retrovirus vectors (e.g., pZIPneo), and or the like. General techniques for gene manipulation, such as insertion of a DNA fragment into a vector, can be performed according to conventional methods (Sambrook J. et al. (1989) Molecular Cloning 2nd ed., 5.61-

5.63, Cold Spring Harbor Lab. press). Administration to living cells may be performed according to the ex vivo method or the in vivo method.

The host cell into which the vector is introduced is not particularly limited. For example, *E. coli*, various animal cells and such can be used. The host cell can be used, for example, as a production system to produce and express a protein. Protein production systems include in vitro and in vivo systems. Such production systems using eukaryotic cells or prokaryotic cells can be given as in vitro production systems.

Animal cells, plant cells, and fungi cells can be used as the host cell when using eukaryotic cells. Mammalian cells, for example, CHO, COS, 3T3, myeloma, BHK (baby hamster kidney), HeLa, Vero, amphibian cells e.g., *Xenopus oocytes* (Valle et al., Nature (1981) 291, 358-340), and insect cells (e.g. Sf9, Sf21, Tn5) are known as animal cells. Among CHO cells, dhfr-CHO (Urlaubb G. and Chasin L. A. (1980) Proc. Natl. Acad. Sci. USA 77: 4216-4220), which are CHO cells deficient in the DHFR gene, and CHO K-1 (Kao F. T. and Puck T. T. (1968) Proc. Natl. Acad. Sci. USA 60: 1275-1281), are particularly preferable. Among animal cells, CHO cells are particularly preferable for large scale expression.

A vector can be introduced into a host cell by, for example, the calcium phosphate method, the DEAE-dextran method, methods using cationic liposome DOTAP (Boehringer-Mannheim), electroporation, lipofection, or the like.

Plant cells originating from *Nicotiana tabacum* are known as protein producing systems and may be used as callus cultures. As fungal cells, yeast cells such as Saccharomyces, including *Saccharomyces cerevisiae*, or filamentous fungi such as Aspergillus, including *Aspergillus niger*, are known.

When utilizing prokaryotic cells, there is a production system using bacterial cells. Bacterial cells, for example, *E. coli* such as JM109, DH5α, HB101, as well as *Bacillus subtilis* are known.

The transformant cells produced using a recombinant DNAs are cultured in vitro to obtain a protein. Culturing can be performed according to known methods. DMEM, MEM, RPMI1640, or IMDM, or the like, may be used as a culture medium for animal cells with or without serum supplements such as fetal calf serum (FCS). It is preferable that the pH for incubation is approximately 6 to 8. Culturing is typically performed for about 15 to 200 hrs at about 30 to 40 degrees centigrade, and the culture medium may be replaced, aerated, or stirred if necessary.

Alternatively, in vivo protein production system includes, for example, a production system using animal or plant. A target DNA is introduced into an animal or a plant, so as to produce proteins in vivo therewithin, and then recovered. With this present invention, these animals and plants are included in the "host".

Animals to be used for the production system described above include mammals and insects. Goats, pigs, sheep, mice, and cattle can be used as mammals (Vicki Glaser, SPECTRUM Biotechnology Applications (1993)). Alternatively, the mammals may be transgenic animals. For instance, a desired DNA may be prepared as a fusion gene with a gene, such as goat β casein gene, that encodes a protein specifically produced into milk. DNA fragments including this fusion gene are injected into goat embryos, which are then introduced back to female goats. Desired proteins are recovered from milk produced by the transgenic goats (those born from the goats that had received the modified embryos) or from their offspring. To increase the amount of milk containing the proteins produced by transgenic goats, appropriate hormones may be administered (Ebert K. M. et al., Bio/Technology (1994) 12: 699-702).

Alternatively, insects, such as silkworm, may be used as the host. When using silkworms, baculoviruses, into which a DNA encoding a desired protein has been inserted, can be used to infect the silkworms, and the desired protein can be recovered from body fluids thereof (Susumu M. et al., Nature (1985) 315, 592-594).

As plant hosts, tobacco can be used, for example. When using tobacco, a DNA encoding a desired protein may be inserted into a plant expression vector, such as pMON 530, which is then introduced into bacteria, such as *Agrobacterium tumefaciens*. The bacteria are used to infect tobacco, such as *Nicotiana tabacum*, and the desired polypeptide is recovered from the leaves (Ma J. K. et al. (1994) Eur. J. Immunol. 24, 131-138).

A protein obtained as above can-be isolated from the interior or exterior of the host cell (culture medium and such), and purified to a substantially pure homogeneous protein. The method for protein isolation and purification is not limited to any specific method; in fact, any standard method may be used. For instance, column chromatography, filtration, ultrafiltration, salting out, solvent precipitation, solvent extraction, distillation, immunoprecipitation, SDS-polyacrylamide gel electrophoresis, isoelectric point electrophoresis, dialysis, and recrystallization may be appropriately selected and combined to isolate and purify the protein.

Chromatography, such as affinity chromatography, ion-exchange chromatography, hydrophobic chromatography, gel filtration chromatography, reverse phase chromatography, adsorption chromatography and such may be used (Strategies for Protein Purification and Characterization: A Laboratory Course Manual. Ed. Daniel R. Marshak et al., Cold Spring Harbor Laboratory Press (1996)). These chromatographies may be performed using liquid chromatographies, such as HPLC and FPLC. Highly purified proteins can be obtained by the above purification methods.

A protein may be optionally modified or partially deleted by treatment with an appropriate protein modifying enzyme before or after purification. For example, trypsin, chymotrypsin, lysylendopeptidase, protein kinase, glucosidase and such are used as protein-modifying enzymes.

Antibodies against a protein, which is encoded by a target gene, can be prepared by using proteins obtained as above. The antibodies may take any form, including monoclonal antibodies and polyclonal antibodies. Such form further includes antiserum obtained by immunizing animals such as rabbits with the protein, all classes of polyclonal and monoclonal antibodies, as well as human and humanized antibodies produced by genetic recombination.

A protein used as a sensitizing antigen to obtain antibodies may be derived from any animal species. However, it is preferably from a mammal, such as human, mouse, or rat, more preferably, from a human.

A full-length protein or a partial peptide thereof may be used as a sensitizing antigen with the present invention. A partial peptide may be, for example, an amino (N)-terminus or carboxy (C)-terminus fragment of the protein. Herein, an "antibody" is defined as an antibody that reacts with either the full-length or a fragment of the protein.

For preparing antibodies, a target gene or its fragment may be-inserted into a known expression vector used to transform a host cell as described herein. The desired protein or its fragment may be recovered from the exterior or interior of the host cell by any standard method, and may be used as the sensitizing antigen. Alternatively, cells expressing the protein or their lysates, or a chemically synthesized protein may be used as an antigen. Preferably, short peptides are used as antigens by appropriately binding to carrier proteins, such as keyhole limpet hemocyanin, bovine serum albumin, and ovalbumin.

Any mammal may be immunized with the sensitizing antigen. However, preferably, the compatibility with parental cells used for cell fusion is taken into account. In general, animals classified as Rodentia, Lagomorpha, or Primates are used.

Animals classified as Rodentia include, for example, mice, rats, and hamsters. Animals classified as Lagomorpha include, for example, rabbits. Animals classified as Primates include, for example, monkeys of Catarrhini (old world monkeys), such as *Macaca fascicularis*, rhesus monkeys, sacred baboons, or chimpanzees.

Methods for immunizing animals with sensitizing antigens are well known in the art. Intraperitoneal injection or subcutaneous injection of sensitizing antigens is used for mammals as a standard method. More specifically, the sensitizing antigen may be diluted and suspended with phosphate-buffered saline (PBS), physiological saline, etc. into an appropriate amount. If desired, the antigen suspension may be mixed with an appropriate amount of a standard adjuvant, such as Freund's complete adjuvant, made into an emulsion, and then administered to mammals. Preferably, this is followed by several administrations of the sensitizing antigen mixed with an appropriate amount of Freund's incomplete adjuvant every 4 to 21 days. An appropriate carrier may also be used when immunizing the sensitizing antigen. After the above immunization, the serum is examined for an increase in the amount of desired antibodies by a standard method.

Polyclonal antibodies may be prepared by collecting blood from the immunized mammal after confirming the increase in the levels of desired antibodies in the serum. The serum is separated from the blood by any conventional method. Serum containing a polyclonal antibody may be used as a polyclonal antibody, or if necessary, the fraction containing the polyclonal antibody may be isolated from the serum, and the isolated fraction can then be purified using a protein A or G column, thereby preparing immunoglobulin G or M.

To prepare monoclonal antibodies, immune cells are collected from a mammal immunized with an antigen and checked for an increase in the level of the desired antibodies in the serum as described above, and these cells are subjected to cell fusion. The immune cells used for cell fusion are preferably obtained from the spleen. The other parent cell fused with the above immune cell is preferably a mammalian myeloma cell, and more preferably, a myeloma cell that has acquired a special feature that can be used for selecting fusion cells by a drug.

The above immune cell and myeloma cell may be fused by basically any standard method, such as those described by Milstein et al. (Galfre G. and Milstein C., Methods Enzymol. (1981) 73, 3-46).

Resulting hybridomas obtained by cell fusion may be selected by cultivating in a standard selection medium, such as the HAT medium (medium containing hypoxanthine, aminopterin, and thymidine). The cell culture is typically continued in the HAT medium for a time period that is sufficient to allow all cells, except the desired hybridoma (non-fused cells), to die, usually from several days to several weeks. Then, standard limiting dilution is performed to screen and clone a hybridoma cell producing the desired antibody.

In addition to the above method for immunizing a nonhuman animal with an antigen for preparing a hybridoma, human lymphocytes, such as those infected by the EB virus, may be immunized with a protein, protein-expressing cells, or their lysates in vitro. The immunized lymphocytes are then fused with human-derived myeloma cells having indefinite division ability, such as U266, to yield a hybridoma producing a desired human antibody binding to a protein (Japanese Patent Application Laid-open No. Sho 63-17688).

Subsequently, the hybridomas thus obtained are transplanted into the abdominal cavity of a mouse from which the ascites is collected. The monoclonal antibodies thus obtained can be purified by, for example, ammonium sulfate precipitation or column chromatography using a protein A or protein G column, a DEAE ion exchange column, an affinity column to which a protein encoded by a target gene is coupled, and such. The prepared antibody can be used not only for purifying and detecting the protein encoded by the target gene, but also as a candidate for an agonist or antagonist of the protein. Such an antibody may also be considered to be used for antibody-therapy of diseases. To administer the obtained antibody to humans (namely, antibody therapy), human antibodies or humanized antibodies are preferred to reduce immunogenicity.

For example, transgenic animals having a repertory of human antibody genes may be immunized with a protein, protein-expressing cells, or their lysates as antigen. Antibody producing cells are collected from the animals, and fused with myeloma cells to obtain hybridoma, from which human antibodies against the protein can be prepared (see WO92-03918, WO93-2227, WO94-02602, WO94-25585, WO96-33735, and WO96-34096). Alternative to producing antibodies using hybridoma, an immune cell that produces antibodies, such as an immunized lymphocyte, which are immortalized by an oncogene, may be used for preparing antibodies.

The monoclonal antibodies obtained as such can also be recombinantly prepared using genetic engineering techniques (see, for example, Borrebaeck C. A. K. and Larrick J. W., Therapeutic Monoclonal Antibodies, published in the United Kingdom by MacMillan Publishers LTD, (1990)).

A recombinant antibody can be prepared by cloning a DNA encoding the antibody from an immune cell, such as a hybridoma or an immunized lymphocyte producing the antibody; inserting this into an appropriate vector; and introducing the vector into a host cell. The present invention encompasses this recombinant antibody.

According to the present invention, an antibody may be a fragment of an antibody or modified antibody, so long as it binds to a protein encoded by a target gene. For instance, the antibody fragment may be Fab, F(ab)$_2$, Fv, or single chain Fv (scFv) in which Fv fragments from H and L chains are linked by an appropriate linker (Huston J. S., et al.(1988) Proc. Natl. Acad. Sci. U.S.A. 85: 5879-5883). More specifically, treating an antibody with an enzyme, such as papain or pepsin, may generate an antibody fragment. Alternatively, a gene encoding the antibody fragment may be constructed, inserted into an expression vector, and expressed in an appropriate host cell (see, for example, Co M. S. et al., J. Immunol., (1994) 152: 2968-2976; Better M. and Horwitz A. H., Methods Enzymol., (1989) 178: 476-496; Pluckthum A. and Skerra A., Methods Enzymol., (1989) 178,497-515; Lamoyi E., Methods Enzymol., (1986) 121,652-663; Rousseaux J. et al., Methods Enzymol., (1986) 121, 663-669; Bird R. E. and Walker B. W., Trends Biotechnol. (1991) 9, 132-137).

An antibody may be modified by conjugation with a variety of molecules, including polyethylene glycol (PEG). "Antibodies" of the present invention include such modified antibodies. Such modified antibody can be obtained by chemically modifying an antibody. These modification methods are conventional in the field.

Alternatively, according to the present invention, an antibody may be obtained as a chimeric antibody, comprising a variable region derived from a nonhuman antibody, and the constant region derived from a human antibody, or as a humanized antibody, including the complementarity determining region (CDR) derived from a nonhuman antibody, the framework region (FR) derived from a human antibody, and the constant region, by well-known methods.

Antibodies thus-obtained may be purified to homogeneity. Any standard protein separation and purification method may be used for antibody separation and purification according to the present invention. For example, column chromatographies, such as affinity chromatography; filtration; ultrafiltration; salting out; dialysis; SDS polyacrylamide gel electrophoresis; isoelectric point electrophoresis may be appropriately selected and combined to isolate and purify the antibody (Antibodies: A Laboratory Manual. Ed Harlow and David Lane, Cold Spring Harbor Laboratory (1988)). However, the methods are not limited thereto. The concentration of the obtained antibody may be determined by measuring absorbance, by enzyme-linked immunosorbent assay (ELISA), or the like.

Columns used for affinity chromatography include protein A columns and protein G columns. For example, Hyper D, POROS, and Sepharose F. F. (Pharmacia) may be given as columns using protein A columns. Chromatography other than affinity chromatography includes ion-exchange chromatography, hydrophobic chromatography, gel filtration chromatography, reverse phase chromatography, adsorption chromatography, and such (Strategies for Protein Purification and Characterization: A Laboratory Course Manual. Ed. Daniel R. Marshak et al., Cold Spring Harbor Laboratory Press (1996)). These chromatographies can be conducted using liquid chromatographies, such as HPLC and FPLC.

For example, measurements of absorbance, enzyme-linked immunosorbent assay (ELISA), enzyme immunoassay (EIA), radioimmunoassay (RIA), or immunofluorescence may be used to measure the antigen binding activity of an antibody. In the case of using ELISA, a target protein is applied to a solid state antibody plate, and then a sample containing a desired antibody, such as culture supernatant of antibody producing cells or a purified antibody, is applied. Then, a secondary antibody, which recognizes the primary antibody labeled with an enzyme, such as alkaline phosphatase, is applied. The plate is then incubated. After washing, an enzyme substrate, like p-nitrophenyl phosphate, is added to the plate and absorbance is measured to evaluate the antigen binding activity of the sample. A fragment of a protein, such as a C-terminus fragment or a N-terminus fragment, may be used as the protein. BIAcore (Pharmacia) may be used to evaluate the activity of an antibody.

The above methods allow the detection or measurement of a protein encoded by a target gene, by exposing an antibody to a sample assumed to contain the protein encoded by the target gene in the sample, and detecting or measuring the immune complex formed by the antibody and the protein. Because the measurement method can specifically detect or measure a protein encoded by a gene, the method may be useful in a variety of experiments, tests, diagnoses, and such, in which the protein is used.

The present invention also provides polynucleotides comprising at least 15 nucleotides that are complementary to one strand of a double strand of a target gene or to the complementary strand thereof.

The term "complementary strand" as used herein refers to one strand of a double strand DNA comprising A:T (or A:U for RNA) and G:C base pairs when viewed against the other strand. Furthermore, "complementary" encompasses not only a nucleotide sequence completely complementary to a continuous nucleotide region with at least 15 nucleotides but also a homology of at least 70%, preferably at least 80%, more preferably 90%, and most preferably 95% or more at the nucleotide sequence level. Homology of proteins can be determined using the algorithm described in the literature (Wilbur W. J. and Lipman D. J., Proc. Natl. Acad. Sci. USA, (1983) 80: 726-730).

Such nucleic acids include probes and primers used for the detection and amplification of a target gene; probes and primers for detecting the expression of the gene; and nucleotides and nucleotide derivatives (for example, antisense oligonucleotides, ribozymes, or DNAs encoding them) used for suppressing the expression of the gene. Herein, the detection of a gene also includes the detection of gene mutation. Furthermore, such nucleic acids can be used in the preparation of DNA chips.

If the above polynucleotide is used as a primer, the 3'-region thereof may be the complementary site, and restriction enzyme recognition sites, tag sequences, and such may be attached to the 5'-region. Antisense oligonucleotides include, for example, antisense oligonucleotides that hybridize with any portion of the protein coding region. The antisense oligonucleotide is preferably an antisense of a continuous sequence comprising at least 15 nucleotides or more within the protein coding region. More preferably, the above continuous sequence comprising at least 15 nucleotides or more contains a translation initiation codon.

A derivative or modified form of an antisense oligonucleotide may also be used. The latter form may be prepared by modifying an antisense oligonucleotide with lower alkylphosphonates, such as, methylphosphonate or ethylphosphonate, or with phosphorothioate, or phosphoroamidate.

The antisense oligonucleotide is not restricted to one in which all nucleotides are complementary to the corresponding nucleotides within a given region of a DNA or mRNA. So long as an oligonucleotide can specifically hybridize with a DNA or mRNA encoding a target gene, it may have one or more nucleotide mismatches.

A derivative of an antisense oligonucleotide according to the present invention may act on cells producing a protein encoded by a target gene and bind to a DNA or mRNA encoding the protein. It then may inhibit the expression of the protein by inhibiting its transcription or translation, or by promoting the degradation of mRNA, and thereby inhibiting the function of the protein.

A derivative of an antisense oligonucleotide of the present invention may be mixed with an appropriate base that is inactive against the derivative, and used as a medicine for external application, such as a liniment or poultice. If necessary, it may be mixed with excipients, isotonizing agents, solubilizing agents, stabilizers, preservatives, pain-killers, or such to be prepared as a tablet, powder, granule, capsule, liposome capsule, injectable solution, liquid formulation, nose drops, freeze-dried agent, or such. The above may be prepared according to standard methods.

For treating patients, a derivative of an antisense oligonucleotide according to the present invention may be directly applied to the affected area of a patient, or administered into blood vessels so as to finally reach the affected area. Moreover, the derivative may be encapsulated in antisense-encapsulating materials, such as liposomes, poly-L-lysine, lipid, cholesterol, lipofectin, or their derivatives in order to increase durability and/or membrane permeability.

The dose of a derivative of the antisense oligonucleotides according to the present invention may be appropriately adjusted depending on the patient's conditions, and a preferable amount in the range of, for example, 0.1 to 100 mg/kg, preferably 0.1 to 50 mg/kg, may be administered.

Since the antisense oligonucleotides of the present invention inhibit the expression of a protein encoded by a target gene, they are useful as an inhibitor of the biological activity of the protein. An expression inhibitor containing an antisense oligonucleotide according to the present invention is useful due to its ability to inhibit the biological activity of the protein, and is further useful not only for medicinal application but as a functional analysis tool for the gene.

Test of mutation or expression of a target gene or a protein can be performed using an antibody against the protein encoded by the target gene, or a polynucleotide containing at least 15 nucleotides complementary to one of the chains of the gene or to the complementary strand thereof. When the target gene is related t® a disease, testing of the disease can be performed using the antibody or the polynucleotide. The test of a disease according to the present invention includes not only tests of patients expressing symptoms of the disease associated with the mutation of a pathogenic gene, but also tests of the expression level of the pathogenic gene and tests of the mutation of the gene performed to determine whether or not the subject is prone to have the disease due to abnormality in the expression level of the pathogenic gene or due to mutation of the gene. That is, the danger of having the disease is considered to be greatly increased due to abnormalities in the expression of the pathogenic gene and occurrence of mutation in one of the alleles of the pathogenic gene, even when no symptom has risen to the surface. Furthermore, phenotypes other than diseases that have genetic factors can be, for example, tested for the presence or absence of their causative genes, or for the mutation or expression of those genes.

Methods for testing diseases and such using antibodies includes, for example, a method including the step of detecting a protein encoded by a causative gene in a test sample. Specifically, the method for testing with antibodies against proteins encoded by causative genes includes the steps of: (a) making the above-mentioned antibody have contact with a test sample; and (b) detecting binding of the antibody to the test sample; Detection of proteins can be performed by immunoprecipitation using antibodies, Western blotting, immunohistochemisty, ELISA, and such.

For the testing according to the present invention, polynucleotides (probe and primers) complementary to a nucleotide sequence of a transcript or cDNA of a gene and a nucleotide sequence of a genomic DNA sequence (including endogenous transcription regulatory sequence) or to their complementary strands may be used. Incidentally, testing mutation includes a test that specifies "carriers", i.e., those having mutation in one of the alleles.

When used as a primer, polynucleotides are normally 15 to 100 bp, and preferably 17 to 30 bp. There are no limitations on the primer so long as it can amplify at least a portion of a target gene region or a region that regulates its expression. Examples of such regions include, for example, exons, introns, promoters, and enhancer regions of the gene.

On the other hand, as a probe, the polynucleotide normally has a strand length of at least 15 bp or longer if it is a synthetic polynucleotide. Double-stranded DNA obtained from a clone that has been inserted into a vector such as plasmid DNA may also be used as a probe. There are no limitations on the probe so long as it is complementary to the nucleotide sequence of at least a portion of a gene or the region regulating its expression, or to its complementary strand.

The regions to which the probe may hybridize includes, for example, the exon, intron, promoter, and enhancer regions of a gene. When used as probes, the polynucleotide or the double stranded DNA are labeled appropriately, and then used. The labeling methods are, for example, phosphorylating the 5'-terminus of polynucleotide with $^{32}$P using T4 polynucleotide kinase, or incorporating a substrate nucleotide labeled with biotin, fluorescent moiety, isotopes such as. $^{32}$P, and such, and using a random hexamer oligonucleotide as a primer and DNA polymerase such as Klenow enzyme (random priming method).

An example of a testing method that utilizes an antibody against a protein encoding a target gene or a polynucleotide containing at least 15 nucleotides complementary to one of the strands of the gene or to its complementary strand, includes a method that includes the step of detecting a transcript of the target gene within a test sample. Such a test method includes methods including the steps of: (a) making the above-mentioned polynucleotide have contact with a test sample, and (b) detecting binding of the polynucleotide to an mRNA in the test sample. Such tests can be performed, for example, by Northern hybridization or RT-PCR.

A test that uses RT-PCR specifically includes (a) synthesizing cDNA from an mRNA in a test sample, (b) performing a polymerase chain reaction using the synthesized cDNA as a template and the polynucleotide of the present invention as a primer, and (c) detecting the DNA amplified by the polymerase chain reaction. Northern hybridization and RT-PCR can be performed by well-known genetic engineering techniques. Also, detection using a DNA chip or a DNA microarray is possible.

In addition, test of diseases and such may be performed by detecting mutations or polymorphisms in target genes. Specifically, such tests can be performed by detecting mutations or polymorphisms in the transcription regulatory region or encoding region of a target gene.

According to an embodiment of such testing methods, the nucleotide sequence of a target gene from a subject is directly determined. For example, a portion or all of a target gene from a subject (for example, regions including exons, introns, promoter, and enhancer) may be amplified by PCR (Polymerase Chain Reaction) and such, using the above-mentioned nucleotide as a primer, DNA isolated from a subject as a template, and the nucleotide sequence thereof may be determined. Then, the determined sequence may be compared to the sequence of a gene derived from a control subject (e.g., healthy person, etc.) to accomplish the test.

As a method for testing according to the present invention, various methods are used in addition to the method for directly determining the nucleotide sequence of DNA derived from the subject. An embodiment of the test methods includes the steps of: (a) preparing a DNA sample from a subject, (b) amplifying the subject-derived DNA using the polynucleotide of this invention as a primer, (c) dissociating the amplified DNA into single-stranded DNA, (d) separating the dissociated single stranded DNA on a non-denaturing gel, and (e) comparing the mobility of the separated single-stranded DNA on the gel with that of a control subject.

An example of such methods is a single-strand conformation polymorphism (PCR SSCP) method (Cloning and polymerase chain reaction-single-strand conformation polymorphism analysis of anonymous Alu repeats on chromosome 11. (1992 Jan 1) Genomics 12(1): 139-146; Detection of p53 gene mutations in human brain tumors by single-strand conformation polymorphism analysis of polymerase chain reaction products. (1991 Aug 1) Oncogene 6(8): 1313-1318; Multiple fluorescence-based PCR-SSCP analysis with postlabeling. (1995 Apr. 1) PCR Methods Appl. 4(5): 275-282).

This method is relatively simple and has the advantage of requiring the smallest amount of sample. Therefore, it is especially preferable when screening many DNA samples. Its principles are as follows. When a double-stranded DNA fragment is dissociated into single strands, each strand forms an independent higher-order structure according to its nucleotide sequence. When this dissociated DNA strand is electrophoresed on a polyacrylamide gel that does not contain a denaturant, depending on the difference in each higher-order structure, complementary single-stranded DNA having the same length of nucleotides move to different positions. The higher-order structure of such single-stranded DNA changes even with replacement of a single nucleotide, and indicates different mobility in the polyacrylamide gel electrophoresis: Therefore, by detecting this change in mobility, existence of mutation in the DNA fragment, such as point mutation, deletion, or insertion, can be detected.

Specifically, to begin with, a whole target gene, or a portion of it, is amplified by PCR and such. Normally, the amplified range preferably has a length of approximately 200 to 400 bp. The amplified region includes all exons and all introns of the gene and also, promoter and enhancers of the gene. During gene fragment amplification by PCR, synthesized DNA fragments are labeled by performing PCR using a primer labeled with isotopes, such as $^{32}P$ or with fluorescent pigments, biotin, and such, or by adding a substrate nucleotide labeled with isotopes such as $^{32}P$, or with fluorescent pigments, biotin, and such into the PCR reactive solution. Otherwise, labeling can be performed by adding a substrate nucleotide labeled with isotopes, such as $^{32}P$, or with fluorescent pigments, biotin, and such to a synthesized DNA fragment using Klenow enzyme and such, after PCR.

The labeled DNA fragment obtained as such is denatured by heating and such, and electrophoresis is performed using a polyacrylamide gel that does not contain denaturants such as urea. Here the conditions for DNA fragment separation can be improved by adding an appropriate amount (approximately 5% to 10%) of glycerol to the polyacrylamide gel. Electrophoretic conditions change with properties of each DNA fragment, but normally, it is performed at room temperature (20° C. to 25° C.). When a favorable separation cannot be achieved, the temperature that gives the most appropriate mobility is tested to be between 4° C. to 30° C.

After electrophoresis, mobility of the DNA fragment is detected by autoradiography using an X-ray film, a scanner detecting fluorescence and such, and then analyzed. When a band having a difference in mobility is detected, this band is directly cut out from the gel and then re-amplified by PCR, and by direct sequencing, the existence of mutation can be confirmed. Also, even when labeled DNA is not used, by staining the gel after electrophoresis with ethidium bromide or by silver staining and such, bands can be detected.

Another embodiment of the testing method of this invention includes the steps of: (a) preparing a DNA sample from a subject, (b) amplifying the subject-derived DNA using a polynucleotide of this invention as a primer, (c) cleaving the amplified DNA, (d) separating the DNA fragments according to their size, (e) hybridizing the detectably labeled polynucleotide of this invention as a probe to the separated DNA fragment, and (f) comparing the size of the detected DNA fragment with that of a control subject.

Examples of such methods include methods using restriction fragment length polymorphism (RFLP), PCR-RFLP, and such. Normally, restriction enzymes are used as enzymes to cleave DNA. Specifically, when mutation or polymorphism exists at the restriction enzyme recognition site, or when there is a nucleotide insertion or deletion in the DNA fragment formed by restriction enzyme treatment, the size of the fragment formed after restriction enzyme treatment changes compared to that of a control (healthy subject). Amplifying this portion containing the mutation or polymorphism by PCR, and then treating with each restriction enzyme enables the detection of these mutations or polymorphisms as differences in band mobility after electrophoresis. Otherwise, chromosomal DNA is treated with these restriction enzymes, and after electrophoresis, by performing Southern blotting using the polynucleotide described above as: a probe, the presence or absence of mutation or polymorphism can be detected.

The restriction enzyme to be used can be appropriately selected depending on each region to be tested. In this method, in addition to genomic DNA, RNA prepared from a subject may be made into cDNA by reverse transcriptase, and after cleaving it in its original form by a restriction enzyme, Southern blotting can be performed. Also, using this cDNA as a template, a portion of or a whole target gene can be amplified by PCR, and after cleaving it with restriction enzyme, their difference in mobility can be investigated.

Furthermore, instead of using DNA prepared from a subject, a similar detection is possible using RNA as well. Such a method includes the steps of: (a) preparing an RNA sample from a subject, (b) separating the prepared RNA according to size, (c) hybridizing the polynucleotide of this invention, that has a detectable label as a probe, to the separated RNA, and (d) comparing the size of the detected RNA with that of a control. An example of a specific method includes electrophoresing RNA prepared from a subject, performing Northern blotting using the polynucleotide described above as a probe, and detecting differences of mobility.

An embodiment of the test methods includes the steps of: (a) preparing a DNA sample from a subject, (b) amplifying the subject-derived DNA using the polynucleotide of this invention as a primer, (c) dissociating the amplified DNA on a gel having a gradually-increased concentration of a DNA denaturant, and (d) comparing the mobility of the dissociated DNA on the gel with that of a control subject.

An example of such a method is denaturant gradient gel electrophoresis (DGGE). The whole target gene, or a portion thereof, is amplified by PCR using the primer as described above, and such. This is then electrophoresed on a polyacrylamide gel in which the concentration of a denaturant such as urea gradually becomes higher in the gel as the material moves, and this is compared to that of a control subject (such as a healthy subject). For a DNA fragment in which mutation exists, the DNA fragment becomes single stranded at a position of lower denaturant concentration, and the rate of movement becomes extremely slow. Therefore, by detecting this difference in mobility, the presence or absence of mutation of polymorphism can be detected.

Apart from these methods, for the purpose of detecting mutations only at a particular position, allele specific oligonucleotide (ASO) hybridization can be used. An oligonucleotide containing a sequence in which a mutation is thought to exist is prepared, and when this is hybridized with sample DNA, if mutation exists, the efficiency of hybrid formation decreases. This can be detected by Southern blotting or by a method that utilizes the property of quenching by intercalation of a specialized fluorescent reagent into a gap in the hybrid, or such a method.

Also, detection by a ribonuclease. A mismatch cleavage method is possible. Specifically, a whole target gene, or a portion thereof, is amplified by PCR and such, and the product is hybridized with labeled RNA prepared from a target gene fragment and such inserted in a plasmid vector, and such. In the portion in which mutation exists, the hybrid takes a single-stranded structure, therefore, this portion is cleaved by ribonuclease A, and by detecting this with autoradiography, and such, existence of mutation can be detected.

Computer-Related Embodiments

In another aspect, the invention provides a distribution map of one or more human genomic regions, which regions can include an entire chromosome, and in particular 2 or more, 5 or more, 10 or more chromosomes of the human genome. In one embodiment, the entire human genome is mapped with microsatellite markers, including 23 single chromosomes (i.e., 22 autosome and an X or Y sex chromosomes). The microsatellite genetic polymorphism markers are located on the human genome map in intervals of at least about 50 to 150 Kb, usually at least about 80 to 120 Kb, more usually at least about 90 to 110 Kb.

The map can include, for example, the position of the markers provided in the Sequence Listing as SEQ ID NOS: 1-27,088. The map can additionally including sequence information for SEQ ID NOS:1-27088, as well as information for design and production of primer pairs (forward and reverse) for use in amplifying the markers.

The distribution map can provide not only the location of the polymorphic markers, but can also be modified to include, either by the manufacturer or by the user performing the marker analysis, the frequency of the markers in a sample from a test subject compared to a control subject, where the test subject has a characteristic of interest (e.g., a condition, disease, and the like). The map can also provide information about the genomic regions throughout which the markers are positioned.

The map thus represents a collection of information, which can be provided in an electronic, machine-readable form (e.g., stored in a computer-readable form, as in a computer system and/or as part of a computer program). The distribution map and sequence information can be used in a variety of ways as exemplified herein, e.g., as a resource for gene discovery, as markers of a given disease or disease state, and the like.

The distribution map and corresponding nucleotide sequence information can be embodied in electronic form comprises, e.g., as an accessible computer data on a machine-readable media. "Media" refers to a manufacture, that contains the distribution map, which can include corresponding sequence information, as described herein, which can be read and accessed by a computer. Such media include, but are not limited to: magnetic storage media, such as a floppy disc, a hard disc storage medium, and a magnetic tape; optical storage media such as CD-ROM; electrical storage media such as RAM and ROM; and hybrids of these categories such as magnetic/optical storage media. One of skill in the art can readily appreciate how any of the presently known computer readable mediums can be used to create a manufacture comprising a recording of the present sequence information.

"Recorded" refers to a process for storing information on computer readable medium, using any such methods as known in the art. Any convenient data storage structure can be chosen, based on the means used to access the stored information. A variety of data processor programs and formats can be used for storage, e.g. word processing text file, database format, etc. The distribution map and sequence information can be provided in conjunction or connection with other computer-readable information and/or other types of computer-readable files (e.g., searchable files, executable files, etc, including, but not limited to, for example, search program software, etc.).

By providing the distribution map and sequences in computer readable form, the information can be accessed for a variety of purposes. Computer software to access sequence information is publicly available. For example, the gapped BLAST (Altschul et al. *Nucleic Acids Res.* (1997) 25:3389-3402) and BLAZE (Brutlag et al. *Comp. Chem.* (1993) 17:203) search algorithms on a Sybase system can be used to identify open reading frames (ORFs) within the genome that contain homology to ORFs from other organisms.

As used herein, "a computer-based system" refers to the hardware means, software means, and data storage means used to analyze the nucleotide sequence information of the present invention. The minimum hardware of the computer-based systems of the present invention comprises a central processing unit (CPU), input means, output means, and data storage means. A skilled artisan can readily appreciate that any one of the currently available computer-based system are suitable for use in the present invention. The data storage means can comprise any manufacture comprising a recording of the present sequence information as described above, or a memory access means that can access such a manufacture.

A variety of structural formats for the input and output means can be used to input and output the information in the computer-based systems of the present invention. One format for an output means ranks the relative expression levels of different polynucleotides. Such presentation provides a skilled artisan with a ranking of relative frequencies of markers in a sample to facilitate analysis and identification of regions associated with a condition of the test subjects.

The distribution map, which can include the sequences of the markers, can be stored on the machine-readable medium in connection with an executable program to facilitate its display and analysis. The distribution map can be used to select polymorphic markers suitable for analysis of a desired region. Such markers can include any combination of at least 50, 100, 500, 1,000, 2,500, 5,000, 10,000, or more of the makers of SEQ ID NOS: 1-27,088.

The computer-readable medium carrying the microsatellite polymorphic marker distribution map also carries one or more sequences of instructions from a user of a computer system for performing, over a desired human genomic region, analysis, searches, and displaying results of searches or analysis, of information regarding the markers within the desired genomic region. Analysis can include, for example, analysis of frequency data for said markers with respect to a characteristic of interest for a human population of interest. The frequency data can be provided by the manufacturer on the medium, or can be input and stored by the user, e.g., as in during the course of marker analysis.

The medium contains information regarding the position of microsatellite polymorphic markers over one or more regions of the human genome, e.g, the position of the markers within a chromosomal region, more usually over one or more regions on 2 or more, 5 or more, 10 or more chromosomes of the human genome. In one embodiment, the entire human genome is mapped with microsatellite markers, including 23 single chromosomes (i.e., 22 autosome and an X or Y sex chromosomes). The microsatellite genetic polymorphism markers are located on the human genome map in intervals of at least about 50 to 150 Kb, usually at least about 80 to 120 Kb, more usually at least about 90 to 110 Kb, said markers usually being positioned at intervals of from about 50 Kb to 150 Kb. The map and thus the computer-readable medium can also include carries sequence information for the markers, where the markers can be any combination of SEQ ID NOS:1-27808.

The medium additionally carries one or more sequences of instructions for execution, at the direction of the user, by one or more processors so as to cause the one or more processor to perform a method. The method can involve, for example receiving a query inputted by the user and receiving instructions as to microsatellite markers and/or a human genomic region to include in analysis; accessing distribution map information stored on the medium; displaying on a display means (e.g., a monitor or screen) a map showing the position of markers on a human genomic region, where the map provides at least the selected markers or markers within the selected region.

Kits

Also provided are reagents and kits thereof for practicing one or more of the above-described methods. The subject reagents and kits thereof may vary greatly. Typically, the kits at least include one or more primer pairs, normally 20 or more, 50 or more 500 or more, 1,000 or more primer pairs, where the primer pairs re forward and reverse primers as described above for amplification of a combination of polymorphic markers of SEQ ID NOS:1-27088 or for amplification of a region associated with psoriasis vulgaris. The primers can be appropriately detectably labeled to facilitate analysis. The subject kits may also include one or more additional reagents, e.g., reagents employed in detecting the detectable label.

In addition to the above components, the subject kits can further include instructions for practicing the subject methods. These instructions may be present in the subject kits in a variety of forms, one or more of which may be present in the kit. One form in which these instructions may be present is as printed information on a suitable medium or substrate, e.g., a piece or pieces of paper on which the information is printed, in the packaging of the kit, in a package insert, etc. Yet another means would be a computer readable medium, e.g., diskette, CD, etc., on which the information has been recorded. The computer-readable format can also include the distribution map as described above. Yet another means that may be present is a website address which may be used via the internet to access the information at a removed site. Any convenient means may be present in the kits.

EXAMPLES

Example 1

(1) Sampling of DNA Samples

Genetic analysis was performed using blood samples of patients suffering from each disease and healthy subjects, which are controls, collecting blood of 10 to 20 ml from 464 Japanese healthy subjects who have agreed to participate in the study, 306 patients with rheumatoid arthritis, and 118 patients with psoriasis vulgaris is carried out, and DNA samples are then collected.

It is noted that this study was made upon examination and approval by the Japan Biological Information Consortium Committee for Ethical Examination, Tokai University Research of Human Genome and Genetic Analysis Committee for Ethical. Examination, University of Tokyo Graduate School of Medicine and Faculty of Medicine, Research Committee for Ethical Examination, Juntendo University Faculty of Medicine Research Ethical Committee.

(2) Preparation of DNA Samples

Preparation of DNA samples was carried out in conformity with the following procedure. Extraction and purification of the genome DNA from the collected blood is carried out using QIAamp DNA Blood Maxi Kit (QIAGEN). Considering a possible influence to amplification efficiency for PCR, T. E. (10 mM Tris-HCl, 0.1 mM EDTA), which is one tenth the normal EDTA concentration, is used to extract the genome DNA from columns. Once extraction is accomplished, agarose gel electrophorsis is carried out so as to determine that decomposition of DNA does not occur, and also to find the purity based on the measured absorbance or 260/280 ratio.

Measurement of DNA and preparation of mixed DNA (pooled DNA) solution are carried out in conformity with the following procedure. A fluorescence plate reader and the fluorescent pigment PicoGreen reagent (Molecular Probes), which stains a double strand DNA specifically, are used to measure DNA. $\lambda$ phage DNA attached to the PicoGreen reagent is used as standard samples to be used for concentration measurement, which include five-point dilution sequences of 10, 30, 100, 300, and 1000 pg/mL. The genome DNA of each individual is diluted into 1/400, and measurements are then carried out three times for the respective sequences. From the results of the three-time measurements, a total of three combinations of two were made, and average values, S.Ds. and C.Vs. are calculated for the respective combinations. The combination with a C.V. of 5% or less and being the lowest value is selected, and the corresponding average is then used as the final DNA concentration. If the respective C.Vs. for all of the three combinations exceeds 5%, measurement of the DNA is carried out repeatedly until a combination with 5% or less is found.

Based on the DNA concentration determined by such operation and measurement, fixed DNA amounts from DNA samples of 125 subjects were mixed together, and T.E. (10 mM Tris-HCl, 0.1 mM EDTA) is added thereto to obtain an 8 ng/µL pooled sample. To perform the first and the second screening, two sets of such pooled DNA sample for the 125 subjects were prepared for each patient group and healthy subject group. It is noted that the sex ratio for the 125 subjects in each set is selected so that it can be equal between the pooled DNA samples for each patient group and those for the healthy subject group, and the age distribution is selected so that it can also be almost equal between them in the 10-year-old class.

(3) Preparation of DNA Sequence Fragment Group Including Microsatellite Genetic Polymorphism Markers (Pooled DNA Genotyping)

A set of a forward primer and reverse primer each having 15 to 100 nucleotides, preferably 15 to 25 nucleotides, more preferably 18 to 22 nucleotides, which are obtained from the DNA sequence made up of the nucleotide sequences of SEQ ID NOS: 1 to 27088, was used to amplify a DNA sequence fragment groups including microsatellite genetic polymorphism markers. The forward primer with its 5'-terminus fluorescently labeled with 6-FAM or HEX(PE Biosystems, Foster City, Calif.) was used whereas the reverse primer is not labeled.

Preparation of a reactive solution for PCR is performed in conformity with the following procedure. The preparation was made such that a 24 ng pooled DNA sample (i.e., 3 µL×8 ng/µL), 2 µL/10× buffer (100 mM Tris-HCl, pH 8.3, 500 mM KCl, and 15 mM MgCl2), 2 pmol forward primer and reverse primer, and 0.5 U AmpliTaq DNA polymerase (Applied Biosystems) were included in a 20 µL reactive solution. The PCR cycle includes: one cycle consisting of processing carried out for 5 minutes at 96° C., 1 minute at 56° C., and 1 minute at 72° C., and 40 cycles consisting of processing carried out for 45 minutes at 96° C., 45 seconds at 57° C. and 45 seconds at 72° C.

The PCR products obtained were diluted with ultra pure water into 1/20 or 1/40, dried by a vacuum pump or an evaporator, and then dissolved in a buffer containing formamide (Applied Biosystems) and DNA size marker GS500 ROX (Applied Biosystems). Afterwards, they were heat-treated for 5 minutes, and then electrophoresed by DNA analyzer ABI 3700 followed by being subjected to determining, using the GeneScan analysis software (Applied Biosystems), the size of each fluorescence signal peak derived from the PCR products. After this operation, each peak size and height were measured using the PickPeak software so as to make data for analysis.

(4) Statistical Calculation

For each MS genetic polymorphism marker whose DNA sequence-was included, comparison of the estimated allele frequencies obtained from the pooled DNA samples for a patient group and pooled DNA samples for a healthy subject group was performed using statistical processing based on the chi-square test and the Fisher test so as to make a genetic correlation analysis. This analysis was performed as follows.

The total of the heights of fluorescence signal peaks derived from the detected PCR products was calculated for each gene locus (MS genetic polymorphism marker). With this as the denominator, the ratio of each allele peak height was calculated to be the gene frequency for each allele within a group. In the statistical processing, an allele number for each allele within a group was found by multiplying the total allele number for the sample included in the pooled DNA sample, and using this allele number, a test regarding the difference among the allele frequencies of the healthy subject group and the patient group is carried out.

Moreover, for genetic correlation analysis using pooled DNA samples based on the above-described method, 2×2 and 2×m divided tables were made to calculate statistic values through the chi-square test and the Fisher test. These results allow optimization of the genetic correlation analysis using pooled DNA samples. Methods for performing a quick analysis are thus studied and corresponding software is developed.

Example 2

Specification of Susceptibility Gene for Psoriasis Vulgaris

Using the method described in Embodiment 1, genome correlation analysis of the susceptibility gene for psoriasis vulgaris is carried out. This screening allows identification of the gene locus extending from the centromeric MICB gene of the sixth chromosome to the telomeric HLA-F gene, and identification of 758 microsatellite loci having 2- to 5-nucleotide repeats existing within the 1.8 Mb HLA class I region including the HLA-B and the HLA-C gene. This fact corresponds to conventional reports (Mizuki N. et al. (1997) Genomics, 42, 55-66; Shiina T. et al. (1998) Genomics, 47, 372-382; Shiina T. et al. (1999) Immunol Rev., 167, 193-199; Tamiya G. et al. (1998) Tissue Antigens, 51, 337-346).

Among these microsatellites, 70 were analyzed for their polymorphism content in the Japanese population. Of these, 38 are found to be highly informative with an average of 66% heterozygosity and an average of 8.9 alleles (Tamiya G. et al. (1998) Tissue Antigens, 51, 337-346; Tamiya G. et al. (1999) Tissue Antigens, 54: 221-228). These 38 microsatellite repeats are selected for high resolution mapping.

Combined with the seven previously known polymorphic genes and microsatellites [MICB, MICA, HLA-B, HLA-C, HLA-A, MIB (Grimaldi M. C. et al. (1996) Hum. Immunol., 51, 89-94), and D6S265 (Weissenbach J. et al. (1992) Nature, 29, 794-801)], a total of 45 informative genetic markers, i.e. one every 41.1 kb, were defined within the HLA class I region. It is considered that this high density polymorphism marker allows acquisition of exact information regarding the haplotype analysis and mapping analysis of psoriasis vulgaris HLA class I related diseases.

Example 3

Specification of Susceptibility Gene for Psoriasis Vulgaris (2)

Next, to determine the definite position of the causative gene for psoriasis vulgaris within the HLA class I region, association analyses are conducted using 11 of these 38 repeats.

These eleven microsatellites are selected so that they can be distributed around the HLA-C gene locus of the sixth chromosome at the rate of one in 100 kb.

Correlation analysis targets the psoriasis vulgaris patient group and the healthy subject group described in Example 1. The patient group consists of 51 males and 25 females with an average onset age of 33 years (SD=15.3).

To determine the number of repeat units of the eleven genetic polymorphism microsatellite loci (genotype of microsatellite allele), the reverse primer and forward primer with 20 to 28 nucleotides are synthesized from the MS genetic polymorphism marker included DNA sequence. It is noted that this synthesizing uses the fluorescent reagent 6-FAM, HEX, or TET (PE Biosystems (presently Applied Biosystems), Foster City, Calif.) so as to label the 5'-terminus of the forward primer. Table 1 shows eleven sets of the primers, i.e., twenty-two in all.

TABLE 1

Microsatellite markers used for correlation analysis

| Micro-Satellite | Localization | Repeat unit | PCR primer |
| --- | --- | --- | --- |
| C1_2_A | Tel. (0 kb)/MICB<br>Cen.(89 kb)/MICA | $(CA)_{23}$ | CA:AATAGCCATGAGAAGCTATGTGGGGGAG<br>TG:CTACCTCCTTGCCAAACTTGCTGTTTGTG |
| C1_4_1 | Tel. (40 kb)/MICA<br>Cen.(6 kb)/HLA-B | $(CAAA)_6$ | CAAA:CGAGAACAACTGGCAGGACTG<br>TTTG:GACAGTCCTCATTAGCGCTGAGG |
| C1_2_5 | Tel. (62 kb)/HLA-B<br>Cen.(19 kb)/HLA-C | $(CA)_4AA(CA)_{20}$ | CA:CAGTAGTAAGCCAGAAGCTATTAC<br>TG:AAGTCAAGCATATCTGCCATTTGG |

TABLE 1-continued

Microsatellite markers used for correlation analysis

| Micro-Satellite | Localization | Repeat unit | PCR primer |
|---|---|---|---|
| C1_4_3 | Tel. (26 kb)/HLA-C<br>Cen.(71 kb)/OTF3 | $(GGAA)_{18}$ | GGAA:TAGAAAACGCAATCTCGGCC<br>TTCC:CTGGATTAACCTGGAGACTC |
| C1_3_1 | Tel. (27 kb)/HLA-C<br>Cen.(69 kb)/OTF3 | $(TTG)_8$ | TTG:CAGTGACAAGCACCTGGCAC<br>CAA:GCCAGATGTGGTGGCATGC |
| C1_2_6 | Tel. (85 kb)/HLA-C<br>Cen.(11 kb)/OTF3 | $(TA)_{17}$ | TA:TGTTCAGACCTCTTCCTGCC<br>AT:GACTAGCTCTTGACTACTTG |
| C1_3_2 | Tel. (37 kb)/OTF3<br>Cen.(7 kb)/S | $(TAA)_{16}$ | TAA:TAGGGATGGTCCCAAACGTG<br>TTA:CCCGTGCAGGACTGATCTCC |
| C2_4_4 | Tel. (80 kb)/S | $(GAAA)_6AAAA(GAAA)_3$ | GAAA:GGCTTGACTTGAAACTCAGAGACC<br>TTTC:TTATCTACTTATAGTCTATCACGG |
| C4_2_12 | Tel. (75 kb)/DDR<br>Cen.(89 kb)/TUBB | $(CA)_{13}$ | CA:GAGCCACGGAGAGTCTCCCTTTATC<br>TG:TCCAGGAACTGTGAGTAGTAAGAAC |
| C4_2_25 | Tel. (69 kb)/TUBB<br>Cen.(47 kb)/HSGT260 | $(TG)_{16}$ | TG:TCTTCTGTGCAAGCAATGCACTGTAC<br>CA:ATGTTACTTTTAGAAGATAACACTC |
| C3_2_11 | Tel. (50 kb)/HLA-E<br>Cen.(21 kb)/MICC | $(GA)_{22}TA(GA)_8$ | GA:AGATGGCATTTGGAGAGTGCAG<br>TC:TCCTTACAGCAGAGATATGTGG |

Eleven selected microsatellite genetic polymorphism markers and PCR primer sequence numbers are listed here. The numbers on the left denote the sequence numbers for the forward primer, while the numbers on the right denote the sequence numbers for the reverse primer.

C1-2-A; SEQ ID NO:27089: SEQ ID NO:27090
G1-4-1; SEQ ID NO:27091: SEQ ID NO:27092
C1-2-5; SEQ ID NO:27093: SEQ ID NO:27094
C1-4-3; SEQ ID NO:27095: SEQ ID NO:27096
C1-3-1; SEQ ID NO:27097: SEQ ID NO:27098
C1-2-6; SEQ ID NO:27099: SEQ ID NO:27100
C1-3-2; SEQ ID NO:27101: SEQ ID NO:27102
C2-4-4; SEQ ID NO:27103: SEQ ID NO:27104
C4-2-12; SEQ ID NO:27105: SEQ ID NO:27106
C4-2-25; SEQ ID NO:27107: SEQ ID NO:27108
C3-2-11; SEQ ID NO:27109: SEQ ID NO:27110

The PCR reactive mixture was prepared to contain 50 ng genomic DNA, 2 μl dNTP (2.5 mM each), 2 μl/10× buffer (100 mM Tris-HCl, pH 8.3, 500 mM KCl, 15 mM MgCl$_2$), and 20 pmol forward and reverse primers as well as 0.5 U Takara recombinant Taq polymerase (Takara Shuzo, Kyoto, Japan) in a total volume of 20 μl. After initial denaturation for 5 minutes at 96° C., processing was carried out using an automated thermal cycler (Takara Shuzo) for 30 cycles consisting of 1 minute at 96° C., 30 seconds at 55° C. and 45 seconds at 72° C., with a final extension of 4 minutes at 72° C. The amplified products were denatured for 5 minutes at 100° C., mixed with formamide-containing stop buffer, applied with a size standard marker of GS5OO Tamra (PE Biosystems) to the starting position of each lane, and run on a 4% polyacrylamide denaturing sequencing gel containing urea in an automated DNA sequencer. Fragment sizes are determined automatically using the GeneScan software (PE Biosystems).

The results are shown in FIG. 1, with the following notations: a) gene map showing the location of each gene in the HLA class I region from IkBL to HLA-L. Black and white boxes represent the HLA-class I genes and the non-HLA genes, respectively. Arrows indicate the orientations of genes; b) Statistical analysis by the case-control correlation test and the exact test of Hardy-Weinberg proportion. The curve is drawn as smoothly fitted on the basis of a two-point moving average in each test. Open circles with solid line indicates Pc-values obtained by Fisher's exact test in the case-control correlation test; open squares with dashed line indicates P-values obtained by the exact test in terms of deviation from Hardy-Weinberg proportions (the probability test); closed spares with bold solid line indicates P-values obtained in the patients by the exact test in terms of heterozygote deficiency against the null hypothesis of Hardy-Weinberg equilibrium; c) Locations of microsatellite markers with the distance (kb) from the HLA-C locus to each microsalellite in parentheses.

The order of the MS genetic polymorphism markers from the centromeric towards the telomeric is C1_2_A, C1_4_1, C1_2_5, C1_4_3, C1_3_1, C1_2_6, C1_3_2, C2_4_4, C4_2_12, C4_2_25, and C3_2_11 (FIG. 1). Repeat units are determined from sequencing data previously obtained by the present inventors (Shiina T. et al. (1999) Immunol. Rev., 167: 193-199). All MS genetic polymorphism markers are established by Tamiya et al. (Tamiya G. et al. (1998) Tissue Antigens, 51, 337-346; Tamiya G. et al. (1999) Tissue Antigens, 54: 221-228).

"Tel" indicates the telomeric, and "Cen.", the centromeric. The PCR primer sequences in order from top of the list are numbered SEQ ID NO:27089 to SEQ ID NO:27110.

Allele frequencies were estimated by direct counting. The test of significance for the distribution of alleles between the patients and the controls was conducted through the chi-square test, which performs correction for continuity, and Fisher's exact test (P-value test). The P-value was corrected by multiplying by the number of microsatellite alleles observed in each locus (Pc). A level of A calculated from the 2×2 contingency table. The exact P-value test of the Hardy Weinberg proportion for multiple alleles is simulated based on the Markov chain method within the Genepop software package (Tamiya G. et al. (1998) Tissue Antigens, 51, 337-346; Tamiya G. et al. (1999) Tissue Antigens, 54: 221-228; Guo S. W. and Thompson E. A. (1992) Biometrics, 48: 361-372). The Markov chain method has the advantage of giving a complete enumeration for testing the Hardy Weinberg proportion in cases where the number of alleles as well as sample size are small. When the number of alleles is below 5, the exact P-value is calculated by the complete enumeration method. A level of P<0.1 is accepted as statistically significant for the Hardy-Weinberg equilibrium test.

In the patients, the phenotype frequency of HLA-Cw6 (8/76 patients, 10.5%) is significantly increased, with a Pc-value of 0.02 (odds ratio=15.88). As shown in Table 2, alleles showing statistically significant differences in Pc-values below 0.05 in the patient group are found at the four microsatellite loci: allele 303 ($\chi^2$=12.62, Pc=0.0015) in C1__2__6; 357 ($\chi^2$=7.91, Pc=0.0034) in C1__8__2; 255 and 259 ($\chi^2$=9.53, Pc=0.0012 and $\chi^2$=11.58, Pc=0.0022, respectively) in C2__4__4; and 223 ($\chi^2$=7.59, Pc=0.036) in C4__2__12. Alleles in each microsatellite genetic polymorphism marker are named on the basis of the length of the amplified fragment.

The most significant correlation was obtained for the allele 303 in the C1__2__6 locus. All four microsatellites in the segment from the loci C1__2__6 to C4__2__12 exhibited statistically significant differences in their allele frequencies between the patients and controls (Table 2 and FIG. 1).

The exact test of Hardy-Weinberg proportion was also carried out for the above 11 microsatellite genetic polymorphism markers by the Markov chain method (Guo S. W. and Thompson E. A. (1992) Biometrics, 48: 361-372) in terms of deviation from Hardy-Weinberg proportions (the probability test) and heterozygote deficiency against the null hypothesis of Hardy-Weinberg equilibrium (Raymond M. and Rousset F. (1995) J. Hered., 86: 248-249; Rousset F. and Raymond M. (1995) Genetics, 140:1413-1419).

All of the tested 11 MS genetic polymorphism markers follow the Hardy-Weinberg equilibrium in the healthy controls (P>0.25), as expected. In contrast, five loci deviate significantly from the Hardy-Weinberg equilibrium in the patient group (P<0.1: C1__2__5, C1__3__1, C1__2__6, C1__3__2, and C2__4__4), as listed in Table 3. Furthermore, five loci show a significant decrease in heterozygotes (P<0.1: C1__4__3, C1__3__1, C1__3__2, C2__4__4, and C4__2__12). On the other hand, no increase in heterozygotes is observed for any MS genetic polymorphism markers. It must be noted that the three microsatellite loci (C1__3__1, C1__3__2, and C2__4__4) in the segment from C1__3__1 to C2__4__4 displays significant P-values in both probability and heterozygote deficiency tests (Table 3 and FIG. 1). In particular, in C1__3__2 and C2__4__4, highly significant P-values are obtained in both of these tests.

TABLE 3

Exact test of the Hardy-Weinberg proportion for microsatellites

| Loci | HW[a] | SE | Hetero.[b] | SE | Ex. Hetero.[c] | Ob. Hetero.[d] |
|---|---|---|---|---|---|---|
| C1__2__A | 0.3939 | 0.0043 | 0.2881 | 0.0042 | 0.801 | 0.763 |
| C1__4__1 | 0.2443 | 0.0016 | 0.7024 | 0.0019 | 0.633 | 0.613 |
| C1__2__5 | <u>0.0063</u> | 0.0006 | 0.1599 | 0.0042 | 0.883 | 0.842 |
| C1__4__3 | 0.1968 | 0.0065 | <u>0.0362</u> | 0.0028 | 0.89 | 0.829 |
| C1__3__1 | <u>0.0286</u> | — | <u>0.0203</u> | — | 0.561 | 0.461 |
| C1__2__6 | <u>0.0889</u> | 0.0023 | 0.1776 | 0.0027 | 0.676 | 0.579 |
| C1__3__2 | <u>0.0172</u> | 0.0005 | <u>0.0051</u> | 0.0003 | 0.848 | 0.75 |
| C2__4__4 | <u>0.0097</u> | 0.0004 | <u>0.0093</u> | 0.0003 | 0.655 | 0.553 |
| C4__2__12 | 0.3006 | 0.0052 | <u>0.0303</u> | 0.0013 | 0.679 | 0.635 |

TABLE 2

Statistically significant alleles that correlate with psoriasis vulgaris

| Loci | Distance from HLA-C a) | No. of alleles | Allele | Odds ratio | CI of odds ratio | X² | P-value b) | Pc-value c) |
|---|---|---|---|---|---|---|---|---|
| C1__2__A | 232 kb(c) | 10 | 242 | 0.44 | 024-0.81 | 6.97 | 0.0059 | 0.059 |
| C1__4__1 | 91 kb(c) | 5 | 221 | 0.59 | 0.31-1.11 | 2.66 | 0.069 | 0.345 |
| C1__2__5 | 19 kb(c) | 14 | 216 | 2.58 | 1.59-5.08 | 7.54 | 0.0057 | 0.0798 |
| C1__4__3 | 29 kb(t) | 17 | 467 | 0.16 | 0.04-0.59 | 7.52 | 0.0037 | 0.0629 |
| C1__3__1 | 31 kb(t) | 4 | 291 | 0.49 | 0.27-0.89 | 5.57 | 0.013 | 0.052 |
| C1__2__6 | 89 kb(t) | 8 | 303 | 0.21 | 0.09-0.50 | 12.62 | 0.00019 | <u>0.00152</u> |
| C1__3__2 | 143 kb(t) | 8 | 357 | 2.37 | 1.30-4.32 | 7.91 | 0.0042 | <u>0.0336</u> |
| C2__4__4 | 200 kb(t) | 6 | 255 | 2.76 | 1.45-5.25 | 9.53 | 0.002 | <u>0.012</u> |
| C2__4__4 | | | 259 | 0.24 | 0.11-0.55 | 11.58 | 0.00037 | <u>0.00222</u> |
| C4__2__12 | 457 kb(t) | 9 | 223 | 0.33 | 0.73-0.15 | 7.59 | 0.004 | <u>0.036</u> |
| C4__2__25 | 618 kb(t) | 7 | 271 | 5.06 | 0.56-45.1 | 2.11 | 0.2 | 1 |
| C3__2__11 | 831 kb(t) | 17 | 209 | 0.55 | 0.26-1.17 | 2.43 | 0.082 | 1 |

Table legend:
a) (c), centromeric HLA-C gene; (t), telomeric HLA-C gene.
b) Determined by Fisher's exact test.
c) Corrected by multiplying by the number of microsatellite alleles observed in each locus.
Pc-values below 0.05, accepted as statistically significant, are underlined.

TABLE 3-continued

Exact test of the Hardy-Weinberg proportion for microsatellites

| Loci | HW[a] | SE | Hetero.[b] | SE | Ex. Hetero.[c] | Ob. Hetero.[d] |
|---|---|---|---|---|---|---|
| C4__2__25 | 0.666 | 0.0041 | 0.6684 | 0.007 | 0.466 | 0.481 |
| C3__2__11 | 0.1837 | 0.0057 | 0.4787 | 0.0078 | 0.9 | 0.895 |

[a]Deviation from Hardy-Weinberg proportions (probability test).
[b]Heterozygote deficiency against the null hypothesis of the Hardy-Weinberg equilibrium.
[c]Expected helerozygote frequency in the patient population.
[d]Observed heterozygote frequency in the patient population.

In the above table, the exact P-value is estimated by the simulations based on the Markov chain method with the following parameters: dememorization number=1000; number of batches=400; number of iteration per batch=8000. When the number of alleles is below 5, the exact P-value is calculated by the complete enumeration method. Pc-values below 0.1, accepted as statistically significant, are underlined. SE, standard error.

As indicated above, four of the analyzed microsatellites (C1_2_6, C1_3_2, C2_4_4, and C4_2_12) in the segment from C1_2_6 to C4_2_12 display statistically significant differentiation between the patients and controls (Table 2 and FIG. 1). Moreover, the three microsatellite loci (C1_3_1, C1_3_2, and C2_4_4) in the segment from C1_3_1 to C2_4_4 display significant deviation in both probability and heterozygote deficiency tests (Table 3 and FIG. 1). In particular, in C1_3_2 and C2_4_4, highly significant P-values are obtained in both of these tests.

Although the mode of inheritance of psoriasis is unclear, Table 2 makes it clear that the frequency of heterozygotes at the five microsatellite loci in the patients is lower than the expected suggests a recessive HLA trait for this disease, although the genetic penetrance is not high. Collectively, it can be concluded that the 111 kb segment from C1_2_6 (89 kb telomeric HLA-C) to C2_4_4 (200 kb telomeric HLA-C) is the common area critical for psoriasis vulgaris at a confidence level of more than 95%, as assessed by both statistical methods for allelic distribution and deviation on the Hardy-Weinberg equilibrium (FIG. 1).

It must be emphasized that these two independent statistical methods, of which the former deals with the data of patients and controls and the latter only with the data of patients, reveals an almost identical critical segment for psoriasis vulgaris. This result is consistent with previous mapping data Which showed the susceptibility gene for psoriasis vulgaris to be residing on the telomeric HLA-C gene, based on a transmission/disequilibrium test (TDT) and parametric linkage analysis using the HLA class I (HLA-A, -B, and -C) and class II (HLA-DRB1 and -DQB1) alleles in the patients (Jenisch S. et al. (1998) Am. J. Hum. Genet., 63, 191-199).

Example 4

Analysis of Susceptibility Gene for Rheumatoid Arthritis

Figure 2:
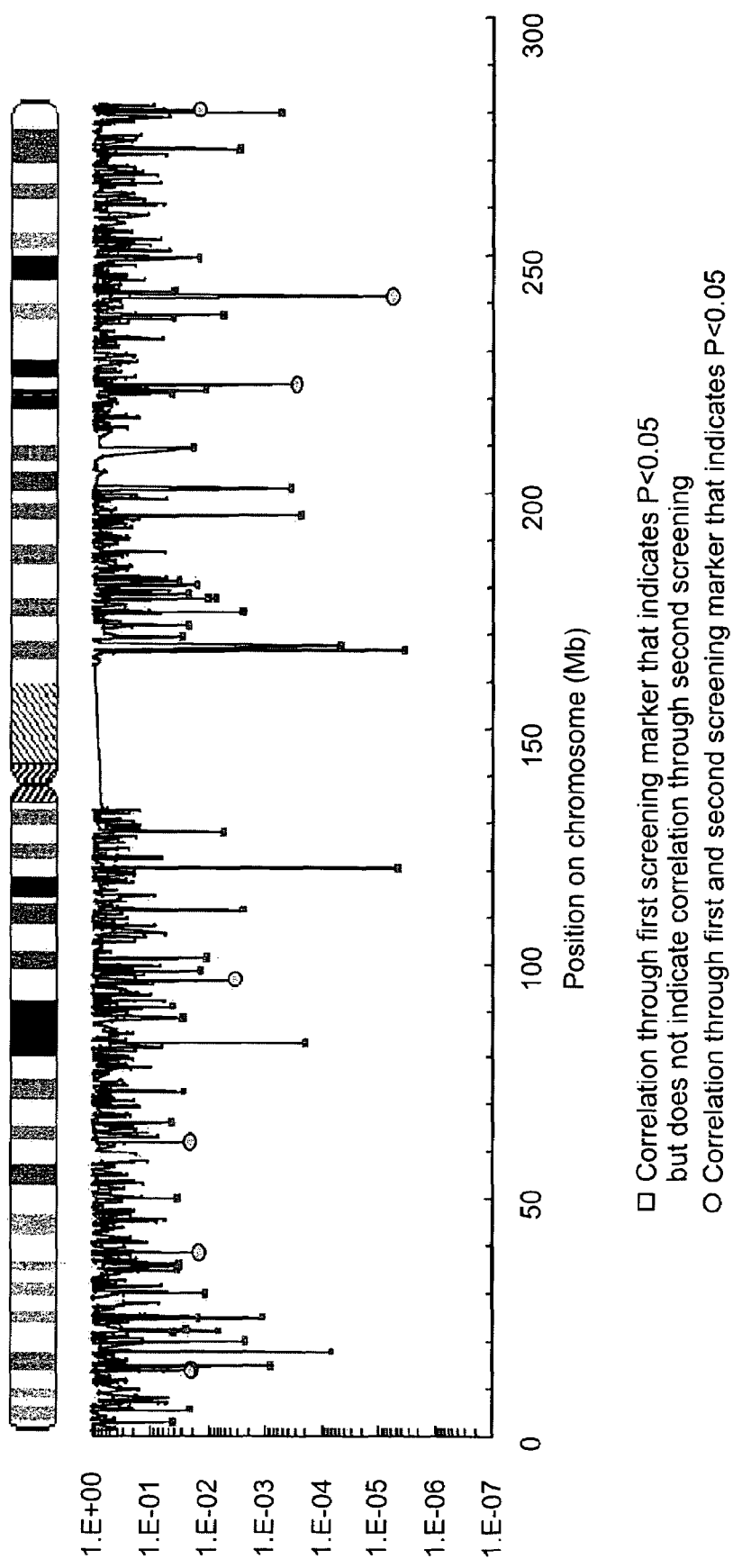
FIG. 2 shows a result of carrying out the first screening of the first chromosome for rheumatoid arthritis.

In the first step of identifying the susceptibility gene for rheumatoid arthritis in which genetic factors are suggested to be involved, a genetic correlation analysis is carried out throughout the genome. Considering the sampling structure for age and sex of patients and healthy subjects, the pooled DNA reagents for analysis of the susceptibility gene for rheumatoid arthritis are adjusted. The sex ratio for the reagents collected from the rheumatoid arthritis patients before the test has begun is 0.212 for men to 0.788 for women. In order to perform the second screening, two pooled DNA reagents (i.e., 125×2) are prepared in accordance with the above sex ratio. The age distribution for this case is illustrated in the ten-year-old class (FIG. 2). The average ages for the reagent pool of to be-compared healthy subjects is shown below:

<Men> Average age: 44.3 SD: 11.8 Sample number: 52
<Women> Average age: 39.1 SD: 12.9 Sample number: 198

Since there is no information regarding onset ages for patients, certain references are referred. The age distribution is surveyed (since the average age is unknown, the age of 45 is given), and in conformity therewith, the pooled DNA reagents for the healthy subjects are prepared.

Screening the pooled DNA samples for the patients and healthy subjects was carried out, as described in Example 1, using primers corresponding to MA genetic polymorphism markers throughout the genome, and the first chromosome and the fourth chromosome (2471 markers) are analyzed first. It is noted that the inter-marker spacing for 57% of the MS genetic polymorphism markers used for the first chromosome and 59% used for the fourth chromosome is below 100 kb.

Figure 3:
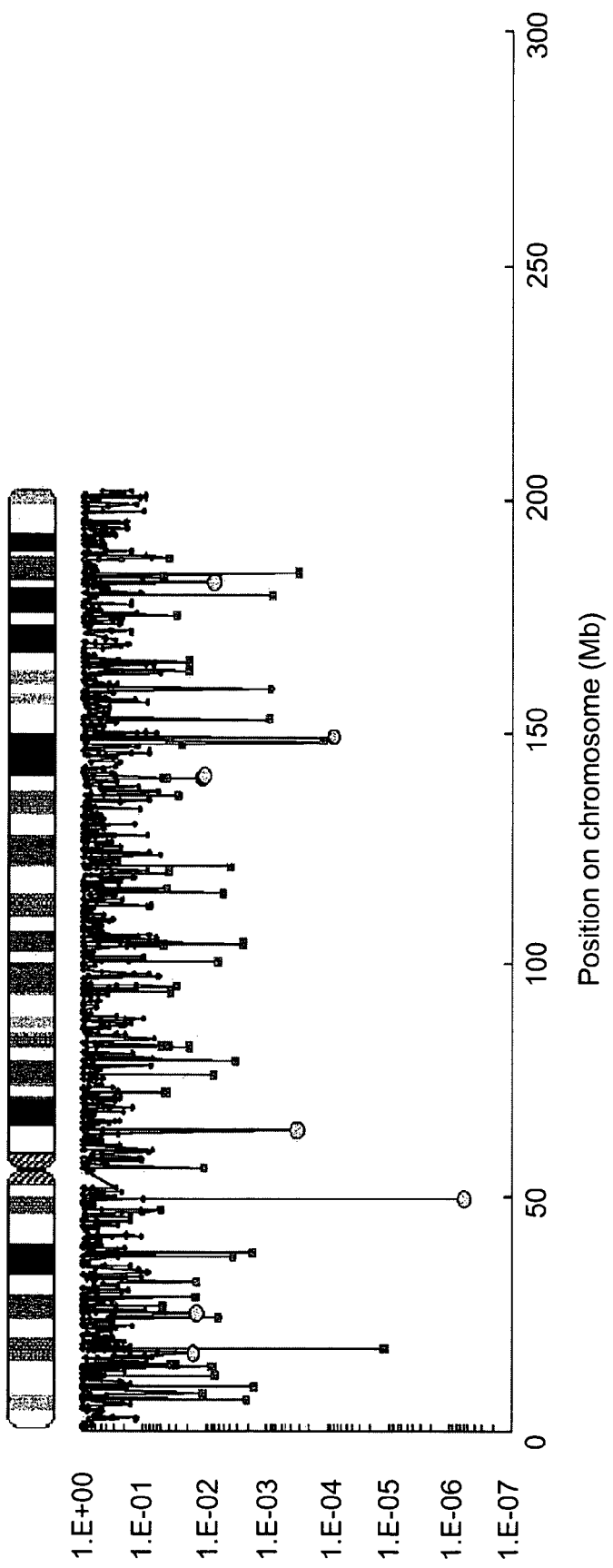
FIG. 3 shows a result of carrying out the first screening of the fourth chromosome for rheumatoid arthritis.
Figure 4:
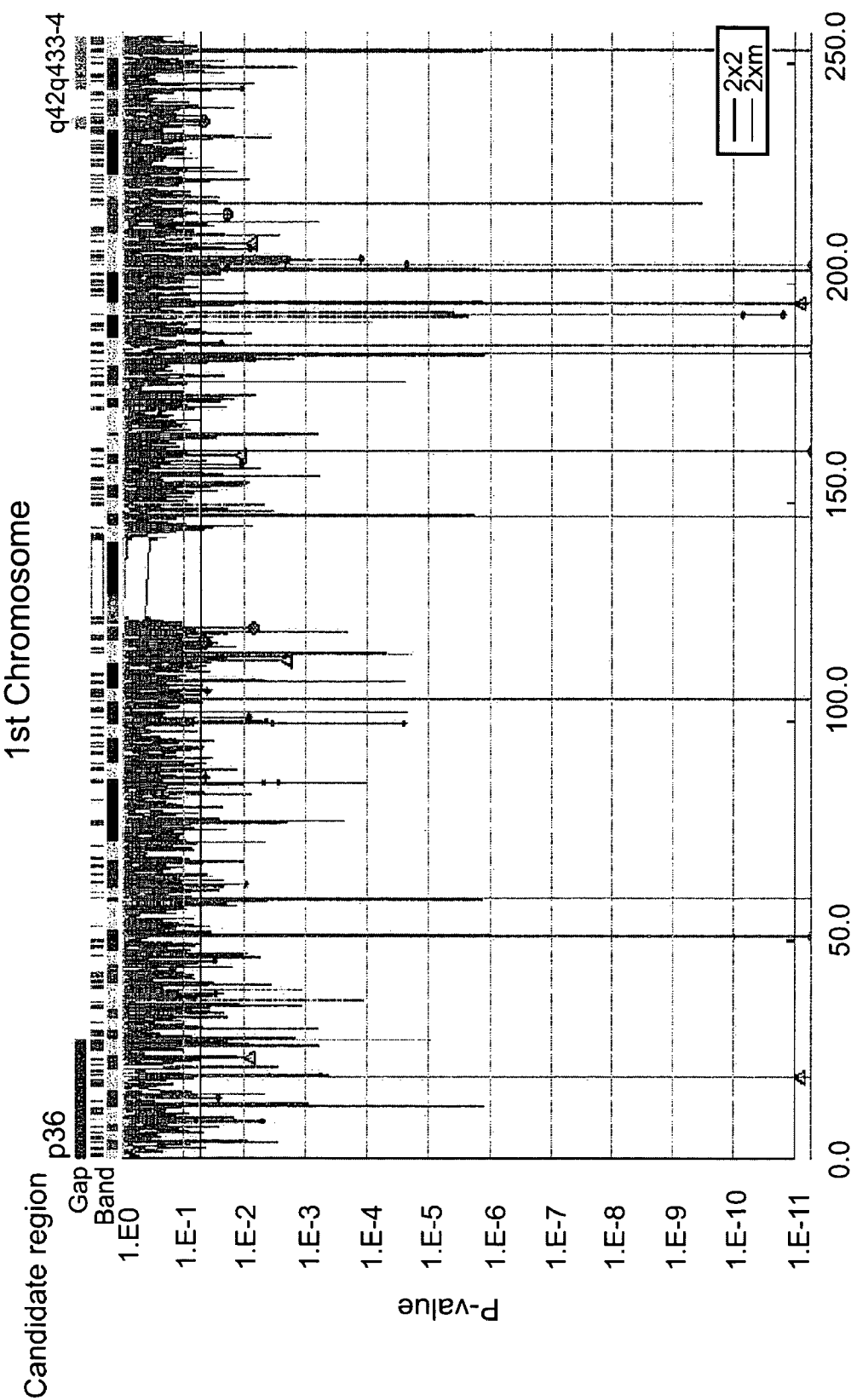
FIG. 4 shows a profile for the rheumatism susceptibility segment in the first chromosome analyzed using a method according to the present invention.
Figure 5:
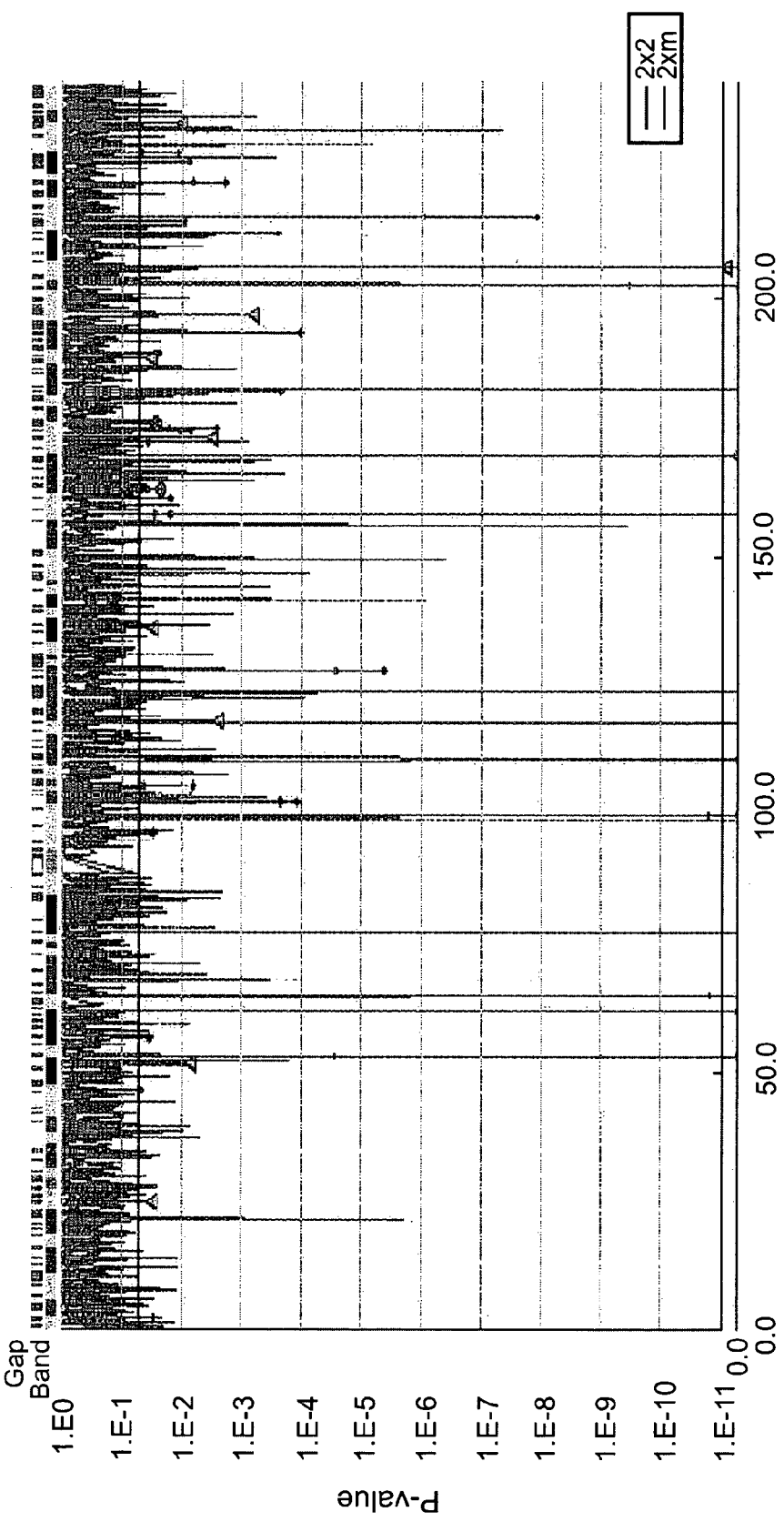
FIG. 5 shows a profile for the rheumatism susceptibility segment in the second chromosome analyzed using a method according to the present invention.
Figure 6:
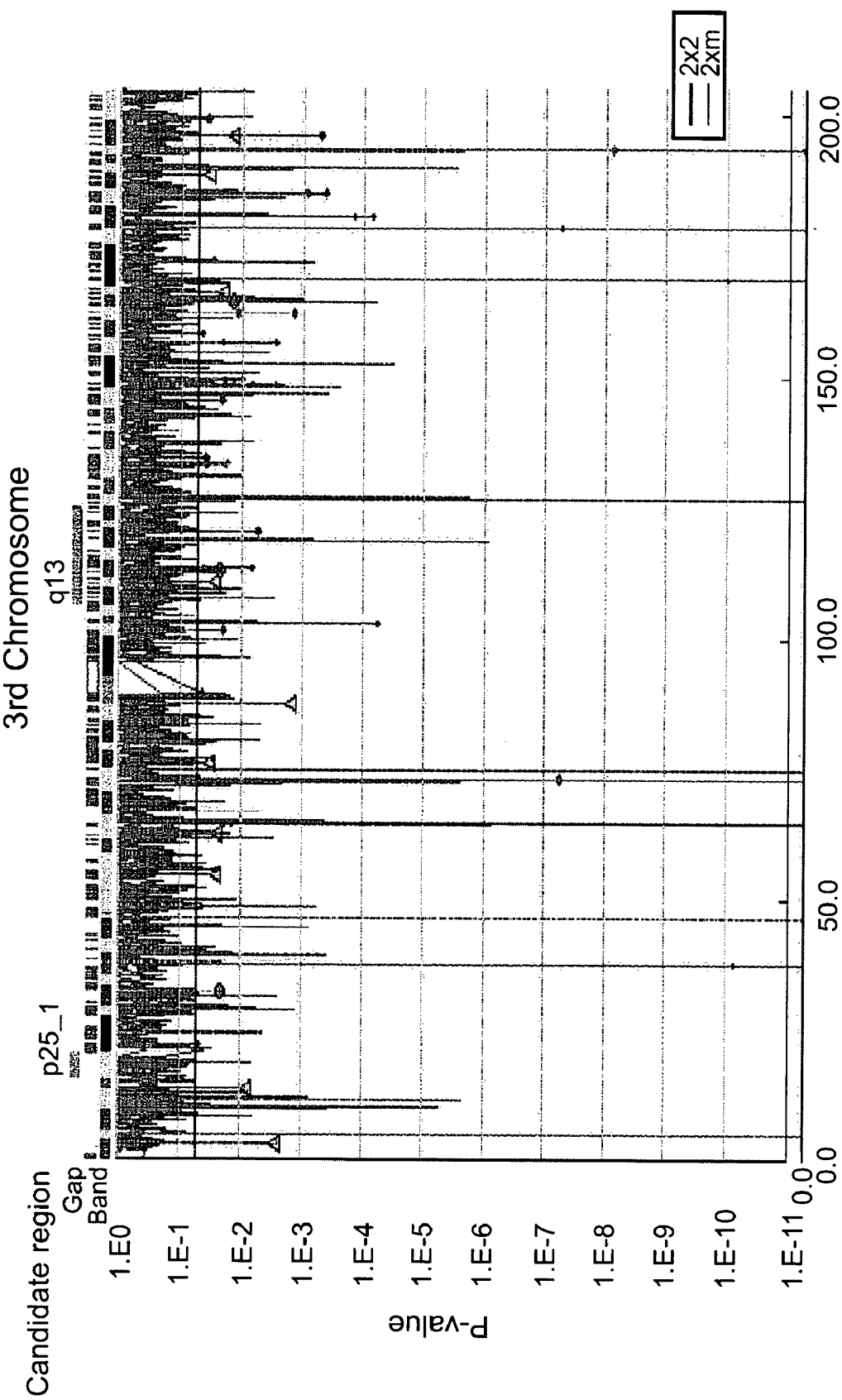
FIG. 6 shows a profile for the rheumatism susceptibility segment in the third chromosome analyzed using a method according to the present invention.
Figure 7:
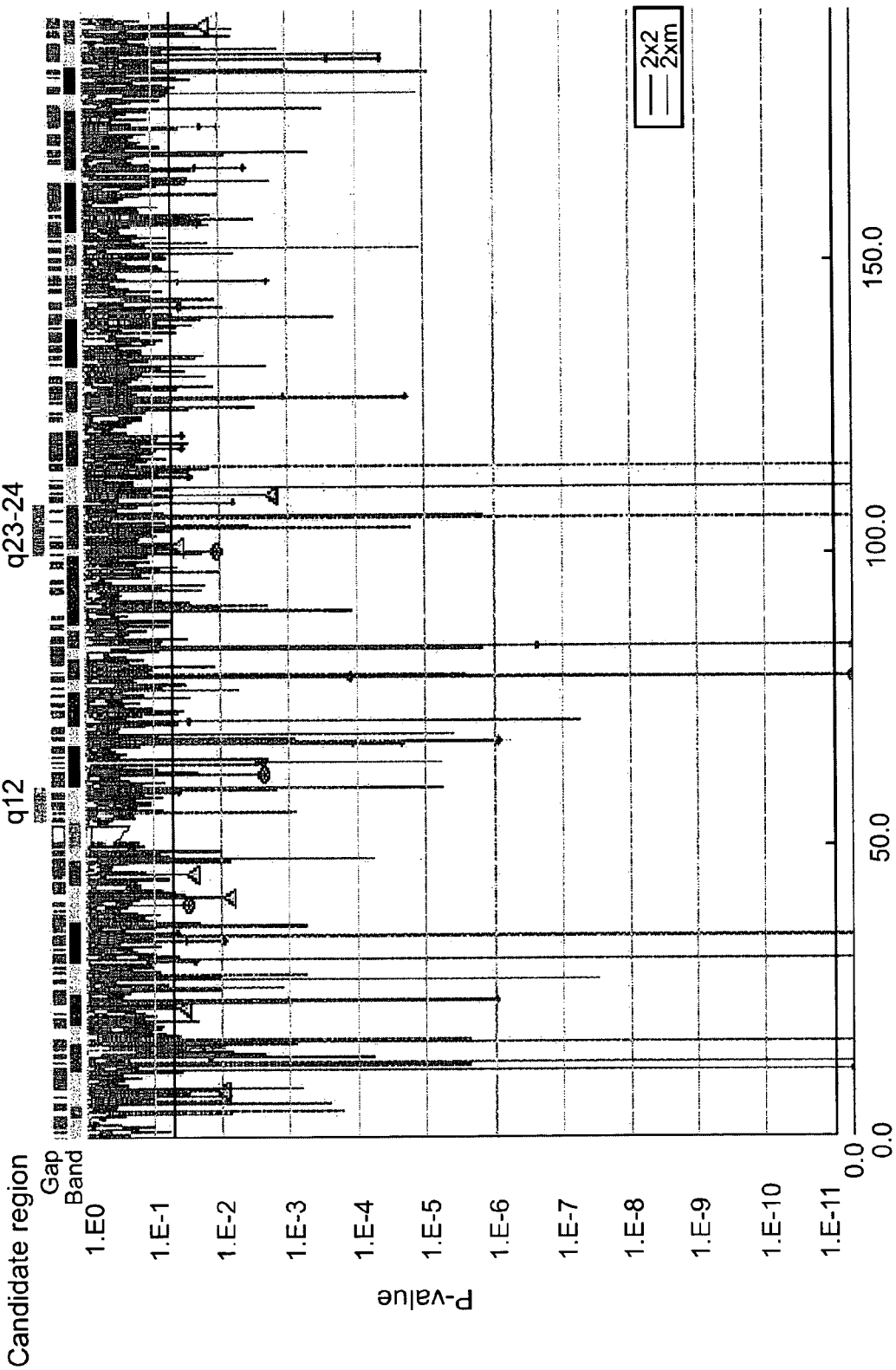
FIG. 7 shows a profile for the rheumatism susceptibility segment in the fourth chromosome analyzed using a method according to the present invention.
Figure 8:
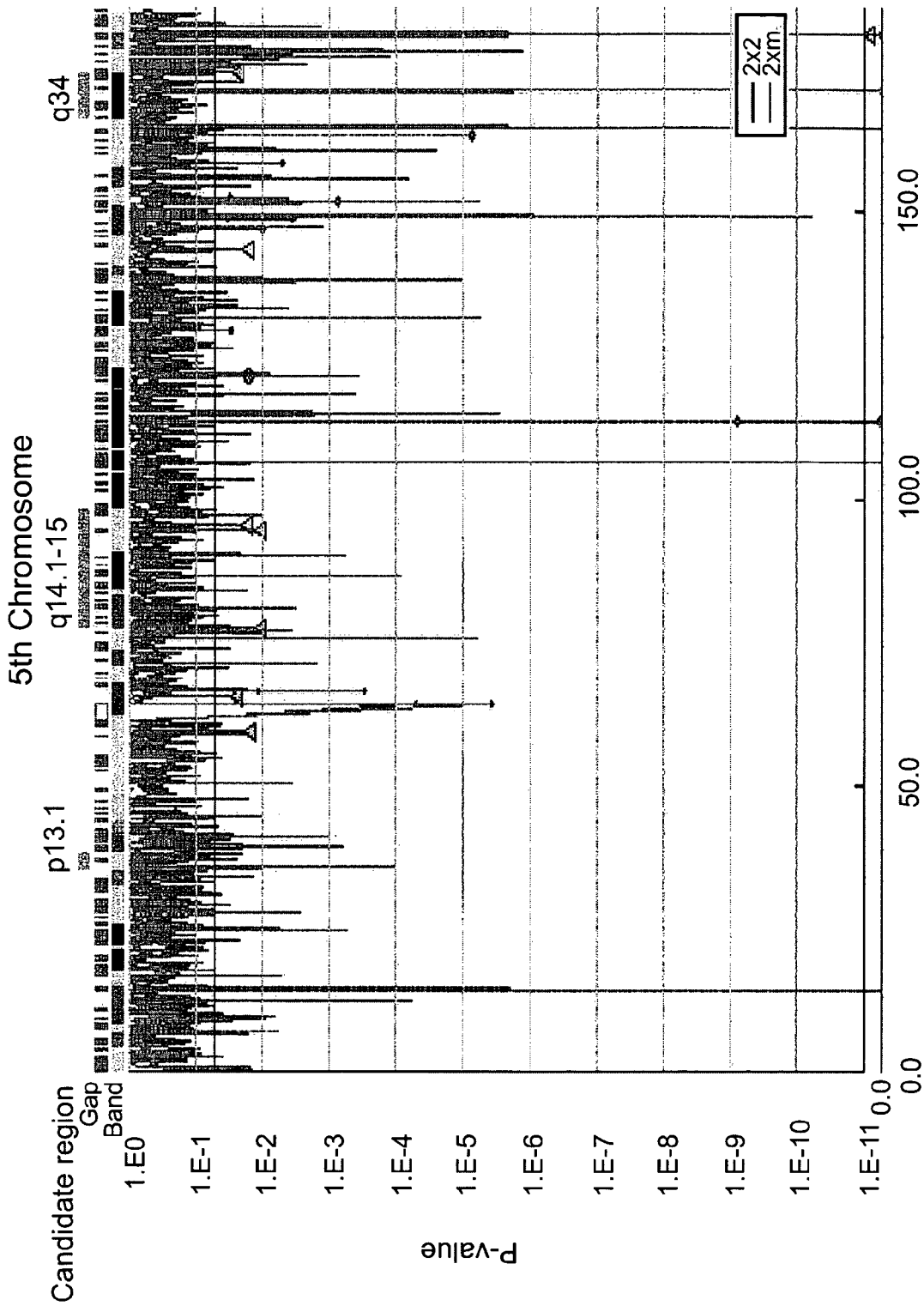
FIG. 8 shows a profile for the rheumatism susceptibility segment in the fifth chromosome analyzed using a method according to the present invention.
Figure 9:
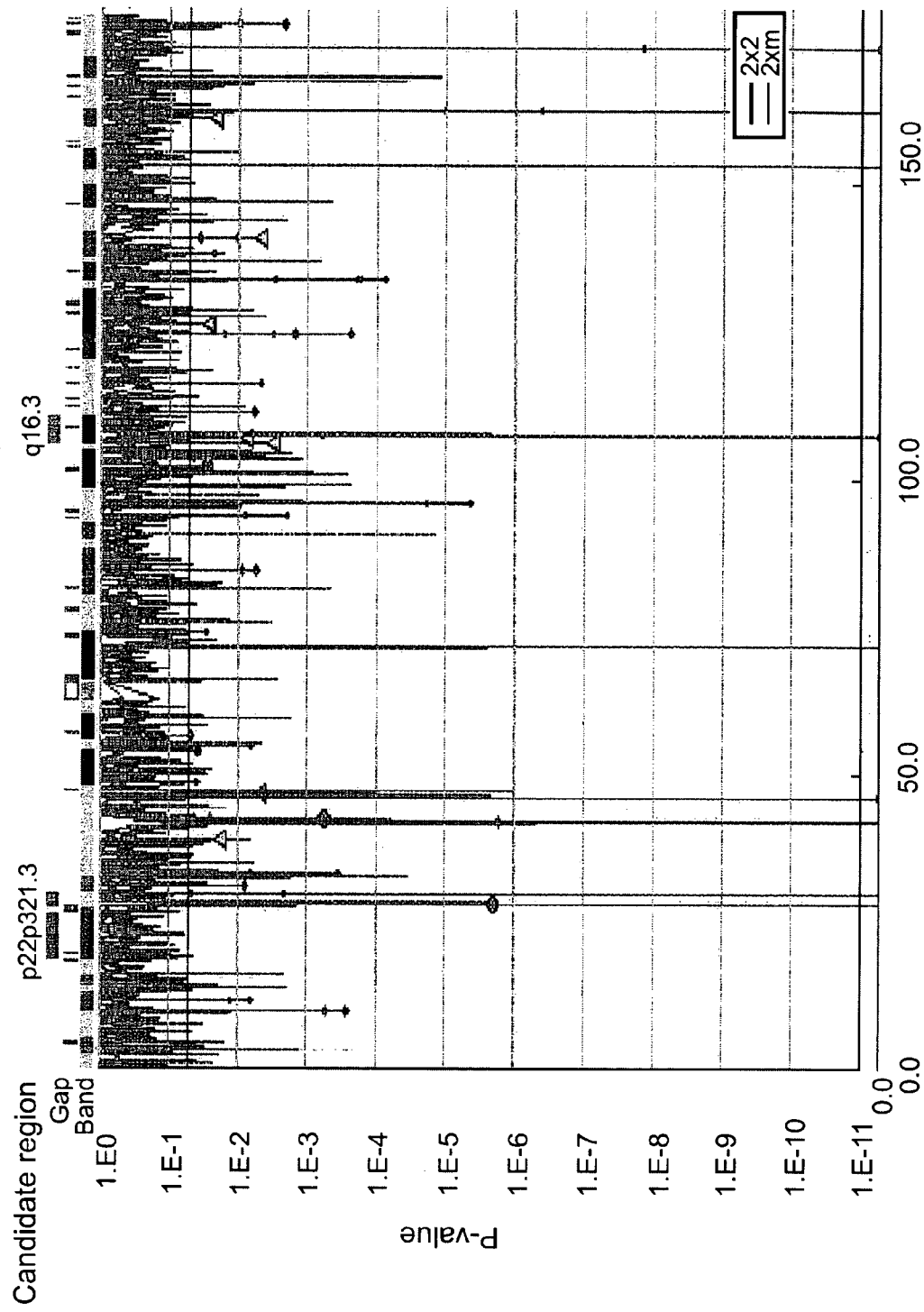
FIG. 9 shows a profile for the rheumatism susceptibility segment in the sixth chromosome analyzed using a method according to the present invention.
Figure 10:
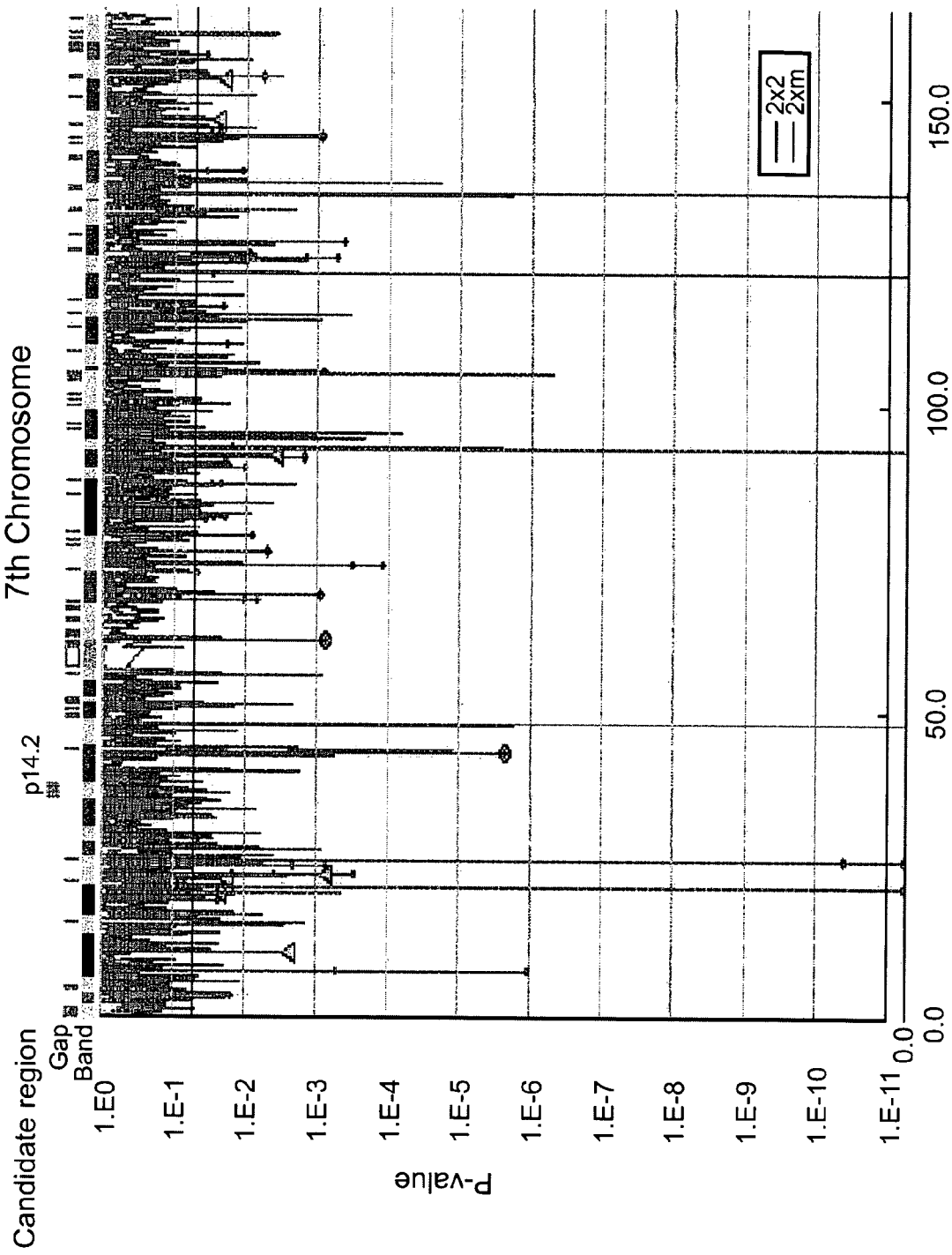
FIG. 10 shows a profile for the rheumatism susceptibility segment in the seventh chromosome analyzed using a method according to the present invention.
Figure 11:
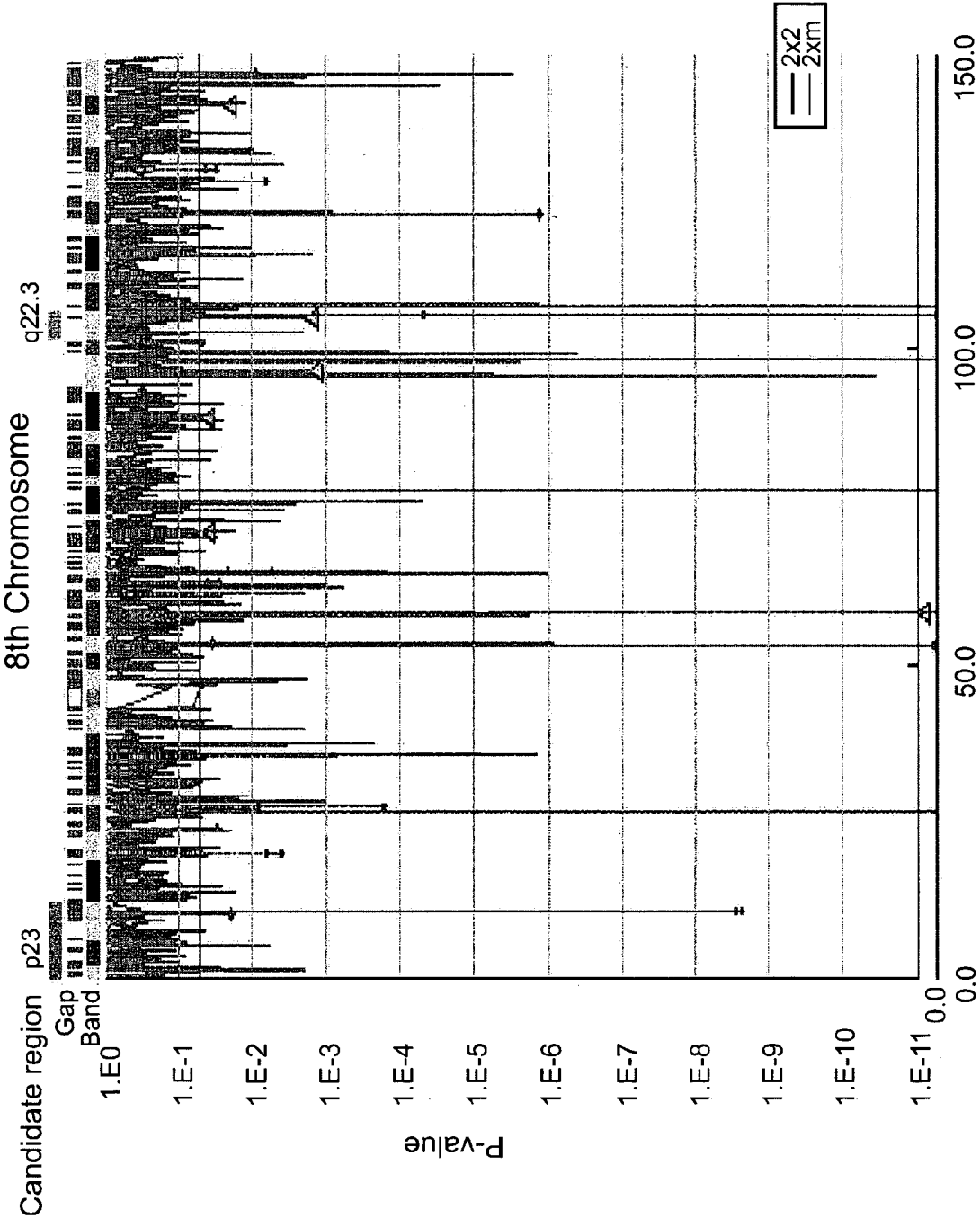
FIG. 11 shows a profile for the rheumatism susceptibility segment in the eighth chromosome analyzed using a method according to the present invention.
Figure 12:
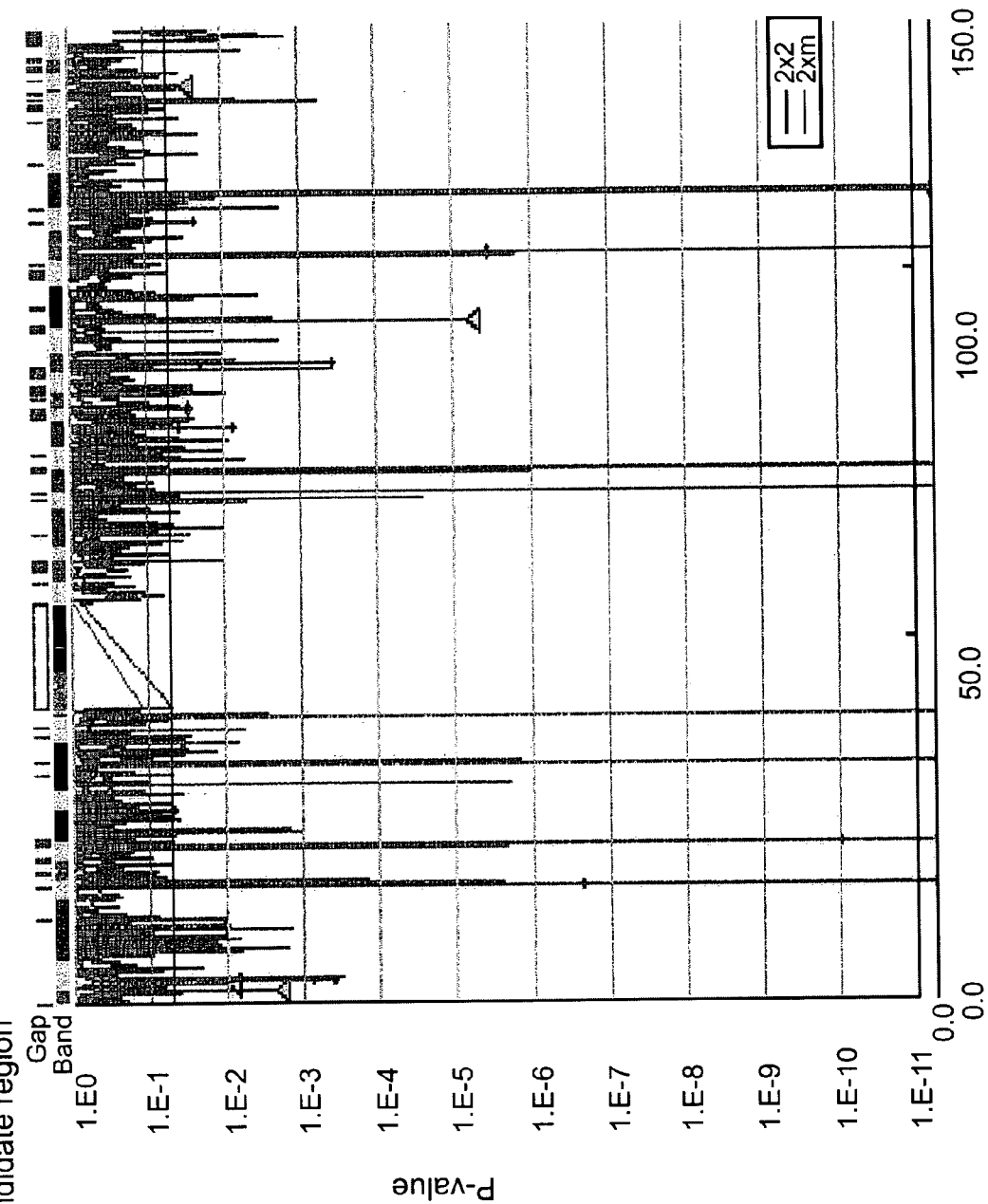
FIG. 12 shows a profile for the rheumatism susceptibility segment in the ninth chromosome analyzed using a method according to the present invention.
Figure 13:
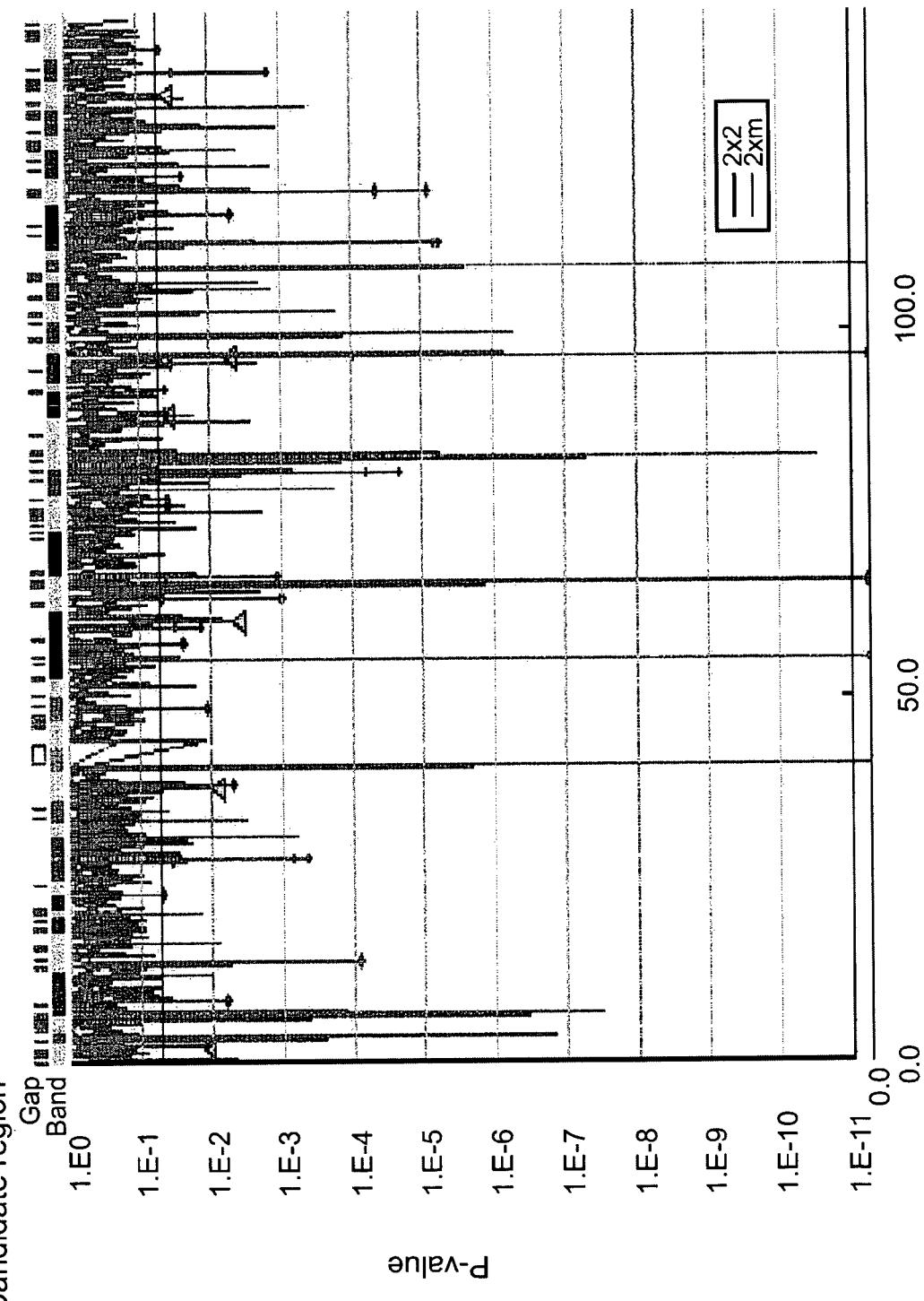
FIG. 13 shows a profile for the rheumatism susceptibility segment in the tenth chromosome analyzed using a method according to the present invention.
Figure 14:
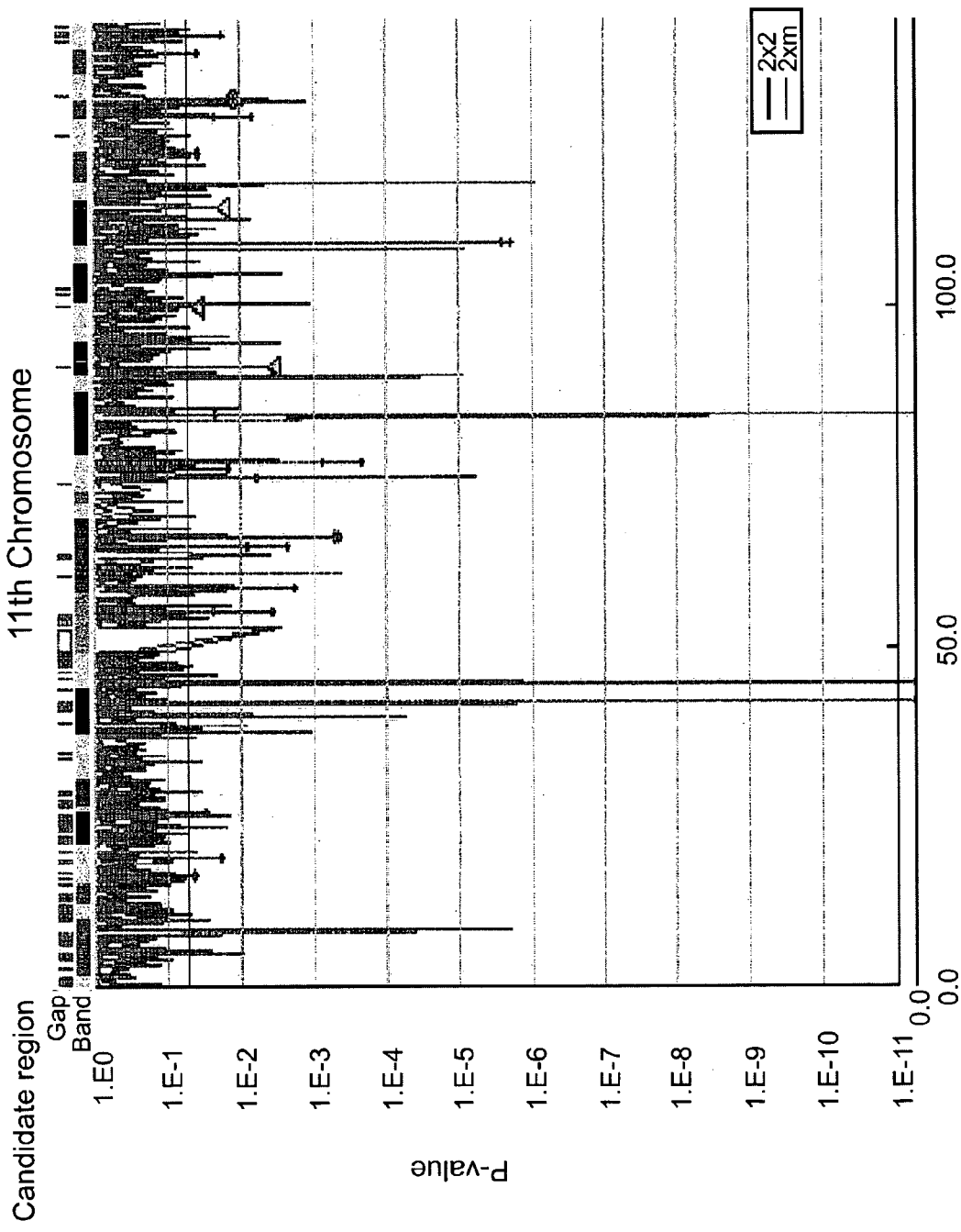
FIG. 14 shows a profile for the rheumatism susceptibility segment in the eleventh chromosome analyzed using a method according to the present invention.
Figure 15:
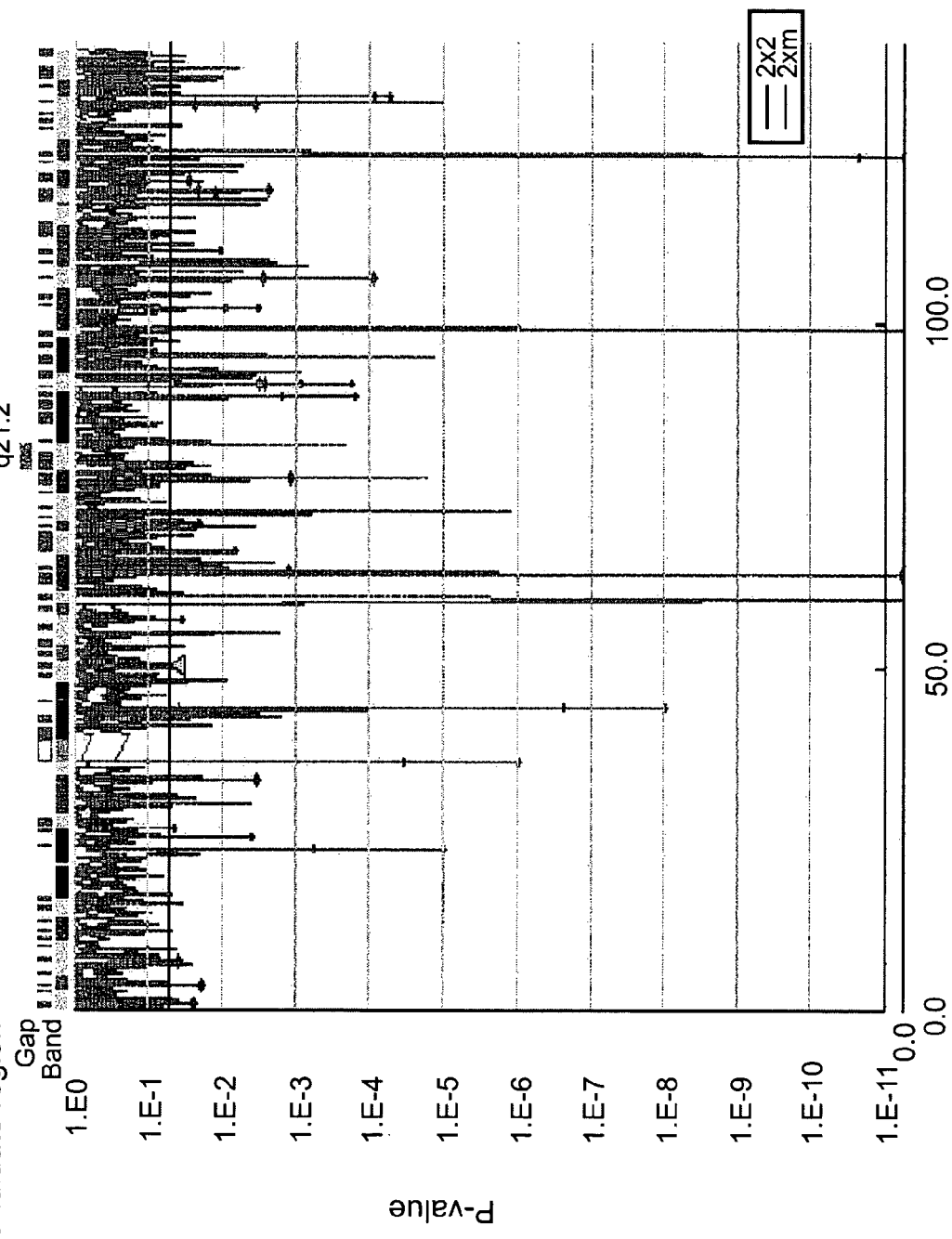
FIG. 15 shows a profile for the rheumatism susceptibility segment in the twelfth chromosome analyzed using a method according to the present invention.
Figure 16:
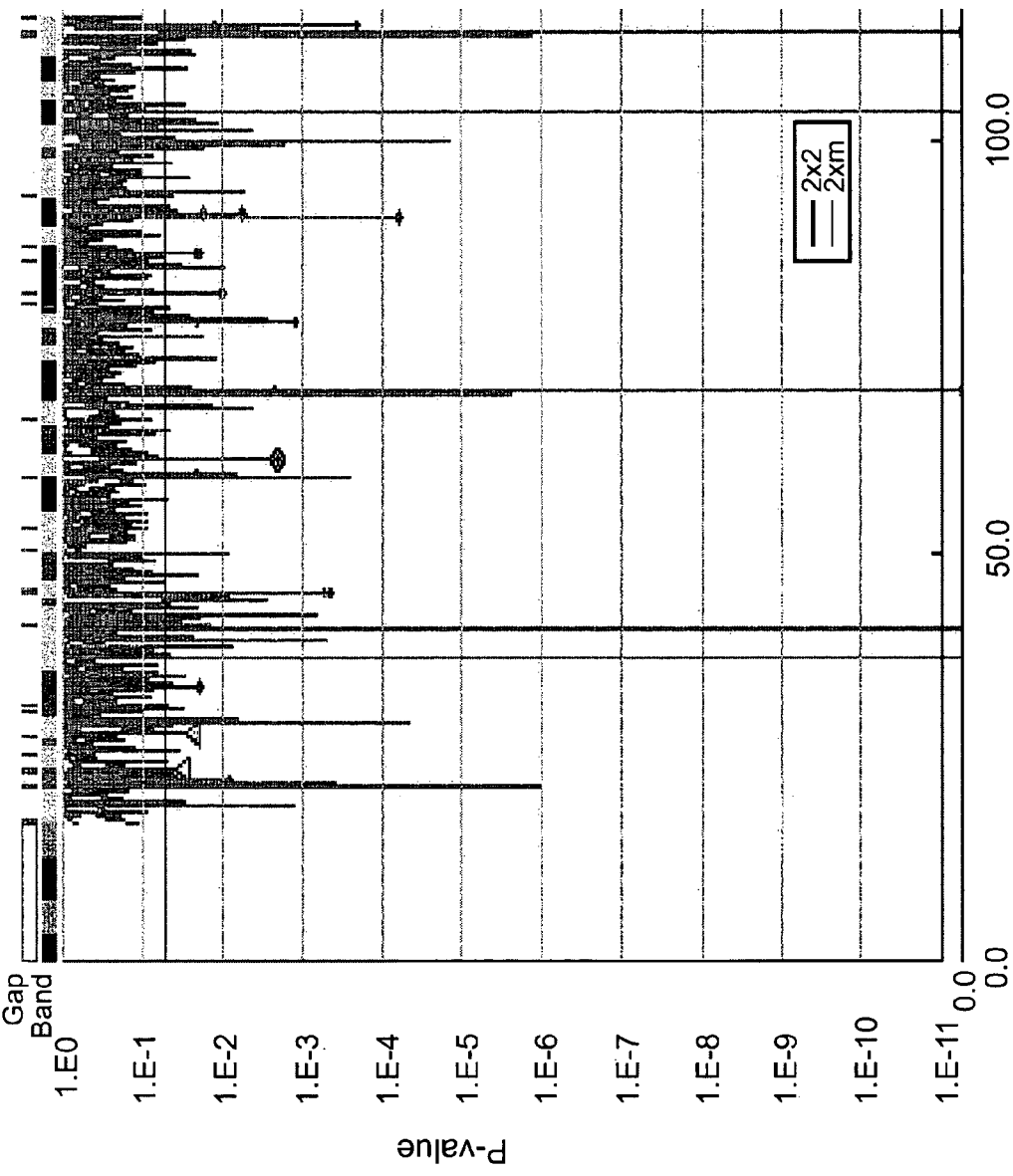
FIG. 16 shows a profile for the rheumatism susceptibility segment in the thirteenth chromosome analyzed using a method according to the present invention.
Figure 17:
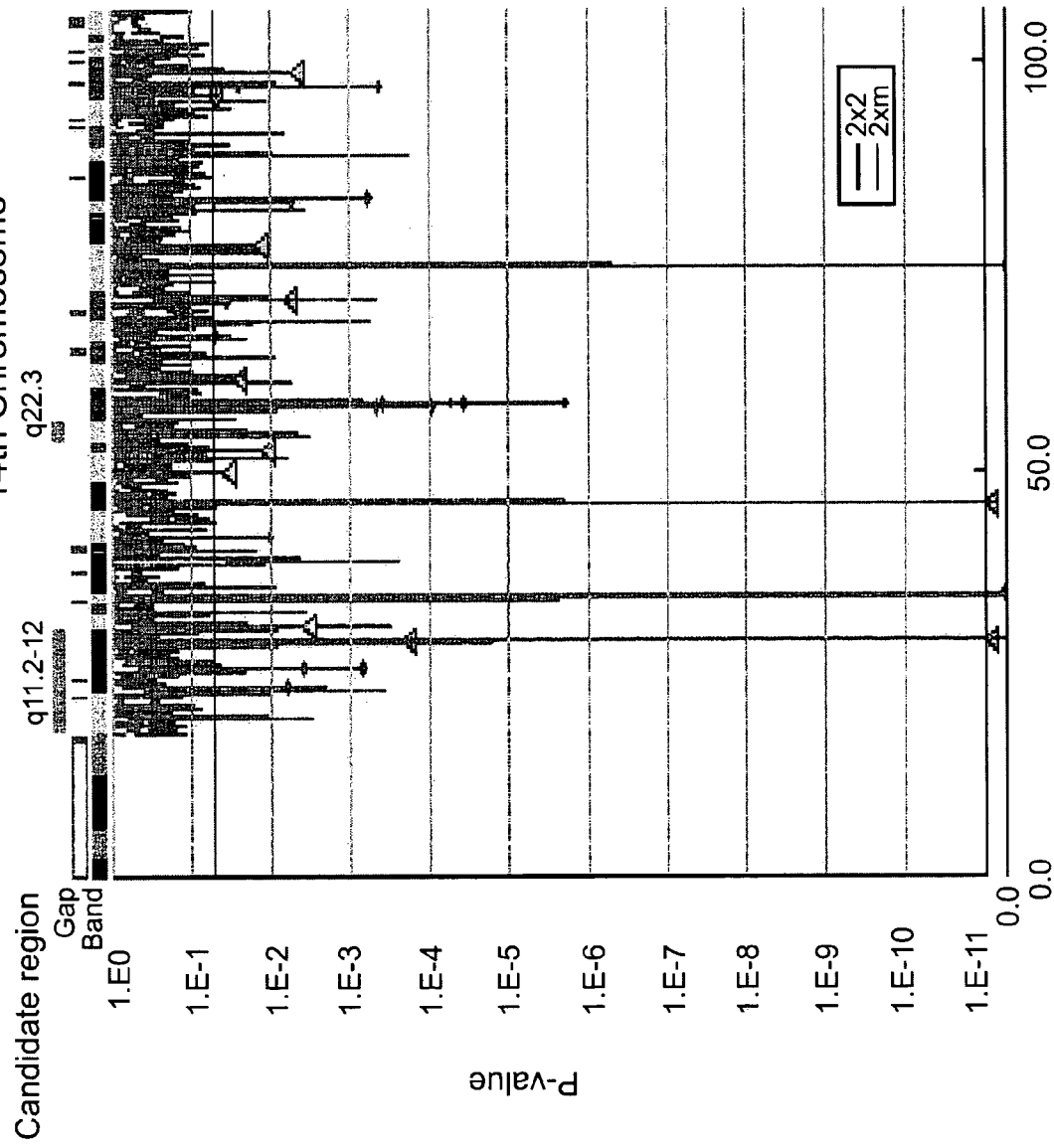
FIG. 17 shows a profile for the rheumatism susceptibility segment in the fourteenth chromosome analyzed using a method according to the present invention.
Figure 18:
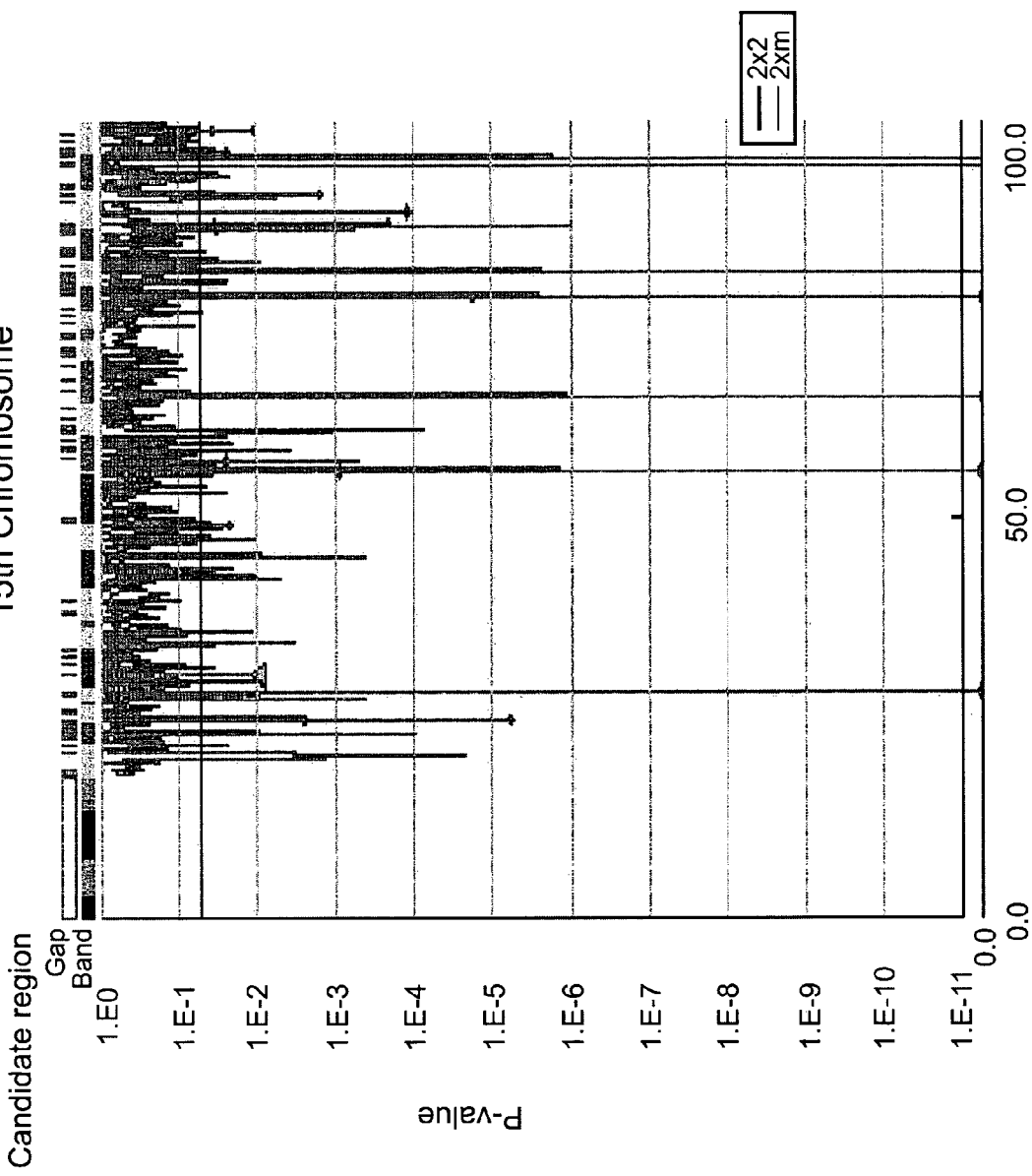
FIG. 18 shows a profile for the rheumatism susceptibility segment in the fifteenth chromosome analyzed using a method according to the present invention.
Figure 19:
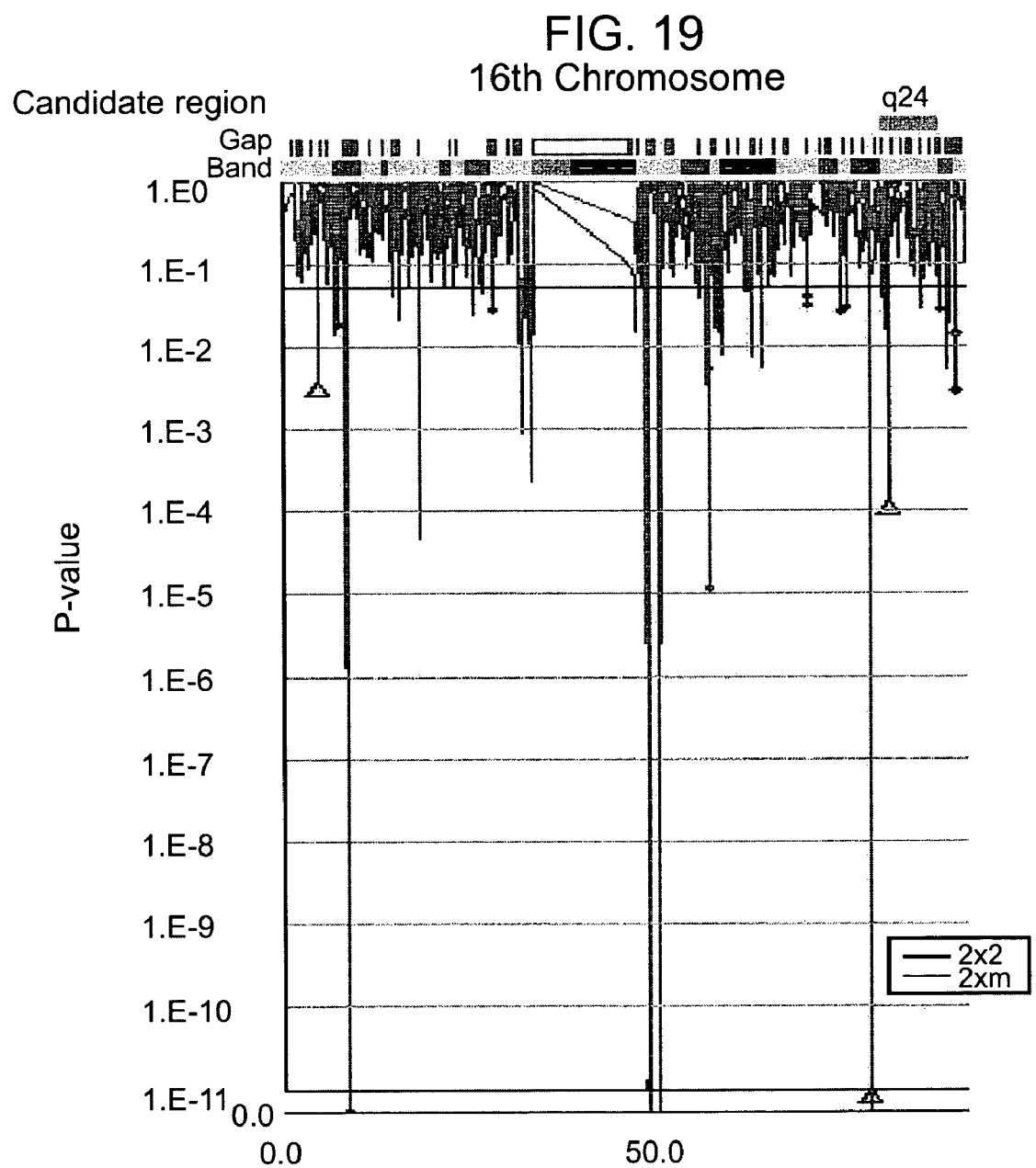
FIG. 19 shows a profile for the rheumatism susceptibility segment in the sixteenth chromosome analyzed using a method according to the present invention.
Figure 20:
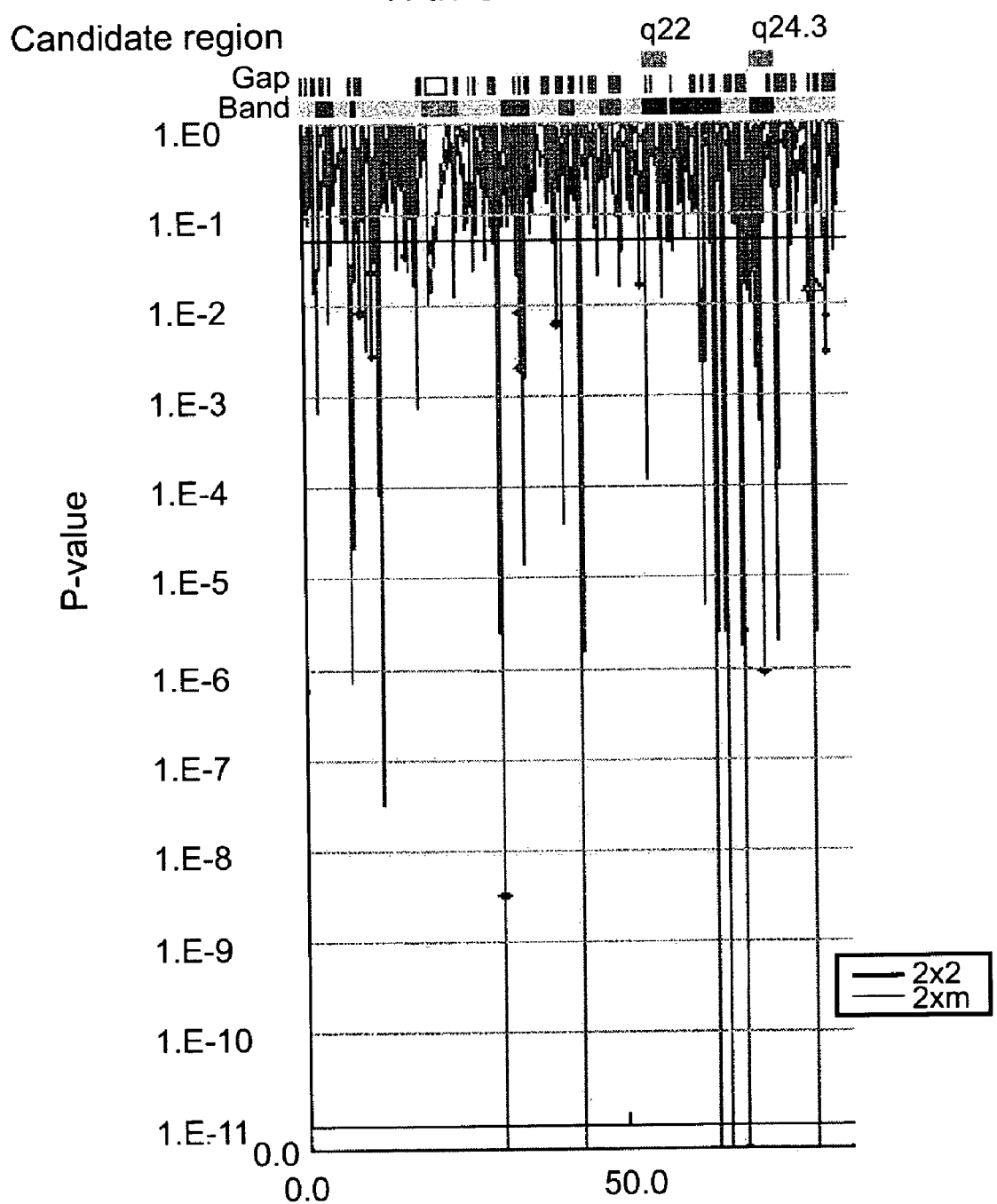
FIG. 20 shows a profile for the rheumatism susceptibility segment in the seventeenth chromosome analyzed using a method according to the present invention.
Figure 21:
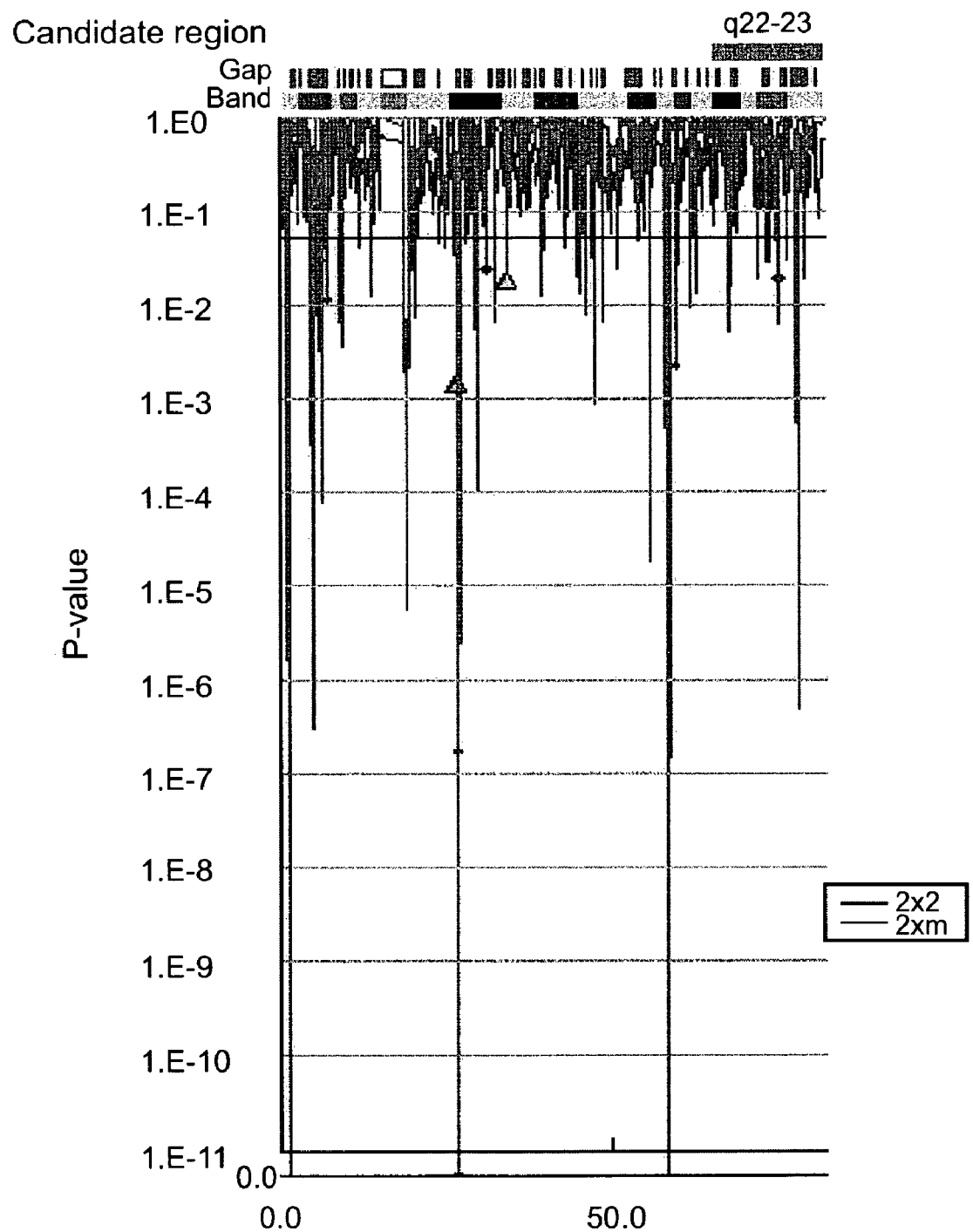
FIG. 21 shows a profile for the rheumatism susceptibility segment in the eighteenth chromosome analyzed using a method according to the present invention.
Figure 22:
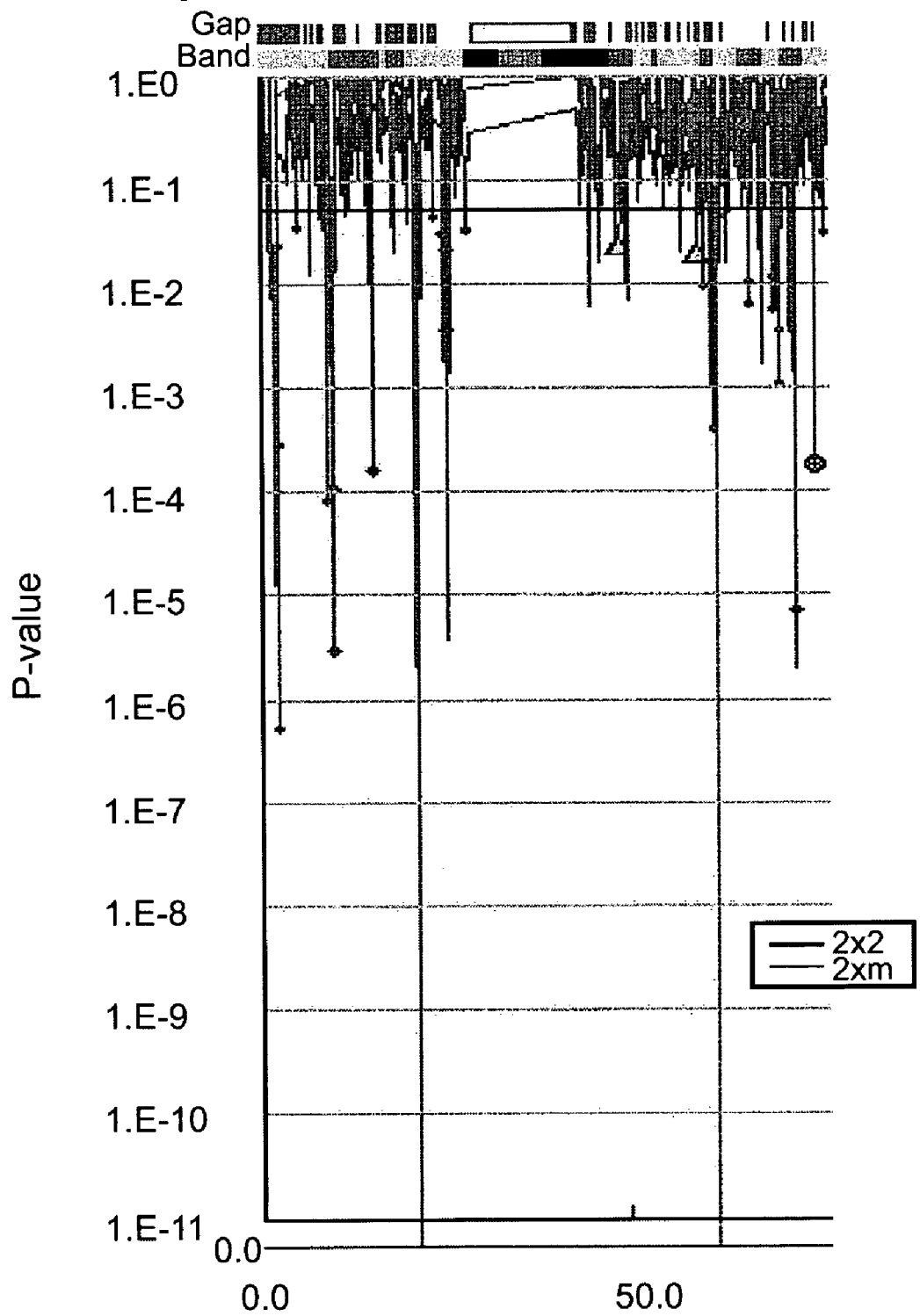
FIG. 22 shows a profile for the rheumatism susceptibility segment in the nineteenth chromosome analyzed using a method according to the present invention.
Figure 23:
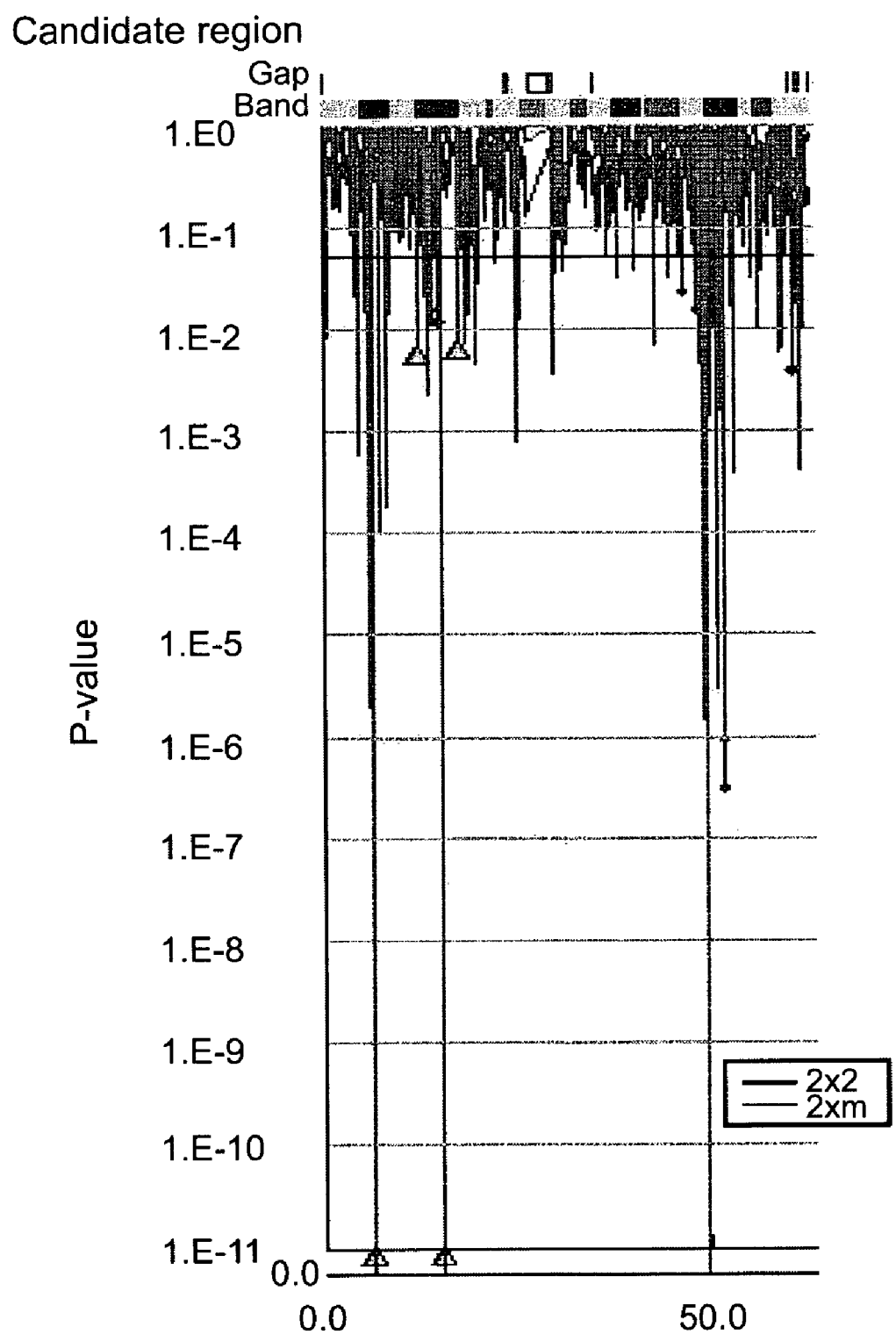
FIG. 23 shows a profile for the rheumatism susceptibility segment in the twentieth chromosome analyzed using a method according to the present invention.
Figure 24:
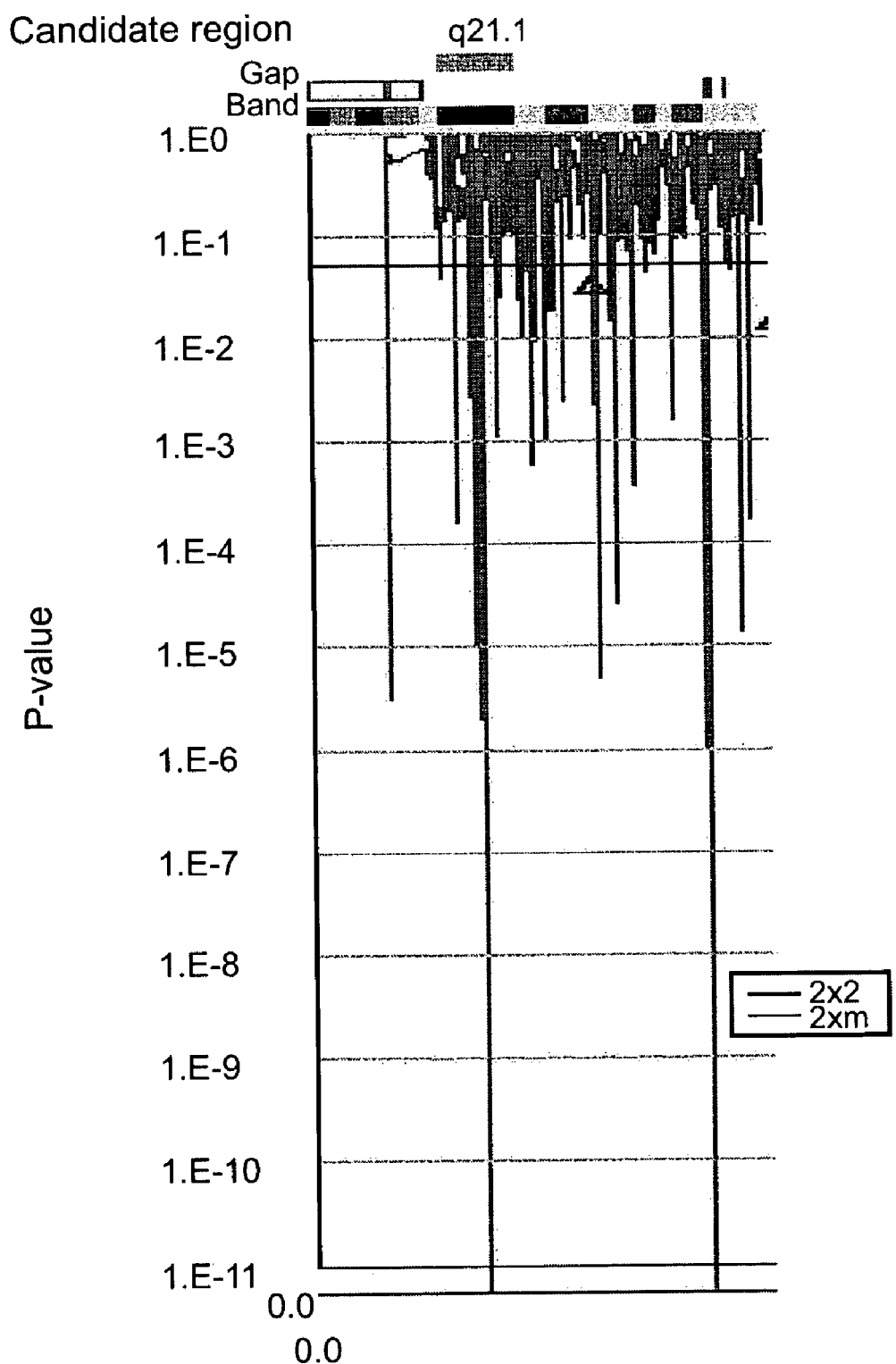
FIG. 24 shows a profile for the rheumatism susceptibility segment in the twenty-first chromosome analyzed using a method according to the present invention.
Figure 25:
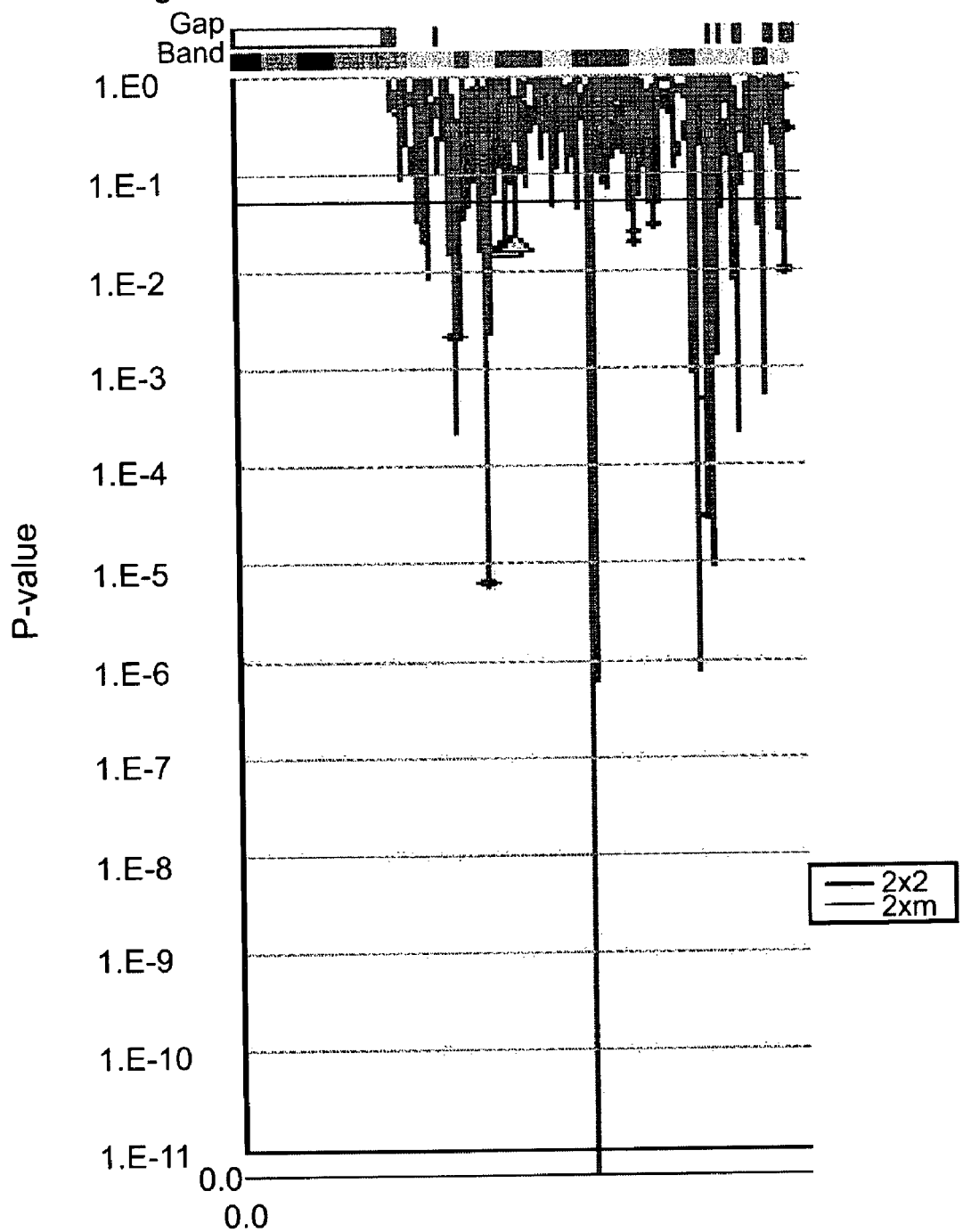
FIG. 25 shows a profile for the rheumatism susceptibility segment in the twenty-second chromosome analyzed using a method according to the present invention.

The result from performing the first screening is shown in FIG. 3. At this time, MS genetic polymorphism markers with correlation are selected through the chi-square test using a 2×m divided table and the Fisher's exact test using a 2×2 divided table. Comparison of the results from using 2×m and 2×2 divided tables show a difference in the number of markers, which indicates correlation. The test using the 2×2 divided table allows detection of the difference in each allele between the patients and the healthy subjects even for the observed markers with a high allele number.

Therefore, in the case where a specific allele and susceptibility gene indicate linkage disequilibrium, the test using the 2×2 divided table allows detection. On the other hand, in the case where there are differences in the allele frequencies on the whole between the patients and the healthy subjects, the test using the 2×m divided table allows thorough detection. Considering such statistical characteristics, an MS genetic polymorphism marker is selected for performing the second screening.

In the second screening, analysis of 102 markers that have been identified as positive by the first screening is carried out. Using other DNA samples, which are different from the DNA samples used for the first screening, the pooled DNA samples to be used for the second screening are prepared and a test is carried out.

Such a step-by-step analysis is expected to allow efficient decrease in false-positive without correcting the statistic threshold. According to the report by Barcellos et al., in the case of performing the first screening using genetic polymorphism markers throughout the genome, the detected number of the MS genetic polymorphism markers found positive is expected to be the total of 1500 false-positive markers (5% of all markers) and some of the true-positive markers. Performing the second screening In the same manner allows restriction of the number of the false-positives to 75 (5% of 1500). Determination due to Individual typing and/or TDT analysis or the like using other patient samples allow further decrease in the false-positives, thereby approaching identification of the susceptibility gene.

Analysis of 10 for the second screening showed 16 positive markers. Cornelis (1998) has reported about the linkage analysis of the first chromosome carried out for 114 paired incidence European Caucasians (Proc Natl Acad Sci USA. (1998) 95(18):10746-50. They have identified significant linkage regions in D1S228 (1p36-pter). Furthermore, Shiozawa at el. (1998) shows a significant linkage in 1p36 with a maximal lod score (MLS) being 3 or greater as the result from performing incidence pair analysis of 41 Japanese families (Int Immunol. (1998) 10(12):1891-5). Furthermore, Jawaheer at el. (2001) shows a significant linkage in D1S235 (1q43-44) as the result from performing incidence pair analysis of 257 families from the North American Rheumatoid Arthritis-Consortium (Am J Hum Genet. 2001 April;68(4): 927-36. Epub 2001 March 09.). On the other hand, Jawaheer at el. (2001) shows a significant linkage in D4S1647 (4q23-24) of the fourth chromosome (Am J Hum Genet. 2001 April; 68(4):927-36. Epub 2001 March 09.).). According to our results provided this time, positive MS genetic polymorphism markers are observed in the reported band regions.

Example 5

Analysis of Susceptibility Segment for Diseases Scattering in Entire Chromosome for Rheumatoid Arthritis Using the samples and method used in Example 4, the first and the second screening with 22,636 polymorphism microsatellites distributed throughout the chromosome as markers are performed. Moreover, the candidate segments restricted by the first and the second screening using samples of the 125 additional healthy subjects and samples of 125 additional patients for the third screening are subjected to an analysis throughout the genome or gene statistic analysis for individuals. As a result, as shown in FIGS. 4 to 26, a profile for the rheumatism susceptibility segment is identified in the first to the twenty-second chromosome except for the Y chromosome, and the X chromosome. The peaks in the figures indicate a given area of the chromosome that is associated with a susceptibility to the disease. These results are compared in quantity with the known candidate segments, and shown in Tables 4 to 6. As shown in Tables 4 to 6, three regions are known, and with a method herein, 22 regions are identified in the third screening step. Specifically, 19 additional candidate segments are identified.

TABLE 4

Correlation of known candidate segment with positiveness rate found by the present analysis

| | First screening | | |
|---|---|---|---|
| | No. of markers for analysis | No. of positive markers | No. of positive markers/1 Mb |
| Entire chromosome* | 22,636 | 2,504 | 0.811 |
| Known candidate segment | 1,843 | 160 | 0.664 |
| Other than candidate segment | 19,432 | 2,166 | 0.761 |

*Y chromosome is removed.

TABLE 5

Correlation of known candidate segment with positiveness rate found by the present analysis

| | Second screening | | |
|---|---|---|---|
| | No. of markers for analysis | No. of positive markers | No. of positive markers/1 Mb |
| Entire chromosome* | 2,204 | 117 | 0.038 |
| Known candidate segment | 145 | 30 | 0.125 |
| Other than candidate segment | 1,910 | 59 | 0.021 |

*Y chromosome is removed.

TABLE 6

Correlation of known candidate segment with positiveness rate found by the present analysis

| | Third Screening | | |
|---|---|---|---|
| | No. of markers for analysis | No. of positive markers | No. of positive markers/1 Mb |
| Entire chromosome* | 53 | 22 | 0.007 |
| Known candidate segment | 8 | 3 | 0.012 |
| Other than candidate segment | 45 | 19 | 0.006 |

*Y chromosome is removed.

Utility of the Invention

The method according to the present invention allows effective genetic correlation analysis throughout a genome irrelevant to race since DNA sequences including microsatellite genetic polymorphism markers prepared (SEQ ID NOS:1 to 27088) have genetic polymorphism, where 95% or greater of them are shared by all races. Analysis of 2471 markers of the first and the fourth chromosome for, for example, the rheumatoid arthritis is carried out, and since the first screening results in finding 102 markers positive, the second screening is then carried out. As a result, 16 markers are found positive (i.e., 6 markers in the first chromosome and 10 markers in the fourth chromosome).

Candidate segments in the susceptibility gene identified are subjected to SNP analysis, which allows identification of the susceptibility gene. Moreover, in addition to usage of the microsatellite genetic polymorphism markers included DNA sequences throughout the genome (SEQ ID NOS:1 to 27088), detailed analysis of only a specific chromosome for a phenotype of a disease or the like is carried out using the sequence numbers 1 to 27088, which allows higher speed and further accurate identification of the genes existing in the susceptibility segment for a disease.

Genes isolated by the method of this invention, proteins encoded by these genes, antibodies against these proteins, and/or polynucleotides containing at least 15 nucleotides complementary to one of the strands of these genes or to their complementary strands may be used for genetic screening and gene therapy. Furthermore, a pathogenic gene of a disease isolated by the method of this invention, a protein encoded by the gene, an antibody against the protein and/or a polynucleotide containing at least 15 nucleotides-complementary to one of the strands of this gene or to its complementary strand may be used for testing, preventing, and/or treating the disease.

SEQUENCE LISTING (27110 sequences)

SEQ ID NO: 1 - DNA, 466 bp, Homo sapiens
  chr8.fa.O7frz.212765
  Located on chromosome 1
  Distance between a terminus base of telomere on chromosomal short arm and 5'-terminus of this base sequence : 8211
  Distance between 3'-terminus of neighbour sequence of sequence listing upward to telomere on chrosomal short arm and 5'-terminus of this base sequence : 0
agatggatgatagatcattgatagatgataggtagatagtagatagattataggtagataaatagatggatgatggatggatgatagatacttgattgatagatgataggtagatagtagatagatgatagataatgatagatgatagctagatagtagatagatgtgataggtagatggtagatagagatgatgatagatggatgatagatggatggatggatgataggtgattgatagatggtagataggtggatggtagagatggtagataaatagatggatgatggatggatgatagagagctgatagtagataaggtagatagtagatagatgatagatggatggatgatagatgattgatagagagatagagagagaaggatgatagactgagcatcataacttcactgaatgctaccagttggattcaaaagtcagcaaactgaaacgtcgaatttcag

SEQ ID NO: 2 - DNA, 207 bp, Homo sapiens
  DISD22_0011793
  Located on chromosome 1
  Distance between a terminus base of telomere on chromosomal short arm and 5'-terminus of this base sequence : 100269
  Distance between 3'-terminus of neighbour sequence of sequence listing upward to telomere on chrosomal short arm and 5'-terminus of this base sequence : 91592
aaccagtgcttagcagacgccgtccctcaggatgcaggcacacgcacacacacacacacacacatgcacacgcacacacatgaacacacatggacacgcgaacacacacatgcacacgtacacacgtgtgctgacacgcggatgctgggccagggctcaccactccaacgcggggtcctggcagcccagcgggtaccagagctcaat

SEQ ID NO: 3 - DNA, 271 bp, Homo sapiens
  DISO7_10007615
  Located on chromosome 1
  Distance between a terminus base of telomere on chromosomal short arm and 5'-terminus of this base sequence : 706251
  Distance between 3'-terminus of neighbour sequence of sequence listing upward to telomere on chrosomal short arm and 5'-terminus of this base sequence : 605775
tgtgaacttcaaactctcagggttttctgaggaataaagagggtttttgcaaaatggagtcagggtcgccttctgttttttctttctttctttctttcttttttttttttttgagaaggagcctcgctctgtcccaaggttggagtgcaatggcaggatcttggctcactgcaacctctgcctcccgggttcaagtgattctctacctctgcctcctgagtagctgggactacaagcacgtgccatgtgtagagatggcatctcactgtgt

SEQ ID NO: 4 - DNA, 123 bp, Homo sapiens
  DISO7_10000554
  Located on chromosome 1
  Distance between a terminus base of telomere on chromosomal short arm and 5'-terminus of this base sequence : 1020587
  Distance between 3'-terminus of neighbour sequence of sequence listing upward to telomere on chrosomal short arm and 5'-terminus of this base sequence : 314065
acgcagattggtctgtccccagagggcgcttggagggcagcggaaggattcgggcctggataggggcttgacctagccctcctcctcctcctcctcctcctcctcgaagtgggcttgcttctt

SEQ ID NO: 5 - DNA, 410 bp, Homo sapiens
  chr1.fa.O7frz.1780396
  Located on chromosome 1
  Distance between a terminus base of telomere on chromosomal short arm and 5'-terminus of this base sequence : 1105774
  Distance between 3'-terminus of neighbour sequence of sequence listing upward to telomere on chrosomal short arm and 5'-terminus of this base sequence : 85064
gctaactttcatctttagtcacatgcaaagagaaaaaaaccagacggacttctttttcatagttaatagcagaaattattatagcactctgctgtgccaacatttgagtttcaattcagagactcaaaacctacgtttgtcaattttttttaaaaaggcgtattcctggctgggcatggtgggctataatcccaacactttaggaggtcaagtcgggaggactgcttgaatccagcagtttgcgaccagcctgggcaatatggcaaaacgctgtgtacacacacacatacacacatacacacacacacacacacaatttttgttagcaataaaaataaatttcctggtcaggccctcttcagtccacacatagaagtgataagaaaaatctattgtcaggcatttcaatt

SEQ ID NO: 6 - DNA, 102 bp, Homo sapiens
  DISD22_0011809
  Located on chromosome 1
  Distance between a terminus base of telomere on chromosomal short arm and 5'-terminus of this base sequence : 1238096
  Distance between 3'-terminus of neighbour sequence of sequence listing upward to telomere on chrosomal short arm and 5'-terminus of this base sequence : 131912
cagaggacgcagagctaagaaagttgggaccttttttttttcagcactacacacacacacacacacacgaactgcagggggctctggagccatggagttaga

SEQ ID NO: 7 - DNA, 162 bp, Homo sapiens
  D1S243
  Located on chromosome 1
  Distance between a terminus base of telomere on chromosomal short arm and 5'-terminus of this base sequence : 1525955
  Distance between 3'-terminus of neighbour sequence of sequence listing upward to telomere on chrosomal short arm and 5'-terminus of this base sequence : 287757
gctccagcgtcatggacttttccggccttgggtcgaggcctcagcgattcaggcggggccgttttggtaacacccgtgtgtgtgtgtgtgtgtgtgtgtgtgtgtgtgtgtgtgtgtgtgtccgtgcgcgcgcgcatgcgtgcaggcatgtgagcctgtgtg

SEQ ID NO: 8 - DNA, 283 bp, Homo sapiens
  DISO7_10007619
  Located on chromosome 1
  Distance between a terminus base of telomere on chromosomal short arm and 5'-terminus of this base sequence : 1667184
  Distance between 3'-terminus of neighbour sequence of sequence listing upward to telomere on chrosomal short arm and 5'-terminus of this base sequence : 141067
ctgtcaccgagaagggacctgggctggcctttcctttgcctttttaaatattttattttattttatattttattttattttattttattttatttattttattttattttattttattttattttattttattttattttaatcatagagatggggcctccctttgtggcccaggctggccttgaactcctgagttcaagcaatcctcccgcctcagcctcccaaagtgctgggatcacgggcgtggccccgcgccagctcccctgcctttcctgaggcatag

SEQ ID NO: 9 - DNA, 260 bp, Homo sapiens
  DISD22_0011823
  Located on chromosome 1
  Distance between a terminus base of telomere on chromosomal short arm and 5'-terminus of this base sequence : 2173981
  Distance between 3'-terminus of neighbour sequence of sequence listing upward to telomere on chrosomal short arm and 5'-terminus of this base sequence : 506514
tccatcagtctagctggaagattttagttaaaaaaaggctgtgtgtgtgtgtgtgtgtgtgtgtgtgtgtgtgtgtgtgtgtctgtctgtctgtctgtctgtctgcctaggtagatggatggagaaatgggcggatggatgaatgggtggatggatggatagatggatagatgaatgaatggacagatggatatgtgagtgtgtgtgtgtgtgtgtgtctgtgtctgtctgtctgtctaggtagtcagatggataaatgc

SEQ ID NO: 10 - DNA, 142 bp, Homo sapiens
  DISD22_0011835
  Located on chromosome 1
  Distance between a terminus base of telomere on chromosomal short arm and 5'-terminus of this base sequence : 2407733
  Distance between 3'-terminus of neighbour sequence of sequence listing upward to telomere on chrosomal short arm and 5'-terminus of this base sequence : 233492
gaaattaggtcaagacgtatgcatgtgcgtgtttgtgtgtgtgtgtgtgtgtgtgtgtgtgtgttggtttattgctcatgaaagcagatttgaatttcttttaagagtgtagccaattctctcattatccaactcagtttcc

SEQ ID NO: 11 - DNA, 245 bp, Homo sapiens
  DISO7_10007628
  Located on chromosome 1
  Distance between a terminus base of telomere on chromosomal short arm and 5'-terminus of this base sequence : 2597413
  Distance between 3'-terminus of neighbour sequence of sequence listing upward to telomere on chrosomal short arm and 5'-terminus of this base sequence : 189538
gttctgaggtcacctggggcttattctgccaaaagagcatctcggtgagtgtgtgtgtgtgtgtgtgtgtgtgtgtgtgtgtgtgtgtgtgtgtgtgtttgggggggtggcactaaggggtcagccagtacagggggtccaggaaggaggtggggagaagactctgtccccaggacctgggaaagggtcacagcctgcccctctgggctgatgggtggggggactttgtccctctggtctgatgg

SEQ ID NO: 12 - DNA, 129 bp, Homo sapiens
  DISO7_10007626
  Located on chromosome 1
  Distance between a terminus base of telomere on chromosomal short arm and 5'-terminus of this base sequence : 2725404
  Distance between 3'-terminus of neighbour sequence of sequence listing upward to telomere on chrosomal short arm and 5'-terminus of this base sequence : 127746
ctaccctctgcttctgtgcctctgcctgcctcctccctctcccatttccagcccctctctctctctctctctccctctctcagtctcccccttccctccatctctctctcttccttgtagctatgatgc

SEQ ID NO: 13 - DNA, 403 bp, Homo sapiens
  chr1.fa.O7frz.2488890
  Located on chromosome 1
  Distance between a terminus base of telomere on chromosomal short arm and 5'-terminus of this base sequence : 2948387
  Distance between 3'-terminus of neighbour sequence of sequence listing upward to telomere on chrosomal short arm and 5'-terminus of this base sequence : 222854
gttgtgttaatggagcttcacggctagggaaggaaagtcagaagtgggagtgaggctcctgccttctacctcttctgttggaaactgccctggaggttgcccttaccccatccatccatccactcactcacccatccatccatgcagccagccagccagccagccagccagccatccccttataaatctatccacccatccatcccctcatccatccatccaaccatccatccatccatccatccacccattgattcacctacccatccattcatccattccttcattaacccatccatgcactcattcatctatccatccatccatccatccatccatctatccatccatccatttacccatctatcccctcatctatccaccaagccattcatccacctat

SEQ ID NO: 14 - DNA, 160 bp, Homo sapiens
  DISD22_0011845
  Located on chromosome 1
  Distance between a terminus base of telomere on chromosomal short arm and 5'-terminus of this base sequence : 3311159
  Distance between 3'-terminus of neighbour sequence of sequence listing upward to telomere on chrosomal short arm and 5'-terminus of this base sequence : 362369
catcagactcccagagcagcccccgagagcctgaggcctggtctgtccccgtgaggctctgctgccggccagcagagcatgtgcctgtgtgtgtgtgtgtgtgtgtgtgtgtgtgtgtgtgtgtgtgtgtgtgtccgcgctgtctgtgggttctctgtta

SEQ ID NO: 15 - DNA, 453 bp, Homo sapiens
  AL390734.3_55495
  Located on chromosome 1
  Distance between a terminus base of telomere on chromosomal short arm and 5'-terminus of this base sequence : 3407787
  Distance between 3'-terminus of neighbour sequence of sequence listing upward to telomere on chrosomal short arm and 5'-terminus of this base sequence : 96468
aacgttgagccaatcaaacctctttataaattacccagtctcagccaggcacagtggctcacacctgtaatcccagcactttgggaggctgaggcgggctgatcacaaggtcaggagatcgagaccatcctggctaacacggtgaaacccgatttctactaaaaatacaaaaaaaaaaaaaaaaattatccgggcatggtggcaggcacctgtagtcccagctactcaggaggctgaggcaggagaatggcatgaacccaggaggtggagcttgcagtgagccgagatcgcgccactgcactccagcctgggcgacagagcgagactctgtctcaaaaaataaataaataaataaataaataaataaaaataaattacccagtctcaggtaattgccctttacaaaccttatcacaacctacactgaccatctacaacatgtttggactttct

SEQ ID NO: 16 - DNA, 163 bp, Homo sapiens
  AL136528.11_100684
  Located on chromosome 1
  Distance between a terminus base of telomere on chromosomal short arm and 5'-terminus of this base sequence : 3546940
  Distance between 3'-terminus of neighbour sequence of sequence listing upward to telomere on chrosomal short arm and 5'-terminus of this base sequence : 138700
catccgtaatacaccagtacatgcttccagcaggtaagaacctctcttttaaaatattaggtcaaaccatgaaattgctgataattaaccgttttggtcctaccaacaatacacacacacacacacacacacacacacacacgtgcagcaagttcagataatt

SEQ ID NO: 17 - DNA, 183 bp, Homo sapiens
  D1S468
  Located on chromosome 1
  Distance between a terminus base of telomere on chromosomal short arm and 5'-terminus of this base sequence : 3547022
  Distance between 3'-terminus of neighbour sequence of sequence listing upward to telomere on chrosomal short arm and 5'-terminus of this base sequence : -81
aattaaccgttttggtcctaccaacaatacacacacacacacacacacacacacacacacgtgcagcaagttcagataattcaacattatatgcagccataatatcaaattctgaatctttaatgctggtcagaggattttgaggagccccgccccaattttggagagggaagtgtgtgtcgc

SEQ ID NO: 18 - DNA, 209 bp, Homo sapiens
  D1S2845
  Located on chromosome 1
  Distance between a terminus base of telomere on chromosomal short arm and 5'-terminus of this base sequence : 3745235
  Distance between 3'-terminus of neighbour sequence of sequence listing upward to telomere on chrosomal short arm and 5'-terminus of this base sequence : 198030
gtggcattccaacctctcgtgtgtgtgtgtgtgtgtgtgtgtgtgtgtgtgtgtgtgtgtgtgtctgtgaacatcggtcaggcccttctcccctcttccaacctcagtgactgagaaagaagtacggctcctatggacaggttacccctagggctccagtgtcctactcgtggggatgttttgcaacccccaagagaagcaccctttgg

SEQ ID NO: 19 - DNA, 217 bp, Homo sapiens
  D1S2893
  Located on chromosome 1
  Distance between a terminus base of telomere on chromosomal short arm and 5'-terminus of this base sequence : 3878272
  Distance between 3'-terminus of neighbour sequence of sequence listing upward to telomere on chrosomal short arm and 5'-terminus of this base sequence : 132828
aaaacatcaactctcccctgtgtttccagcctgtgggcccatgatgaagattctggacttgccagtttccataaccacgtgagccaattccttaaaacttcagcaacccctatacaccacacacacacacacacatacacacacacacacacacacacacacacatcctattgcttctgtttctgtacatagtccctaaggcttattggggtttgag

SEQ ID NO: 20 - DNA, 230 bp, Homo sapiens
  Z98747.1_65121
  Located on chromosome 1
  Distance between a terminus base of telomere on chromosomal short arm and 5'-terminus of this base sequence : 3929699
  Distance between 3'-terminus of neighbour sequence of sequence listing upward to telomere on chrosomal short arm and 5'-terminus of this base sequence : 51210
tctaaacttgtcttgagctcatcacctctctctctctctctctctctctctctctcaactctcagtaaataatcaccagctcctggaggggctcgtgggtaggtatggagagagatgagcaatggtctacacagatgacagaacatatccacatccctaaggtaggaagagactcagtaagttctgggaaaaactagctgagtataacacagtgaaccaagtagacagag

SEQ ID NO: 21 - DNA, 329 bp, Homo sapiens
  Z98747.1_63758
  Located on chromosome 1
  Distance between a terminus base of telomere on chromosomal short arm and 5'-terminus of this base sequence : 3930832
  Distance between 3'-terminus of neighbour sequence of sequence listing upward to telomere on chrosomal short arm and 5'-terminus of this base sequence : 903
ctcatctgctctactcaaatctactaatttgaatgctaatctcatccaaaaacactgtcacagatacattcagaataatatttggccaatatctcggcccaatcaagttgacacataaagttaacctccacaagggctgcatctgaaatcctagatgggaacacttcggagaggtaccagcaggttcctcgactcactcctagggccccttgtgctaaggcttttctgtggctctcaagccatttccaggaattgagtagaaactctctctctctctctctctctccccacccaaacaatattccctgaaagctattaattcctgcaag

SEQ ID NO: 22 - DNA, 261 bp, Homo sapiens
  D1S2660
  Located on chromosome 1
  Distance between a terminus base of telomere on chromosomal short arm and 5'-terminus of this base sequence : 4091271
  Distance between 3'-terminus of neighbour sequence of sequence listing upward to telomere on chrosomal short arm and 5'-terminus of this base sequence : 160110
cacacatgcacatgcacacatgcccacatgcatatgcacacacacacacacacacacacacacattcatgcccaagcacgcccaccctcatgtctcaccatgtgcacataacacacagtcacatataccctggcacacatgcccacatgcagacacgaaacacaggcccacgcttgcatgcacacaggtatgggcacacataccatgcacacataaagacaaataccaggccagacatgatttgcccctgctggtgtcact

SEQ ID NO: 23 - DNA, 300 bp, Homo sapiens
  AL023586.1_44936
  Located on chromosome 1
  Distance between a terminus base of telomere on chromosomal short arm and 5'-terminus of this base sequence : 4125087
  Distance between 3'-terminus of neighbour sequence of sequence listing upward to telomere on chrosomal short arm and 5'-terminus of this base sequence : 33555
cagctgaagtttgagcaacagagttttggcagagcatggacaacatgagagcctcctcctgggccaggggctgtgaccacaccttggtcttgcaggaaacctctccaccctctacaaagccagcatggctctggaaatggtcattcaaggtgcaggattggcgccatctctctctctctctctctctctctctctctctctctctctcttctctctgtctctccccctctccctctctctctcttttccatcctgagacacagagtagagagagatgcctgtagtcttggaagagactcc

SEQ ID NO: 24 - DNA, 265 bp, Homo sapiens
  AL137795.10_109950
  Located on chromosome 1
  Distance between a terminus base of telomere on chromosomal short arm and 5'-terminus of this base sequence : 4181424
  Distance between 3'-terminus of neighbour sequence of sequence listing upward to telomere on chrosomal short arm and 5'-terminus of this base sequence : 56037
ccaaattcagtatgtgattcaccacactcccttctgcctgtttctatgacagtgggagcatgttccccatttccaagagggagccttggcagattccctccctgagggatgacagttagctcaggaccctaccaacctgcaatggacctttaacgaatggggaactgtattagtcagggttctctagaggtacagaactaatggaatatatatatatatatatgtacatagagttaaaatagttaattgtaagcctccattcact

SEQ ID NO: 25 - DNA, 268 bp, Homo sapiens
  AL137795.10_49634
  Located on chromosome 1
  Distance between a terminus base of telomere on chromosomal short arm and 5'-terminus of this base sequence : 4241933
  Distance between 3'-terminus of neighbour sequence of sequence listing upward to telomere on chrosomal short arm and 5'-terminus of this base sequence : 60244
ggctgtcagaattgaatgtgctgaggaggtgggtgctagcgaagtctctctaggaagacagcacaggcgtgcgcagacacacacacacacacacacactcccacccacatcggccacaatgacagatgcttgggtggacgtaacatcgctaagccaccttgctttgaatgtctcagtaagtgaggaagaaggcaaactcatttcactggctgatttctttttaaaagaaaggctgttttccgctgttaatgacctaccacttaattgc

SEQ ID NO: 26 - DNA, 278 bp, Homo sapiens
  D1S1608
  Located on chromosome 1
  Distance between a terminus base of telomere on chromosomal short arm and 5'-terminus of this base sequence : 4290346
  Distance between 3'-terminus of neighbour sequence of sequence listing upward to telomere on chrosomal short arm and 5'-terminus of this base sequence : 48145
gatggcttttggggactattaagtcagagtccttcagaaaaacaaaatcaacaaggtggatagatagatagatagatgatagatagatagatagatagatagatagatagatagatagatagatagagatagatctgatatgtatataaaataagtgtctctcagagagctacctgccatctcttatctaccaatctatctatctattccctctccaggcacaagagacacaaatgtgaccaatctccattttacgttctgtgtcacttggctcagtg

SEQ ID NO: 27 - DNA, 108 bp, Homo sapiens
  DISO7_10007647
  Located on chromosome 1
  Distance between a terminus base of telomere on chromosomal short arm and 5'-terminus of this base sequence : 4377407
  Distance between 3'-terminus of neighbour sequence of sequence listing upward to telomere on chrosomal short arm and 5'-terminus of this base sequence : 86783
tgttggatgaaattcttattctgtatacaaataattgtatacataacacacacacacacacacacacacacacacacacacacattatctctcagcaaatcctgttga

SEQ ID NO: 28 - DNA, 208 bp, Homo sapiens
  DISD22_0011851
  Located on chromosome 1
  Distance between a terminus base of telomere on chromosomal short arm and 5'-terminus of this base sequence : 4488192
  Distance between 3'-terminus of neighbour sequence of sequence listing upward to telomere on chrosomal short arm and 5'-terminus of this base sequence : 110677
  misc_feature (34)...(133): n = A,C,T, or G
gcaaggctataagcaggggcagtttttcctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagatagatagatagatagatagatagatagatagatagatagacagatagacataaggagaattggagagtga

SEQ ID NO: 29 - DNA, 224 bp, Homo sapiens
  D1S2795
  Located on chromosome 1
  Distance between a terminus base of telomere on chromosomal short arm and 5'-terminus of this base sequence : 4721250
  Distance between 3'-terminus of neighbour sequence of sequence listing upward to telomere on chrosomal short arm and 5'-terminus of this base sequence : 232850
ttagttggattagacacggcctcgcctctcccccacaacacacacacacacacacacacacacacacacacacacacacacacacatgaatggatacagaagcctgaggctgtggtccacagtggttaaaagccaggagccagcgtcctccacctggctcccattagaatcaccccaagagatgctgccaggccccctctgtaagccacagtcatcagggtctc

SEQ ID NO: 30 - DNA, 312 bp, Homo sapiens
  Z97988.1_66333
  Located on chromosome 1
  Distance between a terminus base of telomere on chromosomal short arm and 5'-terminus of this base sequence : 4767873
  Distance between 3'-terminus of neighbour sequence of sequence listing upward to telomere on chrosomal short arm and 5'-terminus of this base sequence : 46399
ttacttatgcaaatttctgcagcctgcttcgattcttaccttggaaatggggttttcttttccaccacatgggtgggctgcaaatttttcaaacttttacactctgcttcccctttaaatataaatttcaggttctggtcatttcttgaacccgggacgcagaggttgctgtgagccgagatcacgccactgcactccagcctgggcgacagagtgagactccacctcaaaaaaaaaaagaaagaaagaaagaaagaaagaaaggcataatagaattttggggggatgatggaaatgttctaaacttaattg

SEQ ID NO: 31 - DNA, 347 bp, Homo sapiens
  DISO7_00007075
  Located on chromosome 1
  Distance between a terminus base of telomere on chromosomal short arm and 5'-terminus of this base sequence : 4857551
  Distance between 3'-terminus of neighbour sequence of sequence listing upward to telomere on chrosomal short arm and 5'-terminus of this base sequence : 89366
tggatgccctgtatcctacctaacgttgacagagggctcaaggggtaatttgaaatctaattgctgagtgttttcatttggcattagggacattccacttggtaaatatcaaggagctggaagccttccctgatcctctgggcaaagtttattgatgctgccctggccatgaatgaagaacttgcaaaagccagaggagaaagagagagagagtgagacagagagcgagagagagagagagagagagagagaagagagactgcactccctggaagcagggaggggcaggtgcaggaggggaaggaagtcactgggccaagcccctccagggtgccttgtctgcagta

SEQ ID NO: 32 - DNA, 248 bp, Homo sapiens
  G07859
  Located on chromosome 1
  Distance between a terminus base of telomere on chromosomal short arm and 5'-terminus of this base sequence : 4902068
  Distance between 3'-terminus of neighbour sequence of sequence listing upward to telomere on chrosomal short arm and 5'-terminus of this base sequence : 44170
gcaggttacggataagcaaaggaggaagctagagtgaaccttgtggaatagggttagaattggagacatcaatatgaacgcatagtttgcttaatttagatacagatggagagatagatgatagatagatagatagatagatagatagatagatagatagatgatagatagataatgcatatacatggttcactctacatacatatacttcctagctctacccactgagacagccctgtagcaatgag

SEQ ID NO: 33 - DNA, 174 bp, Homo sapiens
  DISO7_10007646
  Located on chromosome 1
  Distance between a terminus base of telomere on chromosomal short arm and 5'-terminus of this base sequence : 5104220
  Distance between 3'-terminus of neighbour sequence of sequence listing upward to telomere on chrosomal short arm and 5'-terminus of this base sequence : 201904
atgggcattaacagcaccacgaatggtgcgcacacacacacacacacgcaaacacacacacacacgcaaacacacacacacacgcaaacacacacagacacgcacacagacacgcacacacacatgcacacacagacacgcacacgtgcacacatgcagccttccacctctcac

SEQ ID NO: 34 - DNA, 271 bp, Homo sapiens
  D1S2633
  Located on chromosome 1
  Distance between a terminus base of telomere on chromosomal short arm and 5'-terminus of this base sequence : 5241859
  Distance between 3'-terminus of neighbour sequence of sequence listing upward to telomere on chrosomal short arm and 5'-terminus of this base sequence : 137465
gtgcacatcaccatacctggctgtgtgtgtgtgtgtgtgtgtgtgtgtgtgtgtatttttagtagagatgggttttcagtatgttgctgggctggtctagaattccagggctcaagagatttacccaccaggcatgggtggctcacatctgtaatcccagcactttgggaggccgaggcaggcagatcacttgaggtcaggagttcgagaccatcttggccaacatagtgaaaccccattgtaaaaaatacaaaaattagccgggcatggt

SEQ ID NO: 35 - DNA, 210 bp, Homo sapiens
  D1S2870
  Located on chromosome 1
  Distance between a terminus base of telomere on chromosomal short arm and 5'-terminus of this base sequence : 5454177
  Distance between 3'-terminus of neighbour sequence of sequence listing upward to telomere on chrosomal short arm and 5'-terminus of this base sequence : 212047
gatcatgccaatgcactatagcctgggtgagagaccctgcctcaaaacaaaacaaaaaaccatacataaataaaaaaaatacacacacacacacacacacacacacacacacacacacacatagagcaggtgcagtggctcacacctataatccttacacttctttttctttttttctttttgagacagattcttgctgtgtcaccctgg

SEQ ID NO: 36 - DNA, 166 bp, Homo sapiens
  D1S253
  Located on chromosome 1
  Distance between a terminus base of telomere on chromosomal short arm and 5'-terminus of this base sequence : 5524040
  Distance between 3'-terminus of neighbour sequence of sequence listing upward to telomere on chrosomal short arm and 5'-terminus of this base sequence : 69653
ttaccggacgccacacacagagggcagagaggcccacccggccacctcctgactaggtactaggtcatggcttcagagagagagagagagagagcgcaagtgtgtgtgtgtgtgtgtgtgtgtgtagggcacgtgtgtgcgtgtgtttaaggggcttagtagcggc

SEQ ID NO: 37 - DNA, 180 bp, Homo sapiens
  AL031847.17_10172
  Located on chromosome 1
  Distance between a terminus base of telomere on chromosomal short arm and 5'-terminus of this base sequence : 5524092
  Distance between 3'-terminus of neighbour sequence of sequence listing upward to telomere on chrosomal short arm and 5'-terminus of this base sequence : -114
ctaggtactaggtcatggcttcagagagagagagagagagagcgcaagtgtgtgtgtgtgtgtgtgtgtgtgtagggcacgtgtgtgcgtgtgtttaaggggcttagtagcggcagagctgcagcccacagactgagttcttctaggttgatctgcctcataaagaaactgacttgtgac

SEQ ID NO: 38 - DNA, 144 bp, Homo sapiens
  DISO7_10007639
  Located on chromosome 1
  Distance between a terminus base of telomere on chromosomal short arm and 5'-terminus of this base sequence : 5692908
  Distance between 3'-terminus of neighbour sequence of sequence listing upward to telomere on chrosomal short arm and 5'-terminus of this base sequence : 168636
tgaagtgccactgtcctcgccttcctcctcctcctcctcctcctcctcttcctcctcctgctcatcctcctcctcttccaggctctgcaggggctgctgactgcctgggggctcctgtgcacgcagctgttgcagctggttctg

SEQ ID NO: 39 - DNA, 212 bp, Homo sapiens
  DISD22_0011856
  Located on chromosome 1
  Distance between a terminus base of telomere on chromosomal short arm and 5'-terminus of this base sequence : 5865718
  Distance between 3'-terminus of neighbour sequence of sequence listing upward to telomere on chrosomal short arm and 5'-terminus of this base sequence : 172666
tttggcaggttctggaaggggagggtggccaggagagaggtgggatgagagggggaaaggctctagcacacagccagggaggagagagggagggagggagggggagagagagagagagagagagagagagtgagtcctctggggatgcccggccagagcctacccattcctgggtttcagcaccaaaatgtaaggttagccaagagaaagaa

SEQ ID NO: 40 - DNA, 311 bp, Homo sapiens
  AL031447.4_31308
  Located on chromosome 1
  Distance between a terminus base of telomere on chromosomal short arm and 5'-terminus of this base sequence : 5965290
  Distance between 3'-terminus of neighbour sequence of sequence listing upward to telomere on chrosomal short arm and 5'-terminus of this base sequence : 99360
tgagcaagaaactctgtcttagaaaagaaaagaaaagaaaagaaaagaaaagaaaagaaaagaaaagaaaagaaaagaaaagaaggcatttcaattccagttcagcccttcttagctcgtcatgaaaggaagaccatctagttgacatttcaaagaagtggaaaggccaccgtgaaagaggcaaccgcactgcacgatttctaagggtcctgtttatggtgtgaaattgtgtgcaccggtgagaaacacacagtgtgggaacaggacagaaacagtggttactctttttctatcacgaccaaagttatcag

SEQ ID NO: 41 - DNA, 184 bp, Homo sapiens
  D1S2642
  Located on chromosome 1
  Distance between a terminus base of telomere on chromosomal short arm and 5'-terminus of this base sequence : 6086919
  Distance between 3'-terminus of neighbour sequence of sequence listing upward to telomere on chrosomal short arm and 5'-terminus of this base sequence : 121318
cccagactgtgtgcagagtgtgagagagagagagagagagtgtgtgtgtgtgtgtgtgtgtgtgtgtgtgtgtagacaaaagtaaagtcagccttcttaatctgattgtgtaggcataacttttaggttgtttagatacatgattggttggaatgcttatttaatatttgaacggcagcatcgc

SEQ ID NO: 42 - DNA, 132 bp, Homo sapiens
  D1S214
  Located on chromosome 1
  Distance between a terminus base of telomere on chromosomal short arm and 5'-terminus of this base sequence : 6198597
  Distance between 3'-terminus of neighbour sequence of sequence listing upward to telomere on chrosomal short arm and 5'-terminus of this base sequence : 111494
ccgaatgacaaggtgagactgtcacacacacacacacacacacacacacacacacaaaaaaaaaaataaaaataaaaactcgtactggcttttaggaatgcagaatgctacagccactttggaaacaacatt

SEQ ID NO: 43 - DNA, 233 bp, Homo sapiens
  Z97635.10_5196
  Located on chromosome 1
  Distance between a terminus base of telomere on chromosomal short arm and 5'-terminus of this base sequence : 6355815
  Distance between 3'-terminus of neighbour sequence of sequence listing upward to telomere on chrosomal short arm and 5'-terminus of this base sequence : 157086
agactgcatctcgaaatagatagatagatagatagatagatagatagatagatagatagatagatagcacagctctttgtgtggctcccatctacttaaaagccttcccctggttcttcgggataaaactccattgcctggcattgaattcctccacagtttggtgcctccccctccacctggctttgagttctgcctttctattccttgtcctgcggactctcattacttta

SEQ ID NO: 44 - DNA, 344 bp, Homo sapiens
  Z97635.10_24779
  Located on chromosome 1
  Distance between a terminus base of telomere on chromosomal short arm and 5'-terminus of this base sequence : 6375265
  Distance between 3'-terminus of neighbour sequence of sequence listing upward to telomere on chrosomal short arm and 5'-terminus of this base sequence : 19217
acggagcatatacatgcacatatacacacaactacacacatgtacacacaacacacatgcacaagcaaatattcaacacataatgcatgcatgcagcacagaaatacacatacatatacatacatgtacacacatgcataaatacacaacacacacacacacacacacacacacacacacacacacacacacacagcttcctgtattggtcactgttctcttgtaagaagtctctgggaaaatttttcttcgttatgtgtcttagcgagttgaaattttttgggtagaggaaattttctcctcgaagaaaaaattaattattctatactggctactcctgacct

SEQ ID NO: 45 - DNA, 195 bp, Homo sapiens
  D1S2663
  Located on chromosome 1
  Distance between a terminus base of telomere on chromosomal short arm and 5'-terminus of this base sequence : 6470923
  Distance between 3'-terminus of neighbour sequence of sequence listing upward to telomere on chrosomal short arm and 5'-terminus of this base sequence : 95314
atgactgttctctgttttaggaacctgcgtgtgggatgttcttgggagatgtgaagagagaggaaggaaaggacactcaaattattgtcccccaccacacacacacacacacacacacacacacacacacacacacacacacacaatctacttgcttatttatctgctcatttcattgacgcttcccaacaactg

SEQ ID NO: 46 - DNA, 420 bp, Homo sapiens
  Z98052.1_67106
  Located on chromosome 1
  Distance between a terminus base of telomere on chromosomal short arm and 5'-terminus of this base sequence : 6504578
  Distance between 3'-terminus of neighbour sequence of sequence listing upward to telomere on chrosomal short arm and 5'-terminus of this base sequence : 33460
agcttggaaatagcctgatggtgtccaggcaagggctgaggaggaggatagcaggagagtccagggaagccaagcaggctggctcagggggccgttgcaggcactgcgtgaccccagcattcatcacatactggcttaatgtgtgtgtgtgtgtgtgtgtgtgagagagagagagagagagagaggttttattttttttgaaagagtctcgctctgtcgcccaggctggagtgcagtggcatgatctcgtctcggctcactgcaacctctgcctcccaggttcaagcaattctcctgtcttagtctcccaagtagctgggattacaggtgccaaccaccatgcctggctaatttttgtatttttggtggaggcggggtttcaccatgttggtcaggctggtcttgaacttctgacctcag

SEQ ID NO: 47 - DNA, 249 bp, Homo sapiens
  D1S2694
  Located on chromosome 1
  Distance between a terminus base of telomere on chromosomal short arm and 5'-terminus of this base sequence : 6555094
  Distance between 3'-terminus of neighbour sequence of sequence listing upward to telomere on chrosomal short arm and 5'-terminus of this base sequence : 50096
tcacggggtattaagtggtttttaaattatcattgcaaaattttccaaatccatgtggattttttttgttgttgtttatggaaggggaaagaaattgtgtgtgtgtgtgtgtgtgtgtgtgtgtgtgtgtgtgtgtgtgtatgattaatgagtctaaatccaaatttctactttgtggaacgggtagaaaccaaccccctgttctttcccattgtgccagaaatccatgttcctccgcttcttggacct

SEQ ID NO: 48 - DNA, 371 bp, Homo sapiens
  AL034378.3_111279
  Located on chromosome 1
  Distance between a terminus base of telomere on chromosomal short arm and 5'-terminus of this base sequence : 6583789
  Distance between 3'-terminus of neighbour sequence of sequence listing upward to telomere on chrosomal short arm and 5'-terminus of this base sequence : 28446
actgtgccattgtctcactaacacagtcatagatactgcataacagaatagttatggttatgttccaataaaactttatttacaaaacaggcagtgagccaaatttggcccaaggaccatagtttgctgacctctgcctggaaagtaatgtgtcgtttttctctggctgctttcaagatttttctttttcttttcttttcttttctttctttctttctttctttctttctttctttctttctttcttttttctttctttctttctttctttcctttctttctctctctctctctctctctctctttctttctttctttctttctttctttctttctttctttcttttttttaagacagtcttgctctgttg

SEQ ID NO: 49 - DNA, 336 bp, Homo sapiens
  Z97987.1_34067
  Located on chromosome 1
  Distance between a terminus base of telomere on chromosomal short arm and 5'-terminus of this base sequence : 6583824
  Distance between 3'-terminus of neighbour sequence of sequence listing upward to telomere on chrosomal short arm and 5'-terminus of this base sequence : -336
ctgcataacagaatagttatggttatgttccaataaaactttatttacaaaacaggcagtgagccaaatttggcccaaggaccatagtttgctgacctctgcctggaaagtaatgtgtcgtttttctctggctgctttcaagatttttctttttcttttcttttcttttctttctttctttctttctttctttctttctttctttctttcttttttctttctttctttctttctttcctttctttctctctctctctctctctctctctttctttctttctttctttctttctttctttctttctttcttttttttaagacagtcttgctctgttg

SEQ ID NO: 50 - DNA, 163 bp, Homo sapiens
  G07827
  Located on chromosome 1
  Distance between a terminus base of telomere on chromosomal short arm and 5'-terminus of this base sequence : 6656168
  Distance between 3'-terminus of neighbour sequence of sequence listing upward to telomere on chrosomal short arm and 5'-terminus of this base sequence : 72008
gcctctttgttgcagtgatttcttagcctagatagatacttgcttcctagatgatagatagatagatagatagatagatagatagatagatagatattcctatagcctcaaaggttgagtctaggaaattttgagaaaatgctttccttttgccaatgagttc

SEQ ID NO: 51 - DNA, 283 bp, Homo sapiens
  AL034378.3_38820
  Located on chromosome 1
  Distance between a terminus base of telomere on chromosomal short arm and 5'-terminus of this base sequence : 6656179
  Distance between 3'-terminus of neighbour sequence of sequence listing upward to telomere on chrosomal short arm and 5'-terminus of this base sequence : -152
gcagtgatttcttagcctagatagatacttgcttcctagatgatagatagatagatagatagatagatagatagatagatagatattcctatagcctcaaaggttgagtctaggaaattttgagaaaatgctttccttttgccaatgagttcatttatttatacaaccagtatctatttactgagcaactagtatgtgccaggcactgtgctaaacactgggaatataatgatgaacaaaaccagaccatctccatgcttgtgtggagcttagcgttctatgt

SEQ ID NO: 52 - DNA, 188 bp, Homo sapiens
  D1S2666
  Located on chromosome 1
  Distance between a terminus base of telomere on chromosomal short arm and 5'-terminus of this base sequence : 6668117
  Distance between 3'-terminus of neighbour sequence of sequence listing upward to telomere on chrosomal short arm and 5'-terminus of this base sequence : 11655
tgcctatgcttttgaggtattatttttaaaaaatccttacccagaccaatatcatgaagcatttcccctatattttcttgtagttgtgtgtgtgtgtgtgtgtgtgtgtgtgtgtctgtgtgtgtgtctgtgtgtgtggtgtttctttttttttcttttttttttgttttctgagatggagtttcgct

SEQ ID NO: 53 - DNA, 83 bp, Homo sapiens
  D1S508
  Located on chromosome 1
  Distance between a terminus base of telomere on chromosomal short arm and 5'-terminus of this base sequence : 6820713
  Distance between 3'-terminus of neighbour sequence of sequence listing upward to telomere on chrosomal short arm and 5'-terminus of this base sequence : 152408
agctggggaatatatgtatcatatgcacacacacacacacacacacacacacacacacacacacacagagttggccttccaca

SEQ ID NO: 54 - DNA, 305 bp, Homo sapiens
  Z98884.11_25458
  Located on chromosome 1
  Distance between a terminus base of telomere on chromosomal short arm and 5'-terminus of this base sequence : 7025996
  Distance between 3'-terminus of neighbour sequence of sequence listing upward to telomere on chrosomal short arm and 5'-terminus of this base sequence : 205200
ttaatttgaactgccatgataaaacaaacaaacaaacaaacaaacaaacaaacaaaaacaggggaagccacacatgatggcgtgtgcctgtaatcccagctcctcaagaggctgaggccggaggatcttcttgaacccaggtgttgatgtccagcttggacctcgtctcaaaaaaaaaccagaggaaaacaaaataaaaccatctgcaattagacttgtaccgcaaaagggtttttgtccaaatttttgatcttttagtaatattacctacctgagatactggtctgatcctaacaccagtatct

SEQ ID NO: 55 - DNA, 305 bp, Homo sapiens
  AC025220.2_34081
  Located on chromosome 1
  Distance between a terminus base of telomere on chromosomal short arm and 5'-terminus of this base sequence : 7134646
  Distance between 3'-terminus of neighbour sequence of sequence listing upward to telomere on chrosomal short arm and 5'-terminus of this base sequence : 108345
ctggccaatatggtgaaaccccatctctactaaaaatacaaaaattagccgggagtagtggtgggcgcctatgatcccagctacttgggaggctaaggcaggagaattgcttgaacccaggaggtgggggttgcagtgagccgagatcgtgccattgcactccagcctgggccacaaaggaagactctgtaggaaaagaaagagagagagagagggaaggaaggaaggaagaaaaggaatgaaggaaggaaggaaggaaggaaggaaggaaggaaggtgaagcatgttggaaagacactggatag

SEQ ID NO: 56 - DNA, 290 bp, Homo sapiens
  AC025220.2_169158
  Located on chromosome 1
  Distance between a terminus base of telomere on chromosomal short arm and 5'-terminus of this base sequence : 7162833
  Distance between 3'-terminus of neighbour sequence of sequence listing upward to telomere on chrosomal short arm and 5'-terminus of this base sequence : 27882
gccactcatccattcagacatccatccatccatccacccatcatccatgcatccattcatccatccacccacctatcatccatccatccatccatccatccatccatccacaacttttatttcattgtatataattctcatttggaaagggaccaaaagggaacatctttggaaagttttccaaaggtaaattttcctttcttgtttcttccttgtccatttgtctgtgtccttggtagtcaacatgtaaccacagggcagccttggtaggtactttgctaaccaacatc

SEQ ID NO: 57 - DNA, 350 bp, Homo sapiens
  AL365441.6_34087
  Located on chromosome 1
  Distance between a terminus base of telomere on chromosomal short arm and 5'-terminus of this base sequence : 7169288
  Distance between 3'-terminus of neighbour sequence of sequence listing upward to telomere on chrosomal short arm and 5'-terminus of this base sequence : 6165
agccagactcgatctaagaaagaaagaaaagaaagaaagaaagaaagaaagaaagaaagaaagaaagaaagaaagaaagaaagaaagaaaattgccaagagtagattttgagtattctcatcacaaaaattggtaagtatatgaggcaatgagtatgttcattagtttgcttcagccattccacaatgtatagatattctaacacatcatgctgtgtaccataaacatgtacaatttttgtcaattaaaaataattattataaatgttataaagaaagaaaccagatcaaaaaaggagcacatactctattgtttcatttatgtaaactctagaacattcaagctcatct

SEQ ID NO: 58 - DNA, 277 bp, Homo sapiens
  AC025225.3_28192
  Located on chromosome 1
  Distance between a terminus base of telomere on chromosomal short arm and 5'-terminus of this base sequence : 7184138
  Distance between 3'-terminus of neighbour sequence of sequence listing upward to telomere on chrosomal short arm and 5'-terminus of this base sequence : 14500
ggtgaacgtcttaactgtttatctcactttatagcacagcaagaaagaaagaaagaaaagaaagaaaggaagaaagaaagaaagaaaaagagaaagaaagaaagaaagaaagaaagaaagaaagaaagaaagaaagaaagaaagaaagaaaagagggagggagggaggggaaacttctaagatcattccagattttttttcttgactttactccctactacccccttgaaattcatacttgcacacagaaactcttcaaacttcctgtcttgagtac

SEQ ID NO: 59 - DNA, 243 bp, Homo sapiens
  AL009183.10_21042
  Located on chromosome 1
  Distance between a terminus base of telomere on chromosomal short arm and 5'-terminus of this base sequence : 7184141
  Distance between 3'-terminus of neighbour sequence of sequence listing upward to telomere on chrosomal short arm and 5'-terminus of this base sequence : -274
gaacgtcttaactgtttatctcactttatagcacagcaagaaagaaagaaagaaaagaaagaaaggaagaaagaaagaaagaaaaagagaaagaaagaaagaaagaaagaaagaaagaaagaaagaaagaaagaaagaaagaaagaaaagagggagggagggaggggaaacttctaagatcattccagattttttttcttgactttactccctactacccccttgaaattcatacttgcacac

SEQ ID NO: 60 - DNA, 289 bp, Homo sapiens
  AL034417.14_44465
  Located on chromosome 1
  Distance between a terminus base of telomere on chromosomal short arm and 5'-terminus of this base sequence : 7273271
  Distance between 3'-terminus of neighbour sequence of sequence listing upward to telomere on chrosomal short arm and 5'-terminus of this base sequence : 88887
atctttatgtcaaagtcgcatattctgtggtggcctgtccggatccccttcaagtctctctgacctttcttctgccctccagcctgggtgacagagctagagtctgtctcaaataataataataatacaataaataaataaataaataaataaataaataaagtacgctttccattcttggtttgctaagagtttttgtcatgagtagatgttgaaatttattgaatggttttccatcatcagtgacatcttctggcttttctcctttaatctattaccatggtgaatt

SEQ ID NO: 61 - DNA, 113 bp, Homo sapiens
  D1S1612
  Located on chromosome 1
  Distance between a terminus base of telomere on chromosomal short arm and 5'-terminus of this base sequence : 7335703
  Distance between 3'-terminus of neighbour sequence of sequence listing upward to telomere on chrosomal short arm and 5'-terminus of this base sequence : 62143
tcccatgccaaaattcttaggctgtttcttttctttctctttccttccttccttccttccttccttccttccttccttccttccttccttccttccttctttctctttctttc

SEQ ID NO: 62 - DNA, 262 bp, Homo sapiens
  DISD22_0011859
  Located on chromosome 1
  Distance between a terminus base of telomere on chromosomal short arm and 5'-terminus of this base sequence : 7567057
  Distance between 3'-terminus of neighbour sequence of sequence listing upward to telomere on chrosomal short arm and 5'-terminus of this base sequence : 231241
atccacacgtgggagaagggaagcgtgtgtgtgtgtgtgtgtgtgtgtgtgtgtgagatggatggaattgtgtccctctccggccccaaattcataggtgggagccctaatctccaacgtgattgtatttggagataaggcctttaagaatgtaattaaggctaaatgagtgggggttctaatttgtgtggggacctaatccagtagaactgatgtccttagaaaaaggaagagatgagctgccgggagatgctcatgaaca

SEQ ID NO: 63 - DNA, 109 bp, Homo sapiens
  DISO7_10195108
  Located on chromosome 1
  Distance between a terminus base of telomere on chromosomal short arm and 5'-terminus of this base sequence : 7681924
  Distance between 3'-terminus of neighbour sequence of sequence listing upward to telomere on chrosomal short arm and 5'-terminus of this base sequence : 114605
ctctccttcaaggactcccccaccgcccaacacacacacacacatgcacacacgcacacacacacacactccaactgcacccaagtcccacctgggttcatgcaatatt

SEQ ID NO: 64 - DNA, 373 bp, Homo sapiens
  AL356072.8_174468
  Located on chromosome 1
  Distance between a terminus base of telomere on chromosomal short arm and 5'-terminus of this base sequence : 7791557
  Distance between 3'-terminus of neighbour sequence of sequence listing upward to telomere on chrosomal short arm and 5'-terminus of this base sequence : 109524
atccactcatccaaatatcctcccatccaaatatccactcatctatatatccatccatctacatacccacccattcatccgtccacataaccatccgtccactcatccaaatatccacccatctgaatatctactcatctatatatccatccatccacatatccacccatccacccatctaaatatccacttctccatatatccatccatccatccatccatccatccatccatccatccatccacatatccacccatccacccatccaaatatccacttctccatatatacatccatccatctatccatccatccatccacatatccacccatccacccatccaaatatccacttctccttagatacatcca

SEQ ID NO: 65 - DNA, 314 bp, Homo sapiens
  AL008734.10_17677
  Located on chromosome 1
  Distance between a terminus base of telomere on chromosomal short arm and 5'-terminus of this base sequence : 8027226
  Distance between 3'-terminus of neighbour sequence of sequence listing upward to telomere on chrosomal short arm and 5'-terminus of this base sequence : 235296
gacaccagatgacacgaagccctggggtttggcttcagtgaacttcttctcccagtgggaggaataccccaccactacacacacacatgcacgtgcacacacgcacatatacacacacacacacacacacacacacattcttgcacgagtgaaaggggatgtcccttacatcctttgacggcaaaagccctcaacccagtgtttccagagcagccatgggacggggtgggttggggttccaaacacccatcagagccgcgtgaccctactggatttctcggtggcagcctgggctctaagcagatgagcttctg

SEQ ID NO: 66 - DNA, 356 bp, Homo sapiens
  AL008734.10_57307
  Located on chromosome 1
  Distance between a terminus base of telomere on chromosomal short arm and 5'-terminus of this base sequence : 8066737
  Distance between 3'-terminus of neighbour sequence of sequence listing upward to telomere on chrosomal short arm and 5'-terminus of this base sequence : 39197
gcctgattaccacgttttaaatgcaagggagagcctaggcaacatggcgagaccccatctctacaaaaacttttaaaaattagccaggtatggtgacacatacctataattcccgctactcaggatgctgaggtgggaagatcgcttgagcccaggagttcgaggctgcagtgagctgtgaccgcaccactgcactccagcctgggtgacagagagagaatctgtcactcacacacacacacacacacacacacacacacactctctctctctctctctcacactctctctctctctctctccgcaggggagcacacaggaattgaggggggatctagcttatctgcacatctcag

SEQ ID NO: 67 - DNA, 182 bp, Homo sapiens
  AL008734.10_71399
  Located on chromosome 1
  Distance between a terminus base of telomere on chromosomal short arm and 5'-terminus of this base sequence : 8081006
  Distance between 3'-terminus of neighbour sequence of sequence listing upward to telomere on chrosomal short arm and 5'-terminus of this base sequence : 13913
cttgtaaagtgattgccttagtccactccacacctccccaaccgcacgcgcgcacacacacacacacacacacacactcacactctcacacacacacacacactccatctactgggtaaagtgctccctgcagaagaaaagcagctgtaagagagcaggagtgctttaaatgatctaatcca

SEQ ID NO: 68 - DNA, 239 bp, Homo sapiens
  Z98044_30152
  Located on chromosome 1
  Distance between a terminus base of telomere on chromosomal short arm and 5'-terminus of this base sequence : 8124791
  Distance between 3'-terminus of neighbour sequence of sequence listing upward to telomere on chrosomal short arm and 5'-terminus of this base sequence : 43603
cagtgatgtcctcaggaagtctccctccttctttctaacaacaacaacaacaacaacaacaacaacaacaacagcaggccttctacacagaggggaaactagggcagcaaggagactggccctgagtgcgttccagcagggaggccaactgctgagggcctggccagctggggaggctgtggagctcagtggttagaggctcaggctctgaggtgccaagacctcagttccaattccag

SEQ ID NO: 69 - DNA, 299 bp, Homo sapiens
  Z98044.13_78059
  Located on chromosome 1
  Distance between a terminus base of telomere on chromosomal short arm and 5'-terminus of this base sequence : 8172633
  Distance between 3'-terminus of neighbour sequence of sequence listing upward to telomere on chrosomal short arm and 5'-terminus of this base sequence : 47603
cactcctggtcttacttcagtaatgaaatgtacatggaattgatgcaattggtctttctgaacagtttatttagaaggggagttttagtctccccgctcaaacacacacacacacacacacacacacacttcctcctttattttcctttcttgggctctgagtttgtgataaactcaaaacctggaaatacctacattcctgaccaccttctacctctcagtatatctattctgcctaaccccttgtgggttatattagaatgcgctatcttaaccatatctgcatttaaagtgcttct

SEQ ID NO: 70 - DNA, 265 bp, Homo sapiens
  D1S1615
  Located on chromosome 1
  Distance between a terminus base of telomere on chromosomal short arm and 5'-terminus of this base sequence : 8254201
  Distance between 3'-terminus of neighbour sequence of sequence listing upward to telomere on chrosomal short arm and 5'-terminus of this base sequence : 81269
ccatcattctttcatgcctcagagagatggacattcctgtagtacaattccagtcagacatttcttccgttcaaaacatctcagggtgccctaccataagccttataaaatacaaataagaaaacttatcctaggacatatactgagccatccatccatccatccatccatccatccatccatccgtccgtccgtccgtccatccaacaaatatttaagtacctactataagccaggaattgtcctaggtgttggggataaagca

SEQ ID NO: 71 - DNA, 276 bp, Homo sapiens
  AL096855.35_73464
  Located on chromosome 1
  Distance between a terminus base of telomere on chromosomal short arm and 5'-terminus of this base sequence : 8254240
  Distance between 3'-terminus of neighbour sequence of sequence listing upward to telomere on chrosomal short arm and 5'-terminus of this base sequence : -226
tagtacaattccagtcagacatttcttccgttcaaaacatctcagggtgccctaccataagccttataaaatacaaataagaaaacttatcctaggacatatactgagccatccatccatccatccatccatccatccatccatccgtccgtccgtccgtccatccaacaaatatttaagtacctactataagccaggaattgtcctaggtgttggggataaagcaacaaacagggacaggtacagaggctcacacctgtaattctagcactttgg

SEQ ID NO: 72 - DNA, 283 bp, Homo sapiens
  HUMUT1962
  Located on chromosome 1
  Distance between a terminus base of telomere on chromosomal short arm and 5'-terminus of this base sequence : 8349364
  Distance between 3'-terminus of neighbour sequence of sequence listing upward to telomere on chrosomal short arm and 5'-terminus of this base sequence : 94848
aggtgggataggaaatggaaaaggatgaggcagaggcctctgaaaggagggcagaggcagagctccatctccacacagaggaggtcggctggttttcagttttgttttgttgtgggggaagaggaggtaccagtcaatagcaagctgaggagtttaaaaaaagaaggaaggaaggaaggaaggaagggagggagggagggagggagggaggaaggaaggaaggaaggaaggaaggaaggaaggaaggaaggaaggaaggaagtccacatatctgtaaggtggg

SEQ ID NO: 73 - DNA, 394 bp, Homo sapiens
  AC021953.3_12793
  Located on chromosome 1
  Distance between a terminus base of telomere on chromosomal short arm and 5'-terminus of this base sequence : 8349495
  Distance between 3'-terminus of neighbour sequence of sequence listing upward to telomere on chrosomal short arm and 5'-terminus of this base sequence : -152
agtcaatagcaagctgaggagtttaaaaaaagaaggaaggaaggaaggaaggaagggagggagggagggagggagggaggaaggaaggaaggaaggaaggaaggaaggaaggaaggaaggaaggaaggaagtccacatatctgtaaggtgggcaataaaggaacgatctttctgtatttctctacattacaaattcaaactagcatttacgaacttgccaaaaaaaaacctgtttatgtttatagagaaatgcattctgaagtccaaacaactgaccacacaacaatttctaaacccttccactactacataaaacatctgcttctgtgctaaacttttgtaaggcacagtttctgcttcaagaaaatctgtgatgcttggaattgaggtttat

SEQ ID NO: 74 - DNA, 394 bp, Homo sapiens; identical to SEQ ID NO: 73
  AL357713.8_81899
  Located on chromosome 1
  Distance between a terminus base of telomere on chromosomal short arm and 5'-terminus of this base sequence : 8349495
  Distance between 3'-terminus of neighbour sequence of sequence listing upward to telomere on chrosomal short arm and 5'-terminus of this base sequence : -394

SEQ ID NO: 75 - DNA, 278 bp, Homo sapiens
  AC021953.3_42407
  Located on chromosome 1
  Distance between a terminus base of telomere on chromosomal short arm and 5'-terminus of this base sequence : 8420659
  Distance between 3'-terminus of neighbour sequence of sequence listing upward to telomere on chrosomal short arm and 5'-terminus of this base sequence : 70770
cgaaactccgactcaaaatacatacatatatacatacatacatacatacatacatacatacatacatacatacatacaggttgagtatcccttatttgaaatgcttgggaccagagcagtttcaaattttaggtattttcagattttggaatacttgtattatacttactggttgagcatctcaaatcagaaaatctgaaatggtccaatgagcatttcttttgagcatcatcttagcacccaaaaagttttgaattttgaagcatttcagatatcgt

SEQ ID NO: 76 - DNA, 428 bp, Homo sapiens
  AL357552.12_93957
  Located on chromosome 1
  Distance between a terminus base of telomere on chromosomal short arm and 5'-terminus of this base sequence : 8481068
  Distance between 3'-terminus of neighbour sequence of sequence listing upward to telomere on chrosomal short arm and 5'-terminus of this base sequence : 60131
aactgtagaatctaaacggtgagtgcaggggtgctctcactatcataattcctgcaattgttctgcatttaaaccatcagtttgtttgtttgtttgtttgtttgtttgttttttggagacagagtcttgctctgttgcccaggctggagtgcagtggcacaatcttggctcactgcaaggtccgcctcctgggttcatgccattctcctgcctcagcctcttgagtagctgggactacaggcgcccgccaccacgcctggctaattttttgtattttttagtagagacggggtttcaccgtcttaaccaggatggtctcaatctcctgacctcgtgatccacccacctcggcctcccaaagtgcttggattacaggtgtgagccaccgcgcccggcctatacttgttcttaaagtgagcatcatgttt

SEQ ID NO: 77 - DNA, 246 bp, Homo sapiens
  AL356306.3_77607
  Located on chromosome 1
  Distance between a terminus base of telomere on chromosomal short arm and 5'-terminus of this base sequence : 8698448
  Distance between 3'-terminus of neighbour sequence of sequence listing upward to telomere on chrosomal short arm and 5'-terminus of this base sequence : 216952
aaacatacagtcctggctacataggaggttgaggtgcgaggctcacttgagcagcttgggaggtcaaggctgcagtgagctatgattgcaccactgcactccagcctgggtgacagagcaagaccttctctcaatcaatcaatcaatcagtcaatcaatcaatcaatcaattccatgtgtaggtttgtgtgttttcagtccatgtgggtaattaccaagagcttgcttgatcgtatagtaatgtca

SEQ ID NO: 78 - DNA, 167 bp, Homo sapiens
  DISO7_10007703
  Located on chromosome 1
  Distance between a terminus base of telomere on chromosomal short arm and 5'-terminus of this base sequence : 8791531
  Distance between 3'-terminus of neighbour sequence of sequence listing upward to telomere on chrosomal short arm and 5'-terminus of this base sequence : 92837
tcatacattagattgtttctcaagcttttttgactctcacccacagtaaaaaatacagaaatacattttccactgcaacctggttctcgtgtgtgtgtgtgtgtgtgtgtgtgtgtatgtgaaacaaaagtgggcaatacttatctttactacacgtaacactgcct

SEQ ID NO: 79 - DNA, 120 bp, Homo sapiens
  DISO7_10007706
  Located on chromosome 1
  Distance between a terminus base of telomere on chromosomal short arm and 5'-terminus of this base sequence : 9038316
  Distance between 3'-terminus of neighbour sequence of sequence listing upward to telomere on chrosomal short arm and 5'-terminus of this base sequence : 246618
ccttcaatttagacacagagacacactcctgctatacatacacacacacacacacacacacacacacacacacacacacacacagttcagagctgcctctctgttgaaggaagcttggct

SEQ ID NO: 80 - DNA, 107 bp, Homo sapiens
  DISO7_10007705
  Located on chromosome 1
  Distance between a terminus base of telomere on chromosomal short arm and 5'-terminus of this base sequence : 9077761
  Distance between 3'-terminus of neighbour sequence of sequence listing upward to telomere on chrosomal short arm and 5'-terminus of this base sequence : 39325
atgagagccaacacaggcagcaaaaagaaagagagagagagagagagagagagggagggagggaggaaggaagggagggaagaaaagaaagctgcactctaggatct

SEQ ID NO: 81 - DNA, 340 bp, Homo sapiens
  AC013728.4_58702
  Located on chromosome 1
  Distance between a terminus base of telomere on chromosomal short arm and 5'-terminus of this base sequence : 9080093
  Distance between 3'-terminus of neighbour sequence of sequence listing upward to telomere on chrosomal short arm and 5'-terminus of this base sequence : 2225
ccatcctggctaacacaatgaaaccccgtctctactaaaaatacaaaaaattagctgggcgcggtggcgggcgcctgtactcccagctactcgggaggctgaggcaggagaatggcgtgaacccgggaggcggagtttgcagtgagccgagatcgcgccactgcactccagcctgggcgacacagcgagactccgtctcaaaaacaaacaaacaaacaaacaaacaaacagaacaagagcagcaagcccaactgtggaagcacattggaaggtcattggccatatcatctaacagcctagccccaaacagtagagcaaggaagtatgttctactccaaca

SEQ ID NO: 82 - DNA, 273 bp, Homo sapiens
  AL358013.4_144167
  Located on chromosome 1
  Distance between a terminus base of telomere on chromosomal short arm and 5'-terminus of this base sequence : 9381253
  Distance between 3'-terminus of neighbour sequence of sequence listing upward to telomere on chrosomal short arm and 5'-terminus of this base sequence : 300820
gaactgtgattgttccactgtactccagcctgggcaacagagtgagaccctgtttcaatagatagatagatagatagatagatgatagatagatagatagatagatagatagatagatagatagatatgtactaaatgttttcaacagcttctttaagtaaaaggaagaaatgttcttcaaatacctttacaaaataaaataaaaaataaacagggcagtgatgcatgcctatagtacccagctactcctgaggctgaggtacagccaaggag

SEQ ID NO: 83 - DNA, 126 bp, Homo sapiens
  DISO7_10007710
  Located on chromosome 1
  Distance between a terminus base of telomere on chromosomal short arm and 5'-terminus of this base sequence : 9557808
  Distance between 3'-terminus of neighbour sequence of sequence listing upward to telomere on chrosomal short arm and 5'-terminus of this base sequence : 176282
tcgttagtagcatgtggcctaacaaaaggaaaaaatgtttttaaacacacacacacacacacacacacacacacacatacacagacaaaaacacaaaaactctgaggggatctggtgaatctccaa

SEQ ID NO: 84 - DNA, 120 bp, Homo sapiens
  D1S2736
  Located on chromosome 1
  Distance between a terminus base of telomere on chromosomal short arm and 5'-terminus of this base sequence : 9736621
  Distance between 3'-terminus of neighbour sequence of sequence listing upward to telomere on chrosomal short arm and 5'-terminus of this base sequence : 178687
tttttgaggtgtgagagcagagccggcaaggtgtgagtgtgtgtgtgtgtgtgtgtgtgtgcatgcacccgtgagggtgaggggccgcagtgcctgtgtttaccaagaatatcctggagg

SEQ ID NO: 85 - DNA, 275 bp, Homo sapiens
  AC022983.3_103030
  Located on chromosome 1
  Distance between a terminus base of telomere on chromosomal short arm and 5'-terminus of this base sequence : 9770464
  Distance between 3'-terminus of neighbour sequence of sequence listing upward to telomere on chrosomal short arm and 5'-terminus of this base sequence : 33723
tgtaagttgaattcaagtctcaaacctcctgggctcaagcaatccccacctcagcctcccaagtagctggcactacaggtgtgcaccaccatgcccagctaatttttgtagttttgtttgtttgtttgtttgtttgtttgtttgtagagatgggggtctcactatgttgcccaggctggtctcaaactcctgggctcaagcagtctgcccgccttggcctcccaaagtgttggaattacaggcatgagccactgagcctggctttctacataagt

SEQ ID NO: 86 - DNA, 291 bp, Homo sapiens
  DISO7_10000558
  Located on chromosome 1
  Distance between a terminus base of telomere on chromosomal short arm and 5'-terminus of this base sequence : 9880857
  Distance between 3'-terminus of neighbour sequence of sequence listing upward to telomere on chrosomal short arm and 5'-terminus of this base sequence : 110118
agttcaagagtgtggccacaaaaactttaaaaaaaagttttggggtggaaacgtggagtgtgagagaagagagaggtaggtgggaagaaaaaggtgagaagaaacagaagagaagcagagacagagagagagaaagagagacaggcagagagagagagagaaacagagacagagaaagagagagagagacagagagagagagaaagagagacagagagagaaagagagatagagacacacacacacacacacacacacacacacacacacagagtatgaagcagggacctg

SEQ ID NO: 87 - DNA, 172 bp, Homo sapiens
  DISO7_00002015
  Located on chromosome 1
  Distance between a terminus base of telomere on chromosomal short arm and 5'-terminus of this base sequence : 10044260
  Distance between 3'-terminus of neighbour sequence of sequence listing upward to telomere on chrosomal short arm and 5'-terminus of this base sequence : 163112
aaagatgctccttagcgtggaacgagaaacaatgtcaccctgggagagtgctccacgttccccccttcaggaaagacccaggcttccactggctgaatgtgtgcacgtgtgtgtgtgtgtgtgtgtgtgtgtgcgcctgtctcctcattgctcccccagtgatgtcttgctg

SEQ ID NO: 88 - DNA, 375 bp, Homo sapiens
  chr1.fa.O7frz.10670515
  Located on chromosome 1
  Distance between a terminus base of telomere on chromosomal short arm and 5'-terminus of this base sequence : 10114539
  Distance between 3'-terminus of neighbour sequence of sequence listing upward to telomere on chrosomal short arm and 5'-terminus of this base sequence : 70107
agcttaccaaatctagcagaagttgccatgaggaagggagtgactggggccagtccaggcaaaggggtctttcatgttttactctctatgcctctgtggggtttgtaatttttgcaatgagtgcttttaagtgacttacttgattttaaaaaacccatttactgtatgtatgtgtgtgtgtgtgtgtgtgtatatatatgtgtgtgtgtatatatatatgtgtgtgtatgtatatatgtatatataaaattcagagtggccccaggagtagagtgttagaaggtgtccatgagggaggggttgggatctggggaggcctgaggaggcgggcgggtgtggccacaggcagtaccctattagatccagtgctgagtg

SEQ ID NO: 89 - DNA, 368 bp, Homo sapiens
  chr1.fa.O7frz.11371581
  Located on chromosome 1
  Distance between a terminus base of telomere on chromosomal short arm and 5'-terminus of this base sequence : 10298938
  Distance between 3'-terminus of neighbour sequence of sequence listing upward to telomere on chrosomal short arm and 5'-terminus of this base sequence : 184024
ggatagaaggatatgtagaaggatgggtggatagaaggatgagtgggtagaaggatgggtggatgggtggatgaatagaagaatgggtgggtagaaggataggtgaatgaatagatggatagctggaaggatgaatggactgatgatagaagaatggatagttagaaggatgagtgaatggatagatggattggatggatggatggatggatggatggatggatggatggatggatgaacggacgaaggatgggtggtagaaggatggctgaatagaaggatggatggataggatgggtaggtagaagaatgggtggatggttgtgtggacaaaaggatggatgggtgggtggattgatgaatggttg

SEQ ID NO: 90 - DNA, 397 bp, Homo sapiens
  AL049653.7_36093
  Located on chromosome 1
  Distance between a terminus base of telomere on chromosomal short arm and 5'-terminus of this base sequence : 10480632
  Distance between 3'-terminus of neighbour sequence of sequence listing upward to telomere on chrosomal short arm and 5'-terminus of this base sequence : 181326
atggtagcatgcacctataatcccagctacctgggagggtgaggcaggagaatcacttgaacccaagaggcagaggttgcagtgagccgagatcacaccattgcactccaccctggcaacaagagcgatactccgtctcaaaataaaataaaataaaataaaataaaataaaataaaataaaataaataggccaaatataacagcaatcacaataaatgcaattggcctagaatgcactggttaaaagacaaacatttttaaattggattaaaaagataatctagctatatttacaagacagcatccaaaacaaaaagtcacaagacagttaaaagtaaaagaattggaaaagacatatacctccaaaaaaaagctggtacagctatattaatgtta

SEQ ID NO: 91 - DNA, 217 bp, Homo sapiens
  AL031291.3_26284
  Located on chromosome 1
  Distance between a terminus base of telomere on chromosomal short arm and 5'-terminus of this base sequence : 10549338
  Distance between 3'-terminus of neighbour sequence of sequence listing upward to telomere on chrosomal short arm and 5'-terminus of this base sequence : 68309
tgtctggccatcttaacaggaacagctgtgattgatattctttttttaaaagattttatgtatacacacacacacacacacacacacacacacacacacacacacactcacagagttgatttcacctcgaaagcccttgaagtgagagggatgacagctcctctctgagccctgcggaccactctgctgctaatggactgtcagcctctttcattat

SEQ ID NO: 92 - DNA, 152 bp, Homo sapiens
  AL031291_96598
  Located on chromosome 1
  Distance between a terminus base of telomere on chromosomal short arm and 5'-terminus of this base sequence : 10619624
  Distance between 3'-terminus of neighbour sequence of sequence listing upward to telomere on chrosomal short arm and 5'-terminus of this base sequence : 70069
atttcaaaaactcgttttgagagagacaagctgggccctggggggctgtatctctgtgtccttgtccttgggaggtggagaaaggaaaaggggaggaggaggaggaggagcagcgggagggacgggccaggctgcagaaagcaattagtgga

SEQ ID NO: 93 - DNA, 273 bp, Homo sapiens
  HUMUT491B
  Located on chromosome 1
  Distance between a terminus base of telomere on chromosomal short arm and 5'-terminus of this base sequence : 10661355
  Distance between 3'-terminus of neighbour sequence of sequence listing upward to telomere on chrosomal short arm and 5'-terminus of this base sequence : 41579
tccccatttagattgaagggggttgcattgtttctttctttctttctttctttctttctttctttctttctttctttctttctttctttttctttctttctttctctctctctccttccttccttccttccttccttccttccttccttccttccttctttctttctttctttctttctttctttctttctttctttctttcttttttttaggacagagtcttgctctgtcacccgggctggagtgcagtggtgcgatatcggctcactgcaa

SEQ ID NO: 94 - DNA, 270 bp, Homo sapiens
  D1S2667
  Located on chromosome 1
  Distance between a terminus base of telomere on chromosomal short arm and 5'-terminus of this base sequence : 10683832
  Distance between 3'-terminus of neighbour sequence of sequence listing upward to telomere on chrosomal short arm and 5'-terminus of this base sequence : 22204
ctgggtttaccctccagcgaaaacaaaggaaatggtttatccaagggtttggtcccccattcctggtgccatggcccacgacctggcctcaaacctttggccttcctgacccagtccccagggccccagccctgggaggtggctacagacaaggtacaggcagtggagcaagtgtttgtgtgtgtgtgtgtgtgtgtgtgtgtgtgtgtgtgtgtgtgtgtgtgtgttttaagttcatcttccagggtcctgtcccccagacctgaagct

SEQ ID NO: 95 - DNA, 374 bp, Homo sapiens
  chr1.fa.O7frz.11883810
  Located on chromosome 1
  Distance between a terminus base of telomere on chromosomal short arm and 5'-terminus of this base sequence : 10888665
  Distance between 3'-terminus of neighbour sequence of sequence listing upward to telomere on chrosomal short arm and 5'-terminus of this base sequence : 204563
gtaggcacagactgttactgaggacatgggctcagagagagagagaaagtggaaggaatgaaggaaggaaggaaggaaggaaggaagaaagaaagaaagaaagaaagaaagaaagaaagaaagaaagaaggaagaaagaaagaaagaaagagaaaaagaaagaaagagaaagggaggaaggggaagggaagggaaggggagagggaggggagggagggaagaaggaaggaaggaaggaaggaaggaaggaaggaaggaaggaaggaaggaaggaaggaaggaaaaagaaaaagtaggccaagtgtggtggctcacacctgtaatcccagcactttgggaggctgaggtgggaggatcaccttaggtcaggagtt

SEQ ID NO: 96 - DNA, 266 bp, Homo sapiens
  AL021155.1_16298
  Located on chromosome 1
  Distance between a terminus base of telomere on chromosomal short arm and 5'-terminus of this base sequence : 11068431
  Distance between 3'-terminus of neighbour sequence of sequence listing upward to telomere on chrosomal short arm and 5'-terminus of this base sequence : 179392
gtgaatactgaggaacaactgtactctttccttgttgcttctctgtaaccacttgaatctctcagatccccattggggcccttgtcttggaggacagcctcttcagtgtccccagttatatgtatatattatatatatatatatatatatatatatacacacacacactatatatacacacacacacacacacacacacacacacaaacacacattatatatttctgtttgttttgtttttttaagacggagtcttactctgttac

SEQ ID NO: 97 - DNA, 90 bp, Homo sapiens
  D1S2740
  Located on chromosome 1
  Distance between a terminus base of telomere on chromosomal short arm and 5'-terminus of this base sequence : 11098765
  Distance between 3'-terminus of neighbour sequence of sequence listing upward to telomere on chrosomal short arm and 5'-terminus of this base sequence : 30068
ggggctggggtagttttgtgtgtgtgtgtgtgtgtgtgtgtgtgtgtgtgcgtgcacatgagcatgccacagtaagagtatcaaaaggct

SEQ ID NO: 98 - DNA, 406 bp, Homo sapiens
  chr1.fa.O7frz.12184341
  Located on chromosome 1
  Distance between a terminus base of telomere on chromosomal short arm and 5'-terminus of this base sequence : 11182092
  Distance between 3'-terminus of neighbour sequence of sequence listing upward to telomere on chrosomal short arm and 5'-terminus of this base sequence : 83237
cgatgaaggtaagccattattgttgctgttattgagaagcaggaacctgagaaaggggctttgagccacgccaccccatccccttcccccacccctgctgctggagttcaagagcctgttccatcaagaatcctgaattgcgcatgcacgcgtacacacacacacacacacacacacacacacactcactcacatgctctcacgctggctttttccatccatgaaatgtgacactcttcctgtccccagcagccccctgttgccaagagggcctcagagctggtggctctggttctcttcacctggggagagacttcaccgtcctggcaggagctcgggggagcccttccccaagtgtgagcagcatccctcgtttctggatcccaggttcaggtagtgaggcctc

SEQ ID NO: 99 - DNA, 410 bp, Homo sapiens
  AL357835.3_68101
  Located on chromosome 1
  Distance between a terminus base of telomere on chromosomal short arm and 5'-terminus of this base sequence : 11411683
  Distance between 3'-terminus of neighbour sequence of sequence listing upward to telomere on chrosomal short arm and 5'-terminus of this base sequence : 229185
atgtcactgtggtttgaggtacttggctgtgagccccggaggaggaagtgtctgttcgctgatggggggttggaagagatcattgacttctgccccaagcgtgagccccaagtgtgcaggggggagtgcggggggagggctgttggcggcgcatcccagggctctggctctgcccttgcatctagcctgtctttcctgtgggctgtgacaagccactctgcatctctgagactccatttcttcttcttcttcttcttcttcttcttcttcttcttcttcttcttcttcttcttcttctccttctccttctccttctccttctccttctccttctccttctccttctccttctccttctccttctccttctccttctccttctccttcttcttctgatggagtctgactcc

SEQ ID NO: 100 - DNA, 236 bp, Homo sapiens
  AL355998.4_40197
  Located on chromosome 1
  Distance between a terminus base of telomere on chromosomal short arm and 5'-terminus of this base sequence : 11411857
  Distance between 3'-terminus of neighbour sequence of sequence listing upward to telomere on chrosomal short arm and 5'-terminus of this base sequence : -236
cttgcatctagcctgtctttcctgtgggctgtgacaagccactctgcatctctgagactccatttcttcttcttcttcttcttcttcttcttcttcttcttcttcttcttcttcttcttcttctccttctccttctccttctccttctccttctccttctccttctccttctccttctccttctccttctccttctccttctccttctccttcttcttctgatggagtctgactcc

SEQ ID NO: 101 - DNA, 247 bp, Homo sapiens
  D1S434
  Located on chromosome 1
  Distance between a terminus base of telomere on chromosomal short arm and 5'-terminus of this base sequence : 11510077
  Distance between 3'-terminus of neighbour sequence of sequence listing upward to telomere on chrosomal short arm and 5'-terminus of this base sequence : 97984
gcaggtggcacagtgagaaaaagtgtggcttcttttggacagtgcagagtaagttataggtgtcagagaagcagaaatgatccaagtaaaatgtggtgtgtagtatgggatggagaattagtcctgttttttgttttggtgtgtgtgtgtgtgtgtgtgtgtgtgtgtgtgtgtgtttctacataaagtatgacaattagtattcttgtaaacaaaagaggtttctttttggtaatgtaaattagct

SEQ ID NO: 102 - DNA, 315 bp, Homo sapiens
  AL031276.1_39185
  Located on chromosome 1
  Distance between a terminus base of telomere on chromosomal short arm and 5'-terminus of this base sequence : 11510112
  Distance between 3'-terminus of neighbour sequence of sequence listing upward to telomere on chrosomal short arm and 5'-terminus of this base sequence : -212
tggacagtgcagagtaagttataggtgtcagagaagcagaaatgatccaagtaaaatgtggtgtgtagtatgggatggagaattagtcctgttttttgttttggtgtgtgtgtgtgtgtgtgtgtgtgtgtgtgtgtgtgtttctacataaagtatgacaattagtattcttgtaaacaaaagaggtttctttttggtaatgtaaattagcttttgccacatacatacagttgaggctgattttggttggagggaagaacaatgaacaaatcatgaattggtgtgttatttatatttcaaatgtcaaagcttatg

SEQ ID NO: 103 - DNA, 279 bp, Homo sapiens
  AL031296.1_117751
  Located on chromosome 1
  Distance between a terminus base of telomere on chromosomal short arm and 5'-terminus of this base sequence : 11639294
  Distance between 3'-terminus of neighbour sequence of sequence listing upward to telomere on chrosomal short arm and 5'-terminus of this base sequence : 128867
ggtgctaggccttcataaggttttggcctggaacatggcacagaggaacgtctgccccatcctaaagcaagtcaggaaccagctctcttttctcctgggcactctgcctggagggcaagtggatcagcagcctcttggggtgtggggtgaggtggctggaattctctctctctctatatatatatatgtatacacacacacacacacacacacacacacacacactccacaattcttcaactctctggaagaacccctcaaagtctataacaaggcatt

SEQ ID NO: 104 - DNA, 204 bp, Homo sapiens
  HUMUT7498
  Located on chromosome 1
  Distance between a terminus base of telomere on chromosomal short arm and 5'-terminus of this base sequence : 11660855
  Distance between 3'-terminus of neighbour sequence of sequence listing upward to telomere on chrosomal short arm and 5'-terminus of this base sequence : 21282
aagattgcaccactgcactccagcctcggcgacatagccagacttcgtctcacatagatagatagatagatagatagatagatagatagatagataagataatatttggaaattaacaagtaggtaatccttagatcaaagaagaaattaaaagcaaaattaaagactacatagaaagcaataaaaggagaatgcttactgcca

SEQ ID NO: 105 - DNA, 273 bp, Homo sapiens
  AL031296.1_89249
  Located on chromosome 1
  Distance between a terminus base of telomere on chromosomal short arm and 5'-terminus of this base sequence : 11667921
  Distance between 3'-terminus of neighbour sequence of sequence listing upward to telomere on chrosomal short arm and 5'-terminus of this base sequence : 6862
gatccttgaacactatgtagctacttgtgctaaagctcccttccttcctctctgcatgcacgcgcgcgcgcgcacacacacacacacacacacacacacagacacagacacagaggggaagtgggagaggaaagggaggggaagaagattagcttcatttgtgtcttggaaggatttgggtcatgagttataaacaccaaaaccttccacgcatccactgatccactgagtcatcccagactcagctacatgtgacaaggttgtagaaattga

SEQ ID NO: 106 - DNA, 101 bp, Homo sapiens
  DISD22_0011868
  Located on chromosome 1
  Distance between a terminus base of telomere on chromosomal short arm and 5'-terminus of this base sequence : 11820435
  Distance between 3'-terminus of neighbour sequence of sequence listing upward to telomere on chrosomal short arm and 5'-terminus of this base sequence : 152241
aaagaggtcacgcaggagactgatttcattgagaggttaaaacaaaacaaaacaaaacaaaacaaaagcccgtgactctagtgatggatttgtcatcacaa

SEQ ID NO: 107 - DNA, 205 bp, Homo sapiens
  DISD22_0011869
  Located on chromosome 1
  Distance between a terminus base of telomere on chromosomal short arm and 5'-terminus of this base sequence : 11932237
  Distance between 3'-terminus of neighbour sequence of sequence listing upward to telomere on chrosomal short arm and 5'-terminus of this base sequence : 111701
tctgcttactatgctgaaggagataaaaatctaaatttgaaatttgaggaagttgaaactggtaatttaaaagttcagaaggcaaaacgaaatttaaaaaattaaaatggaaaaaataacatagcattaatacacacacacacacacacaaacacacacacgtatatataggaaacaaatagaaattccagaactgaagaataca

SEQ ID NO: 108 - DNA, 284 bp, Homo sapiens
  AL358783.4_51668
  Located on chromosome 1
  Distance between a terminus base of telomere on chromosomal short arm and 5'-terminus of this base sequence : 12121372
  Distance between 3'-terminus of neighbour sequence of sequence listing upward to telomere on chrosomal short arm and 5'-terminus of this base sequence : 188930
acttgaggtcagaagttggagaccagcctgaccaacttggagaaacaccatctccactaaaaatacaaaattacctgggcatggtggtatatgtctgtaatcccagctactcgggaggctgaagcaggagaatcgcttgaacgcaggagacggaggttgtggtgagctgagatcacaccattgcactgcaaccggggcaacaagagcaaaactcggtctcaaaatccataaataaataaataaataaataaatacatacatacatacaataaagcggcttgttt

SEQ ID NO: 109 - DNA, 468 bp, Homo sapiens
  AL023585.5_102455
  Located on chromosome 1
  Distance between a terminus base of telomere on chromosomal short arm and 5'-terminus of this base sequence : 12215038
  Distance between 3'-terminus of neighbour sequence of sequence listing upward to telomere on chrosomal short arm and 5'-terminus of this base sequence : 93382
ttagatgcgaggatcacctgagcccaggaggttgagactgcagtgagccatcattgtgccactgcactccagcctgctcaacagaatgaaaccttgcctcaaaaaaaaggaaggaaagaaggaaggaagggagggagggagggagggaggggagagaaaaagacagaaggaaacagaaagaaaggtggaaagaaagaaaaagaaagaagaaagaaagtaagaaaaagaaagaaagaaagaaaaagaaggaaagaaggaaggaaagaaaaagaaagaaagaagaaagaaagaaagaaagaaagaaagaaagaaagaaagaaagaaagaaagaaagaaagaaaaagagcgagccttcttgtctttaagagcagcgcatatatactgttatattgggtgcacacctaaaatacatttcccccacaaaacctggaagctctatttcatgttgaaatatctgctaagttcacg

SEQ ID NO: 110 - DNA, 121 bp, Homo sapiens
  D1S228
  Located on chromosome 1
  Distance between a terminus base of telomere on chromosomal short arm and 5'-terminus of this base sequence : 12318136
  Distance between 3'-terminus of neighbour sequence of sequence listing upward to telomere on chrosomal short arm and 5'-terminus of this base sequence : 102630
gggaccatagttcttggtgactatgtgtgtgtgtgtgtgtgtgtgtgtgtgtatatatatatatatatatatatatatataactttttttgtaaactaaatgccatttcaatgttgcagtt

SEQ ID NO: 111 - DNA, 172 bp, Homo sapiens
  DISO7_10000559
  Located on chromosome 1
  Distance between a terminus base of telomere on chromosomal short arm and 5'-terminus of this base sequence : 12489986
  Distance between 3'-terminus of neighbour sequence of sequence listing upward to telomere on chrosomal short arm and 5'-terminus of this base sequence : 171729
agtgcatttctgcttggtagatttatgtacacacacacacacacacacacacacacaaacacacacaatctagaaaaggtataagccaagtgttaactttttttttaattctcccttgtttttgattatttttattgtctcagtatatatgtgagctttgcctaatatgtgg

SEQ ID NO: 112 - DNA, 414 bp, Homo sapiens
  AL358783.4_87917
  Located on chromosome 1
  Distance between a terminus base of telomere on chromosomal short arm and 5'-terminus of this base sequence : 12692544
  Distance between 3'-terminus of neighbour sequence of sequence listing upward to telomere on chrosomal short arm and 5'-terminus of this base sequence : 202386
gaaatgtattgtacatttgcacacaatacaaccagatgtgtgcaccattcttaaagacaggaaggctgagtttctctctctctctttctttctttctttctttctttctttctttctttctttctttctttcctttctttctttctttcatttccttccttccctccctccctccctcctttcctccctccctccctccctcccttccttccttccttcctccctcccttccttccttccttcctctggcatctgccccagctcacattctcagattccatcttcccaggctgattttccgaggcgagcccatcatttttgggagtaaacacgctttcccttgtagtagaggccaagactgtatctgcctcctctgccctcaaagacaatgttgtgtttgaagagtctgcactg

SEQ ID NO: 113 - DNA, 271 bp, Homo sapiens
  DID22N_0000135
  Located on chromosome 1
  Distance between a terminus base of telomere on chromosomal short arm and 5'-terminus of this base sequence : 13033316
  Distance between 3'-terminus of neighbour sequence of sequence listing upward to telomere on chrosomal short arm and 5'-terminus of this base sequence : 340358
gtaggtttcagtacagtgtgatctcttcaaaaaagtagagagaatgaaaaggaaagaaaaagagagagcatgagagagaaagaagaagaagaaaggaagaaaggaaagaagggagggaaggagggaaggaggaaggaagggagggatggagggcgggtgggaaggagggaaagaataaaaagagagagaaagagagttggagggaagtagggaaggaaggaaggaaggaaggaaggtaatgcacaaatttacatgaagatgagagcagtgg

SEQ ID NO: 114 - DNA, 251 bp, Homo sapiens
  DID22N_0000137
  Located on chromosome 1
  Distance between a terminus base of telomere on chromosomal short arm and 5'-terminus of this base sequence : 13103371
  Distance between 3'-terminus of neighbour sequence of sequence listing upward to telomere on chrosomal short arm and 5'-terminus of this base sequence : 69784
gcataaagttggcttcctgtacttatataatttttggaatgtgtatttaagttaaaaacattaaaatgggctggaccaggtggtgcatgcctgtagtcccagcactttgggaggaggagacaggaggatcgcttgaggaccagagttggagaccagtatgggcaagattgcaagaccctgtctctctgtctctcatacacacacacacacacacacatcatgaatgtcttagattcattgtaagttccacc

SEQ ID NO: 115 - DNA, 303 bp, Homo sapiens
  chr1.fa.O7frz.17070245
  Located on chromosome 1
  Distance between a terminus base of telomere on chromosomal short arm and 5'-terminus of this base sequence : 13150305
  Distance between 3'-terminus of neighbour sequence of sequence listing upward to telomere on chrosomal short arm and 5'-terminus of this base sequence : 46683
catcctcacttaataggtaatgacaaaggctcagaaaggttaagaaggttgcatgggtagtaagcatcagagctaggcagtctgattccagtattaccactatactatactatactatactatactatactatactatactatactataccatatgtactattactttactgatatatccctaagaggaaatccctgagatctggtatctcccagatactgggacatcatcctatgccctcctgcttgcctacctgtcttttccacagacctatatctaccatttaaatcagtgtccttgtga

SEQ ID NO: 116 - DNA, 318 bp, Homo sapiens
  AL137798.8_77845
  Located on chromosome 1
  Distance between a terminus base of telomere on chromosomal short arm and 5'-terminus of this base sequence : 13233461
  Distance between 3'-terminus of neighbour sequence of sequence listing upward to telomere on chrosomal short arm and 5'-terminus of this base sequence : 82853
tcatgtaagatatcctggtgacaacctaaatgtctatcaaaaggggactgctactaagtacatgatggtacatcctttaagtggagaactgtggccaagaaaaaccagtggagaagttcttcctggcctgatccagagccacctcccagttataactagtaggtgaaaaaagcatcttcaagaactgtgaagatgaaattttaccaggcgtatatacaaaaaagtgtgtgtgtgtgtgtgtgtgtgtgtgtgtgtgtgtgcgcgtgtgtgatctcatttgctcatataaaataaccctggaaggtcacttaagaaact

SEQ ID NO: 117 - DNA, 118 bp, Homo sapiens
  DISD22_0011892
  Located on chromosome 1
  Distance between a terminus base of telomere on chromosomal short arm and 5'-terminus of this base sequence : 13568827
  Distance between 3'-terminus of neighbour sequence of sequence listing upward to telomere on chrosomal short arm and 5'-terminus of this base sequence : 335048
ctctaggcccttccagtgctctccccacccatgaagaggaaagattgtgcgtgtgtgtgtgtgtgtgtgtgtatgtgaagttatcacactaggtctgtgtgtgccttcatccctgagt

SEQ ID NO: 118 - DNA, 196 bp, Homo sapiens
  AL031277.1_128543
  Located on chromosome 1
  Distance between a terminus base of telomere on chromosomal short arm and 5'-terminus of this base sequence : 13645272
  Distance between 3'-terminus of neighbour sequence of sequence listing upward to telomere on chrosomal short arm and 5'-terminus of this base sequence : 76327
cagagcatagttgtcatttgtctctgtgtacgtatttgtaaagcatttggagatcccaagcatgctgactatagctctttaagtttgtgtgtgtgtgtgtgtgtgtgtgtgtgtgtgtgtgtgtgtgtgtaggggtggggggcgcggggcaaacaaacctaaatagaaaaataatgagaattacagtttcgaattt

SEQ ID NO: 119 - DNA, 225 bp, Homo sapiens
  HUMUT1987
  Located on chromosome 1
  Distance between a terminus base of telomere on chromosomal short arm and 5'-terminus of this base sequence : 13742129
  Distance between 3'-terminus of neighbour sequence of sequence listing upward to telomere on chrosomal short arm and 5'-terminus of this base sequence : 96661
ttatggcacttggaaattgactgtatgcccatatcatgcagtcttaattaccgtggctataaaataagtcttgtcctttcctttcctttcctttttccttccttccttccttcccttccttccttccctttccttccttccttccttccttccttccttccttccttcctcccttccttccttccttccttctttccttccttgttttctttctgaaatctcact

SEQ ID NO: 120 - DNA, 223 bp, Homo sapiens
  AL031277.1_31646
  Located on chromosome 1
  Distance between a terminus base of telomere on chromosomal short arm and 5'-terminus of this base sequence : 13742169
  Distance between 3'-terminus of neighbour sequence of sequence listing upward to telomere on chrosomal short arm and 5'-terminus of this base sequence : -185
gtcttaattaccgtggctataaaataagtcttgtcctttcctttcctttcctttttccttccttccttccttcccttccttccttccctttccttccttccttccttccttccttccttccttccttcctcccttccttccttccttccttctttccttccttgttttctttctgaaatctcactctattgtctaggctggagtaaagtggcatgatcttagc

SEQ ID NO: 121 - DNA, 309 bp, Homo sapiens
  AC074234.5_26672
  Located on chromosome 1
  Distance between a terminus base of telomere on chromosomal short arm and 5'-terminus of this base sequence : 13744483
  Distance between 3'-terminus of neighbour sequence of sequence listing upward to telomere on chrosomal short arm and 5'-terminus of this base sequence : 2091
cctaatgctaaatgacgagttaatgggtgcagcacaccagcatggcacatgtatacatatgtaactaacctgcacattgtgcacatgtaccctaaaacttaaagtataataataataataataataataataataataataataaatatatattaaaaaaaagaaaaaaaagtgttcccttttcttcacaatttcgccagcatctgttatttattgatgttttaataatagccattctggcttgtgtgagatggtatctcattgtggttttgatttgcatttctctaatgattagtgatgtcaagcatt

SEQ ID NO: 122 - DNA, 360 bp, Homo sapiens
  AL031277.1_315
  Located on chromosome 1
  Distance between a terminus base of telomere on chromosomal short arm and 5'-terminus of this base sequence : 13773386
  Distance between 3'-terminus of neighbour sequence of sequence listing upward to telomere on chrosomal short arm and 5'-terminus of this base sequence : 28594
atgtacattccgtaaatgtacatttatagaacatacgtatattcttcacagttatatctaaattgacattaaaaaaatgaaactgtcctgttccttctctgtgtgaccagccagcaccattaagctattgctatgtgccaggctctgaataagtgctttgaatagcatctttctttctttctttctttctttctttctttctttctttctttctttctttctttctttctttctttctttctttttaacttttaagtttaggagtacaagtacaggtttgttacataggtaaacttgtatcatggggatttgttgtacagattatttcttcacccaggtattaagcctagtatccattag

SEQ ID NO: 123 - DNA, 412 bp, Homo sapiens
  AC074234.5_82641
  Located on chromosome 1
  Distance between a terminus base of telomere on chromosomal short arm and 5'-terminus of this base sequence : 13788404
  Distance between 3'-terminus of neighbour sequence of sequence listing upward to telomere on chrosomal short arm and 5'-terminus of this base sequence : 14658
atgttaagcaaacttattgtggactgtgtctgatatctggattgctagtggtccttccttcctgccttccctccctttcttccttctccttccttccttccttcattccatcctttcttccttccttctttccttcctccctccctccctccctgcctccctccctcccttccttcttcttctttttcttttcttgatagggtcttgctctgttgcccaggcttggagtgcagtggtgtgatcttggctccctacaatctctgcctctcaggctcaagctatcctcccacctcagcctccccagtagctgggactacaggtgtgcaccaccatgtccagctaatttttgtattttttgtagagacagtatctcaccttattgcccaggctggtgttgaactcctgagctcca

SEQ ID NO: 124 - DNA, 419 bp, Homo sapiens
  AC026663.3_2636
  Located on chromosome 1
  Distance between a terminus base of telomere on chromosomal short arm and 5'-terminus of this base sequence : 13789564
  Distance between 3'-terminus of neighbour sequence of sequence listing upward to telomere on chrosomal short arm and 5'-terminus of this base sequence : 748
cagagtttgaagctgtaagtttactgtttctcatcaagctttcacccactagatttagcattcgttgacatttcctgcctgaattataactatgagaggctgtcaaatggcaattttccaagtccatcattttgtgcatctattggttggcatttgactataaagaagaactttttcttctatctctctatgcatttatttgtggatatatttatgtatccatccatccatccatccatccatccatccatctatccatatggacatatagatttctattcaatgagttctaattcattatcatcacttttatataaaaattattcttgatttggccagtgagggtttcttcaagctggctactgtgtgtttttggaatgtctccatccatcttggagaagttccttgctttctggcta

SEQ ID NO: 125 - DNA, 396 bp, Homo sapiens
  AL033525.10_146232
  Located on chromosome 1
  Distance between a terminus base of telomere on chromosomal short arm and 5'-terminus of this base sequence : 13849181
  Distance between 3'-terminus of neighbour sequence of sequence listing upward to telomere on chrosomal short arm and 5'-terminus of this base sequence : 59198
actttgctaatatcaactcacaatatatatatagcaatgaatggtaaaactaacagtgtacccacaatcatagttgggaattttaacacagctgttccataggatgatttttttaaatgacatttgctctcagtttgtgtgtgtgtgtgtgtgtgtgtgtgtgtgtgagagagagagagagagagagagagaatgtttttaaacctaagtctttagtacatttttttatgaagccggtgcctggtagatggggtgaactgggatattggaatgctggttctggcaagggccacctgaattggggaagatgcagtggtgtggttttcagaacatccgagatggctcctatgcctgcttcccttctctgcccaagtccctattgctggacttctgagg

SEQ ID NO: 126 - DNA, 282 bp, Homo sapiens
  AL033525.10_128164
  Located on chromosome 1
  Distance between a terminus base of telomere on chromosomal short arm and 5'-terminus of this base sequence : 13867283
  Distance between 3'-terminus of neighbour sequence of sequence listing upward to telomere on chrosomal short arm and 5'-terminus of this base sequence : 17706
ttcatgcatcaaagcctagctcagccatcatctcctccatgaaaaaacaaaaaaacaaaaaaccttcatctccttctgtgttctttaaagggttaaatgtttctgctgtggtctgtgtgtgtgtgtgtgtgtgtgtgtgtgtgtgtgtgtgtgtgtgtaggggtagtggatgacagggcagtatactggatgtcataataggctttggagttagatatcatacctgtgttttaatcctacttctgccaattgccagctgtgctatctggttacttaacctct

SEQ ID NO: 127 - DNA, 240 bp, Homo sapiens
  Z99291.1_53473
  Located on chromosome 1
  Distance between a terminus base of telomere on chromosomal short arm and 5'-terminus of this base sequence : 14038552
  Distance between 3'-terminus of neighbour sequence of sequence listing upward to telomere on chrosomal short arm and 5'-terminus of this base sequence : 170987
caaattgtccttggagtgtactgcctctcacaagcatgcatgcatatgcacccgcacacacacacacacacacacacacacacacacatgtgcacacatgcacacatacactcacacattcacacttattattacattggtggaaaagtaattgcagtttttgttattaaaagtaatggcaaaaactgcaattacttttgcaccaacctgcaacctgattggtaggattgtatgttcttt

SEQ ID NO: 128 - DNA, 179 bp, Homo sapiens
  D1S2834
  Located on chromosome 1
  Distance between a terminus base of telomere on chromosomal short arm and 5'-terminus of this base sequence : 14041631
  Distance between 3'-terminus of neighbour sequence of sequence listing upward to telomere on chrosomal short arm and 5'-terminus of this base sequence : 2839
tatgaaatggggataatagtacgggctttgcaaaaatgttggaaagattaaatgtagtgtaaaatgttagcattaaataaatgttacagtgtgtgtgtgtgtgtgtgtgtgtgtatacatatcctatatgttaaaatgcgttcagttgcaactactagaaaatctgcccacatccaaca

SEQ ID NO: 129 - DNA, 389 bp, Homo sapiens
  Z99291.1_48507
  Located on chromosome 1
  Distance between a terminus base of telomere on chromosomal short arm and 5'-terminus of this base sequence : 14043503
  Distance between 3'-terminus of neighbour sequence of sequence listing upward to telomere on chrosomal short arm and 5'-terminus of this base sequence : 1693
taaagcatggagtaattgatttactcaagtgtgggaggagggaaaggggatttgaggtaaatgtgtgtgtgtgtgtgtgtgtgtgtgtgtgtgtgtgtgtgtggtatgtatgtgtgtgtgtgtgttaagtaggaaggaggaaagtggccagctttcttgttgacacaccatataggcatccatgaaagtcttcaaaaatgagtctggctctaggaactgtagagaggcaggtgtcaaacccaactctctttctcctgaaagaggtgatgtacagggtagtccttaaagggaagggctttatgattaaacagaggcaggtttaaatcctggccccatcagttagaaagtgtgattttggacaagctatctaatctttctaagcctcaatt

SEQ ID NO: 130 - DNA, 333 bp, Homo sapiens
  Z99291.1_239
  Located on chromosome 1
  Distance between a terminus base of telomere on chromosomal short arm and 5'-terminus of this base sequence : 14091747
  Distance between 3'-terminus of neighbour sequence of sequence listing upward to telomere on chrosomal short arm and 5'-terminus of this base sequence : 47855
ccatttagataacagttcaaagacattctctttgaacatgacatttaaacttagatctggggatggagagagagagagaggagcgtgtgtgtgtgtgtgtgtgtgtgtgtgtgtgtgtgtgtgtgtgaaagagaagccttgtctcatgctttattgcatatatttgtactttagttttgtgtgttaagcattaccccatgaggtgattggaaatagctcccctgagatgttgcaaaagatatatacaaattattttttcagaaatttacatttaatttagggaatataacaattccagctggtcccttgggaacagaggatcctttaatcctt

SEQ ID NO: 131 - DNA, 477 bp, Homo sapiens
  chr1.fa.O7frz.14313423
  Located on chromosome 1
  Distance between a terminus base of telomere on chromosomal short arm and 5'-terminus of this base sequence : 14178761
  Distance between 3'-terminus of neighbour sequence of sequence listing upward to telomere on chrosomal short arm and 5'-terminus of this base sequence : 86681
taggacattaccaatatcttgaagtctcttctgtgaccttttctaaccacatctccctctccccaccagggaagcgactatccagtatttggtatttattattcccatgcagtccttcatagcaacagtcctcacaatgtggtctctggatcagcaacatcagtatcacccagaaatttattagaaatacagattctttggccccattcccagacctattgagttagaaactctgagggagagacccaggaatctgggttataaaaagccctccaggtaattctgatgcatcgtgaaaactgcagccttgtggtaaatactgtgtgtgtgtgtgtgtgtgtgtgtgtgtgtgtgtgtgtgtgtgtgtctaaacaatacattagttttaactgattttgaccttgatatcaatgaaataattctttgtgtattctttcgttacttgatatttttctctacattatgtttgtgcgattc

SEQ ID NO: 132 - DNA, 405 bp, Homo sapiens
  chr1.fa.O7frz.14441995
  Located on chromosome 1
  Distance between a terminus base of telomere on chromosomal short arm and 5'-terminus of this base sequence : 14393183
  Distance between 3'-terminus of neighbour sequence of sequence listing upward to telomere on chrosomal short arm and 5'-terminus of this base sequence : 213945
caacatggtgaaacctcatctatactgaaaatacaaaacttagctggccatggtggcacatgcctgtaatcccagctacttgggaggctggggcaggagaatcacttgaacctgggaggcagagtttgcagtgagcctagattgcaccactgcactccagcctgtgtgacagagtaagactctgtcttaaaaataataataataataataataataataataataatgaatacactgttttgaaatcacttttcaatcaacattatttaaggagaatttttccttaatttaaatattattcaaaatagaatttcaatgttcatttctctcatgaataaatattcttgtgtataaatctttgcctacatatctgactgtttccctagaatagacttgctggaaatg

SEQ ID NO: 133 - DNA, 152 bp, Homo sapiens
  HUMUT2127
  Located on chromosome 1
  Distance between a terminus base of telomere on chromosomal short arm and 5'-terminus of this base sequence : 14431595
  Distance between 3'-terminus of neighbour sequence of sequence listing upward to telomere on chrosomal short arm and 5'-terminus of this base sequence : 38007
tgggcggggatagaaggaatagtagtgtctggtctagaatcctatctatctatctatctatctatctatctatctatctatctatctatctatgtacctacctacctatctatcttcctctccactctatgcagcctctccatgtggttagc

SEQ ID NO: 134 - DNA, 253 bp, Homo sapiens
  AL034395.6_99459
  Located on chromosome 1
  Distance between a terminus base of telomere on chromosomal short arm and 5'-terminus of this base sequence : 14494972
  Distance between 3'-terminus of neighbour sequence of sequence listing upward to telomere on chrosomal short arm and 5'-terminus of this base sequence : 63225
gtcacttacagaggctgtgacagagtcgagaacccaggccagcacacatattctcttgtaaggccccgaacagggaaagaagaaacacacacacacacacacacacacacacacaccaagaaagattcaaggagggaaaaaaatgcacttgcacttctaccaaggaattagagactttaagtatatatgcttatgtgtttaagtctgtggttagaatgtctattaatatttatcaatttcatacctaggagct

SEQ ID NO: 135 - DNA, 405 bp, Homo sapiens
  AL031732.8_57460
  Located on chromosome 1
  Distance between a terminus base of telomere on chromosomal short arm and 5'-terminus of this base sequence : 14605890
  Distance between 3'-terminus of neighbour sequence of sequence listing upward to telomere on chrosomal short arm and 5'-terminus of this base sequence : 110665
gtgcaggagttctgaacttagaaaacttggatgggctctagggtttctggaaaatgctgatatttttgcaaaactgtgtgtgtgtgtgtgtgtgtgtgtgtgtgtgtgtgtgtggatttctctgtgaagagggtttgtggctttcaccatgtcctcaaagaggttttatggctttagcaattcgcaaaaaggttatcaaccaagtgccaagatcccctccaccaccaaacaagatgaaaacccaaaaactttgctcaggatctcagagcttcactgactctccatgaaaccccactcacaatccctgttttgttttttctcaaggcaggaattgggaacgtggtatgtatcgtgggtgatacacaatacacagagtatcgtgtatcgatagattagagttggtga

SEQ ID NO: 136 - DNA, 183 bp, Homo sapiens
  D1S507
  Located on chromosome 1
  Distance between a terminus base of telomere on chromosomal short arm and 5'-terminus of this base sequence : 14605925
  Distance between 3'-terminus of neighbour sequence of sequence listing upward to telomere on chrosomal short arm and 5'-terminus of this base sequence : -370
ctctagggtttctggaaaatgctgatatttttgcaaaactgtgtgtgtgtgtgtgtgtgtgtgtgtgtgtgtgtgtgtggatttctctgtgaagagggtttgtggctttcaccatgtcctcaaagaggttttatggctttagcaattcgcaaaaaggttatcaaccaagtgccaagatcccct

SEQ ID NO: 137 - DNA, 213 bp, Homo sapiens
  AL031732.8_23526
  Located on chromosome 1
  Distance between a terminus base of telomere on chromosomal short arm and 5'-terminus of this base sequence : 14639788
  Distance between 3'-terminus of neighbour sequence of sequence listing upward to telomere on chrosomal short arm and 5'-terminus of this base sequence : 33680
ctgtattctcaaacttccatgtggctaaaaatgggaagggggtactttttaaaaatataggttcctgggcccctggcctgttggggctcatgtgggactcaagggtgtgtgtgtgtgtgtgtgtgtgtgtgtgtgtgtgtgtgtgtgtgtatattttttttttttgagacggagttttgctcttgttgcccaggctagaattcaatggcgtga

SEQ ID NO: 138 - DNA, 253 bp, Homo sapiens
  D1S2728
  Located on chromosome 1
  Distance between a terminus base of telomere on chromosomal short arm and 5'-terminus of this base sequence : 14737478
  Distance between 3'-terminus of neighbour sequence of sequence listing upward to telomere on chrosomal short arm and 5'-terminus of this base sequence : 97477
cgcctcgttcagttcatacaacctgaaattcgggtttgccagaatgttggtgtctaagagccgagaatgtcatcaaccacagttcttttgttaccacacaaaaggactctgctgtcctcccaagtcattcacacacacacacacacacacacacacacacacacacacatacacacacatacatacatatatattttttgttgttgttgttttgagatggagtctcactctgtcacccaggctggagtgtagt

SEQ ID NO: 139 - DNA, 453 bp, Homo sapiens
  AC073084.2_164956
  Located on chromosome 1
  Distance between a terminus base of telomere on chromosomal short arm and 5'-terminus of this base sequence : 14777803
  Distance between 3'-terminus of neighbour sequence of sequence listing upward to telomere on chrosomal short arm and 5'-terminus of this base sequence : 40072
cacgataccagacaagtgagtacagatagagaatccaaggattgagctctggagtcctccaacatttggaggtcggaagggggaagaggatccaacaaaggctactgaaaaggaacagctggtgaggtaggaagaaaccagtagagaagtgacatgtgtccggaagagagtgttcaactgttagatgctgctgacagattaagtaagaggggctggaaaggtgaccactggatttaataatgtcattggtgaccttgagttgtttcagaggaatggtggcatgaatcgctagctagctggctgactggatggatggatggatggatggatggatggatggatggatggatggatggacagatggatggaaggctaacttaactactgcagctaacttaactactgcaggtaactgcaccatcttgtcacctgtgacagcaattaagcaactgt

SEQ ID NO: 140 - DNA, 280 bp, Homo sapiens
  HUMUT1441B
  Located on chromosome 1
  Distance between a terminus base of telomere on chromosomal short arm and 5'-terminus of this base sequence : 14786918
  Distance between 3'-terminus of neighbour sequence of sequence listing upward to telomere on chrosomal short arm and 5'-terminus of this base sequence : 8662
gcgaaactccatctcaaaagaaagaaagaaagaaagaaagagagagagagagagagagagagaaagaaagaaagaaaagaaagaaagaaagaaagaaagaaagaaagaaagaaagaaagaaagaaagaaagaaagaaagaaagaaaagcggttcttgagctcttctgttgcagggtgcaggctttcttaggactggatggaagtggtggcctctgtcccacctttttcaaaggtgagaccctgggtcacagccaaagggagcattatcttcacacgctcc

SEQ ID NO: 141 - DNA, 454 bp, Homo sapiens
  AC073084.2_118250
  Located on chromosome 1
  Distance between a terminus base of telomere on chromosomal short arm and 5'-terminus of this base sequence : 14813415
  Distance between 3'-terminus of neighbour sequence of sequence listing upward to telomere on chrosomal short arm and 5'-terminus of this base sequence : 26217
cttatgcctgtttaaccatcactttgggaagctgaggcaggcggatcacctgagctcaggagttcaggagttcgagatcagcgtgggcaacatggcgaaaccccatctctactaaaagtacaaaagttagccaggcacggtggcgtgtgcttgtagtcccagctactcgggaggctgagacaagagaatcgcttgcacctgggaggcggaggttatagtgagccgagacactgttgcacttcctgcttgggcgacagagtaagaccttgtctcaataaataaataatgaatgaatgaatgaatgaatgaatgaatgcctggccctgccctaattacaaccaattagcccctggctctccagaaggctctgggatatctgtggcctgtggatctcctgactggctgctcttctccctcctaacattcattcctgacctttagccatgagtggctg

SEQ ID NO: 142 - DNA, 150 bp, Homo sapiens
  D1S2672
  Located on chromosome 1
  Distance between a terminus base of telomere on chromosomal short arm and 5'-terminus of this base sequence : 14855835
  Distance between 3'-terminus of neighbour sequence of sequence listing upward to telomere on chrosomal short arm and 5'-terminus of this base sequence : 41966
gtgggtgtgggaccattctctaggcatctgatttctttcccactgtgtgtgtgtgtgtgtgtgtgtgtgtgtgtgtgtgtctcaagcaaacacactagtgtttcctggtcacacagacccctcgctatccacaaagccaccaagatggat

SEQ ID NO: 143 - DNA, 314 bp, Homo sapiens
  AL035405.10_117168
  Located on chromosome 1
  Distance between a terminus base of telomere on chromosomal short arm and 5'-terminus of this base sequence : 14996042
  Distance between 3'-terminus of neighbour sequence of sequence listing upward to telomere on chrosomal short arm and 5'-terminus of this base sequence : 140057
tctcatggtattgagtttgtctgtttgggtgtgtgtgtgtgtttttatttgttttgttttgttttgttttgttttgttctgttttgagttggggtctcagtctgtcacccaggctggagtacagtggtatgatcttggctcactataacctccgcctccctggctgaaaagatcctcctacctcagcctcctgagcagctgggaccccaggcacacgccaccacgtccagctaatttttttgtatttttggtagagatggggtttcaccatgttgcccaggctgatctcaaactcctgaagctcaagcattctg

SEQ ID NO: 144 - DNA, 318 bp, Homo sapiens
  AL035405.10_97276
  Located on chromosome 1
  Distance between a terminus base of telomere on chromosomal short arm and 5'-terminus of this base sequence : 15015890
  Distance between 3'-terminus of neighbour sequence of sequence listing upward to telomere on chrosomal short arm and 5'-terminus of this base sequence : 19534
cttataaagtgctgagcacaaggatggcacgtgggaggtaatcagtcggtctcagcagctgtggtcattgtcaccaatgtgtgtgtgtgtgtgtgtgtgtgtgtgtgtgtgtgtgtgtgtgtctggggagctgactgagcctcccctgctgactcaaaatggtcctctcttcagctccacaggcatccgggaggctgagcgttttggaacgccccctggcagggcctccagcgtcacgcgggcaggaaaggaggagaacagcagcggtctcaagtacaaggctggccgggtaagtctctcaatggatttacctgtgag

SEQ ID NO: 145 - DNA, 248 bp, Homo sapiens
  AL035405.10_78717
  Located on chromosome 1
  Distance between a terminus base of telomere on chromosomal short arm and 5'-terminus of this base sequence : 15034412
  Distance between 3'-terminus of neighbour sequence of sequence listing upward to telomere on chrosomal short arm and 5'-terminus of this base sequence : 18204
gtcatgtcttgcttctaagaatagaatccagtaaaaatgatgggctgtcactcctgagattaggttatgaaagactgtgacctccatcttgcttgtgtatgtgtgggcgtgctcgctctctgtctctctctctgtgtgtgtgtgtgtgtgtgtgtgtgtctccttatttgcttgcattgataaggccagctgccaagttgtaagccatcccataaagagacccatttgaccaggaactaaagtggtct

SEQ ID NO: 146 - DNA, 190 bp, Homo sapiens
  AL031283.26_113082
  Located on chromosome 1
  Distance between a terminus base of telomere on chromosomal short arm and 5'-terminus of this base sequence : 15297103
  Distance between 3'-terminus of neighbour sequence of sequence listing upward to telomere on chrosomal short arm and 5'-terminus of this base sequence : 262443
aagcaatagccatatctacatagatgtggacacacacacacacgcacacacacacacacacacacacactgctatctgtaaaagggtgaggggctggggaaaaaacctctaagaattctcagggggcgaggttgatagtgaaagaaaggctgagaaacacagagttagactaatgaagacataaagatcc

SEQ ID NO: 147 - DNA, 221 bp, Homo sapiens
  Z23650.1_191
  Located on chromosome 1
  Distance between a terminus base of telomere on chromosomal short arm and 5'-terminus of this base sequence : 15447712
  Distance between 3'-terminus of neighbour sequence of sequence listing upward to telomere on chrosomal short arm and 5'-terminus of this base sequence : 150419
gtacatttatcggcctttaatattgaatgtgtctccagtgttagcagagtaactggccctccaaatatatggttggatgaaagaacaagaaaagttgttcaagtattaagtgaaataagtatgagatgaccccattttgttttatgtatatgcatacacacacacacacacacacacacacacacacacatttgtaactcttcttacatattgccagattg

SEQ ID NO: 148 - DNA, 206 bp, Homo sapiens
  D1S436
  Located on chromosome 1
  Distance between a terminus base of telomere on chromosomal short arm and 5'-terminus of this base sequence : 15447735
  Distance between 3'-terminus of neighbour sequence of sequence listing upward to telomere on chrosomal short arm and 5'-terminus of this base sequence : -198
tgaatgtgtctccagtgttagcagagtaactggccctccaaatatatggttggatgaaagaacaagaaaagttgttcaagtattaagtgaaataagtatgagatgaccccattttgttttatgtatatgcatacacacacacacacacacacacacacacacacacatttgtaactcttcttacatattgccagattgctctacag

SEQ ID NO: 149 - DNA, 337 bp, Homo sapiens
  chr1.fa.O7frz.16871199
  Located on chromosome 1
  Distance between a terminus base of telomere on chromosomal short arm and 5'-terminus of this base sequence : 15814695
  Distance between 3'-terminus of neighbour sequence of sequence listing upward to telomere on chrosomal short arm and 5'-terminus of this base sequence : 366754
aacagagttagatgccaacacacacacacacacacacacacacacacacacacacacacaccaacacacacacgcacacagtagttagggatcaaagtatggccaaacaaggtcctgcacagtcatcctgtcccctcatctctctgacctcattgcctgctgcattcctgtccctcactgtattttagcctcacacctgggcctctgctcttgctatttctgcctggaacactcttcctgcatgtccttgtgactctctcctttacctgcttcacaggtctttattcatatgtctccctctgtgaggcattccctaactacagtttgaaaggacaac

SEQ ID NO: 150 - DNA, 281 bp, Homo sapiens
  D1S2697
  Located on chromosome 1
  Distance between a terminus base of telomere on chromosomal short arm and 5'-terminus of this base sequence : 15992623
  Distance between 3'-terminus of neighbour sequence of sequence listing upward to telomere on chrosomal short arm and 5'-terminus of this base sequence : 177591
gggccacagagtgagaccttatctcaaacaaaacaaaacaaaacacacacacacacacacacacacacacacacaaaacaaaaatcaaaacaaaacaaacaaaaaacagaaaaaagaaagaaaataagactattgctggtacgtaaaacaaattaatgccttactcccagggttgccgtgaggtcaaatggaaaactcagtgtacaggctcaggcacagagtccagtacatgccacctggacctcctaggggtcctctgggcctccttaaccacctctgcc

SEQ ID NO: 151 - DNA, 302 bp, Homo sapiens
  chr1.fa.O7frz.16369434
  Located on chromosome 1
  Distance between a terminus base of telomere on chromosomal short arm and 5'-terminus of this base sequence : 16151335
  Distance between 3'-terminus of neighbour sequence of sequence listing upward to telomere on chrosomal short arm and 5'-terminus of this base sequence : 158431
ctaggctacctgtaacagtagagacaacacgccacgtggtggcacacacctgtaatcccagtaatttgggaggttgaggcaggagcatcagtgaaaatggccatgagtgagtcatggccatgccactcacctccagcctgggcaatagagcaagaccctgtctcataaataaataaataaataaataaataaataaatacagtagagacaataaatgtttgtgctggttttttacattataaaaagattaaaatcattcctcttttgaactcagttaaatcataaatgtatccattacaacc

SEQ ID NO: 152 - DNA, 296 bp, Homo sapiens
  AC058783.13_138180
  Located on chromosome 1
  Distance between a terminus base of telomere on chromosomal short arm and 5'-terminus of this base sequence : 16290994
  Distance between 3'-terminus of neighbour sequence of sequence listing upward to telomere on chrosomal short arm and 5'-terminus of this base sequence : 139357
ggaaggtggacatgactttcctcccttccagggtgggaaagccccgccccgccccgccccgccccgccccgcccaggtaggcgattgtgaaatggcaaagacatccacgtgcatcccttaacgctcacgccaaggcggctgctgctctgccatctcaggggctgcactcagcttcctccccaggttcttacctcacacttcgattcttgggccacaaatttggccagtgccagcttctccatggtggcatccgtcaggatgctggggtagggaggttctcgacagcctttgatcat

SEQ ID NO: 153 - DNA, 227 bp, Homo sapiens
  DISO7_10007721
  Located on chromosome 1
  Distance between a terminus base of telomere on chromosomal short arm and 5'-terminus of this base sequence : 16476562
  Distance between 3'-terminus of neighbour sequence of sequence listing upward to telomere on chrosomal short arm and 5'-terminus of this base sequence : 185272
ttacatgcttgcctttgtgcctgtgtgtatgatgtctgagtgtgtgtgtgtgtgtgtgtgtgtgtgtgtgtgtgtgtgtgtccatgcacctgcctgagtgggggtcattgggtgcactcatcctgggctcgcaggctcactgtcagggccagcaggatggaagacacacaaggatctctcctgccttccccctctgcactggccgtgtcccagggaggtacctgaca

SEQ ID NO: 154 - DNA, 279 bp, Homo sapiens
  AL049569.13_9001
  Located on chromosome 1
  Distance between a terminus base of telomere on chromosomal short arm and 5'-terminus of this base sequence : 16653797
  Distance between 3'-terminus of neighbour sequence of sequence listing upward to telomere on chrosomal short arm and 5'-terminus of this base sequence : 177008
agtctgaaagctctaagcagacatttagttcaattcggctgaaacaaaacaaaacaaaacaaaacaaaacaaaacaaaactctgtggactgaggttcaaatctcagctccatctatttctagctgcagggccttgggcaagtgacttaacccttctgattccatttagtttcctcatttgtaaaacaaggacaatgtgatctctagctcacaggattaaatgaaatacgtaagcaaactgccagcccagtgcttcatgtggaagtttcataggagtttc

SEQ ID NO: 155 - DNA, 392 bp, Homo sapiens
  chr1.fa.O7frz.17887772
  Located on chromosome 1
  Distance between a terminus base of telomere on chromosomal short arm and 5'-terminus of this base sequence : 16697105
  Distance between 3'-terminus of neighbour sequence of sequence listing upward to telomere on chrosomal short arm and 5'-terminus of this base sequence : 43029
cttcatgacttggatttacaaccaagaccactacagctctgactggatggaggaactgcctgacaaacattttttcttcttcttcttcttctttctcctcctcctcctccgtcttcttcttcttcttcttcttcttcttcttcttcttcttcttcttcttcttcttcttcttcttcttcttcttcttcttcctcttcttcttgttcttcttcttcttcctcttcctcttcctcctcttcctcttcctcctcttcttcttcttgtccctcttccttctcctttttcttcttcttcttctttttgagacagagtctcactctgctgcccagggctgctgtgcagtggcgtgaacatggctcactgcatcctcgaccttccaggctcatgtgata

SEQ ID NO: 156 - DNA, 241 bp, Homo sapiens
  chr1.fa.O7frz.18613271
  Located on chromosome 1
  Distance between a terminus base of telomere on chromosomal short arm and 5'-terminus of this base sequence : 16845297
  Distance between 3'-terminus of neighbour sequence of sequence listing upward to telomere on chrosomal short arm and 5'-terminus of this base sequence : 147800
tactatgtgccaagttctaagaacagcagacgcagcagtgggcaagacagacgacatctcgtctactaccttccagttggaggacacagacaaaatgactcgttattgctccctgcttttctttttctctctctcacacacgcgcgcacacacacacacacacacacacacacacctcctggttgtagactttgagtgcaagctgacagcatgtggcatgtaatcatttgttctgcaacat

SEQ ID NO: 157 - DNA, 416 bp, Homo sapiens
  chr1.fa.O7frz.18520411
  Located on chromosome 1
  Distance between a terminus base of telomere on chromosomal short arm and 5'-terminus of this base sequence : 17120450
  Distance between 3'-terminus of neighbour sequence of sequence listing upward to telomere on chrosomal short arm and 5'-terminus of this base sequence : 274912
tggcatgtaggacttatattaaacacatcactatgcttttctcttaatttgttttttgttacaggtggctcagccaagaacctagtgatgggtgaggaaaagaaatcttctcagctgggctcagtggctcatgcctgtaatcctagcactttgggaggccgaggcaggtggatcgaggctgaggcaggagaattgcttgaacctgagaggtggaggttgcagtgagctgagatcacgccactgcactccagcctgggtagcctgggtgacaaagggactttgtctcaaacacacacacacacacacacacacaacacacacacacacacacaaaacaaagaaatcttttatctcctgcagggtttctatgtgatttttacttgagcaatacaagagtatattgtccaggtgagcac

SEQ ID NO: 158 - DNA, 381 bp, Homo sapiens
  chr15.fa.O7frz.97761449
  Located on chromosome 1
  Distance between a terminus base of telomere on chromosomal short arm and 5'-terminus of this base sequence : 17323984
  Distance between 3'-terminus of neighbour sequence of sequence listing upward to telomere on chrosomal short arm and 5'-terminus of this base sequence : 203118
gcagtattgcctttccataataaaaagaaatctgagttctgaaatatatttgcatccatacctgccagataagggactgcagacctggatttcctcttcttttaaaggtgattttctcctatgcctttaggaaaaaaaatattctctctctctctctctctctctctctctctctctctctctctcacacacacacacacacacacacacacacataaacacacacagacaccaattaagatatcatttctctgggggtgtaagacattgtatactttccataacttatctctaattttcaccttaaaagtagctgttattatccccagttaaatacaggtactaaaacaaaaaaggcttaactattactttgtccaacca

SEQ ID NO: 159 - DNA, 323 bp, Homo sapiens
  AL358593.6_182467
  Located on chromosome 1
  Distance between a terminus base of telomere on chromosomal short arm and 5'-terminus of this base sequence : 17702366
  Distance between 3'-terminus of neighbour sequence of sequence listing upward to telomere on chrosomal short arm and 5'-terminus of this base sequence : 378001
ctttaccaaatatcactgttgctcatatggttcgtgcatttgaatatctatctgttcttctgtccatctacctgttctcccatcggtttgtccatccatccatccatccatccatccatcctccagatagtctgtaagctgagcatccattcttccatccagttgcccatccccctccctcccttttacccttcacccatcctccctccattcattctccagcagtgtgccagaggcagctagtgtcagctcacaagaactcaggagccagttatgagcatctctttacaaattcccattcagtgatgtcactttggtagctt

SEQ ID NO: 160 - DNA, 463 bp, Homo sapiens
  chr1.fa.O7frz.19577676
  Located on chromosome 1
  Distance between a terminus base of telomere on chromosomal short arm and 5'-terminus of this base sequence : 17787424
  Distance between 3'-terminus of neighbour sequence of sequence listing upward to telomere on chrosomal short arm and 5'-terminus of this base sequence : 84735
gaaatagaacatgaatggatagatggatggatggatggatggatggatggatggatggatggatagatggataaatagttgatgaaaaagtaagaaggcaggcagatggttggataggcatttggttgagtggtgatttagtagttaagtggatagacagatagatggatttatggatgaattggaagatagacagatggatggatggaacaagggtttgatgtctgcgtgtttggatgtgagagagtgagcaggccaaagataattggatgggtgggtgcaaggttgagtgggtaggttgatggtttggacggtgagttaagtgtatattgggtgggtggtgaagatctggatgggtagatccatgtggtataatagagtggctggctggtgtggtaatggttgcataaagacacaaagtgtcttttcaccttccaatgttatgctcagactcctaagtaaa

SEQ ID NO: 161 - DNA, 239 bp, Homo sapiens
  D1S1592
  Located on chromosome 1
  Distance between a terminus base of telomere on chromosomal short arm and 5'-terminus of this base sequence : 17843535
  Distance between 3'-terminus of neighbour sequence of sequence listing upward to telomere on chrosomal short arm and 5'-terminus of this base sequence : 55648
ggtgacaggtattgactgcctgtggtgcttcaggcagagggagagagaaatagtcacagtccttaccctggtgagttaaaaggataatgcttaagatgccattcacccacccttctatccatttgtcattcattcattcattcattcattcattcattcatgtatccattcatttattcggtaaatagcaagcacctactactgtataggagtaaacccgagacaatctctgccctcaa

SEQ ID NO: 162 - DNA, 431 bp, Homo sapiens
  AL356552.8_16518
  Located on chromosome 1
  Distance between a terminus base of telomere on chromosomal short arm and 5'-terminus of this base sequence : 17998100
  Distance between 3'-terminus of neighbour sequence of sequence listing upward to telomere on chrosomal short arm and 5'-terminus of this base sequence : 154326
ataaaataggctgtctggctagacgtggatcacatgcccactcctgtggtggggagggtctttggcctcacccctccatggacccatcataaggaagagcagggtgctgttccccaaaggagaaggggatggtgggtaggtgaagcaatcaatgcccccttgcccacagcaaggcaggggctgacaccctgaagggggtgttgaggatgaagcgtgtgcgtgtgcgtgcatgcgaacacttgtgtgtgtgtgtgtgtgtgtgtgtgtacgtgtgtgtgtgcatgaacacccggcatttctaggagctcaagaagtgctggctgacctggctgctggtgagtgggaagaagatgtcagggccagggtgatggcattgggtagtttctcagaggacagtttgggttcccagtaaacattaagttgctcctagc

SEQ ID NO: 163 - DNA, 467 bp, Homo sapiens
  chr1.fa.O7frz.19691160
  Located on chromosome 1
  Distance between a terminus base of telomere on chromosomal short arm and 5'-terminus of this base sequence : 18264838
  Distance between 3'-terminus of neighbour sequence of sequence listing upward to telomere on chrosomal short arm and 5'-terminus of this base sequence : 266307
tttgtcaatgcttatagcctataagagcatggtgattcttcagttgtttgcccattcttctatccatccatccattcatccatccatccatccatccatccatccatccctccattcatccagcacttattttgagccagtgacgttgtccttcttacactgggccctcagcactgtgggctgggactatctggagaatgaaggggttagttcacacagcctatctgccttcaggctttgtcaagggataggtgctttgaagccacaaggtgaaatacactgaccccagcgaaagtgacaaatttggccctgcccagatctggtcttccagtctccagccccttcctctgtagagatgtgcatgaagaagtgtcccagcacctggattacagagtgagaaactgaggcttggaggagggggctaagcctgcctcaagagcatggcaatctaaagccaaacttcactc

SEQ ID NO: 164 - DNA, 407 bp, Homo sapiens
  AL356101.7_59618
  Located on chromosome 1
  Distance between a terminus base of telomere on chromosomal short arm and 5'-terminus of this base sequence : 18369231
  Distance between 3'-terminus of neighbour sequence of sequence listing upward to telomere on chrosomal short arm and 5'-terminus of this base sequence : 103926
aggcaggacaattgatcacttgagcccaggaggtcaaggctgctgtgagccatgattgtgccagttcactccagcctgggtaacagagcgagaccctgcctcaaaaaacacaaaaaaaaaagaaaaagaaaagaaagaaagagagagagagaaagagaaagaaaaagaaagaaagaaagaaagaaagaaagaaagaaagaaagaaagaaaggaaggaaggaaggaaggaaggaaggaaggaaggaaggaaggaaggaaggaaggaaaagagaaagaaagaaagaaagggaaggaaggaaggaaggaaggaaggaaggaaggaaggaaggaaggaaggaaaagcaatcctctcctctcaggaaggttctaggtgtctgatctctgtttgctcagtgaagataagaaag

SEQ ID NO: 165 - DNA, 245 bp, Homo sapiens
  AL356101.7_71886
  Located on chromosome 1
  Distance between a terminus base of telomere on chromosomal short arm and 5'-terminus of this base sequence : 18382811
  Distance between 3'-terminus of neighbour sequence of sequence listing upward to telomere on chrosomal short arm and 5'-terminus of this base sequence : 13173
gaatggatgtttggatagatgtttggagggatggatgaatagatggatgtttggaaggatggatatttggatggatggatggatggatggatggatggatggatggatgggtggatggatggatggatggatggatgagtgggtgaatgggtgagtgattgtcttagaaagcatccagaattcctaggggaaacttagaggagcttttccttgagattccacagtactatccttgcatcaggatg

SEQ ID NO: 166 - DNA, 160 bp, Homo sapiens
  Z67335
  Located on chromosome 1
  Distance between a terminus base of telomere on chromosomal short arm and 5'-terminus of this base sequence : 18451950
  Distance between 3'-terminus of neighbour sequence of sequence listing upward to telomere on chrosomal short arm and 5'-terminus of this base sequence : 68894
gctaaggctgggcttggggtgtgtgtgtgtgtgtgtgtgtgtgtgtgtgtgtgtgtgtgtgtgttgcggggaggcgatctaatatttccagggcccaggaagcagttgggggtcagggtgctacaacaaaagagggaccctccctccaacctgtcagccc

SEQ ID NO: 167 - DNA, 437 bp, Homo sapiens
  AL356101.7_163058
  Located on chromosome 1
  Distance between a terminus base of telomere on chromosomal short arm and 5'-terminus of this base sequence : 18472959
  Distance between 3'-terminus of neighbour sequence of sequence listing upward to telomere on chrosomal short arm and 5'-terminus of this base sequence : 20849
ggcatagcgttaggagaaatacctaatgtaaatgatgagttgatgggtgcagcaaaccaacatggcacacgtatacttaagtaacaaacctgcacgttgtgcacatgtaccctagaacttaaagtataataataataataataataataataataataaagaaatatgagcctgggacaaaggggtagagtaaaccaggagaaacaaaatgtgagcagcttctcctgcacctccattgaccctcgggctccatgggaacacttccactttcccgtgccaggcccagaagcgggctcctccccagaggaggtgccactcgagggaacagtgacagagtctggggcctcagcctggcccaagtccctccccaatcacttttgctcaacacccccgtgtgagctcctgattgctactgctccacgttactgtggacttac

SEQ ID NO: 168 - DNA, 168 bp, Homo sapiens
  AL031737_48999
  Located on chromosome 1
  Distance between a terminus base of telomere on chromosomal short arm and 5'-terminus of this base sequence : 18591776
  Distance between 3'-terminus of neighbour sequence of sequence listing upward to telomere on chrosomal short arm and 5'-terminus of this base sequence : 118380
gttgtcacgacagcacacaaaaccacctgaactattattattattattattattattattattattattattattttgagacaaagtctcaccctgtcacccaggctggagtgcagtggcgcgatcttgtctcactgtaacctccaccccctggattcaagcgattct

SEQ ID NO: 169 - DNA, 207 bp, Homo sapiens
  AL021528.1_111000
  Located on chromosome 1
  Distance between a terminus base of telomere on chromosomal short arm and 5'-terminus of this base sequence : 18665748
  Distance between 3'-terminus of neighbour sequence of sequence listing upward to telomere on chrosomal short arm and 5'-terminus of this base sequence : 73804
aacaaactcattaaacttgtcaacactcattaggcctgtaaaacattgaactagagccactggggagacttggagagggtgtgtgtgtgtgtgtgtgtgtgtgtgtgtgtgtgtgtgtctgggagtgtgtgctccaaagctgaaccaggccctgggagacccatctcctaggctttgcaggggcagaagtcacattcgtttgttcat

SEQ ID NO: 170 - DNA, 371 bp, Homo sapiens
  AL021528.1_68508
  Located on chromosome 1
  Distance between a terminus base of telomere on chromosomal short arm and 5'-terminus of this base sequence : 18708222
  Distance between 3'-terminus of neighbour sequence of sequence listing upward to telomere on chrosomal short arm and 5'-terminus of this base sequence : 42267
gccaccttcacctattatctatattgttatttacttttcaacgaaatcaagtgttttaaaataaaaatgcacaacactcccataaagggaaggcaattgttaaaatacacacacacacacacacacacacacacactacacacaaaggaaaacaaaacaacatgattaaagcctttcaggaaaatgtcacctgcaaacgcctcctctccctgcattcagaagggagattggcacaggttagaaaggcactgaggatgcattagcaccaaactgagacccctcttccccccttctccatgcccaggaggcctgggagagaagtggaatggaataactttcccatcctcatgtccaggttattgaattctgtt

SEQ ID NO: 171 - DNA, 225 bp, Homo sapiens
  AL021528.1_66693
  Located on chromosome 1
  Distance between a terminus base of telomere on chromosomal short arm and 5'-terminus of this base sequence : 18710048
  Distance between 3'-terminus of neighbour sequence of sequence listing upward to telomere on chrosomal short arm and 5'-terminus of this base sequence : 1455
atgtatggattgatacgtgaagtgccagcacaggaaggggagacaaaaatgttgggttattatcccactaatgtttgataaatccgtgtgtgtgtgtgtgtgtgtgtgtgtgtgtgtgtgtgtgtttcctatttcaaggaggcccagggtgtgtaagcaaagtagggcctcagtctccagagaaagaacccggcttgcacatctgggtctgaagtgcaggtctca

SEQ ID NO: 172 - DNA, 227 bp, Homo sapiens
  D1S2644
  Located on chromosome 1
  Distance between a terminus base of telomere on chromosomal short arm and 5'-terminus of this base sequence : 18710061
  Distance between 3'-terminus of neighbour sequence of sequence listing upward to telomere on chrosomal short arm and 5'-terminus of this base sequence : -212
tacgtgaagtgccagcacaggaaggggagacaaaaatgttgggttattatcccactaatgtttgataaatccgtgtgtgtgtgtgtgtgtgtgtgtgtgtgtgtgtgtgtgtttcctatttcaaggaggcccagggtgtgtaagcaaagtagggcctcagtctccagagaaagaacccggcttgcacatctgggtctgaagtgcaggtctcattcaggtgggttgca

SEQ ID NO: 173 - DNA, 239 bp, Homo sapiens
  AL021528.1_22123
  Located on chromosome 1
  Distance between a terminus base of telomere on chromosomal short arm and 5'-terminus of this base sequence : 18754649
  Distance between 3'-terminus of neighbour sequence of sequence listing upward to telomere on chrosomal short arm and 5'-terminus of this base sequence : 44361
gaagatgagtggatagaaggatggaaggatgatggatggatgaaagaatggatgagtagacaggacggatggatggatggatggatggatggataaatggatggatggatggatggatggatggatggatggatggatggatggatgggtgtagatagagtgaatggaagaataaacaaaaagaacctcaatttctaggagagtctcttcttttttccagctgctgttgattatctggc

SEQ ID NO: 174 - DNA, 176 bp, Homo sapiens
  G09194
  Located on chromosome 1
  Distance between a terminus base of telomere on chromosomal short arm and 5'-terminus of this base sequence : 18852013
  Distance between 3'-terminus of neighbour sequence of sequence listing upward to telomere on chrosomal short arm and 5'-terminus of this base sequence : 97125
agatctctagcctcatggagcttatattccagcaggagaaagatggactatctatctatctatctatctatccatctatctattatctatctatctcatttatccatctatctattatctatctatctatctatctatctatctatctatctatctatctgcctatccatccatcc

SEQ ID NO: 175 - DNA, 137 bp, Homo sapiens
  DISD22_0011912
  Located on chromosome 1
  Distance between a terminus base of telomere on chromosomal short arm and 5'-terminus of this base sequence : 19196738
  Distance between 3'-terminus of neighbour sequence of sequence listing upward to telomere on chrosomal short arm and 5'-terminus of this base sequence : 344549
ctgccacaggacagacacactcgtgtgcacatgcacacacacacacacacacacactcactcactctctcttcttcctcctccctttctacccttgaacccactctacaaacccataattctctaaatgttctgagg

SEQ ID NO: 176 - DNA, 382 bp, Homo sapiens
  AL357564.8_21694
  Located on chromosome 1
  Distance between a terminus base of telomere on chromosomal short arm and 5'-terminus of this base sequence : 19269330
  Distance between 3'-terminus of neighbour sequence of sequence listing upward to telomere on chrosomal short arm and 5'-terminus of this base sequence : 72455
caggtttagaactcctggactaggctgggcacggtggctcacaccttaaatcccaacacttttgagaggccgagatgagaggatcacttatgcccagcaattttagaccagcttggcaacctagagagggagaccctgtctctacaaaaaaattaaaaagttacccaggcatggtggcatgtacctatggtaccagctacttgggaggctgaggtgcaccactgcactccagcctgggtgacagaacaagaccttgtctcaaaacaaaaaattaaataaataaataaataaataaataaataaataaataaaacctcctggaatagaagaaactcccaaatggaaaaatttttggaatttaaacaatcagttcaaggctaat

SEQ ID NO: 177 - DNA, 383 bp, Homo sapiens
  AL360017.5_19326
  Located on chromosome 1
  Distance between a terminus base of telomere on chromosomal short arm and 5'-terminus of this base sequence : 19415212
  Distance between 3'-terminus of neighbour sequence of sequence listing upward to telomere on chrosomal short arm and 5'-terminus of this base sequence : 145500
cagatggtaaagctttaaactgatccactggccaggtgaggcgactcatgcctggaatcccaacactttgggaggctgaggcaggtggattgcgtaagctgagttcaagaccagcctgggcaacgtggtggtgtgcacctgtagacctagctacctgggaggttaaggtgggaggattgcttgggccctggaggtcaaggctgcagtgagtcaagacagcaccactgcactccagcctgggtgacagagaccttgtctcaaacaaaacaaaacaaaacaaaacaaaacaaaacaaaacacaggaaaacctggatctgcttagcattggccctagggcagggagtgggttaccttccaccgtggattaactcagttcaactgat

SEQ ID NO: 178 - DNA, 380 bp, Homo sapiens
  AL035413.19_36339
  Located on chromosome 1
  Distance between a terminus base of telomere on chromosomal short arm and 5'-terminus of this base sequence : 19415213
  Distance between 3'-terminus of neighbour sequence of sequence listing upward to telomere on chrosomal short arm and 5'-terminus of this base sequence : -382
agatggtaaagctttaaactgatccactggccaggtgaggcgactcatgcctggaatcccaacactttgggaggctgaggcaggtggattgcgtaagctgagttcaagaccagcctgggcaacgtggtggtgtgcacctgtagacctagctacctgggaggttaaggtgggaggattgcttgggccctggaggtcaaggctgcagtgagtcaagacagcaccactgcactccagcctgggtgacagagaccttgtctcaaacaaaacaaaacaaaacaaaacaaaacaaaacaaaacacaggaaaacctggatctgcttagcattggccctagggcagggagtgggttaccttccaccgtggattaactcagttcaactg

SEQ ID NO: 179 - DNA, 107 bp, Homo sapiens
  AL035413_34648
  Located on chromosome 1
  Distance between a terminus base of telomere on chromosomal short arm and 5'-terminus of this base sequence : 19417125
  Distance between 3'-terminus of neighbour sequence of sequence listing upward to telomere on chrosomal short arm and 5'-terminus of this base sequence : 1532
acagagcaagactctgcctcaaacaaacaaacaacaacaacaacaaaaaacggctctagacaacaacaacaacaacagactccggaggctgatttgttaaggccaag

SEQ ID NO: 180 - DNA, 323 bp, Homo sapiens
  AL035413.19_3968
  Located on chromosome 1
  Distance between a terminus base of telomere on chromosomal short arm and 5'-terminus of this base sequence : 19447613
  Distance between 3'-terminus of neighbour sequence of sequence listing upward to telomere on chrosomal short arm and 5'-terminus of this base sequence : 30381
atgtaagattccacgagtctttcttctcctaccctatgttctcccgtcacatgtatggtgtgttctgcttctgggatctcaccaaggagtagcagcaagacttgggacaaataagtggtcttaggtcaggcatggtggctcacgcctataatcccagcactttgggaggccaaggtggggggatcacttgactccaggagttcaagaccagcctgggcaacatagtgagaccgtgtcttaaaatatatatatatatatatatatatataaataaaataaatggtcatgagggacactttttgctgtactggtgcttggtcatg

SEQ ID NO: 181 - DNA, 277 bp, Homo sapiens
  AC026576.2_84623
  Located on chromosome 1
  Distance between a terminus base of telomere on chromosomal short arm and 5'-terminus of this base sequence : 19504181
  Distance between 3'-terminus of neighbour sequence of sequence listing upward to telomere on chrosomal short arm and 5'-terminus of this base sequence : 56245
gcctgtagttccagcaactcgggaggctgaggcaggagaatggcatgaacccgggaggcagagcttgcagtgagcccagatcactccagcctgggcgacagagcgagactccatctcaaaaacaacaacaacaacaacaacaacaacaacaaacccacacataacccctaaaaatttctggtcttcagaaagtatctcaactagatattagcaatcctccttataaatgaaaagcaaattaagatataagtaagcctgtctaatttgaaacggtgat

SEQ ID NO: 182 - DNA, 207 bp, Homo sapiens
  AC026576.2_137063
  Located on chromosome 1
  Distance between a terminus base of telomere on chromosomal short arm and 5'-terminus of this base sequence : 19525047
  Distance between 3'-terminus of neighbour sequence of sequence listing upward to telomere on chrosomal short arm and 5'-terminus of this base sequence : 20589
agacctcagactgttgacgtcagtttctggtccacagctgccttggaaacctccctgagccaaaattaaaacaacagctttctctcagggtatgcttaagttattgttgttgttgttgttgttttaaaaagaaaaaaagacaacaggtttgatgtgacactcagtgtctccggtgtgccaggcactgtgtcaggtactttacaaaca

SEQ ID NO: 183 - DNA, 187 bp, Homo sapiens
  D1S2647
  Located on chromosome 1
  Distance between a terminus base of telomere on chromosomal short arm and 5'-terminus of this base sequence : 19583182
  Distance between 3'-terminus of neighbour sequence of sequence listing upward to telomere on chrosomal short arm and 5'-terminus of this base sequence : 57928
tacctcctccctgaaatgttgaaggagcgggagactaaaacctccttctatacctacttttcccttctataaatggagagcatgatacctatctcatacaattgctgtgaggtttttgtgttttgtgtgtgtgtgtgtgtgtgtgtgtgtgtgtgtgtgtgttttgagatggagtcttgccgttgtt

SEQ ID NO: 184 - DNA, 100 bp, Homo sapiens
  D1S199
  Located on chromosome 1
  Distance between a terminus base of telomere on chromosomal short arm and 5'-terminus of this base sequence : 19711357
  Distance between 3'-terminus of neighbour sequence of sequence listing upward to telomere on chrosomal short arm and 5'-terminus of this base sequence : 127988
ggtgacagagtgagaccctgtcttaaaaaaaattaaaaaccacacacacacacacacacacacacacacacacacttatttacggagcacatggtctttg

SEQ ID NO: 185 - DNA, 125 bp, Homo sapiens
  DISO7_10000561
  Located on chromosome 1
  Distance between a terminus base of telomere on chromosomal short arm and 5'-terminus of this base sequence : 19945294
  Distance between 3'-terminus of neighbour sequence of sequence listing upward to telomere on chrosomal short arm and 5'-terminus of this base sequence : 233837
aggaggtcactgtcgaggaaaaactgaacaactgtgttttttgttttgttttgttttgttttgttttgttttgttttgttttgtttttttctgtaacacggggccgaggctggagccaagactac

SEQ ID NO: 186 - DNA, 134 bp, Homo sapiens
  DISO7_10000564
  Located on chromosome 1
  Distance between a terminus base of telomere on chromosomal short arm and 5'-terminus of this base sequence : 20185678
  Distance between 3'-terminus of neighbour sequence of sequence listing upward to telomere on chrosomal short arm and 5'-terminus of this base sequence : 240259
tctcatggctaaagttctgaagtaaaagctataggatctttgtgtgtgtgtgtgtgtgtgtgtgtgtgtgtatgtgtatatatttaaaaggcatttataatttctataatttgatgtttaattggcaattcaat

SEQ ID NO: 187 - DNA, 462 bp, Homo sapiens
  chr1.fa.O7frz.21716175
  Located on chromosome 1
  Distance between a terminus base of telomere on chromosomal short arm and 5'-terminus of this base sequence : 20249859
  Distance between 3'-terminus of neighbour sequence of sequence listing upward to telomere on chrosomal short arm and 5'-terminus of this base sequence : 64047
aggtacatggttagtcagtgatataagtggaattttttttaaaaaaactagacttattttattttattttattttattttattttattttattttattttattttattttattttttgagacagagtgtcactctgttgcccaggctggagtgcagtgtcgcgatctgggctcactgaaacctctgcctcccaggtccaagtgattctcctgcctcagcctcctgaatagctgggattacaggcacccaccacgatgcctggctaatttttgtatttttagtagagacgaggttttgccatgttgggcaggctggtcttgaactcctgaccccaggtgatctgcctgcctcagccaccctaagtgttgggattacaggcatgagccaccatgcctggcctagactttatctttatatggcagttttaggttcacagcaaaattgagaaggtatggagatttc

SEQ ID NO: 188 - DNA, 179 bp, Homo sapiens
  D1S2843
  Located on chromosome 1
  Distance between a terminus base of telomere on chromosomal short arm and 5'-terminus of this base sequence : 20322060
  Distance between 3'-terminus of neighbour sequence of sequence listing upward to telomere on chrosomal short arm and 5'-terminus of this base sequence : 71739
gggctgggcattacacaacactggagagcaaaaggcaggtactgctgacgttaactgcatgtactgctgacattaaacagaccgccatttcactgtgcactggcaaaggcgcgcgtgcgtgcgcacacgcacacacacacacacacacacacacacacacggtgagaagccaatttgat

SEQ ID NO: 189 - DNA, 229 bp, Homo sapiens
  Z98257.1_38697
  Located on chromosome 1
  Distance between a terminus base of telomere on chromosomal short arm and 5'-terminus of this base sequence : 20322116
  Distance between 3'-terminus of neighbour sequence of sequence listing upward to telomere on chrosomal short arm and 5'-terminus of this base sequence : -123
gcatgtactgctgacattaaacagaccgccatttcactgtgcactggcaaaggcgcgcgtgcgtgcgcacacgcacacacacacacacacacacacacacacacggtgagaagccaatttgattctccaaaggattgtataattcttaggtgattttaaaatagctgatgaagaatccactttaatcttttttgggtgggtgatgaagggctgaagagcatcgctaaga

SEQ ID NO: 190 - DNA, 398 bp, Homo sapiens
  AL020998.1_28940
  Located on chromosome 1
  Distance between a terminus base of telomere on chromosomal short arm and 5'-terminus of this base sequence : 20447750
  Distance between 3'-terminus of neighbour sequence of sequence listing upward to telomere on chrosomal short arm and 5'-terminus of this base sequence : 125405
agagtagattcaagaggcagatcaggagctgcagtccaggcagaggtggtggtggcctgggacagggtgctggtggccatgaagggaggatgtggacggatacaagggcttttctagggaagacacatgggtcttggcgatggattggctgtgtgtgtgtgtgtgtgtgtgtgtgtgtgtgtgtgtgtgtgtgtgtgttgcgggcgtgggggtggggggtggtgagaaggaggtgcaggaatgactcccaggttttggcctctacacctggaagaatgtggctccccttactttggtgactattggggttggccctcacataccaagcgttcactgcagtgggcagcctcactgaagtcagaggagggacgtggtgagctattccaacgctctcattc

SEQ ID NO: 191 - DNA, 264 bp, Homo sapiens
  D1S2732
  Located on chromosome 1
  Distance between a terminus base of telomere on chromosomal short arm and 5'-terminus of this base sequence : 20447846
  Distance between 3'-terminus of neighbour sequence of sequence listing upward to telomere on chrosomal short arm and 5'-terminus of this base sequence : -302
cggatacaagggcttttctagggaagacacatgggtcttggcgatggattggctgtgtgtgtgtgtgtgtgtgtgtgtgtgtgtgtgtgtgtgtgtgtgtgttgcgggcgtgggggtggggggtggtgagaaggaggtgcaggaatgactcccaggttttggcctctacacctggaagaatgtggctccccttactttggtgactattggggttggccctcacataccaagcgttcactgcagtgggcagcctcactgaagtca

SEQ ID NO: 192 - DNA, 346 bp, Homo sapiens
  AL020998.1_80128
  Located on chromosome 1
  Distance between a terminus base of telomere on chromosomal short arm and 5'-terminus of this base sequence : 20498896
  Distance between 3'-terminus of neighbour sequence of sequence listing upward to telomere on chrosomal short arm and 5'-terminus of this base sequence : 50786
gataatggactgtcactgtgatagacaagccctctccctggccctcaccatggctctaggctgctggggggacctgacgtcccctttgtagtacctcactgacttctatgagcctggcactgcctctccctttgtaagacacgtgcttctttgttcttttcctccactgtgcatcctgtaaaggccagttttgtgtgtgtgtgtgtgtgtgtgtgtgtgtgtgtgtgtctgtgtgtgtgtcctgctgggatggcaattaggatgtcctagtccctcacgggtgaagaacacattgaggaaagcaggttctcggggctcctgggttaaagaactctgtaggagacga

SEQ ID NO: 193 - DNA, 401 bp, Homo sapiens
  AL139254.6_119298
  Located on chromosome 1
  Distance between a terminus base of telomere on chromosomal short arm and 5'-terminus of this base sequence : 20608130
  Distance between 3'-terminus of neighbour sequence of sequence listing upward to telomere on chrosomal short arm and 5'-terminus of this base sequence : 108888
ggacatattcaaaccatagcagatggagtaagtggatggatagatggatagatggacagatggatggatggacagatggatagatggacagatggatggatggatggatggatggatggatggatggataagtgggtggataaatggatggatggatggatggatggatggatgaaaaataggggatggaaaggtaagagacagtaagctcttgacaatgatggttggtatggtaatttaaacccatatcccaagaaggttcaggaaaaaaattaagtcaagatctaacatagacccctagcccagaaaccaccatcccaaaggcctagaactcatgaaactctcagtaaaaatgtctgaaaagatctattggtctttgctccttaaaggtgaagaccatc

SEQ ID NO: 194 - DNA, 428 bp, Homo sapiens
  AC025224.3_137960
  Located on chromosome 1
  Distance between a terminus base of telomere on chromosomal short arm and 5'-terminus of this base sequence : 20609578
  Distance between 3'-terminus of neighbour sequence of sequence listing upward to telomere on chrosomal short arm and 5'-terminus of this base sequence : 1047
tcctaccacgcacactatttatattttcctttttgccttaagcttcatgcagacacgtgcactttcccttgtccttgcatgagctgcagaaacattattattattattattattattattattattattattaaagatggtgtttcactcttgttgcccaagctggagtgcaatggcatgacctcggctgactgcaacctctgcctcccgggttcaagtgattctcctgcctcagcctccccagtagctgggattacaggcgcctgccgccatgcctggccaattttttgtatttttagtagagatggggtttcaccatgttggccaggctggtctcgatctcctgacctcaggtgttccacccgcctcagcctcccaaagtgctgggattacaggcgtgagccaccgtgcctggcagatacattatt

SEQ ID NO: 195 - DNA, 396 bp, Homo sapiens
  AL356300.5_107869
  Located on chromosome 1
  Distance between a terminus base of telomere on chromosomal short arm and 5'-terminus of this base sequence : 20723673
  Distance between 3'-terminus of neighbour sequence of sequence listing upward to telomere on chrosomal short arm and 5'-terminus of this base sequence : 113667
gataccactggtgataagtagcagaaaaaatatttaaactgatgggtctgatgtcaagtcctgcaccccttgcccatccattatactggctcctcctatgaattctgggatggatgagagcccaggattcagatgacagacaaactcaggtttaagatctattattattattattattattattattattattattattattagacagtatcttgctctgtcacccaggaatgcagtggcaacatcatagttcactgcagcctcgaactcctgggttcaagccaccctcccacctcagcctcctgagtagctgagactaaaggcatgtgccaccatacctggctaatttttttttaaattttcgtagagatggggtcttagtatgttgcacccgct

SEQ ID NO: 196 - DNA, 374 bp, Homo sapiens
  AL365439.2_120643
  Located on chromosome 1
  Distance between a terminus base of telomere on chromosomal short arm and 5'-terminus of this base sequence : 20746546
  Distance between 3'-terminus of neighbour sequence of sequence listing upward to telomere on chrosomal short arm and 5'-terminus of this base sequence : 22477
caggaacgttgagtaagttagaagcccaggcttcagggtcagtgaaaccagtttccaaatccagccgcattatggaccttgggcatgctgcttagaccctgagcctggcttctcatctgtgaaatggaggagactggtctgttacagggtcttaagaaacgatttctgtaaagttcctgacacagggtatgtaatacattcaaactattatatagttttgttttgttttgttttgttttgttttgtttgagaacaagtctctctgtgccgcccaggctggagtgtagtggcaagatttcggctcactgcaacctccgcctcccaggttcaagcgattctcatgcttcagcctcctgagtaattgagactacagg

SEQ ID NO: 197 - DNA, 436 bp, Homo sapiens
  AC019062.2_96903
  Located on chromosome 1
  Distance between a terminus base of telomere on chromosomal short arm and 5'-terminus of this base sequence : 20992326
  Distance between 3'-terminus of neighbour sequence of sequence listing upward to telomere on chrosomal short arm and 5'-terminus of this base sequence : 245406
aattaaggtcttagtggctgagtgtggctcataactgtaatcccagcacgcaggaggccaaggtgggaggatcactgcagcccacgagtgcaagactagcctaggcaacacagtgagactccatctctacaaaaaattaaaaaaaaaaaaaaaaatcagccaggtgtgatggcgtgcacctgtagtcccagctactcaggagactgaggcaggaagattgcttgaacctaggtggttgaggctgtggtgagttgtgatcatgccactacactccagcctgggtgacagagcgggatcccatctcaaaaatatataaataaataaataaataaataaataaataaaggtcttaattaaatagtctaaatgaatgaattgaaattaaaaaaatacttaaaattatttaaggatcctgagaaaggatctatgttgaaag

SEQ ID NO: 198 - DNA, 480 bp, Homo sapiens
  AL358392.10_69753
  Located on chromosome 1
  Distance between a terminus base of telomere on chromosomal short arm and 5'-terminus of this base sequence : 21090432
  Distance between 3'-terminus of neighbour sequence of sequence listing upward to telomere on chrosomal short arm and 5'-terminus of this base sequence : 97670
tcaaattgtagtttaacctccaatttcatctcttctctcctaaagaagtaactcaaccaggccaggtgttgtggctcatgcctgtaatcccagcactctgggaggccaaggcagacagatcaccagaggtcaagagttcgagatcagcctggccaacatgatgaaaccccgtctctaccaaaaatacaaaaattagccaggagtggtggcaggtgcctgttaattccagctattcgggaggctgaggcaggagaattgcttgaacccaggaggtggaggttgcagtgagccgaggtcgcgccactgcactccagcctaggcaacaagagcaaggctccgtctcgaaaacaagcaaacaaacaaacaaacaaacaaacagtctataacaaaggagttccttatcttcccaaagaaaaaataatgatgaactattttactaatcaataagtcagaaaaatcaggaaacataccaagtactgt

SEQ ID NO: 199 - DNA, 268 bp, Homo sapiens
  AC019062.2_173924
  Located on chromosome 1
  Distance between a terminus base of telomere on chromosomal short arm and 5'-terminus of this base sequence : 21090644
  Distance between 3'-terminus of neighbour sequence of sequence listing upward to telomere on chrosomal short arm and 5'-terminus of this base sequence : -268
gtgcctgttaattccagctattcgggaggctgaggcaggagaattgcttgaacccaggaggtggaggttgcagtgagccgaggtcgcgccactgcactccagcctaggcaacaagagcaaggctccgtctcgaaaacaagcaaacaaacaaacaaacaaacaaacagtctataacaaaggagttccttatcttcccaaagaaaaaataatgatgaactattttactaatcaataagtcagaaaaatcaggaaacataccaagtactgt

SEQ ID NO: 200 - DNA, 171 bp, Homo sapiens
  DISO7_10000565
  Located on chromosome 1
  Distance between a terminus base of telomere on chromosomal short arm and 5'-terminus of this base sequence : 21204891
  Distance between 3'-terminus of neighbour sequence of sequence listing upward to telomere on chrosomal short arm and 5'-terminus of this base sequence : 113979
gatatcttatccatgaaatggaagtttcagtatcttaatttcttggagttaaagaaaaatcttttatgactttacacacacacacacacacacacacacacacacacacaagtttaagtttaaatgcggttaactaatataatttaatacaaggcatgtcaaggcaaacag

SEQ ID NO: 201 - DNA, 234 bp, Homo sapiens
  AL031005.1_22222
  Located on chromosome 1
  Distance between a terminus base of telomere on chromosomal short arm and 5'-terminus of this base sequence : 21422387
  Distance between 3'-terminus of neighbour sequence of sequence listing upward to telomere on chrosomal short arm and 5'-terminus of this base sequence : 217325
gcatcctcgtagcctaattcccacttatgagtgagaacatacgatgttcggttttccattcctgagttacttcacttagaataatggtctccaatcctatccaggttgctgtgaatgccattaattctttccttttttatggctgagtagtattctattgtgtgtgtgtgtgtgtgtgtgtgtgtgtgtgtgtgtgtgtgtgtggtgtgtgtgtatttctttatccactcattg

SEQ ID NO: 202 - DNA, 171 bp, Homo sapiens
  D1S478
  Located on chromosome 1
  Distance between a terminus base of telomere on chromosomal short arm and 5'-terminus of this base sequence : 21501549
  Distance between 3'-terminus of neighbour sequence of sequence listing upward to telomere on chrosomal short arm and 5'-terminus of this base sequence : 78928
gcattcatttattcagcaagataatgactaccttccaggttctctgctgagtatggagtgcgtgtgtgtgcatgtgtgcacctgcgtgaaagtgtgtgcccgtgcgtgtgtgcgtgtgtgtgtgtgtgtgtgtgtgtgtgtgtgtgtgtagggtactggggtattgggcat

SEQ ID NO: 203 - DNA, 419 bp, Homo sapiens
  AL031728.12_60794
  Located on chromosome 1
  Distance between a terminus base of telomere on chromosomal short arm and 5'-terminus of this base sequence : 21570632
  Distance between 3'-terminus of neighbour sequence of sequence listing upward to telomere on chrosomal short arm and 5'-terminus of this base sequence : 68912
tggtactatcttgctctgtgaccctgggcaacctccttcacctctctgtgcctgctgcagggtggtttgagtacaaccggaggcaggagacataaaaagcctcctcagaaccctcggcccacggcttgcactgggagaaaacagggggagacggtccatccgaggcccttaagaacagcactgactccctgccaaggggttagagacgtgggtggggagctggtgaccatcagggagattcagtgaggacaacaggaaacacatcacacagacacacagacacacacagatacacacacacacacacacacacacacacacacacacacacgccctgcaaacgcgccgcattaggaacccaggggccaaggacaacttggccacactgcaaagaagtgagtgctggatttgtttaaaag

SEQ ID NO: 204 - DNA, 321 bp, Homo sapiens
  chr1.fa.O7frz.23566230
  Located on chromosome 1
  Distance between a terminus base of telomere on chromosomal short arm and 5'-terminus of this base sequence : 21729961
  Distance between 3'-terminus of neighbour sequence of sequence listing upward to telomere on chrosomal short arm and 5'-terminus of this base sequence : 158910
tagttcagattctgattgtgaatctgattggctcagctcctccttttgaatcaggagacaagaccagggattggctgaaccccatctagtcagctgtggctagaggagtgtgtgtgtgtgtgtgtgtgtatgtgtgtatgtgtggtgtcctgggatggctgcttagtgcaacaggtgttgtggtagcttccccagcatcagggaacctgcaagcagggcctctaggtgtgtctaagtttgttttttgttgcttataatagaatatctgaagctgagtaatttataaggaaaaataatttataccttacagttatggaggct

SEQ ID NO: 205 - DNA, 272 bp, Homo sapiens
  D1S2828
  Located on chromosome 1
  Distance between a terminus base of telomere on chromosomal short arm and 5'-terminus of this base sequence : 21855463
  Distance between 3'-terminus of neighbour sequence of sequence listing upward to telomere on chrosomal short arm and 5'-terminus of this base sequence : 125181
ggctcctgaacctgggcttgctggtttagtcccagtcacagtggatcctcccctaactccattggttagcaccggtgtctcccagagttaggccaatggccaggcccagactgaggtcacacatcttccgaacccccaaggagtcaccccctcttcccaacacacacacacacacacacacacacacacacacacacacacacacacacacacatacaatgactaggagcatgatctctcccatgcaccttaatggaaggtcagccaaagct

SEQ ID NO: 206 - DNA, 402 bp, Homo sapiens
  AC020565.4_40915
  Located on chromosome 1
  Distance between a terminus base of telomere on chromosomal short arm and 5'-terminus of this base sequence : 22013311
  Distance between 3'-terminus of neighbour sequence of sequence listing upward to telomere on chrosomal short arm and 5'-terminus of this base sequence : 157576
ttgaagccaggaattcaagaccagtcagggcagcaaagcaagaccccatctctatttttaaaaaactatgtaactggctgggtgtggtggctctactaaaaatacaataattaggtgggtatggtggcatgcgcctgtaatcccagctactcgggaggctgaggcaggagaatcacttgaacccaaaaggtggaggttgcagtgagagcagataacgccactgcactccagcctgggtgacagagcgagactccgtctcaaaataataataataataataataataataataataataataataaggcaggtatgtatttggggctcctgctaaatgagattttagcttctcttgccacacacaaaatttgtaactgtgagataacagatgtcaatctgctt

SEQ ID NO: 207 - DNA, 101 bp, Homo sapiens
  DISD22_0011917
  Located on chromosome 1
  Distance between a terminus base of telomere on chromosomal short arm and 5'-terminus of this base sequence : 22129130
  Distance between 3'-terminus of neighbour sequence of sequence listing upward to telomere on chrosomal short arm and 5'-terminus of this base sequence : 115417
cgtctagtccaaccctcttctatgtacacacacacacacacacacacacacacacacacacacacacagtcaccctacatgggaattcccttgacagcatc

SEQ ID NO: 208 - DNA, 337 bp, Homo sapiens
  AL031279.1_39464
  Located on chromosome 1
  Distance between a terminus base of telomere on chromosomal short arm and 5'-terminus of this base sequence : 22440803
  Distance between 3'-terminus of neighbour sequence of sequence listing upward to telomere on chrosomal short arm and 5'-terminus of this base sequence : 311572
gaacaagtcctctagcttgttcttcattttcaagtttgacttggatattcttggtgttttgcatttccaaacaaattttagaatcatcttgacacctttctgtctctctctctgtcacacacacacacacacacacacacacacacacacacacacacacttatgggattttaaatcataatttcactgaatttccacatcaatatgaggagaattgacatctttataatagggaatcttctgatccagcttatagtttgtttaaaaaataaagttgactttatattttcctttgtaaagtaataaagcagaagaattggaaatgtaaacatacaga

SEQ ID NO: 209 - DNA, 274 bp, Homo sapiens
  AL031279.1_45457
  Located on chromosome 1
  Distance between a terminus base of telomere on chromosomal short arm and 5'-terminus of this base sequence : 22446703
  Distance between 3'-terminus of neighbour sequence of sequence listing upward to telomere on chrosomal short arm and 5'-terminus of this base sequence : 5563
ttagattagctaggacttccagtataatgttgaataggagttgtgagagaggacatccatgccttgttcccaatctcagggggaaagtgtctggttgcttgtcattaagtatgatgttggctgtagtgttttttgtagtttttgaaaaaatcaagttgaggaagtttacccctattcctaatttgctgagaggtgttttttgtttttggtgtgtgtgtgtgtgtgtgtgtgtgtgtgtgtgtgtgtgtgtgtgtatgttctatcatgaatggat

SEQ ID NO: 210 - DNA, 155 bp, Homo sapiens
  D1S2702
  Located on chromosome 1
  Distance between a terminus base of telomere on chromosomal short arm and 5'-terminus of this base sequence : 22468078
  Distance between 3'-terminus of neighbour sequence of sequence listing upward to telomere on chrosomal short arm and 5'-terminus of this base sequence : 21101
ataaacacagacacacctgccagggcacacccatgggcacgcataggtgtctcacagtcactggcatgtgtgtcctagcgcatgcgccacacacacacacacacacacacacacacacacacacacacacacatcgatgcacattcttcaggtaa

SEQ ID NO: 211 - DNA, 283 bp, Homo sapiens
  AL031279.1_110019
  Located on chromosome 1
  Distance between a terminus base of telomere on chromosomal short arm and 5'-terminus of this base sequence : 22511293
  Distance between 3'-terminus of neighbour sequence of sequence listing upward to telomere on chrosomal short arm and 5'-terminus of this base sequence : 43060
actgatccaggagcagattacaagggagactggagccaaatccgctttgaaaaagagctggtggagtttaactcccgctcagtgaggtcacctggaaaagctccttccctgcctgggagccgggtgtagagttggggtgagggggatgtggggccagagcagagttctggtaaggagctctgtgtgtgtgtgtgtgtgtgtgtgtgtgtgtgtgtgtgtgtgtgcgcgccagggtgtatgtgcatgtatgtgtatatttggggatgcatgtatgaggacgtat

SEQ ID NO: 212 - DNA, 353 bp, Homo sapiens
  HUMUT5123
  Located on chromosome 1
  Distance between a terminus base of telomere on chromosomal short arm and 5'-terminus of this base sequence : 22583493
  Distance between 3'-terminus of neighbour sequence of sequence listing upward to telomere on chrosomal short arm and 5'-terminus of this base sequence : 71917
ccatctggataatccagggtactctacccatatcaaggtccttaatcacatctgaaaagtccctattgccatgtaaatgcatgtattcacagttctgctcctcccttccccttccctcccctcccctcccttcccttcctttctctcccttcccttcctccctttttctttctttctttctctttctttctttctttctttctttctttctttctttctttctttctttctttttctttctttcctcccttccttccttcccctttcttgttctctttctcactctctttctccctccctccctcccttccttccttttcttttatggggtttcactcttgttgcccaggctg

SEQ ID NO: 213 - DNA, 297 bp, Homo sapiens
  AL358788.2_45924
  Located on chromosome 1
  Distance between a terminus base of telomere on chromosomal short arm and 5'-terminus of this base sequence : 22604902
  Distance between 3'-terminus of neighbour sequence of sequence listing upward to telomere on chrosomal short arm and 5'-terminus of this base sequence : 21056
aggatagtccatctttggagaccagttactgcattatcctcccagacattttattcacttctccatcctagtttctttctttccctccctccctttttccattccattccattccattccactccactccactccactccattccactccattccattcctttctcttgctttctttattcaacagggtcatatccaagctgtagcacagtggtgtaatcacagctcactacagcctcaaattcctgagcagttcttgtgcctctgcttcccaactagctgattaaattagaggtgc

SEQ ID NO: 214 - DNA, 446 bp, Homo sapiens
  AL358788.2_105818
  Located on chromosome 1
  Distance between a terminus base of telomere on chromosomal short arm and 5'-terminus of this base sequence : 22617375
  Distance between 3'-terminus of neighbour sequence of sequence listing upward to telomere on chrosomal short arm and 5'-terminus of this base sequence : 12176
ccaccagccattctacaaccaaccaccaatccaatcttccttccttccttccttccttccttccttccttctttccttccttccttccttcattccttccttccttctttccttccttccttccttccttcattccttccttccttcctttctttctccttccttccttccttccttcctctctctctctttctctctctctcctctctctctctttcttttctttcaagacagagtcttgctctgttgcccaggctggagtgcagtggcttgagctcggctcactgcaacctctgcctcccgagctcaagtggttcttgtgcctcagccttctgagtagctgggattacaggcacccgccaccacgcctggctaatttttgtatttttagtagagacaggttttcgccatgttggccaggccggttttaaactcctgacctcagg

SEQ ID NO: 215 - DNA, 159 bp, Homo sapiens
  D1S2864
  Located on chromosome 1
  Distance between a terminus base of telomere on chromosomal short arm and 5'-terminus of this base sequence : 22798328
  Distance between 3'-terminus of neighbour sequence of sequence listing upward to telomere on chrosomal short arm and 5'-terminus of this base sequence : 180507
tctttcattcagtcgctccctttcctcccttcttcccaggtgtgtgtgtgtgtgtgtgtgtgtgtgtgtgtgtgtgtgtgtgtgtagggcagagcgggagggctacctgggaaataaactcccttcccacatacagccttggtttcgggcattagagct

SEQ ID NO: 216 - DNA, 491 bp, Homo sapiens
  AC025929.3_119355
  Located on chromosome 1
  Distance between a terminus base of telomere on chromosomal short arm and 5'-terminus of this base sequence : 22861492
  Distance between 3'-terminus of neighbour sequence of sequence listing upward to telomere on chrosomal short arm and 5'-terminus of this base sequence : 63005
ttatgtaacttgctccatgtcacacagcaggtgagtgagaatcaggatccaaacacaggtcaggctgactcctcggggagaggcagtgttggtgtgtgctggggctgggaggagggttgaggatgtgggccctgtctgaagtttgggagtcacccagccagccagcaggtcacacctgaatctgtcttccgatttctcctgggggagagcatcccaggcccactggccagggataatgagtgatgagtagagggatgcttgctttctctctctctctctctttctttctttcttctttccttctttctttctctctttctttctcttccttccttccctccctccctccttccttcctccctccctctcttctttctttctttctttctttctttctttctttccttttcttttttttttcagacagcgtcttgctctgtcactcaggctgaagtgcagtggcaccctcacaacttactgcagcctcgaac

SEQ ID NO: 217 - DNA, 396 bp, Homo sapiens
  AL158086.6_46792
  Located on chromosome 1
  Distance between a terminus base of telomere on chromosomal short arm and 5'-terminus of this base sequence : 22861668
  Distance between 3'-terminus of neighbour sequence of sequence listing upward to telomere on chrosomal short arm and 5'-terminus of this base sequence : -315
tgaatctgtcttccgatttctcctgggggagagcatcccaggcccactggccagggataatgagtgatgagtagagggatgcttgctttctctctctctctctctttctttctttcttctttccttctttctttctctctttctttctcttccttccttccctccctccctccttccttcctccctccctctcttctttctttctttctttctttctttctttctttccttttcttttttttttcagacagcgtcttgctctgtcactcaggctgaagtgcagtggcaccctcacaacttactgcagcctcgaactcctgggctcaagtgatcctctcacctcagcttcccaagtagccaggactacaggcgtgcactaccgtgactggctaactt

SEQ ID NO: 218 - DNA, 141 bp, Homo sapiens
  D1S2698
  Located on chromosome 1
  Distance between a terminus base of telomere on chromosomal short arm and 5'-terminus of this base sequence : 23205632
  Distance between 3'-terminus of neighbour sequence of sequence listing upward to telomere on chrosomal short arm and 5'-terminus of this base sequence : 343568
accacacccggcctagattgtattttgataagtgtttgtgtgtgtgtgtgtgtgtgtgtgtgtgtgcgcgcacgtgcgcatgtgtgtacgtgtgtgtctatttcctgcaccttctttaaacttttggtttgagggactccc

SEQ ID NO: 219 - DNA, 260 bp, Homo sapiens
  AL031428.9_74116
  Located on chromosome 1
  Distance between a terminus base of telomere on chromosomal short arm and 5'-terminus of this base sequence : 23301497
  Distance between 3'-terminus of neighbour sequence of sequence listing upward to telomere on chrosomal short arm and 5'-terminus of this base sequence : 95724
cagtaatgagtcgattatgaaatagataactttttaagcatctggaactgtttgtgtgtgtgtgtgtgtgtgtgtgtgtgtgtgtgtgtaaaacttaaatcttgataataatcttttaagttaaatcatgagaatgacagactttgggactttctaacatagtttttttttctttccttaagagaataatataattgaaattcttgcatcggctgttgagttataagaaatgttttgtaagctttgttattaaccagaca

SEQ ID NO: 220 - DNA, 162 bp, Homo sapiens
  D1S458
  Located on chromosome 1
  Distance between a terminus base of telomere on chromosomal short arm and 5'-terminus of this base sequence : 23373849
  Distance between 3'-terminus of neighbour sequence of sequence listing upward to telomere on chrosomal short arm and 5'-terminus of this base sequence : 72092
atccaacttccacacctccaccaaaacatgcacacatgcacacatacctgcacctgcgcgcatgcatgaacgcgcacacatacacacacacacacacacacacacacacacccatccctgcctctatcttcccagagagcaaggcggctagaattacaatgg

SEQ ID NO: 221 - DNA, 191 bp, Homo sapiens
  AL049576.19_23247
  Located on chromosome 1
  Distance between a terminus base of telomere on chromosomal short arm and 5'-terminus of this base sequence : 23433246
  Distance between 3'-terminus of neighbour sequence of sequence listing upward to telomere on chrosomal short arm and 5'-terminus of this base sequence : 59235
tatgatcacttcctacctttacacacacacacacacacacacacacacaaagtttatccaaacttctcttagcacacccactgctttcccacatttgaccctttgctgaagctcttcccctgctgtctcacctcccagcttctcccagccagaaagcaatcctccctgttctgaataaccaataacattgt

SEQ ID NO: 222 - DNA, 464 bp, Homo sapiens
  AL353585.24_83564
  Located on chromosome 1
  Distance between a terminus base of telomere on chromosomal short arm and 5'-terminus of this base sequence : 23474834
  Distance between 3'-terminus of neighbour sequence of sequence listing upward to telomere on chrosomal short arm and 5'-terminus of this base sequence : 41397
tccaatgatacctattccacaggattgaaccttggagaactcttccctgcaatacactccaaatcctttttatgtatgtatgtatgtatgtatgtatgtatgtatgtatgtatgtatgtatttttatttatttatttttaggcaggctcactctctctgttgcctaggctggagtacagtggcatgatcatggctcactgcagcctcaacctcctgagctcaagccttcctcctgcctcagcctcccaagttgctagaactgcaggtgcaccatcatgcctggcaaattttaaaaaaatttttttatagagatggggtctccctatgttgcccaggctgatcttgaactcctaagttcaagtgatcttcctgcctcagcctcccaaagtaccagattacagttgtgaatcatcatgcccagccccaaatccttttctacatttcctattgtttacctatccaga

SEQ ID NO: 223 - DNA, 217 bp, Homo sapiens
  chr1.fa.O7frz.24771200
  Located on chromosome 1
  Distance between a terminus base of telomere on chromosomal short arm and 5'-terminus of this base sequence : 23684244
  Distance between 3'-terminus of neighbour sequence of sequence listing upward to telomere on chrosomal short arm and 5'-terminus of this base sequence : 208946
cttgctactgaaatgaatacatttatgtacatgaaaaggttacaaaatagtatacagagtgtaattcaattttattaaaacaaataggtattttatacctatttataggtagtaatgcataggaatagtctagcaggatgtatatatatatatatatatatataaattttatatgtatatatacacacaattatatgtgagtgcttgtttctagata

SEQ ID NO: 224 - DNA, 122 bp, Homo sapiens
  D1S2734
  Located on chromosome 1
  Distance between a terminus base of telomere on chromosomal short arm and 5'-terminus of this base sequence : 23783910
  Distance between 3'-terminus of neighbour sequence of sequence listing upward to telomere on chrosomal short arm and 5'-terminus of this base sequence : 99449
tggcactcagacctcaaaatgatactatttcagaacacagcacggaacatgtgtgtgtgtgtgtgtgtgtgtgtgtgtgtgtgtgtgtgtgtgtgtgtctgtgcaggagaatcccttgaacc

SEQ ID NO: 225 - DNA, 269 bp, Homo sapiens
  AL021154.1_68238
  Located on chromosome 1
  Distance between a terminus base of telomere on chromosomal short arm and 5'-terminus of this base sequence : 23788669
  Distance between 3'-terminus of neighbour sequence of sequence listing upward to telomere on chrosomal short arm and 5'-terminus of this base sequence : 4637
ctgaccaacatggtgaaaccccatctctactaaaaaaaaaatacaaaacttagccgggagtagtggcgggcatctgtaatctcagctacttgggaggctgaggcaggagaatcgcttcaacccaggaggcggagattgcagtcagccaagattgtgtcactgcactccagcctgggcaacagagtgagactctgtctcaaaaataaataaataaataaataaataaatcaaacaaaacagaagatctcatactaggaatgagcttagtg

SEQ ID NO: 226 - DNA, 392 bp, Homo sapiens
  AL021154.1_76617
  Located on chromosome 1
  Distance between a terminus base of telomere on chromosomal short arm and 5'-terminus of this base sequence : 23796991
  Distance between 3'-terminus of neighbour sequence of sequence listing upward to telomere on chrosomal short arm and 5'-terminus of this base sequence : 8053
tacatgctcgtaacagtcctaccacatcagtattggcactggctctcggaagccaaaaaatggagacttacagagagtaagcacatgcccaaggtcacacaaaggccggagccagggtttgaacccaggcctgtctgactgcaaagccatgtaccaggctgcctcagctgcatcccacacacgctgccccaggatttgctagaatttgggccaaggcctgggctacgcccacctgcccccatcactgcatgtacttgcacacacacacacacacacacacacacacagccttctctcttttctcactctccttcacccttattctgcactcccagggtcccaatgcggcaagtgtccccctaaggatacctccctgacacctttggacagtg

SEQ ID NO: 227 - DNA, 180 bp, Homo sapiens
  D1S482
  Located on chromosome 1
  Distance between a terminus base of telomere on chromosomal short arm and 5'-terminus of this base sequence : 23797172
  Distance between 3'-terminus of neighbour sequence of sequence listing upward to telomere on chrosomal short arm and 5'-terminus of this base sequence : -211
cgctgccccaggatttgctagaatttgggccaaggcctgggctacgcccacctgcccccatcactgcatgtacttgcacacacacacacacacacacacacacacagccttctctcttttctcactctccttcacccttattctgcactcccagggtcccaatgcggcaagtgtccccct

SEQ ID NO: 228 - DNA, 170 bp, Homo sapiens
  D1S2838
  Located on chromosome 1
  Distance between a terminus base of telomere on chromosomal short arm and 5'-terminus of this base sequence : 23805068
  Distance between 3'-terminus of neighbour sequence of sequence listing upward to telomere on chrosomal short arm and 5'-terminus of this base sequence : 7716
gaatcgcttgaacccaggaggtggaggttgcaatgagccaagatcgtgccactgcactccagcctgggtcacagagcgagaccctgtctcaaacacacacacacacatacacacacacacacacacacacacacacacacaaaaccctcagagtttctgccgtacacgcc

SEQ ID NO: 229 - DNA, 167 bp, Homo sapiens
  AL021154.1_86839
  Located on chromosome 1
  Distance between a terminus base of telomere on chromosomal short arm and 5'-terminus of this base sequence : 23807384
  Distance between 3'-terminus of neighbour sequence of sequence listing upward to telomere on chrosomal short arm and 5'-terminus of this base sequence : 2146
tgttccttcatctgataaacagggctaatcacagctgtctcgggtttattgcgttgaagtgaatctgggatgggatgtgaatgtgctgtgtgtgtgtgtgtgtgtgtgtgtgtgtaccaaaatttattaagaaggcaaacaatttggttggacaactcttcaaagaa

SEQ ID NO: 230 - DNA, 100 bp, Homo sapiens
  D1S2620
  Located on chromosome 1
  Distance between a terminus base of telomere on chromosomal short arm and 5'-terminus of this base sequence : 23807444
  Distance between 3'-terminus of neighbour sequence of sequence listing upward to telomere on chrosomal short arm and 5'-terminus of this base sequence : -107
gaatctgggatgggatgtgaatgtgctgtgtgtgtgtgtgtgtgtgtgtgtgtgtaccaaaatttattaagaaggcaaacaatttggttggacaactctt

SEQ ID NO: 231 - DNA, 319 bp, Homo sapiens
  chr1.fa.O7frz.24241227
  Located on chromosome 1
  Distance between a terminus base of telomere on chromosomal short arm and 5'-terminus of this base sequence : 24000578
  Distance between 3'-terminus of neighbour sequence of sequence listing upward to telomere on chrosomal short arm and 5'-terminus of this base sequence : 193034
tggtttcaagctaatatgtcaccctaagagttttggactttatattgtttcccaaacttctgttattattattattattattattattattattattattattattattagagacagggtctcactctttctcccagggtggagtgcagtggtgcaatcaaggctcactgcagcctcgaactcctgggcccaagggatcctcctgcttcagcctcctgagtagctgagccttcaggtgccaccatcatgcccagctaacttctgtcattttttatccaccttcatgatttttaccttctctgagttcctaccaacctac

SEQ ID NO: 232 - DNA, 432 bp, Homo sapiens
  chr1.fa.O7frz.24148156
  Located on chromosome 1
  Distance between a terminus base of telomere on chromosomal short arm and 5'-terminus of this base sequence : 24093624
  Distance between 3'-terminus of neighbour sequence of sequence listing upward to telomere on chrosomal short arm and 5'-terminus of this base sequence : 92727
aacattataaactcaattccacttccttccttccccgtaacagctcttcacataataattcagtttttaaacacttaatatttgccaggcacatacaagagccatttacatatttatttatttatttatttatttgagatacagtctcattctgtctccaggctggagagcagtggcgcgatcttggctcactgcaaccttcacctcccaggttcaagtgattctcctgcctcagcctcccgagtagctgggactacaggtgcgcaccaccacacctggctaattttttgtattttagtagagacaggatttcaccaggttggccaggctggtcccgaactcccgacctcaagtgatccacccacctcagcctcccaaagtgctaggattataggcatgagccaccacgcctggtgagccatttacatatta

SEQ ID NO: 233 - DNA, 141 bp, Homo sapiens
  DISO7_10000569
  Located on chromosome 1
  Distance between a terminus base of telomere on chromosomal short arm and 5'-terminus of this base sequence : 24450514
  Distance between 3'-terminus of neighbour sequence of sequence listing upward to telomere on chrosomal short arm and 5'-terminus of this base sequence : 356458
gtctgccttcttatccttcctttccttcccatccatccatccatccatccatccatccttccttccttccttcccaaccaccctttcttctcaatcatcctttctaaccaatatttttttcttcctatgcctcctttctta

SEQ ID NO: 234 - DNA, 345 bp, Homo sapiens
  chr1.fa.O7frz.26520812
  Located on chromosome 1
  Distance between a terminus base of telomere on chromosomal short arm and 5'-terminus of this base sequence : 24673592
  Distance between 3'-terminus of neighbour sequence of sequence listing upward to telomere on chrosomal short arm and 5'-terminus of this base sequence : 222937
ctaggaagcttgaaaggactatttccacaactttgggatcaggccaacttcagtttgatttcatctctgtcactaaggggagagccaggtgaccttagatgttatatcacctctctgggactgttaccatcttctgtataaaacagggatacttatggcggctacttcacaggcctcttgaattacatgattttatatatatatatatatttatttatttatttatttatatattatttatatatatatttatatatttatatatttatatatatataaaatcaagcactagaacagtgcctgacacatactatggacactgttatctaatcctcatagcaatca

SEQ ID NO: 235 - DNA, 283 bp, Homo sapiens
  AL031431.8_100197
  Located on chromosome 1
  Distance between a terminus base of telomere on chromosomal short arm and 5'-terminus of this base sequence : 24805027
  Distance between 3'-terminus of neighbour sequence of sequence listing upward to telomere on chrosomal short arm and 5'-terminus of this base sequence : 131090
gattagctccacctaagttgagaaatgtagaccaatagggcaagaggcagaagtgtcactttaatggaggtccctccacatggaaacccaagaagtggggaagaagcgtttcccacaaaacacctactaagtcccatgttgtgttataggtgctgggaatacagcagtaggatagatggggcttctgctcacagagattatagtcgtgtgtgtgtgtgtgtgtgtgtgtgtgtgtgtgtgtgttgtgggaggggagagatacaataaacaagcaactaaatga

SEQ ID NO: 236 - DNA, 255 bp, Homo sapiens
  D1S2674
  Located on chromosome 1
  Distance between a terminus base of telomere on chromosomal short arm and 5'-terminus of this base sequence : 24882621
  Distance between 3'-terminus of neighbour sequence of sequence listing upward to telomere on chrosomal short arm and 5'-terminus of this base sequence : 77311
tcaactgtctctgtaacagtaaacatttggaaattgaaatatctatggatatttcaaaatccctaaatatatatacacatatatttacacaaatatgtatacacacacatatataaaggtatatcaaatctatattatttctaatacacacacacacacacacacacacacacacacacacacatatatattttttttcttcagatggagtctcattctgtttcccaggctggagtgcagtggtacaatctcggc

SEQ ID NO: 237 - DNA, 154 bp, Homo sapiens
  DISD22_0011938
  Located on chromosome 1
  Distance between a terminus base of telomere on chromosomal short arm and 5'-terminus of this base sequence : 24916509
  Distance between 3'-terminus of neighbour sequence of sequence listing upward to telomere on chrosomal short arm and 5'-terminus of this base sequence : 33633
gcaacagattataggcaccccctcttatggtgcatgtgtgtatgtgtgcatgtgtgtgtgtgtgcgcttgtgtgcatgtgtgtgcatgtgggtgtgtgcacgtgtgtgcgtgtgtgtgcgtgtgtgtgttggtggtggtagtagaaagtgacag

SEQ ID NO: 238 - DNA, 194 bp, Homo sapiens
  DISD22_0011939
  Located on chromosome 1
  Distance between a terminus base of telomere on chromosomal short arm and 5'-terminus of this base sequence : 24995155
  Distance between 3'-terminus of neighbour sequence of sequence listing upward to telomere on chrosomal short arm and 5'-terminus of this base sequence : 78492
acagttcctcttacatagggaagagagtagagatatgtgtgtgtgtgtgtgtgtgtgtgtgtgtgtgtgtgtgtgtgtgtgtgtgtatgattagaatatagtggaaaatatgctatgagaccatatgtgaaaaattgaatcctgttttggaaggtctagacccagggtttttgggaggctcagcaactccctaa

SEQ ID NO: 239 - DNA, 157 bp, Homo sapiens
  D1S1676
  Located on chromosome 1
  Distance between a terminus base of telomere on chromosomal short arm and 5'-terminus of this base sequence : 25222540
  Distance between 3'-terminus of neighbour sequence of sequence listing upward to telomere on chrosomal short arm and 5'-terminus of this base sequence : 227191
ggcacagttggcagagtaagaatctattgaggaagaaaggaggaaaggagggaaggagggaaggatagaaggaaggaaggaaggaaggaaggaaggaaggaaggaaggaaggaaggaaggaaggaagtaagtcaggcaggctaagctccagtccaag

SEQ ID NO: 240 - DNA, 425 bp, Homo sapiens
  AL023096.1_19965
  Located on chromosome 1
  Distance between a terminus base of telomere on chromosomal short arm and 5'-terminus of this base sequence : 25248624
  Distance between 3'-terminus of neighbour sequence of sequence listing upward to telomere on chrosomal short arm and 5'-terminus of this base sequence : 25927
tatggtatcattgtgaggaactgccaagctgtttcccaaagtggctgaaccattttacatccccaccagcaacatatgagagttctaatttctccacattctcaccagtgcttgttttcctttcctttcctttcctttcctttcctttcctttcctttcctttcctttcctctctctctctttctgtcttttaaattatagccattctagtggatatgaaagagtatctcattgtggttttgatttggatttttcaaatgactaatgatgttgagcatcttttcatgtgcttcttggccattgtatatcttctttgaaaaaatgtctgttcaagcattttgaccatttttaaattgggttattttgtctttctgttgctgaattgcaagagttttttttatatgtcctggattctagatgcttat

SEQ ID NO: 241 - DNA, 459 bp, Homo sapiens
  chr1.fa.O7frz.27078252
  Located on chromosome 1
  Distance between a terminus base of telomere on chromosomal short arm and 5'-terminus of this base sequence : 25321001
  Distance between 3'-terminus of neighbour sequence of sequence listing upward to telomere on chrosomal short arm and 5'-terminus of this base sequence : 71952
aagaggaacctaaaccttcacgctgcctgcaccgattggaccggagtgctcaggctcgcgccaacaagtgtttcaaagaagaagccagacagtgaagggggaagtgagggagaagctggaaaactctcaggctgaccaatcgtcagcccattcattcgttcatccatccatccatccatccatccatccatccatccatccatccattctttctttctttcctctatccattcagtgagaagggctgaatatcacctgtgagcctgcccctgctcccaagaacaccctttggacacctgtggggtgagtagtgaggggcagcaatggcagagcacccccaccgcctggaggggagaaagggaagggctgggaaggctccccaagggggcggccatgaagctgggccttgagaagacaggccagggtttctcaccttccacatcctgcttagagtcagac

SEQ ID NO: 242 - DNA, 334 bp, Homo sapiens
  DISO7_00007679
  Located on chromosome 1
  Distance between a terminus base of telomere on chromosomal short arm and 5'-terminus of this base sequence : 25399029
  Distance between 3'-terminus of neighbour sequence of sequence listing upward to telomere on chrosomal short arm and 5'-terminus of this base sequence : 77569
aggcttcctgatgctgttggcaccactgcccagtcccagctcaggcttctggagagtgggcctcaggatggcagagctggcagaggaggtagaggctagcccatcgtggggacagaatgagagtccatggacctaaagaagagctgggaaccgcaaatcccatgtggaattatgggatatgtgtgtgtgtgtatgtatgtgtgtgtgtgtgtatgtatgtgtgtgtgtgtgtgtgtgtgttcatatacacacattatctgcatttcccaaggaggagggtcaggtttcatcagattctcaaagacaaaaataacatgttcaggaccaggatgct

SEQ ID NO: 243 - DNA, 211 bp, Homo sapiens
  DISO7_00007682
  Located on chromosome 1
  Distance between a terminus base of telomere on chromosomal short arm and 5'-terminus of this base sequence : 25433559
  Distance between 3'-terminus of neighbour sequence of sequence listing upward to telomere on chrosomal short arm and 5'-terminus of this base sequence : 34196
tgtctggacctggtttgagcctggcacaactctgggctctgtagggagtacagagaaaccccaactccaacacacacacacacacacacacacacacacacacacacagctcagggcacaggtagacacggagccacatagccacaggaggacatcaacacacatacactgagtacgtactgtagaccaggcgctgaggcactagcagaat

SEQ ID NO: 244 - DNA, 165 bp, Homo sapiens
  DISO7_10000570
  Located on chromosome 1
  Distance between a terminus base of telomere on chromosomal short arm and 5'-terminus of this base sequence : 25483105
  Distance between 3'-terminus of neighbour sequence of sequence listing upward to telomere on chrosomal short arm and 5'-terminus of this base sequence : 49335
caccatgaacatttataatccatagaaatactattttatgtttttgtgctatataaaatgtgtttaatatatatatatatatatatatatatatatatatatatatatatatagaatatagaagagctacctatttttaaatctgggcctacccatagacttgtt

SEQ ID NO: 245 - DNA, 111 bp, Homo sapiens
  DISD22_0011943
  Located on chromosome 1
  Distance between a terminus base of telomere on chromosomal short arm and 5'-terminus of this base sequence : 25667773
  Distance between 3'-terminus of neighbour sequence of sequence listing upward to telomere on chrosomal short arm and 5'-terminus of this base sequence : 184503
ctgagaaggaaggatgcctctcactcattcattcattcattcattcattcattcattctttcaacaaacactgttgggcacctactttctgtgggaatagaagacaagatt

SEQ ID NO: 246 - DNA, 107 bp, Homo sapiens
  DISD22_0011945
  Located on chromosome 1
  Distance between a terminus base of telomere on chromosomal short arm and 5'-terminus of this base sequence : 25824355
  Distance between 3'-terminus of neighbour sequence of sequence listing upward to telomere on chrosomal short arm and 5'-terminus of this base sequence : 156471
gtcactttccaggtggatgcagtgtgtgtatgcgggcgtgcgtgcgtgcgtgcgtgtgtgtgtgtgtgtgtgtgtgtgtattgaatcccggtgggaattaactctaa

SEQ ID NO: 247 - DNA, 456 bp, Homo sapiens
  chr1.fa.O7frz.28215527
  Located on chromosome 1
  Distance between a terminus base of telomere on chromosomal short arm and 5'-terminus of this base sequence : 26013681
  Distance between 3'-terminus of neighbour sequence of sequence listing upward to telomere on chrosomal short arm and 5'-terminus of this base sequence : 189219
atctgtgaacagtgatagtctgacttcctctttcccaatttggatgtcctttattcctttctcttgccagattgctctggctaggacttccagtactatgtttttgtttgtttgtttgtttgtttgtttttgtttttgagacagagtctcgctctgtcgcccaggctggagtccagtggcacgatcttggctcactgaaacccccgcctcccgcatttaagtgattcttgtgcctcagcctcctgagcagctgggattacaggcatgtaccaccacgcctggttaattttttttgtatttttagaagagacggggttttgccatgttgcccaggctggtctcaaactcctgagcttaggcagtccacccgcctcagcctcccaaagtgctaggattacaggcatgagccaccgcacccagcccagtgctatgtttaatagaagtagtgaaagtcgg

SEQ ID NO: 248 - DNA, 247 bp, Homo sapiens
  D1S2885
  Located on chromosome 1
  Distance between a terminus base of telomere on chromosomal short arm and 5'-terminus of this base sequence : 26195230
  Distance between 3'-terminus of neighbour sequence of sequence listing upward to telomere on chrosomal short arm and 5'-terminus of this base sequence : 181093
gacatccatcccctggcttagtagcacccacttcacacacatacaaacacacacactaacatatatatacacacacacatacacacatatacaaacatacacaaacatatatacacatacaaatgtacatatacacagacatacacacaaatatatatgcctacacacaaacacacacacacacacacacacacacacacacacacacacacttgcacacactacagactcagcccgagtgggaccc

SEQ ID NO: 249 - DNA, 458 bp, Homo sapiens
  AL355525.6_5558
  Located on chromosome 1
  Distance between a terminus base of telomere on chromosomal short arm and 5'-terminus of this base sequence : 26308905
  Distance between 3'-terminus of neighbour sequence of sequence listing upward to telomere on chrosomal short arm and 5'-terminus of this base sequence : 113428
tgtacataaacgtatgaaggacattaaactgttaataatagctatccaggctgggtgcagtggctcacacctgtaatcccagcactttgggaggctgaggtgggtggatcacttgagccaggagttcaagaccagcctgggtaacatggtgaaaccccatctctaaaaaaaaaatacaaaaaattagctgggtattgtgattcatgcctatagtcccagcagcttggaagattgaggtgggagaatcacttgaatccaggaggtcaaggctgcagtgagccatgatcgccccactgcactccagcctgggtgacacagggagaccccagctcaaaaacaaacaaacaaacaaacaaacaaacaaacaaacaaaatagctgtctgatgaagggaatagactaaaaggagacttttactatttgctctatatttatctgtagtgtttgcatctttgtaga

SEQ ID NO: 250 - DNA, 102 bp, Homo sapiens
  DISD22_0011950
  Located on chromosome 1
  Distance between a terminus base of telomere on chromosomal short arm and 5'-terminus of this base sequence : 26392277
  Distance between 3'-terminus of neighbour sequence of sequence listing upward to telomere on chrosomal short arm and 5'-terminus of this base sequence : 82914
tttattctaagtatgatggaaggcatgaatattattattattattattattattattattattgcttattattgtttaggtatggtgaggccaggagatcag

SEQ ID NO: 251 - DNA, 251 bp, Homo sapiens
  DISD22_0011951
  Located on chromosome 1
  Distance between a terminus base of telomere on chromosomal short arm and 5'-terminus of this base sequence : 26614301
  Distance between 3'-terminus of neighbour sequence of sequence listing upward to telomere on chrosomal short arm and 5'-terminus of this base sequence : 221922
tgaatattctctgaaactaggaccaaaagtctctgttaaaatataaatgagctgagagtggtggcacatgctggtagtcccagctactctggaggttgaacgggaggatagcttgagcccaggagtttgagcccagcctgggcaacataaagagactccttctcaaatgcatgtgtgtctgtgtgtgtgtgtgtgtgtgtgtgtgtgtgttcctcctttgaaacaattttccagtctgattcttcaagctc

SEQ ID NO: 252 - DNA, 123 bp, Homo sapiens
  DISD22_0011953
  Located on chromosome 1
  Distance between a terminus base of telomere on chromosomal short arm and 5'-terminus of this base sequence : 26707286
  Distance between 3'-terminus of neighbour sequence of sequence listing upward to telomere on chrosomal short arm and 5'-terminus of this base sequence : 92734
tacggagagcacatgtatctctctctctctcacacacacacacacacacacacacacacacagttccatggtcatagaggtacccacagatgtgtgcagagggacaaactgacagatacacct

SEQ ID NO: 253 - DNA, 226 bp, Homo sapiens
  DISD22_0011959
  Located on chromosome 1
  Distance between a terminus base of telomere on chromosomal short arm and 5'-terminus of this base sequence : 26987526
  Distance between 3'-terminus of neighbour sequence of sequence listing upward to telomere on chrosomal short arm and 5'-terminus of this base sequence : 280117
tgtcatgagtctaactcagtggttaaaagaaacgtctccagccgggcgcagtggtatatgcctgtagtccaagcgttttgggaggccagggtgggtggaccacttgagctcaggagtttgagaccagcctgagcaacatagcgaaacctcatctctacaaaaagaaaaaagaaaagagagagagagagagagagagagagaggtctcctagagtaactcaggcttc

SEQ ID NO: 254 - DNA, 179 bp, Homo sapiens
  DISO7_10000571
  Located on chromosome 1
  Distance between a terminus base of telomere on chromosomal short arm and 5'-terminus of this base sequence : 27080348
  Distance between 3'-terminus of neighbour sequence of sequence listing upward to telomere on chrosomal short arm and 5'-terminus of this base sequence : 92596
aacaatgaacaatgaaagtaatgagaatagcaactattgtttactgagtgcttacgaggtgccaggcactgtaatacacacacacacacacacacacacacacacacacacacacacgttatataggttagtgcattttatcctcacagcaaccccaactaaatcttatacacagaagc

SEQ ID NO: 255 - DNA, 267 bp, Homo sapiens
  chr1.fa.O7frz.30054344
  Located on chromosome 1
  Distance between a terminus base of telomere on chromosomal short arm and 5'-terminus of this base sequence : 27123422
  Distance between 3'-terminus of neighbour sequence of sequence listing upward to telomere on chrosomal short arm and 5'-terminus of this base sequence : 42895
ctagtttgaaactcctgacctcaagtgatccgcctgctttggccttctaaagtgctgggattacaggtgtgagccactgcacccagcctattctgtgcttttaaacaaacagaacacacacacacacacacacacacacacacacacacctacatatatttaatttctcttcctaagcctaagagctttaataacacattgaagcaacctaatttcttgcttatggccatttacatttacagggtacatagtatgttgaacttggga

SEQ ID NO: 256 - DNA, 462 bp, Homo sapiens
  AL358572.6_42825
  Located on chromosome 1
  Distance between a terminus base of telomere on chromosomal short arm and 5'-terminus of this base sequence : 27176331
  Distance between 3'-terminus of neighbour sequence of sequence listing upward to telomere on chrosomal short arm and 5'-terminus of this base sequence : 52642
ttgtctaaccatcaccactgtatatttctagaactttttcatgattccaaatgaaaactctgtacccattaagcagtaactccccattctccccttcttctaacctctggtaacctctattctactttctgtctttgacttcttattctagatatctcatataagtggaatcacagaaaatgtatccttttgtgccagacttatttcatttaccataatggttttttgttgttgttgttgttgttgttgttgttttgagatggagtctcaggctggagtgcagtggcacgatctcggcttaccgtgacctctgcctcccgggttcaagtgattctcctgcctcagcctccagagtagctgggattataggtgcacaccaccatgcctggctaatttttgtatttttagtagagacagggtttcaacatgttggtcagtctgttcttaaactcctgacctcgt

SEQ ID NO: 257 - DNA, 167 bp, Homo sapiens
  AL020997.1_116763
  Located on chromosome 1
  Distance between a terminus base of telomere on chromosomal short arm and 5'-terminus of this base sequence : 27360848
  Distance between 3'-terminus of neighbour sequence of sequence listing upward to telomere on chrosomal short arm and 5'-terminus of this base sequence : 184055
actttgcatagactgaacagtaatttcattttgatattttgcactgcggtgggtgaaccctcccatccctaccccttagcaaaacacacacacacacacacacacacacacacacacacacacactcccctgggagtatctgtctagcatctagcaagttcttattc

SEQ ID NO: 258 - DNA, 429 bp, Homo sapiens
  AL020997.1_90724
  Located on chromosome 1
  Distance between a terminus base of telomere on chromosomal short arm and 5'-terminus of this base sequence : 27386828
  Distance between 3'-terminus of neighbour sequence of sequence listing upward to telomere on chrosomal short arm and 5'-terminus of this base sequence : 25813
gtggtacacatcagctactcagaggctggggcaggaggatcatttgaccctggaaggttgaggctgcagtgagttgaaatcatgccatgtactccagcctcagcaatagagtgaaactctgtctgaaaaaacaaaacaaaacacacacacacacacacacacacacacacacacacacacacaccacatactgacagcattgtcctgttctatgaacacagaagtaaaaactcacccctgacctcaaacagctgtctatttgtaaataaaggatatagacagacaagtaacaaagttattataaataactgctatatccaattggtactacaggagttcagagggcaggaataatcagtaagaactcaagcggccaagaaaggcctcaagagaaggtggacagtgaagtaagaggaaggcatgaataag

SEQ ID NO: 259 - DNA, 166 bp, Homo sapiens
  D1S2787
  Located on chromosome 1
  Distance between a terminus base of telomere on chromosomal short arm and 5'-terminus of this base sequence : 27386870
  Distance between 3'-terminus of neighbour sequence of sequence listing upward to telomere on chrosomal short arm and 5'-terminus of this base sequence : -387
tttgaccctggaaggttgaggctgcagtgagttgaaatcatgccatgtactccagcctcagcaatagagtgaaactctgtctgaaaaaacaaaacaaaacacacacacacacacacacacacacacacacacacacacacaccacatactgacagcattgtcctgt

SEQ ID NO: 260 - DNA, 352 bp, Homo sapiens
  AL020997.1_88111
  Located on chromosome 1
  Distance between a terminus base of telomere on chromosomal short arm and 5'-terminus of this base sequence : 27389542
  Distance between 3'-terminus of neighbour sequence of sequence listing upward to telomere on chrosomal short arm and 5'-terminus of this base sequence : 2506
acaaagatggatttaaatccaggaaatttggctccagagtatatagactctgtgtgtgtgtgtgtgtgtgtgtgtgtgtgtgtttaccttcagaattttttttccccttagggctaattagcatgagtgagaatattaggtcaaaaggcacaaacttttctgtgatgttaagtattgtcaatgaacttagttaaggggtttgggagaaacatgagaaactcagtataagacaagttttatatgaaggtagtttatttcaggaggagatgtcagaacatgaattgaagatatgggccacgcacttagaggtgaaggggttagattggaaaaagatctgaggtcatgatcataa

SEQ ID NO: 261 - DNA, 367 bp, Homo sapiens
  chr1.fa.O7frz.30471539
  Located on chromosome 1
  Distance between a terminus base of telomere on chromosomal short arm and 5'-terminus of this base sequence : 27464246
  Distance between 3'-terminus of neighbour sequence of sequence listing upward to telomere on chrosomal short arm and 5'-terminus of this base sequence : 74352
actaaataccactgaattgttcactttaaaatgcttaattttatgttatgtgaatttcatttcaaattattattattattactttttgagagagggtctcactctcccccaggatggagtgcaaaggctcaatcttggctccctgcagcctcaacatccctgggctcaggtgatactccaacctcagcttcctgagaagctgagactacaggcacacactaccaagttcttcacggcaggctaatttttttgtttgtttgtttgagacgtagtctcactctgttgcccaggctggagtacagtggcgtgatctcggctcactgcaacctccgcctcgcaggttcaagcaattcacctgcctcagcct

SEQ ID NO: 262 - DNA, 210 bp, Homo sapiens
  AL031729.16_27023
  Located on chromosome 1
  Distance between a terminus base of telomere on chromosomal short arm and 5'-terminus of this base sequence : 27559943
  Distance between 3'-terminus of neighbour sequence of sequence listing upward to telomere on chrosomal short arm and 5'-terminus of this base sequence : 95330
aggtaaagtgcttaatgcagtggccagcgcatatagtaagcgctataaattttgtatttgctattcttttatagaggatgtgtgtgtgtgtgtgtgtgtgtgtgtgtgttcatgtgcatgcacatctatgtgcagacggatgagggctggaggtgtgtgtatatggggtgtgtgtacactagaagatgtttgtgctaggaatctgtgcag

SEQ ID NO: 263 - DNA, 261 bp, Homo sapiens
  D1S2639
  Located on chromosome 1
  Distance between a terminus base of telomere on chromosomal short arm and 5'-terminus of this base sequence : 27576329
  Distance between 3'-terminus of neighbour sequence of sequence listing upward to telomere on chrosomal short arm and 5'-terminus of this base sequence : 16176
attgcctctaggctttgggaagagagcctctgtggagtgtgtgtgtgtgcgtgtgtgtgtgtgtgtgtgtgtgtgtgtgatccttcctcctctagttattggtagaaagattccctggaaatcctcctatgctgggtgacctaaaggaaagaaagataaggcaatcaatgcagattgagaattccctgtgtcctgccctgtgctgggggttgctgaatgagagcagtaagatggagagaagccaaatggctgctcagaggg

SEQ ID NO: 264 - DNA, 132 bp, Homo sapiens
  DISD22_0011961
  Located on chromosome 1
  Distance between a terminus base of telomere on chromosomal short arm and 5'-terminus of this base sequence : 27753372
  Distance between 3'-terminus of neighbour sequence of sequence listing upward to telomere on chrosomal short arm and 5'-terminus of this base sequence : 176782
tggtagcaaggttccacagaaaaaagtaaaacttgctgttgatgaagatgatgatgatgatgatgatgatgatgatgatgattttgatgatgaggaagctgaagaaaaagtgccagtgaagaaatctatatg

SEQ ID NO: 265 - DNA, 119 bp, Homo sapiens
  DISD22_0011972
  Located on chromosome 1
  Distance between a terminus base of telomere on chromosomal short arm and 5'-terminus of this base sequence : 28026724
  Distance between 3'-terminus of neighbour sequence of sequence listing upward to telomere on chrosomal short arm and 5'-terminus of this base sequence : 273220
ctgaaggcatctgctgtggacacacacacacacacacacacacacacacacacacacacacagaaagagagagagaaaaacagaaagagagagagcgagaagctaagagggcaggtcag

SEQ ID NO: 266 - DNA, 246 bp, Homo sapiens
  AL356390.5_180792
  Located on chromosome 1
  Distance between a terminus base of telomere on chromosomal short arm and 5'-terminus of this base sequence : 28102471
  Distance between 3'-terminus of neighbour sequence of sequence listing upward to telomere on chrosomal short arm and 5'-terminus of this base sequence : 75628
ccaataagcttggaagatgaccctgagccccagctggggtcacagtctgggctagttccttgatttcagcctggtaagatgctaagcagaggactcaaaacatgctgggcttctgacccacagaaactgtgacacaataaatgtgttttttgtttgtttgtttgtttgtttgtttgtttttgacggagtctcgttctgtcacccaggctggagtgcaatggcacaatctcggcttactgcaacttc

SEQ ID NO: 267 - DNA, 225 bp, Homo sapiens
  D1S2749
  Located on chromosome 1
  Distance between a terminus base of telomere on chromosomal short arm and 5'-terminus of this base sequence : 28221800
  Distance between 3'-terminus of neighbour sequence of sequence listing upward to telomere on chrosomal short arm and 5'-terminus of this base sequence : 119083
ggccatgtgtagcctttcctctgtgtgtgtgtgtgtgtgtgtgtgtgtgtgtgtgtgtgtgtgtgtgtgtgtgtaacagtgagggagtagtatggtgggggatgagggtgcagccaagagaagggctgaatgaataaatgcatttcactgatgtagaaactaaagcccagagagtctgagtcacttgtccaggctcacaaagcaccaagcagtaaaggcaggatc

SEQ ID NO: 268 - DNA, 163 bp, Homo sapiens
  D1S455
  Located on chromosome 1
  Distance between a terminus base of telomere on chromosomal short arm and 5'-terminus of this base sequence : 28228224
  Distance between 3'-terminus of neighbour sequence of sequence listing upward to telomere on chrosomal short arm and 5'-terminus of this base sequence : 6199
cccacaggtagatttaataggaggatccctgcatcctcccccaggtaattttgtgtgtgtgtgtgtgtgtgtgtgtgtgtgtgtgtgtgtgtgtgtggtgtgttccaggctggagggcagggcagtggtgttaatatggttcactgcagccttgacctcctgg

SEQ ID NO: 269 - DNA, 101 bp, Homo sapiens
  DISO7_10007743
  Located on chromosome 1
  Distance between a terminus base of telomere on chromosomal short arm and 5'-terminus of this base sequence : 28326861
  Distance between 3'-terminus of neighbour sequence of sequence listing upward to telomere on chrosomal short arm and 5'-terminus of this base sequence : 98474
atctcggtcttgcactggcgcgcgcgcacacacacacacacacacacacacacacacacacccatctccagcccctgccactgtccagttctcagccacaa

SEQ ID NO: 270 - DNA, 101 bp, Homo sapiens
  DISD22_0011979
  Located on chromosome 1
  Distance between a terminus base of telomere on chromosomal short arm and 5'-terminus of this base sequence : 28480792
  Distance between 3'-terminus of neighbour sequence of sequence listing upward to telomere on chrosomal short arm and 5'-terminus of this base sequence : 153830
aatccacttctcaagctggaacaacaagtggtgtgtgtgtgtgtgtgtgtgtgtgtgtgtgtgtatgtattattttattttttgagatggcatctcgctct

SEQ ID NO: 271 - DNA, 131 bp, Homo sapiens
  DISD22_0011985
  Located on chromosome 1
  Distance between a terminus base of telomere on chromosomal short arm and 5'-terminus of this base sequence : 28891160
  Distance between 3'-terminus of neighbour sequence of sequence listing upward to telomere on chrosomal short arm and 5'-terminus of this base sequence : 410267
ccaaagcagatacaggtgggggacctggtggggggggtagttttaaaaccacgtgactgcacacacacacacacacacacacacacacacacacacaccacccccaccccccgggcagataattatacatt

SEQ ID NO: 272 - DNA, 145 bp, Homo sapiens
  DID22N_0000342
  Located on chromosome 1
  Distance between a terminus base of telomere on chromosomal short arm and 5'-terminus of this base sequence : 29203782
  Distance between 3'-terminus of neighbour sequence of sequence listing upward to telomere on chrosomal short arm and 5'-terminus of this base sequence : 312491
gtggtgcagcactctcactacacacacgcatgcacgtgcacacacacacacacacacacacacacacacacacacccctggccaacagggggtggcctcccaggctttcccacgggtgcgaacccagggtgcatctgtgctcctt

SEQ ID NO: 273 - DNA, 155 bp, Homo sapiens
  D1S470
  Located on chromosome 1
  Distance between a terminus base of telomere on chromosomal short arm and 5'-terminus of this base sequence : 29294862
  Distance between 3'-terminus of neighbour sequence of sequence listing upward to telomere on chrosomal short arm and 5'-terminus of this base sequence : 90935
aagtggggctaataaatctcctggccttgcagagatgtggagaatggataggaaaatgctttgtaaaggagaacacacacgcacacacacacacacacacacacacacaaaattaattaaagtcctctctgcttgcacctatgcctatggtgtag

SEQ ID NO: 274 - DNA, 185 bp, Homo sapiens
  chr1.fa.O7frz.32803217
  Located on chromosome 1
  Distance between a terminus base of telomere on chromosomal short arm and 5'-terminus of this base sequence : 29335525
  Distance between 3'-terminus of neighbour sequence of sequence listing upward to telomere on chrosomal short arm and 5'-terminus of this base sequence : 40508
tcaggtactcaggtcagtacttcccaatgggctccgtctcattctgcctctgtagaccaagttgaccatgccttctctctctctctctctctcacacacacactctctctctctctctctccattttttcagtttctttagctccaccacttcgcactttcctgtttacaagctactcagacttt

SEQ ID NO: 275 - DNA, 211 bp, Homo sapiens
  chr1.fa.O7frz.32373864
  Located on chromosome 1
  Distance between a terminus base of telomere on chromosomal short arm and 5'-terminus of this base sequence : 29375074
  Distance between 3'-terminus of neighbour sequence of sequence listing upward to telomere on chrosomal short arm and 5'-terminus of this base sequence : 39364
gtttggcagtttctatagacaaccaccttatagcccagcaacttcacttctaagtatttaacaaaaagtactaaccaatctgtgtgtgtgtgtgtgtgtgtacgtatgcatgtgcagtattactgtctatatctcacagatgtaaactccatgagaacagggactttgttgatattcattattctctctccagtcattagaacataagatc

SEQ ID NO: 276 - DNA, 260 bp, Homo sapiens
  D1S1622
  Located on chromosome 1
  Distance between a terminus base of telomere on chromosomal short arm and 5'-terminus of this base sequence : 29441494
  Distance between 3'-terminus of neighbour sequence of sequence listing upward to telomere on chrosomal short arm and 5'-terminus of this base sequence : 66209
tcaccctcacatgatgccctttttttggtaccattattattattattattattattattattattattattgcttaactaggagacaacattttttgtacacaattgttataaacatcctccacgttaagataggggaaaagcaaagcagagctaatagtgtacctccatctgcagggaccaaataaaccacttttcaaattgcaaaaaggattagaaactagagttccattaatgtcagttacagctggagacagaggg

SEQ ID NO: 277 - DNA, 156 bp, Homo sapiens
  Z24299.1_182
  Located on chromosome 1
  Distance between a terminus base of telomere on chromosomal short arm and 5'-terminus of this base sequence : 29563276
  Distance between 3'-terminus of neighbour sequence of sequence listing upward to telomere on chrosomal short arm and 5'-terminus of this base sequence : 121522
gtgtttgctgagcacctactatgtgctgggctatgcataagggggctgtgcgtgtgtgtctctgtgtttgcatctgtgtgtgtgtgtgtgtgtgtgtgtgtgtatgtgtgtataagagagatccaggttcttacctgattccacaaggactcagat

SEQ ID NO: 278 - DNA, 136 bp, Homo sapiens
  D1S493
  Located on chromosome 1
  Distance between a terminus base of telomere on chromosomal short arm and 5'-terminus of this base sequence : 29563288
  Distance between 3'-terminus of neighbour sequence of sequence listing upward to telomere on chrosomal short arm and 5'-terminus of this base sequence : -144
cacctactatgtgctgggctatgcataagggggctgtgcgtgtgtgtctctgtgtttgcatctgtgtgtgtgtgtgtgtgtgtgtgtgtgtatgtgtgtataagagagatccaggttcttacctgattccacaagg

SEQ ID NO: 279 - DNA, 169 bp, Homo sapiens
  AL137076.6_59764
  Located on chromosome 1
  Distance between a terminus base of telomere on chromosomal short arm and 5'-terminus of this base sequence : 29821754
  Distance between 3'-terminus of neighbour sequence of sequence listing upward to telomere on chrosomal short arm and 5'-terminus of this base sequence : 258330
aatcaggtaagaacctggatctctcttacacacacacacacacacacacacacgcacacacacacacacacacacacacacacacatgctccttctatgtggaccagcactgacagcacatcctgccgggagcagtgggggataaaacaatgaattcctagcagacctc

SEQ ID NO: 280 - DNA, 176 bp, Homo sapiens
  AL137076.6_59731
  Located on chromosome 1
  Distance between a terminus base of telomere on chromosomal short arm and 5'-terminus of this base sequence : 29821754
  Distance between 3'-terminus of neighbour sequence of sequence listing upward to telomere on chrosomal short arm and 5'-terminus of this base sequence : -169
aatcaggtaagaacctggatctctcttacacacacacacacacacacacacacgcacacacacacacacacacacacacacacacatgctccttctatgtggaccagcactgacagcacatcctgccgggagcagtgggggataaaacaatgaattcctagcagacctcctgagct

SEQ ID NO: 281 - DNA, 400 bp, Homo sapiens
  AL137076.6_51358
  Located on chromosome 1
  Distance between a terminus base of telomere on chromosomal short arm and 5'-terminus of this base sequence : 29830148
  Distance between 3'-terminus of neighbour sequence of sequence listing upward to telomere on chrosomal short arm and 5'-terminus of this base sequence : 8218
atgagctgaagtccattagttcattcattcattcattcattcattcattcattcattcattcatttgtctgagcacctactatgtgccaggcactgttctaggtcccaggcacacagcaggaggtgcaatagacatgtctttgtggagtcaacattttactgaggagaaacatgataaacaaatagctacacagccagtcgggcagtgaaaatggcagaggggaacaaaatacagggtaaagggaatgggggtgctgggtggaggggcagttgatattgggtcattctggccaccactggggaatgtccactccatcacctggcccatgaccactcagctcacttgtgctaggaagtttccagccccagactctgagggtcttgctcatctcctagagtc

SEQ ID NO: 282 - DNA, 235 bp, Homo sapiens
  D1S449
  Located on chromosome 1
  Distance between a terminus base of telomere on chromosomal short arm and 5'-terminus of this base sequence : 29972398
  Distance between 3'-terminus of neighbour sequence of sequence listing upward to telomere on chrosomal short arm and 5'-terminus of this base sequence : 141850
caggtttggggactcagaaaacctgggtccaggacatcagacaagtctctccccatctgggccttggtcaccttctctgtaaaactaggatggttcctaaattcccaaactcactaggacattaggagacctcactctaggcctgaaacagggtcagcattagacacacacacacacacacacacacacacacacacacacacacacactccccatcatgtcctcaccacaaggg

SEQ ID NO: 283 - DNA, 356 bp, Homo sapiens
  U95738.1_40859
  Located on chromosome 1
  Distance between a terminus base of telomere on chromosomal short arm and 5'-terminus of this base sequence : 29972507
  Distance between 3'-terminus of neighbour sequence of sequence listing upward to telomere on chrosomal short arm and 5'-terminus of this base sequence : -126
ctcactaggacattaggagacctcactctaggcctgaaacagggtcagcattagacacacacacacacacacacacacacacacacacacacacacacactccccatcatgtcctcaccacaagggcacatgtctcactgtgagaggggtcttctcttgatgtgtttccccagactgagtgtggggactgattcccgctcctcagtgcatctcggcagcagcaccgggcctggcacatagtaggtgctccgtaagcactggcccagggaatgaatgaatgatcttagtgtatagtgcatgttttaggagctgccccgagtccctttcagaacaactgtagtttgataaacaggtgc

SEQ ID NO: 284 - DNA, 352 bp, Homo sapiens
  AL021921.1_105069
  Located on chromosome 1
  Distance between a terminus base of telomere on chromosomal short arm and 5'-terminus of this base sequence : 29972511
  Distance between 3'-terminus of neighbour sequence of sequence listing upward to telomere on chrosomal short arm and 5'-terminus of this base sequence : -352
ctaggacattaggagacctcactctaggcctgaaacagggtcagcattagacacacacacacacacacacacacacacacacacacacacacacactccccatcatgtcctcaccacaagggcacatgtctcactgtgagaggggtcttctcttgatgtgtttccccagactgagtgtggggactgattcccgctcctcagtgcatctcggcagcagcaccgggcctggcacatagtaggtgctccgtaagcactggcccagggaatgaatgaatgatcttagtgtatagtgcatgttttaggagctgccccgagtccctttcagaacaactgtagtttgataaacaggtgc

SEQ ID NO: 285 - DNA, 280 bp, Homo sapiens
  U95738.1_43788
  Located on chromosome 1
  Distance between a terminus base of telomere on chromosomal short arm and 5'-terminus of this base sequence : 29975291
  Distance between 3'-terminus of neighbour sequence of sequence listing upward to telomere on chrosomal short arm and 5'-terminus of this base sequence : 2428
agcagtaagtgctaaggacacaaagctggaagtcaggggcctcgtttgtcctgatgaaaagcttgctcctgtcctgacactatgaagccagcacatccggtccttctcagagctgctttctgctggggaggctcccggcatgaagaacattgtgtgggaataatggatgcatgaagtaggacccaaggacccttcatttattcattcattcattcattcattcattcattcattcattcccagggcccagccctgggtataaatcagtgaaaccagacag

SEQ ID NO: 286 - DNA, 299 bp, Homo sapiens
  U95738.1_52654
  Located on chromosome 1
  Distance between a terminus base of telomere on chromosomal short arm and 5'-terminus of this base sequence : 29984260
  Distance between 3'-terminus of neighbour sequence of sequence listing upward to telomere on chrosomal short arm and 5'-terminus of this base sequence : 8689
tcctaaaggtggagattatgtctgggtcacatcccagtcatcacatggggatgggacagtgtcccatagtgaaacccaatcaccatgactttgacaatatgaaggaaggaaggaaggaaggaaggaaggaaggaaggaaggaaggaaggaaggaaggaaggaaagagcaattaacaaataaatgatcatggtgaatgtggaaatgctttgtaccctgtaaagtactgagcccaaaggcaggctgagactctggcagggggacacagacacgggatagaaggaggtacaggcgtaaggag

SEQ ID NO: 287 - DNA, 199 bp, Homo sapiens
  AL021921.1_35037
  Located on chromosome 1
  Distance between a terminus base of telomere on chromosomal short arm and 5'-terminus of this base sequence : 30042537
  Distance between 3'-terminus of neighbour sequence of sequence listing upward to telomere on chrosomal short arm and 5'-terminus of this base sequence : 57978
agcctttctaagcatgtaattccccagaatatctttgcatgcctctgttcaccttcgtggagtttccccatcacacacacacacacacacacacacacacacgcatacactcatgagatgcatgtccccagagggctggacctgcctcatttagcctcttcccccaaaggaccaggccttgtgcttcacaagaaagtgc

SEQ ID NO: 288 - DNA, 252 bp, Homo sapiens
  U95738.1_128918
  Located on chromosome 1
  Distance between a terminus base of telomere on chromosomal short arm and 5'-terminus of this base sequence : 30060533
  Distance between 3'-terminus of neighbour sequence of sequence listing upward to telomere on chrosomal short arm and 5'-terminus of this base sequence : 17797
ggcatagcttcctaagtttagttcaaagatcttcccagtaccccatgccacccctccatgacccccaacccctcagcaggccagatgcccagcagaccagatgcccacaggcaagatccatgcatgcacgtacacacacacacacacacacacacacacacacacaaacacagaacacaacacacacacagacacacaacacacacacacacgcactcatgcatccttccaggctgagttacagtgactgat

SEQ ID NO: 289 - DNA, 362 bp, Homo sapiens
  AC023412.3_14647
  Located on chromosome 1
  Distance between a terminus base of telomere on chromosomal short arm and 5'-terminus of this base sequence : 30206223
  Distance between 3'-terminus of neighbour sequence of sequence listing upward to telomere on chrosomal short arm and 5'-terminus of this base sequence : 145438
gaatggtaggacctgcctcttggagttgttggaggaggactggtaatgatgtcttgtcaaacagcccttcactgcacagtgcctgggccatgtgggttcaatgggggattcagggggagctgtgatgacgatgatgatgatgatgatgatgatgatgacaatgatggaggtggtgatgatggttgtgttaaagttctccagagaaacagaaccctttaaatatatgtgtgtgtgtgtgtgtgtgtgtgtgtgtgtgtgtgtgtgcgtgtgtctgtgagagagagagagaagaggagaaagacagagttttcttttaaagaactggctaatgtgatcatggaggctggcaagtccaaaatctg

SEQ ID NO: 290 - DNA, 185 bp, Homo sapiens
  D1S2781
  Located on chromosome 1
  Distance between a terminus base of telomere on chromosomal short arm and 5'-terminus of this base sequence : 30206318
  Distance between 3'-terminus of neighbour sequence of sequence listing upward to telomere on chrosomal short arm and 5'-terminus of this base sequence : -267
gttcaatgggggattcagggggagctgtgatgacgatgatgatgatgatgatgatgatgatgacaatgatggaggtggtgatgatggttgtgttaaagttctccagagaaacagaaccctttaaatatatgtgtgtgtgtgtgtgtgtgtgtgtgtgtgtgtgtgtgtgcgtgtgtctgtgagag

SEQ ID NO: 291 - DNA, 416 bp, Homo sapiens
  chr1.fa.O7frz.33479572
  Located on chromosome 1
  Distance between a terminus base of telomere on chromosomal short arm and 5'-terminus of this base sequence : 30551241
  Distance between 3'-terminus of neighbour sequence of sequence listing upward to telomere on chrosomal short arm and 5'-terminus of this base sequence : 344738
tatgcaactttcgtttcaagaatcatgctgcattgaaaagatgtctatctcttttcacatctccccaccctctacacacacacacacacacacacacacacacacacacacagaggctgtgattcacctccgttcccagcactcaacacagagcttcatcccaagtacgcttccacaaatccaaacccccatcagccccctccccattacccttaccccagcctccacccacccctcccagcctctgcacttcctttccaacctccatgcacctgcttcccatctctttagtcatgtcgtagccaccacctaggagctgggactgcccccctgctcaccatgtctgcccttcctatcacccctcagcagggaggaaaagttgcctatctgttgggtcagatttctgaagactgatg

SEQ ID NO: 292 - DNA, 193 bp, Homo sapiens
  D1S513
  Located on chromosome 1
  Distance between a terminus base of telomere on chromosomal short arm and 5'-terminus of this base sequence : 30584359
  Distance between 3'-terminus of neighbour sequence of sequence listing upward to telomere on chrosomal short arm and 5'-terminus of this base sequence : 32702
agctgagaccctgccttgatcgcaagacacaggcactgagggtctccttccccacccaacttcacacacacacacacacacacacacacacacacacacacactcttaggccgccaccagggagcccactgggcttgcaatggtgtgtgttagtaccatggacagtgctgggagagggcaggctctgaaggct

SEQ ID NO: 293 - DNA, 299 bp, Homo sapiens
  HUMUT2521
  Located on chromosome 1
  Distance between a terminus base of telomere on chromosomal short arm and 5'-terminus of this base sequence : 30687302
  Distance between 3'-terminus of neighbour sequence of sequence listing upward to telomere on chrosomal short arm and 5'-terminus of this base sequence : 102750
aaggattatacagcagctgtttaaatatactcaggttgtaaaggaaaatatgctgtagtgaatgaaaagataggagattttagtagaaaattatgtatgtatgtatgtatctgtctatctgtctatctgtctgtctgtctgtctgtctgtctgtctgtctgtctgtctatctatctatctatctatctatctatctctatctatgaatgagatggagtctcgctctgtcgcccaggctggagtacggtggcgcaatcttggcttactgcaagctctgcctcctgggttcacaccattct

SEQ ID NO: 294 - DNA, 113 bp, Homo sapiens
  DISD22_0012004
  Located on chromosome 1
  Distance between a terminus base of telomere on chromosomal short arm and 5'-terminus of this base sequence : 30928744
  Distance between 3'-terminus of neighbour sequence of sequence listing upward to telomere on chrosomal short arm and 5'-terminus of this base sequence : 241143
ctacattgctctgtggctgttttcttttcttttttccttttaagatgtacacacacacacacacacacacacacacacacacacacacacacactgctccctgactgtgtcaa

SEQ ID NO: 295 - DNA, 248 bp, Homo sapiens
  AL359192.8_125811
  Located on chromosome 1
  Distance between a terminus base of telomere on chromosomal short arm and 5'-terminus of this base sequence : 31072669
  Distance between 3'-terminus of neighbour sequence of sequence listing upward to telomere on chrosomal short arm and 5'-terminus of this base sequence : 143812
tgtctggctagctcctacttatcctggaggtgccagcagaaaattattccctgaggccccaggctgggtgacatcccatgtcatatgtcttttcaattttgttataagtctttattttatttatttatttatttatttatttatttattttgagtctgtctgttgcccaggctggagtgcagtagcacgattatggctcactgcagccttgaactcccaggttcaagtgatcttcctaaattagcctc

SEQ ID NO: 296 - DNA, 449 bp, Homo sapiens
  chr1.fa.O7frz.34270439
  Located on chromosome 1
  Distance between a terminus base of telomere on chromosomal short arm and 5'-terminus of this base sequence : 31287784
  Distance between 3'-terminus of neighbour sequence of sequence listing upward to telomere on chrosomal short arm and 5'-terminus of this base sequence : 214867
ctgtcgcctaggctatctatctatctatctatctatctatctatctatctatctatctatctatctatctttctatcatctatatctatctatctatgtatctatgtgtctatctatctatctaatctctatctatctatctatctagggacagactctccctctgtcacccaggccggagtgcggtggtgcgatcttggctcactgcaacctccacctcacgggctcaagcaattctcatgtctcagcctcccgagtaggtgggattacaggcgtgtgccactatgcccagctaatttttgtatttttagtagagacagggtttcgccacgttgaccaggctggtctcaaactcctggcctcaagtgatctgtctgcctcaccctcccaaagtgctaagattacaggcatgagccaccacgcctggcccattcctggcaatctagacc

SEQ ID NO: 297 - DNA, 469 bp, Homo sapiens
  chr1.fa.O7frz.34175625
  Located on chromosome 1
  Distance between a terminus base of telomere on chromosomal short arm and 5'-terminus of this base sequence : 31339248
  Distance between 3'-terminus of neighbour sequence of sequence listing upward to telomere on chrosomal short arm and 5'-terminus of this base sequence : 51015
attaggctagttggctcattacatcataggggaaaaaaataaaccccatttgcatgaatttcaccaaatttggagattgtgtgttgatctaaaattaaaaacataatgtatataaaacattttagaggccccagagttgtttagataggtaggctatcaacctccagaatcagcttatgtaggtatgtgggatgtagtgatgatggatagagaaagtagtggctcccagtaggagctctaaacagaaagggcaggtattttgagtttcaggcatctgcaggcatccatgtgcatctctctctctctctctctctctctctctctctctgtgtgtgtgtgtgtgtgtgtgtgtgtgtgtgtgtgtgtgtgtgtgtgtgtgaaagagagagtgggagaatgagaatagaggtggataaatttcccaagcaacttcagggagggcagttattttagacaggatgactgattt

SEQ ID NO: 298 - DNA, 135 bp, Homo sapiens
  D1S2765
  Located on chromosome 1
  Distance between a terminus base of telomere on chromosomal short arm and 5'-terminus of this base sequence : 31650395
  Distance between 3'-terminus of neighbour sequence of sequence listing upward to telomere on chrosomal short arm and 5'-terminus of this base sequence : 310678
ttttaccagttttatacgcacgtgtgtgtgtgtgtttgtgtgtgtgtgtgtgtgtgtgtggttccgtgcaattttagcacatgtaaacttgtgtgactgtcatcacagtcaagatacaaactattccatcattgg

SEQ ID NO: 299 - DNA, 458 bp, Homo sapiens
  chr1.fa.O7frz.34588104
  Located on chromosome 1
  Distance between a terminus base of telomere on chromosomal short arm and 5'-terminus of this base sequence : 31664541
  Distance between 3'-terminus of neighbour sequence of sequence listing upward to telomere on chrosomal short arm and 5'-terminus of this base sequence : 14011
cttacttgaattcaagactcaaacacaaacacacactcatgcacacatatgcagacatgcacacacccacacattcacacatgcacacacgcacacacacacacacacacacagcagcccctcttctgagtcccttcactcattctcctacctcggccagcacctagggaagacaagacatcacacaccatgcagatgccatacctgcccaaggacaaagttctgccttgggtttagcttcagtccatcctcctgttctgcagaggttaaggtcactggccccctcccttatgctgctccagttcctctcccacacctcctatgcctaacggcgcatcttcagagcctttgaaaagggctttggctgcaatgggaaagatggtggttgcatcccaggagtcacctcccaggagggaaacagtgtgagtttcagagggtgacatgttaggaatgtccta

SEQ ID NO: 300 - DNA, 98 bp, Homo sapiens
  D1S2832
  Located on chromosome 1
  Distance between a terminus base of telomere on chromosomal short arm and 5'-terminus of this base sequence : 31912504
  Distance between 3'-terminus of neighbour sequence of sequence listing upward to telomere on chrosomal short arm and 5'-terminus of this base sequence : 247505
gcaagacctctctaaaaacgaaaagaaaacacacacacacacacacacacacacacacacacacacacacacacaaaaggaaatgctgaaaggattgc

SEQ ID NO: 301 - DNA, 306 bp, Homo sapiens
  AL136115.12_52600
  Located on chromosome 1
  Distance between a terminus base of telomere on chromosomal short arm and 5'-terminus of this base sequence : 31998919
  Distance between 3'-terminus of neighbour sequence of sequence listing upward to telomere on chrosomal short arm and 5'-terminus of this base sequence : 86317
tgctaactggtagcagcttaagaacaaaaacccaggtttgtttctttctttctttctttctttctttctttctttctttctttctttcttttatttattttgagacaggttttcactctgtcacccaggctgagtgcagtggcgcgatcatggctcaccgcagcctcaacctcctgtctcaagcgatcctcccacctcaggctcctgaggagctgggaacacaggtgcacaccaccaggctaatttttgattttctgtagcaacaaggtttcactatgctgcccaggctgatctcgaattcctgga

SEQ ID NO: 302 - DNA, 306 bp, Homo sapiens; identical to SEQ ID NO: 301
  AL139160.3_144491
  Located on chromosome 1
  Distance between a terminus base of telomere on chromosomal short arm and 5'-terminus of this base sequence : 31998919
  Distance between 3'-terminus of neighbour sequence of sequence listing upward to telomere on chrosomal short arm and 5'-terminus of this base sequence : -306

SEQ ID NO: 303 - DNA, 383 bp, Homo sapiens
  AL356459.10_42574
  Located on chromosome 1
  Distance between a terminus base of telomere on chromosomal short arm and 5'-terminus of this base sequence : 32232350
  Distance between 3'-terminus of neighbour sequence of sequence listing upward to telomere on chrosomal short arm and 5'-terminus of this base sequence : 233125
tttcagtcaaccagatctctagactcactattgtgaggacagcatcaatccgtgaaagatccaccccatgatccaatcacttcccaccaggccccatctccagcactggggattacaattcaacctgagatttatatgggcacaaatatccaaactctatcaactattattaactatattcaccatgctgtgcaatagatctcaaaacaaacaaacaaacaaacaaacaaacaaacgtattcctcctgaggtcttgtaccctttgaccatcattttccctattcccctcagccctcagcctctggtaaccaccattctactttgtttctatggattcaattgttttagattctacatgcaagtggtaacgtggtattagtctg

SEQ ID NO: 304 - DNA, 412 bp, Homo sapiens
  AL031602.14_2459
  Located on chromosome 1
  Distance between a terminus base of telomere on chromosomal short arm and 5'-terminus of this base sequence : 32281470
  Distance between 3'-terminus of neighbour sequence of sequence listing upward to telomere on chrosomal short arm and 5'-terminus of this base sequence : 48737
gagaaatacggctggtgtatcaggggcataagaaaaacctgtcttgccgggcgcggtggctcacgcctgtaatcccagcactttgggaggccgaggtgggcggatcacgaggtcaggagatcgagaccattctggccaacacggtgaaaccccgtctctactaaacacacacacacacacacacacacacacacacacacacacacacacaattagccgggcatggtggcgggcgcctgtagtcccagctactcgggaggctgaggcaggagaatggcgtgaacccgggaggtggaggttgcagtgaacccagattgcacctctgcactccagcctgggcgacagagcgagactccgtcacagaaaaaaaaaagaaaaagaaaaacctgtcttatggcatgaagtacagtat

SEQ ID NO: 305 - DNA, 220 bp, Homo sapiens
  D1S2676
  Located on chromosome 1
  Distance between a terminus base of telomere on chromosomal short arm and 5'-terminus of this base sequence : 32325261
  Distance between 3'-terminus of neighbour sequence of sequence listing upward to telomere on chrosomal short arm and 5'-terminus of this base sequence : 43379
tctgtcagaacaaacgtgtccagaagcagaggcatttctgtgttcaatgctattacagagaaacaaacatgttaaaacacacacacacacacacacacacacacacacacacacacaaagtggctgtactatgagcaaattcttcctccattttctaaactttgtacagatggttatattatttttacaataaaaagtctacagcaaagtatggcaactc

SEQ ID NO: 306 - DNA, 222 bp, Homo sapiens
  D1S241
  Located on chromosome 1
  Distance between a terminus base of telomere on chromosomal short arm and 5'-terminus of this base sequence : 32339479
  Distance between 3'-terminus of neighbour sequence of sequence listing upward to telomere on chrosomal short arm and 5'-terminus of this base sequence : 13998
cactgaaacatccaagttgaaggaggggaagggagatgtgttactaagataaaagggagtcaaaatttattgagtacctactatatagcaggctgtcatctaggttgtgggtgcttgatacacacacacacacacacacacacacacacacacacacatatatcataattttccagtatcattgtgaatgtttagttgatgagggcaagaactttatcagtc

SEQ ID NO: 307 - DNA, 468 bp, Homo sapiens
  AL138800.6_36071
  Located on chromosome 1
  Distance between a terminus base of telomere on chromosomal short arm and 5'-terminus of this base sequence : 32532448
  Distance between 3'-terminus of neighbour sequence of sequence listing upward to telomere on chrosomal short arm and 5'-terminus of this base sequence : 192747
ctggagctgaaccttaagaatgaattcatgccaggagcagtggctcacacctgtaatcccagcactttgggaggccgaggcaggtggatcacctgaggtcaggagttcaagaccaacctgaccaatatggtgaaaccccgtctctactaaaaatacaaaaattaggccgcctgtagtcccagctacttgggaggctgagacagaagaatcacttgaacccaggagctggaggttgcagtgagccaagatggtgccagcgcactccagcctgagcgacagagcaagactccatctcaaaaaataataataataataataataataataataataataataataataattcactgggcaggtaagggagaggtcttccagacagagggaacagctcatacaaaagcatggaaacacaaaaagacatgttttgggaagtgagcttagtggtggaatcacaaggaatgttaa

SEQ ID NO: 308 - DNA, 180 bp, Homo sapiens
  DISD22_0012011
  Located on chromosome 1
  Distance between a terminus base of telomere on chromosomal short arm and 5'-terminus of this base sequence : 32764155
  Distance between 3'-terminus of neighbour sequence of sequence listing upward to telomere on chrosomal short arm and 5'-terminus of this base sequence : 231239
tcttcccacctccagatgtttgatgaataatttacttccatttgtgtgtgtgtgtgtgtgtgtgtgtgtgtgtgtgtgtttaatacttagctcttctagaaagtatttggtgtactgtgtgatgagaagatctaaatttttctctaagtagctaactactgtagataagaaggagggagg

SEQ ID NO: 309 - DNA, 396 bp, Homo sapiens
  chr1.fa.O7frz.36383571
  Located on chromosome 1
  Distance between a terminus base of telomere on chromosomal short arm and 5'-terminus of this base sequence : 33025310
  Distance between 3'-terminus of neighbour sequence of sequence listing upward to telomere on chrosomal short arm and 5'-terminus of this base sequence : 260975
attactgttgcacatactcgactatacagttgggtggatctgacagtacacaacttacaatgggaaactctggctatataatcagttgatcccccatatatatatattctacatcgtttattgtaactcttgtcagttgttaagctgttgcctcttagcgccgcaaccacacttctgtatcaacttgtgtagtgctggggctggggttcagaaattcacattccagcatatatatatatatatatatatatatatatatatatatgtatatatatacgtatatatatatacacatatatacgtatatatatacatacacacatacacatatatatatatacacatactgttgtcacctctgctttggtgaccctcaccagtttctttacagattaa

SEQ ID NO: 310 - DNA, 264 bp, Homo sapiens
  AC026053.4_223
  Located on chromosome 1
  Distance between a terminus base of telomere on chromosomal short arm and 5'-terminus of this base sequence : 33086593
  Distance between 3'-terminus of neighbour sequence of sequence listing upward to telomere on chrosomal short arm and 5'-terminus of this base sequence : 60887
tacctatgtaacaaatctgcacatcctgcacatgtaccctggaactgaaaagttgaagaaaaaaaaagaagaaagaagaaggaagaagaaagaaggagaaggaggaggagaaggagaagaagaagaagagaagaagaaaagaagaagaaagaagaaagaaggaagaagaagaagaagaagaagaagaagaagaagaagaagaaggagaagaagaaggtgcatggttgatgcttgagagcgtttttagttctgatcggaggtaca

SEQ ID NO: 311 - DNA, 421 bp, Homo sapiens
  AL136115.12_110257
  Located on chromosome 1
  Distance between a terminus base of telomere on chromosomal short arm and 5'-terminus of this base sequence : 33168215
  Distance between 3'-terminus of neighbour sequence of sequence listing upward to telomere on chrosomal short arm and 5'-terminus of this base sequence : 81358
atctttcagtttcaacaccagaggacatacaatttaaaaaattaaaaaaattaaaaaacggctgggcatggtggctcacacctgtaatcccagcactttgggaggctgaggcgggcagatcacgaggtcaggagatcgagaccatcctggctaacatggtgaaaccccatctctactaaaaaatataaaaaaattagccgggcatggtggcgggcgcctgtagtcccagctactcggggggctgaggcaggagaatggcgtgaacctgggaggcagagcttgcagtgagccgagatcgcgccactgcactccagcctgggcgacagagcgagactccatctcaaataaataaataaataaataaataaataaataaataaataaataaaaataaaacaacttagaatttcctcagaaagcc

SEQ ID NO: 312 - DNA, 177 bp, Homo sapiens
  HUMUT7543
  Located on chromosome 1
  Distance between a terminus base of telomere on chromosomal short arm and 5'-terminus of this base sequence : 33349736
  Distance between 3'-terminus of neighbour sequence of sequence listing upward to telomere on chrosomal short arm and 5'-terminus of this base sequence : 181100
gggaacaggaggaagaggtggaccgacaagtaacatagaatacagccataggccacccacaccaggctatctatctatcttatctatctatcatctatctatctatctatctatctatctatctatctatctatctatctatgagatggagtctcgctctgtttcccaggctggact

SEQ ID NO: 313 - DNA, 245 bp, Homo sapiens
  AL121991.6_167460
  Located on chromosome 1
  Distance between a terminus base of telomere on chromosomal short arm and 5'-terminus of this base sequence : 33508287
  Distance between 3'-terminus of neighbour sequence of sequence listing upward to telomere on chrosomal short arm and 5'-terminus of this base sequence : 158374
tgtaattccagctagtcaggaggctgaggcaggagaatcacttgaacccggggggcaaaggctgcaatgagctgagatcatgccactgcactccagcctgggcaataggtgagtctccatctcaaacaacaacaacaacaacaacaacaacaacaaaccccccaaaaaaaccaaacaaacagaaaagactgccccattccctgggacaacctggagtgtatacataccactgatactgcctcaag

SEQ ID NO: 314 - DNA, 322 bp, Homo sapiens
  AL049795.20_17716
  Located on chromosome 1
  Distance between a terminus base of telomere on chromosomal short arm and 5'-terminus of this base sequence : 33573350
  Distance between 3'-terminus of neighbour sequence of sequence listing upward to telomere on chrosomal short arm and 5'-terminus of this base sequence : 64818
catattctggtagcatcttcactgaactgggctgaacagtaatcactctaggaaacaaagctaaatttataaactaggtggtttagctaaaggccactgggggaaaactatctcctgtacacatgactatatatccaaagctcaaggtctaaggaaaaaaaaaatgtgtatatatatatgtgtgtgtgtgtgtatatatatatatatatatatatatatatatatatatataaatacatatataatataaaaaatatatatattcctagttcttctagtttgctaatcctaattctctcttaggatttactagttctttggc

SEQ ID NO: 315 - DNA, 261 bp, Homo sapiens
  chr1.fa.O7frz.37142750
  Located on chromosome 1
  Distance between a terminus base of telomere on chromosomal short arm and 5'-terminus of this base sequence : 33815864
  Distance between 3'-terminus of neighbour sequence of sequence listing upward to telomere on chrosomal short arm and 5'-terminus of this base sequence : 242192
tttagacagaaggaacagtatgagaaaagacacagaggcataggtgggtgcagcatgttgaagaagttcaatgctgtggtagagagagagagagagagagagagagagagagcgtgaggatctgacataagatgggcaggaggaaataaggggccagatatgactgtagtgccacctggtgctggaaggagtcagagcctggcctgagatgacattctgctctggaagacttaactggagtcactagtgagtagctcagga

SEQ ID NO: 316 - DNA, 194 bp, Homo sapiens
  D1S201
  Located on chromosome 1
  Distance between a terminus base of telomere on chromosomal short arm and 5'-terminus of this base sequence : 33938058
  Distance between 3'-terminus of neighbour sequence of sequence listing upward to telomere on chrosomal short arm and 5'-terminus of this base sequence : 121933
ggtatggaagtcacccaacagaggctcaagaaggaatctgaaatcccaggagtagccagagtgactgtcaccataaggcaactcatacatgtgcagacacacacacacacacacacacacacacacacacacacacacatgcacagaggggaggactgttctttgacacgggccaccccatcagtcattttgag

SEQ ID NO: 317 - DNA, 190 bp, Homo sapiens
  AL355178.7_42432
  Located on chromosome 1
  Distance between a terminus base of telomere on chromosomal short arm and 5'-terminus of this base sequence : 33971046
  Distance between 3'-terminus of neighbour sequence of sequence listing upward to telomere on chrosomal short arm and 5'-terminus of this base sequence : 32794
aaatctcaccatctaggcataagcattgtgaagattttgctgtaggatcttgggtcttttacagacacgccctccctatttcccatcacacacacacacacacacacacacacacacacacacacatatactcttaccacattgatggtatcccactgtatccaccatgttattgctacagaactctagg

SEQ ID NO: 318 - DNA, 204 bp, Homo sapiens
  D1S2830
  Located on chromosome 1
  Distance between a terminus base of telomere on chromosomal short arm and 5'-terminus of this base sequence : 34088166
  Distance between 3'-terminus of neighbour sequence of sequence listing upward to telomere on chrosomal short arm and 5'-terminus of this base sequence : 116930
aaaaggattaggtaagagtgagaaatgcatttcaaacacgcacgcgtgcacacgcgcgcgcgcgcacacacacacacacacacacacacacacacacacacacacacacacaccatacaccccagaggacatatgccccagggggttggccaagagtatccatcatctgtacataaaaaggacagcacatttatcacatctgga

SEQ ID NO: 319 - DNA, 467 bp, Homo sapiens
  AL139140.5_37654
  Located on chromosome 1
  Distance between a terminus base of telomere on chromosomal short arm and 5'-terminus of this base sequence : 34171095
  Distance between 3'-terminus of neighbour sequence of sequence listing upward to telomere on chrosomal short arm and 5'-terminus of this base sequence : 82725
agcttcttaactcacctggaagatcttgggacctgtcagtctcccaaaatcacatgagacaattctttacaacaaattatctatctatttgctgtttgtctgtctatctatctatctatctatctatctatctatctatctatcatctatctgtctatcatctatcaatcatctatcatctatttatcatctatctgtgtatcatctatcatctatcaatcaatcgtctatcatctctctaatatctatctatctatctatctatctatctatctatctatctatcatctatctatctatctctatctcctattgttctgtttctctggagaaccctcactaatacagtgaattaggcatgggggagaatgccctgtgggctcacattccattcctttgtctggagaaatcccaagtcccagccatgtcacctgattcagtgggtaccattggataagatgagtcat

SEQ ID NO: 320 - DNA, 168 bp, Homo sapiens
  AL121980.14_48357
  Located on chromosome 1
  Distance between a terminus base of telomere on chromosomal short arm and 5'-terminus of this base sequence : 34242824
  Distance between 3'-terminus of neighbour sequence of sequence listing upward to telomere on chrosomal short arm and 5'-terminus of this base sequence : 71262
tcctggatcttatcatgagagggatggaaggttaagaggcacagataagctactctgtgtgtgtgtgtgtgtgtgtgtgtgtgtgtgtgtgtgtgtgtgtgtgtgtgtctgagcctgagcagagtctgatgaatatgtggactttcattaaagttcttcctcatgtcc

SEQ ID NO: 321 - DNA, 300 bp, Homo sapiens
  AL121980.14_75767
  Located on chromosome 1
  Distance between a terminus base of telomere on chromosomal short arm and 5'-terminus of this base sequence : 34270064
  Distance between 3'-terminus of neighbour sequence of sequence listing upward to telomere on chrosomal short arm and 5'-terminus of this base sequence : 27072
aagaaagctatcctattaatgctccaatgtgcactgaggtatattcatgatgatgttaactataacattatttgaaatagtgaaaaatgcaattattagggaaattgttaaaaaaaatgaggctgacatatatatatatactgacattgaaacatatttaacgtagacatttaagagaataaaagcaagctgtagaataatatgtttatgtttcacctcctatcctgtgtgtgtgtgtgtgtgtgtgtgtgtgtgtgcatgcgccagcgtgtgtgtgtgtaatgcctaggctaatagacc

SEQ ID NO: 322 - DNA, 139 bp, Homo sapiens
  D1S2783
  Located on chromosome 1
  Distance between a terminus base of telomere on chromosomal short arm and 5'-terminus of this base sequence : 34270267
  Distance between 3'-terminus of neighbour sequence of sequence listing upward to telomere on chrosomal short arm and 5'-terminus of this base sequence : -97
gtttatgtttcacctcctatcctgtgtgtgtgtgtgtgtgtgtgtgtgtgtgtgcatgcgccagcgtgtgtgtgtgtaatgcctaggctaatagaccaacttaataatgcttagggaagacagtggaattagggtaggg

SEQ ID NO: 323 - DNA, 323 bp, Homo sapiens
  chr1.fa.O7frz.37737375
  Located on chromosome 1
  Distance between a terminus base of telomere on chromosomal short arm and 5'-terminus of this base sequence : 34369423
  Distance between 3'-terminus of neighbour sequence of sequence listing upward to telomere on chrosomal short arm and 5'-terminus of this base sequence : 99017
aaggaatcatacaactgagtgtatatacaagctagaactataacacttccagaagaaaacaagagaaaaccttcatggctttgggacaggtaaaaatctctctctctctccatatatatatatatatatatatatatatatatatatatatatatatatatatatatggatgcataaacaaattatagtatattaatatatatgaattatatagaaataaaacacacatatatatgtaatcttataactcactaataagacaaataattcaatttaaaaatgggcagaaacttgaatagatgatttccaaatggtcaataaac

SEQ ID NO: 324 - DNA, 187 bp, Homo sapiens
  Z67532
  Located on chromosome 1
  Distance between a terminus base of telomere on chromosomal short arm and 5'-terminus of this base sequence : 34452269
  Distance between 3'-terminus of neighbour sequence of sequence listing upward to telomere on chrosomal short arm and 5'-terminus of this base sequence : 82523
gcagttcagccagatgggaaattgacattttactcacaattctgtcttgaggtgctcatgtgtccacacacagacgtaagacacacacacacacacacacacacacacacacacacaccccgcagaactgctgctgtggcagtggtcagttctagtctcagactctgcctccacctgtcaatcccga

SEQ ID NO: 325 - DNA, 163 bp, Homo sapiens
  chr1.fa.O7frz.37848456
  Located on chromosome 1
  Distance between a terminus base of telomere on chromosomal short arm and 5'-terminus of this base sequence : 34570708
  Distance between 3'-terminus of neighbour sequence of sequence listing upward to telomere on chrosomal short arm and 5'-terminus of this base sequence : 118252
taacatgtctggtcctatgaagacaaagcacacagggtaagaaagtgatggcaggagtgctggctttattattattattattattattattattattattattattattatactttaagttctgggatacttgtgcagaacatgcaggtttgttacataggta

SEQ ID NO: 326 - DNA, 185 bp, Homo sapiens
  D1S195
  Located on chromosome 1
  Distance between a terminus base of telomere on chromosomal short arm and 5'-terminus of this base sequence : 34827659
  Distance between 3'-terminus of neighbour sequence of sequence listing upward to telomere on chrosomal short arm and 5'-terminus of this base sequence : 256788
tgggacatctctgggacagtgtgggctgaggaacctgaagaaacagatgtcagaaattcaggtttaaagtgtttcctgcactgtgctattctatgctgtcacacacacacacacacacacacacacacacatacacacacagtcctgcccctctccccacaataccccaaaccttcaggcaaatg

SEQ ID NO: 327 - DNA, 439 bp, Homo sapiens
  chr1.fa.O7frz.38134992
  Located on chromosome 1
  Distance between a terminus base of telomere on chromosomal short arm and 5'-terminus of this base sequence : 34855099
  Distance between 3'-terminus of neighbour sequence of sequence listing upward to telomere on chrosomal short arm and 5'-terminus of this base sequence : 27255
ctgaactgtgagtcacttaaactctttactttataaattacccagtatcgggtatgtctttattagcagtgtgagaacgaactaatacatcaccctttgggtttttacagctcctcattctcaaaggacaccctcttccacttcaccactgatgcccaaggtttccccttcaactctaaattattaccacaaatggtactactacctccaaaattaaaattccagcaccgtgccctctgattacaacctatccttacatttagtttctcaattccccctgaaatccaattattgattctcatctcccatccccagcacacacacaaacacacacacacacacacacacacacacgtttccccctgccctcagctcccctttgtgtttgcttctcttctttcaccaatgagattttgtagtctgttaccataattatgcc

SEQ ID NO: 328 - DNA, 274 bp, Homo sapiens
  AL008634.1_83154
  Located on chromosome 1
  Distance between a terminus base of telomere on chromosomal short arm and 5'-terminus of this base sequence : 34995155
  Distance between 3'-terminus of neighbour sequence of sequence listing upward to telomere on chrosomal short arm and 5'-terminus of this base sequence : 139617
ctctcactccaggcagttaggcactcaattttatcatctcttctgctcatggaatatcccacacttccctcaaggtgagctgcaggccaccttttctggttctctctgtctctgtctctttctctcagtatgtgtgtatctctctctgtttccccccaagacacacacacacacacacacacacacaaacatacacacctctttttccacatctccttgttgttttgatcataaagaagcggtgtggcacagtgtctacaccaacatcgtgctt

SEQ ID NO: 329 - DNA, 245 bp, Homo sapiens
  AL008634.1_56633
  Located on chromosome 1
  Distance between a terminus base of telomere on chromosomal short arm and 5'-terminus of this base sequence : 35021729
  Distance between 3'-terminus of neighbour sequence of sequence listing upward to telomere on chrosomal short arm and 5'-terminus of this base sequence : 26300
ctatcagacacatggcaagtacacctttgaaggcccctgcatctgccattgcctctccacacaaatacacatacgcaacacaaagcacacagacacacaaatacacacacacacacacacacacacacacacacgccccaaagcttccttgcatgtttcctttcaaggagatttacatagcctaataggtatacaatgactccctgctgtacccccaccaggtctagatggtgctcagttaacac

SEQ ID NO: 330 - DNA, 235 bp, Homo sapiens
  AL008634.1_37596
  Located on chromosome 1
  Distance between a terminus base of telomere on chromosomal short arm and 5'-terminus of this base sequence : 35040781
  Distance between 3'-terminus of neighbour sequence of sequence listing upward to telomere on chrosomal short arm and 5'-terminus of this base sequence : 18807
ataacatgtgaactccatgagtgaggagatacacatggctatgaaaatgcaacattggcatttgcaaagctagaaaaagaaacctctctctccctctctctctctctctctctctctctttccaccttcctgctcttctactccttttggggagggaaggctgaatcagctctctacagtctaaaaagactatgctcagccagcattgtttgtgataaaggtgttctaaatcaga

SEQ ID NO: 331 - DNA, 277 bp, Homo sapiens
  AL121988.10_80491
  Located on chromosome 1
  Distance between a terminus base of telomere on chromosomal short arm and 5'-terminus of this base sequence : 35185875
  Distance between 3'-terminus of neighbour sequence of sequence listing upward to telomere on chrosomal short arm and 5'-terminus of this base sequence : 144859
actaggtctggttctccattatacattttcttggcactgtgcttctcctttgtgactctatcacaattgcatttttagagttattggtgtgtgtgtgtgtgtgtgtgtgtgtgtgtgtgtgtgtgtgtttaatgtcttatttcctcctttgactgtaatcttcaagaggaccaggcccagaggttgaaccatgagaaccatgcttactgatttatttccactatcaggcgcaacacgtggcacatagtaggtgcttaatgaatatttgacgatgagt

SEQ ID NO: 332 - DNA, 166 bp, Homo sapiens
  D1S1570
  Located on chromosome 1
  Distance between a terminus base of telomere on chromosomal short arm and 5'-terminus of this base sequence : 35185942
  Distance between 3'-terminus of neighbour sequence of sequence listing upward to telomere on chrosomal short arm and 5'-terminus of this base sequence : -210
tgcatttttagagttattggtgtgtgtgtgtgtgtgtgtgtgtgtgtgtgtgtgtgtgtgtttaatgtcttatttcctcctttgactgtaatcttcaagaggaccaggcccagaggttgaaccatgagaaccatgcttactgatttatttccactatcaggcgcaa

SEQ ID NO: 333 - DNA, 279 bp, Homo sapiens
  AL356256.9_137296
  Located on chromosome 1
  Distance between a terminus base of telomere on chromosomal short arm and 5'-terminus of this base sequence : 35251610
  Distance between 3'-terminus of neighbour sequence of sequence listing upward to telomere on chrosomal short arm and 5'-terminus of this base sequence : 65502
atagtgcgagaaatcagtcaacccaatttcgagacttattacatagctacataatcagagccacatggtaccatgcagtgacagacacatcagtggaacagaatagagacttcagaaatagacacacataaatattcccaactaatttttgagaaaagcaactcaatgaggaaagataagtcttttcaacaagcagtgctgtagcaattgagcattcatacacaaataataataataataataataataataataataatgcacttcaacctaagtctc

SEQ ID NO: 334 - DNA, 217 bp, Homo sapiens
  D1S496
  Located on chromosome 1
  Distance between a terminus base of telomere on chromosomal short arm and 5'-terminus of this base sequence : 35375996
  Distance between 3'-terminus of neighbour sequence of sequence listing upward to telomere on chrosomal short arm and 5'-terminus of this base sequence : 124107
gcatttgtctgggttcttttgacaaagagaaccaacaaaggtgtgtgtgtgcgtgtgtgtgtgtgtgtgtgtgtgtgtatggatggatggatagatatagacagatagatagatagatagatagatagatagatagatgatagatagatagatagatgatagatagatagatagatagatagatagatagatagatagatgcatagatgcatagaga

SEQ ID NO: 335 - DNA, 261 bp, Homo sapiens
  AL354876.4_90621
  Located on chromosome 1
  Distance between a terminus base of telomere on chromosomal short arm and 5'-terminus of this base sequence : 35403364
  Distance between 3'-terminus of neighbour sequence of sequence listing upward to telomere on chrosomal short arm and 5'-terminus of this base sequence : 27151
aggttgcagagtcaagatcacaccactgcattccattccaacctgggcaacagaacgagactctgtctcaaaaaaatatagatagatagatagatagatagatagatagatagatagatagatagatagatgcagtccacctgcaatgcattcctgttttcatgtgagggcttcctaggcttttgattaaaagtcttgtggctctctgtctcctcagccctgttagacacaggagattcccttggaaggttctgagcttag

SEQ ID NO: 336 - DNA, 172 bp, Homo sapiens
  chr1.fa.O7frz.39255636
  Located on chromosome 1
  Distance between a terminus base of telomere on chromosomal short arm and 5'-terminus of this base sequence : 35494442
  Distance between 3'-terminus of neighbour sequence of sequence listing upward to telomere on chrosomal short arm and 5'-terminus of this base sequence : 90817
agaagcaaatgagaaggataactggagggcagagaggggtagtgagtacagattgggttaacctcagatagaaagctttacatttcttttttgtttgtttgtttgtttgttgagacacagtctcactctgtcacccaggctggagtgcagtggctcaatgtccattcactgc

SEQ ID NO: 337 - DNA, 172 bp, Homo sapiens
  D1S441
  Located on chromosome 1
  Distance between a terminus base of telomere on chromosomal short arm and 5'-terminus of this base sequence : 35664445
  Distance between 3'-terminus of neighbour sequence of sequence listing upward to telomere on chrosomal short arm and 5'-terminus of this base sequence : 169831
tgtaaatgttttgttaagtctccctttttgttgtttctctctctctctctctctctgtgggtgggtgtgtgtgtgtgtgtgtgtgtgtgtgtgtgtgtgtgtgtgtgtttcttttgttttttttagagacaagttctttcactctgtcacccaggctggagtgcagtggtgc

SEQ ID NO: 338 - DNA, 281 bp, Homo sapiens
  AL359186.13_108819
  Located on chromosome 1
  Distance between a terminus base of telomere on chromosomal short arm and 5'-terminus of this base sequence : 36132030
  Distance between 3'-terminus of neighbour sequence of sequence listing upward to telomere on chrosomal short arm and 5'-terminus of this base sequence : 467413
ctggctaacacggtgaaaccccaaatctactaaaaatacaaaaaattagccgggcgtggtggtgggcccctgtagtcccagctaccagggaggctgaagcaggagaatggcgtgaacccaggaggaggagcttgcagtgagccgagattgcgccactgcacctgggcgacagagcaagactccgtctcaaaaataaataaataaataaataaataaataaataaataaataaatatagtgactgacatatagtaggcactcagtgttaatctcgctgcctc

SEQ ID NO: 339 - DNA, 198 bp, Homo sapiens
  D1S2656
  Located on chromosome 1
  Distance between a terminus base of telomere on chromosomal short arm and 5'-terminus of this base sequence : 36263029
  Distance between 3'-terminus of neighbour sequence of sequence listing upward to telomere on chrosomal short arm and 5'-terminus of this base sequence : 130718
ctaggcaaaaatcatctgggttttccaaacgtgaaaaattaggttctgggggcccagcaggaaaggcgtgtgtgtgtgtgtgtgtgtgtgtgtgtgtgtgtgtgtgtgtgtgtgtgtgtgtgtgtgtttgaggggagggtgaggttgagtgaatgtctctgtagttagacccagaaattgttccatgacttccaagca

SEQ ID NO: 340 - DNA, 251 bp, Homo sapiens
  AL357035.3_18889
  Located on chromosome 1
  Distance between a terminus base of telomere on chromosomal short arm and 5'-terminus of this base sequence : 36320636
  Distance between 3'-terminus of neighbour sequence of sequence listing upward to telomere on chrosomal short arm and 5'-terminus of this base sequence : 57409
cagctacttggaggctgaggcaggagaatcacttgaactcaggaagtggaggttgcagtgagctgagatcacgccactgcagtcctgcctgggtgacagagtgagactctgtctcaaaaaaagaagaaagaaaagaaagacagagagagaaggaaggaaggaaggaaggaaggaaggaaggaaggaaggaaggaaggaagtttgtttttgtcttacagttctggaggcttgaagtctgaaatcaaggtatt

SEQ ID NO: 341 - DNA, 346 bp, Homo sapiens
  AL138901.3_14833
  Located on chromosome 1
  Distance between a terminus base of telomere on chromosomal short arm and 5'-terminus of this base sequence : 36482102
  Distance between 3'-terminus of neighbour sequence of sequence listing upward to telomere on chrosomal short arm and 5'-terminus of this base sequence : 161215
cagaaggtggaagttgcagtgagctgagattgccccattgcactccagcctgggcaacaagagccaaactctgtgaaagaaaagaaagaaagaaaaagaaagaaggaaaggaaagaaggaaagaaagaaagaaggaaagagaaagaaagaaagaaagaaagaaagaaagaaagaaagaaagaaagaaagaaggaaagagaaagaaagaaagaaagaaagaaagaaaggaaagaaagaaagaaagaaagaaagaaagaaagaaagaaagaaagaaagaaagaaagaaagaaagaaagccaactcctaacagaaacaggaaaaactaaggaaagtccatacatgacac

SEQ ID NO: 342 - DNA, 340 bp, Homo sapiens
  chr1.fa.O7frz.40559024
  Located on chromosome 1
  Distance between a terminus base of telomere on chromosomal short arm and 5'-terminus of this base sequence : 36544332
  Distance between 3'-terminus of neighbour sequence of sequence listing upward to telomere on chrosomal short arm and 5'-terminus of this base sequence : 61884
ggagcttgtaggattatctcacagaattttaaagcccagcaggtttaaagactattccatttggttgtgggagtcagttcagtggatagggactagaaacaaagttggccttatctttgaggctatgggtgagtccatctttctgtgtgtagcaaaaccaggagagaacaaaaacctctaacttctgttacactgtgggaacctgggactgtgtgtgtgtgtgtgtgtgtgtgtgtctgcctatgggagagtataagtatataagagtaaaagtaatagatacataagtcatgaaacgtaaggaaaaataatgcctgtgaatctattagccaacttaaga

SEQ ID NO: 343 - DNA, 347 bp, Homo sapiens
  AL360074.5_81629
  Located on chromosome 1
  Distance between a terminus base of telomere on chromosomal short arm and 5'-terminus of this base sequence : 36569872
  Distance between 3'-terminus of neighbour sequence of sequence listing upward to telomere on chrosomal short arm and 5'-terminus of this base sequence : 25200
atggctaacacggtgaaaccccatctctactaaaaatacaaaaagaaattagccgggtgtggtggagggcacctgtagtctcagctattcgggaggctgaggcagaagaatggcgtgaaccagggaggcagagcttgcagtgagccgagatcgcaccactgggcgacagaagcaagactccatctcaaataataataataataataataataataataataataataatacaaaaattagccgggtgcagtggcgcatagtcaaacaagattaacctcctgcccatagtcccctgcacacagcacaagacagggctagcgactgtcagatggatgagtgctccactc

SEQ ID NO: 344 - DNA, 294 bp, Homo sapiens
  AL358433.7_59028
  Located on chromosome 1
  Distance between a terminus base of telomere on chromosomal short arm and 5'-terminus of this base sequence : 36698190
  Distance between 3'-terminus of neighbour sequence of sequence listing upward to telomere on chrosomal short arm and 5'-terminus of this base sequence : 127971
cagatactgttttctttggcacaatgtccacatctatctttctgtggcatttatttatttatttatttatttatttttgagacagggtcttactgtgttgcccaggctggagtgcaatggtgcgatctcggctcactgcaacctccacttcccaggttcaagcgattctcccgcctcagcctcccgagtagctgggattacaggcacctgccatcatgccggctaattttttatttttagtagagacggggtttctccatgttggccaggctggtcttgaactcctgacctcag

SEQ ID NO: 345 - DNA, 218 bp, Homo sapiens
  D1S2729
  Located on chromosome 1
  Distance between a terminus base of telomere on chromosomal short arm and 5'-terminus of this base sequence : 36813162
  Distance between 3'-terminus of neighbour sequence of sequence listing upward to telomere on chrosomal short arm and 5'-terminus of this base sequence : 114678
tacttgcctaatgctgtgtggggcctggctttgccctgccccggtccctagtggggccaggttccatggctctgactagccctgctggttctcataccctggtacagaaagaaagattctatgactcaaacacacacacacacacacacacacacacacacacacacacacacacacacaccccagagccttaggccttggtctcccaaggattgata

SEQ ID NO: 346 - DNA, 257 bp, Homo sapiens
  AL080286.16_110111
  Located on chromosome 1
  Distance between a terminus base of telomere on chromosomal short arm and 5'-terminus of this base sequence : 36869899
  Distance between 3'-terminus of neighbour sequence of sequence listing upward to telomere on chrosomal short arm and 5'-terminus of this base sequence : 56519
agtttcctaggattgctgtaacaaatgaccacaaaccaggtggcttacacacacacacacacacacacacacacacacacacatacacactcttattctctcacagtcctggaggctggaagtctgcaatcagtgtcatcaaggtcatgctcccttggagggatctagggaagaatctgtccttgcttcttcctggcttctggtcactcccagcagcccttgtcattccttggcttgtagctgcattactcgagtgt

SEQ ID NO: 347 - DNA, 112 bp, Homo sapiens
  HUMUT700
  Located on chromosome 1
  Distance between a terminus base of telomere on chromosomal short arm and 5'-terminus of this base sequence : 36869917
  Distance between 3'-terminus of neighbour sequence of sequence listing upward to telomere on chrosomal short arm and 5'-terminus of this base sequence : -239
taacaaatgaccacaaaccaggtggcttacacacacacacacacacacacacacacacacacacatacacactcttattctctcacagtcctggaggctggaagtctgcaat

SEQ ID NO: 348 - DNA, 327 bp, Homo sapiens
  AL080286.16_132770
  Located on chromosome 1
  Distance between a terminus base of telomere on chromosomal short arm and 5'-terminus of this base sequence : 36892555
  Distance between 3'-terminus of neighbour sequence of sequence listing upward to telomere on chrosomal short arm and 5'-terminus of this base sequence : 22526
aaagtatgctatacaaccaaacattaaataaataaataaataaatatacatatatatatatatatatatatatatatatatatatttttttttttttttttttttttttgagatgtagtctcccgctgtcacccaggctggagtgcagtggcgtgatcttggctcactgcaacctctgcctcccgggttcaagtgattctcctgcctcagcctcctgagtagctgggattacaggcatgcgccatgactcccagctaatttttgtatttttagtgcccacggggcttcaccagttggccaggttggtctcaaactcctaggcttaag

SEQ ID NO: 349 - DNA, 267 bp, Homo sapiens
  AC027619.3_135182
  Located on chromosome 1
  Distance between a terminus base of telomere on chromosomal short arm and 5'-terminus of this base sequence : 36893700
  Distance between 3'-terminus of neighbour sequence of sequence listing upward to telomere on chrosomal short arm and 5'-terminus of this base sequence : 818
tgcatctttgcaagtaatcttcctccctgacacctccagtaattaaaaccaagtatcaaaataatctgaattaagaaccaggcctttgacttgccgtatcacacagctttgctttttaaaaatgaaacattttcaatcacatggttcccatgtaatcttttttaaatttttattatttatttatttatttatttattttgagatggagtttttctctcgtcggccaggctggagcgcaatggtgcaatctcggctaaatgtaacctc

SEQ ID NO: 350 - DNA, 414 bp, Homo sapiens
  AC027619.3_155224
  Located on chromosome 1
  Distance between a terminus base of telomere on chromosomal short arm and 5'-terminus of this base sequence : 36947431
  Distance between 3'-terminus of neighbour sequence of sequence listing upward to telomere on chrosomal short arm and 5'-terminus of this base sequence : 53464
ttaatggaatacggagcattagcctcgctctctgagtgcaggattgcttgccccctggactcagatgggaattgcttatgggctctgcaggctgagaggaagggggctcctgactcaatgatttcattctccctgcagcatcctgaatctctcttttggaggaggggcagtgtacttgaaggaaggaaggaaggaaggaaggaaggaaggaaggaaggaaggaaggtgggaagaaaacaggcaaactctgggccctgggcaggctgcttaacctgggaggtctcaggaggagtggctgtcctgtcctggccctgaggatctcctggggtgaactctgtcaggagggcctctcctatgctgtgcttggtgctgccggcatgaacgaagacccatgtggtatgactcactgcattg

SEQ ID NO: 351 - DNA, 423 bp, Homo sapiens
  AL359635.11_462860
  Located on chromosome 1
  Distance between a terminus base of telomere on chromosomal short arm and 5'-terminus of this base sequence : 37212584
  Distance between 3'-terminus of neighbour sequence of sequence listing upward to telomere on chrosomal short arm and 5'-terminus of this base sequence : 264739
tctgtcgtactgagaaactgagctggcagagcactggggttctgtgatggtggcagactccctgccccaaccctgccccagctacccccatctcttgcaggtagaaacatccctggaagcttttaccatgagtgatgggagcactattattcacttcctcacagtttcacctgctcttctctctctctttcactctctctctccgtgtgtgtgtgtgtgtgtgtgtgtgtgtgtgtgtgtgtgtgtgtgtcttctttgtttccctctgttcatgctccctccatagatttatttttgtctccgcccttcctgtcttttcctctcccccaccatcactaccactaccccgcagggcaggataactggtggccattgggagtgacactcattcccataaggcaggtcagaagcacattgttaagg

SEQ ID NO: 352 - DNA, 238 bp, Homo sapiens
  D1S472
  Located on chromosome 1
  Distance between a terminus base of telomere on chromosomal short arm and 5'-terminus of this base sequence : 37212709
  Distance between 3'-terminus of neighbour sequence of sequence listing upward to telomere on chrosomal short arm and 5'-terminus of this base sequence : -298
ccatgagtgatgggagcactattattcacttcctcacagtttcacctgctcttctctctctctttcactctctctctccgtgtgtgtgtgtgtgtgtgtgtgtgtgtgtgtgtgtgtgtgtgtgtcttctttgtttccctctgttcatgctccctccatagatttatttttgtctccgcccttcctgtcttttcctctcccccaccatcactaccactaccccgcagggcaggataac

SEQ ID NO: 353 - DNA, 192 bp, Homo sapiens
  AL359966.3_17183
  Located on chromosome 1
  Distance between a terminus base of telomere on chromosomal short arm and 5'-terminus of this base sequence : 37268918
  Distance between 3'-terminus of neighbour sequence of sequence listing upward to telomere on chrosomal short arm and 5'-terminus of this base sequence : 55971
aacatgtattgagtgcttaccacggctgtgttctaagcacttcatatgcattaactcattcaatcctcacaaaaaccctgtgaggcaggtacaactattattattattattattattattattattattttgagatattaaatactttgctcttgggaggctgaagcgggcagatcacaaggtcaggagttc

SEQ ID NO: 354 - DNA, 235 bp, Homo sapiens
  D1S2637
  Located on chromosome 1
  Distance between a terminus base of telomere on chromosomal short arm and 5'-terminus of this base sequence : 37286026
  Distance between 3'-terminus of neighbour sequence of sequence listing upward to telomere on chrosomal short arm and 5'-terminus of this base sequence : 16916
ctgattagaggcaaaggcagcctgggcaggggagagttacaggctccttgggggaaagaaaaggaggaaattcctttaggtttcattgaggggaactgggcatgaatgaatacctgtccctggtgctgtgcctgtacacacacaagcacaccagtacaggtacatgcccatactactgcacacacacacacacacacacacacacacagaactaccaacatccacccacgactcg

SEQ ID NO: 355 - DNA, 130 bp, Homo sapiens
  D1S2723
  Located on chromosome 1
  Distance between a terminus base of telomere on chromosomal short arm and 5'-terminus of this base sequence : 37286529
  Distance between 3'-terminus of neighbour sequence of sequence listing upward to telomere on chrosomal short arm and 5'-terminus of this base sequence : 268
ctgagtagagccttgggggaactctctccaagcctccagcaggaagaacagtgtgtttgtgcatgcacgcacacacacacacacacacacacactcagatggatccctggcctccaggttcaccaggttg

SEQ ID NO: 356 - DNA, 237 bp, Homo sapiens
  D1S1555
  Located on chromosome 1
  Distance between a terminus base of telomere on chromosomal short arm and 5'-terminus of this base sequence : 37403281
  Distance between 3'-terminus of neighbour sequence of sequence listing upward to telomere on chrosomal short arm and 5'-terminus of this base sequence : 116622
tgtttagctttacggccacctgaacatctataggaccctctgtaggaatgcccagtgctgagaacaaaattgtttttaattccattacctacagccttgaggctgccaccttctactctttgggaaatttgcttccatcacacacacacacatgcacacacacacacacacacacacacacacacatcaaacaagctaacaacaaaacacctgtatatttccctgttgcatgagtca

SEQ ID NO: 357 - DNA, 268 bp, Homo sapiens
  AL033524.11_87321
  Located on chromosome 1
  Distance between a terminus base of telomere on chromosomal short arm and 5'-terminus of this base sequence : 37579931
  Distance between 3'-terminus of neighbour sequence of sequence listing upward to telomere on chrosomal short arm and 5'-terminus of this base sequence : 176413
ctgcaaattctgcatatgtatcttgtaaacctgcacgttctgcacatgcatcttgttttccttttttagaaagaaaaagaaaaaaaaacatatatatatatatatatatatatatatatatatatatatatatatatatatatacacacatatatttggacaaaaaatacaagaaaaaaattattgtccatctctctatgctcccaatgttcaacttccctagtagtaagggaaattcaaactacaacaatgataaggtgccatgaaa

SEQ ID NO: 358 - DNA, 430 bp, Homo sapiens
  AL033524.11_13855
  Located on chromosome 1
  Distance between a terminus base of telomere on chromosomal short arm and 5'-terminus of this base sequence : 37653272
  Distance between 3'-terminus of neighbour sequence of sequence listing upward to telomere on chrosomal short arm and 5'-terminus of this base sequence : 73073
tcataagcactaggcaataagtcaaagaaacttaaaaaaatacatggagaatctagataaaaggcaaagggatacagagggtagcaagggggctgaaagctaaaagtgagaaatgggggcttcaatgtcatcttctaaggtgacagtggctcacccatggcaccttagacaaatccatccggggtactgaaccaggcctggacaagagtgattgttttttgtttgtttggttgactggtgttattgtttgtttgtttgtttgtttgttttggttcacgggggtaagagcaaggttagaggaaaatgagctgattttgagacatgatgtggacgtctgcatgggggtgtccagtaggaaagcctgagttcaggaggaagatttcaatgggcttaatcttgctggggaaagtcagttctgctctcagatgta

SEQ ID NO: 359 - DNA, 379 bp, Homo sapiens
  AC023225.3_92312
  Located on chromosome 1
  Distance between a terminus base of telomere on chromosomal short arm and 5'-terminus of this base sequence : 37852231
  Distance between 3'-terminus of neighbour sequence of sequence listing upward to telomere on chrosomal short arm and 5'-terminus of this base sequence : 198529
atccatcagaacattgactgattgattgattgattgattcattcattcattcattcattccagcacccacaaggctccaaactgttcctggctgggacagaaaagaggagcaaacctggcccctgtcctggaggagccagggaaaggagatggaagtataaatagccagttacccgaaagtgggatgggctattatactggagtgtatgatacagtaagtccttacttaacatcatcaatttgttcttggaaactgacattaagcaaaacaatatataacaaaaccaatattttcttcatggacattgaatgaaacaaaatgctgttatttgaggacctgctgtatgttgtttcccttaaagtcacagtttccaagaac

SEQ ID NO: 360 - DNA, 440 bp, Homo sapiens
  AC023225.3_160594
  Located on chromosome 1
  Distance between a terminus base of telomere on chromosomal short arm and 5'-terminus of this base sequence : 38067425
  Distance between 3'-terminus of neighbour sequence of sequence listing upward to telomere on chrosomal short arm and 5'-terminus of this base sequence : 214815
gaccttatccttactatgtgcaatgtcctctgattttttttctattctattgatgtctttgaaatgctgattataaaccactattttaaaacccaatgaaaaggtgcaatccagtttgaaaaatagttgactaacaactaccactgagcataagctttgcaacctcctcatagttgttattattattattattattattattattattattatttgagacagagtctcgctctgttgcccaggctggagtgcagtgacatgatcttgactcactgcaagctccacctcccaggttcacgccattctcctgcctcagcctcccaagtagctgggactacaggcgcctgccatcatgcccggctaattttgttttttgtatttttagtagagatggggtttcaccgtgttagccaaaatggtcttgatcttctgacttcgtg

SEQ ID NO: 361 - DNA, 471 bp, Homo sapiens
  chr1.fa.O7frz.42577843
  Located on chromosome 1
  Distance between a terminus base of telomere on chromosomal short arm and 5'-terminus of this base sequence : 38120597
  Distance between 3'-terminus of neighbour sequence of sequence listing upward to telomere on chrosomal short arm and 5'-terminus of this base sequence : 52732
cttaagttagctaactcctaggaagtggacaagctgaccactcttttgcctgtatatggtttttattttttattttttaagtttttaatgttttatttatttatttatttatttatttattttgagacggagtctcgctctgtcacccaggctggagtgcaatggcgcaatctcggctcaccgcaacctccacctcccaggttaaagtgattctcctgcctcagtctcctgagtagctgggattacaggcgcatgccaccacgcctggctaacttttgtatttttagtagagacagagtttcaccatgttggcaaggctggtctcgaactcctgacgtgatccacccacctcggcctcccaaagtgctgggattacaggcgtcagccacagcgcctagcctaatgttttttatttttcagtctcactctgtcacccaggctggagtgccattgtgcgaccatagctcacta

SEQ ID NO: 362 - DNA, 248 bp, Homo sapiens
  HUMUT499
  Located on chromosome 1
  Distance between a terminus base of telomere on chromosomal short arm and 5'-terminus of this base sequence : 38248090
  Distance between 3'-terminus of neighbour sequence of sequence listing upward to telomere on chrosomal short arm and 5'-terminus of this base sequence : 127022
agcattgtagaccaccccagccccccgccaggggcagatggtctccatagcagatggagactaggctggcagtggcaggatgggctttctagtctcagcctggccactctggctaataagacaatccgggggcagtgacagggctaactgctggggtgtgtgtgtgtgtgtgtgtgtgtgtgtatgtgtatgtgtgtgtgtatataggtgtgtaggagagggagccctggccttattgggccattctg

SEQ ID NO: 363 - DNA, 358 bp, Homo sapiens
  chr1.fa.O7frz.42775338
  Located on chromosome 1
  Distance between a terminus base of telomere on chromosomal short arm and 5'-terminus of this base sequence : 38329325
  Distance between 3'-terminus of neighbour sequence of sequence listing upward to telomere on chrosomal short arm and 5'-terminus of this base sequence : 80987
tgacgtgatatttgaaatcataaaagaaaagattgataaatttgactatatgaaaattaaacatttaagtaccttaaagaacattataagaaaattttaaaagaggggtatatacatatgtatgtgtatatatatatatatatatatatatatatatatatatatatatgacaacagtttaattttatttctaatgtacaaagagctcttacaaatcattaagaaaaagataaatatctcattagaaaaatgggcaaaggacatgaacaggcaattcacaaagaaaataactacaaatgcctgaaaaaacaaaaagacatttatttccccctccctataatcttagcaatgccaatag

SEQ ID NO: 364 - DNA, 450 bp, Homo sapiens
  chr1.fa.O7frz.42906353
  Located on chromosome 1
  Distance between a terminus base of telomere on chromosomal short arm and 5'-terminus of this base sequence : 38459031
  Distance between 3'-terminus of neighbour sequence of sequence listing upward to telomere on chrosomal short arm and 5'-terminus of this base sequence : 129348
tccattaaagatgcacatttacacacagctgatttacatagaacacaaggaaaccgctccattttcagaaaaaagagactcctggtcactggtcacttgaaacagtgtggatccaggatgagggagcctcctgcccttcctgtgattttttaggcaactgtgaaagggccatcagaccaagagtaggtggctgggggaggaaagcaggttgaacaaaaggaagaaatgaggtgttgggcaggcacatgctatttagtttctgtatttgcttttagagcaattctattccttacttacatatgcccttgtgaacctttagggtctgtttttaaattctgccaagcctccccagccctgttactcccatcacacacacacagacacacacacacacacacacacacacacacacacacacacagagtttttatttcaaaggtaagcagtcac

SEQ ID NO: 365 - DNA, 211 bp, Homo sapiens
  DISO7_00000002
  Located on chromosome 1
  Distance between a terminus base of telomere on chromosomal short arm and 5'-terminus of this base sequence : 38566012
  Distance between 3'-terminus of neighbour sequence of sequence listing upward to telomere on chrosomal short arm and 5'-terminus of this base sequence : 106531
ttgctgaacccaactgagattgacagagagagagagagagagagagagacagagagagagacagagagagagagaggagaaggggaggggaggggaggataaaggaggagaggagagggaagaaatggaggggaggtaggggaaggtgagaaggggagagagagaactgagtgtagccaaggcacagacacaaagatccaatgcatcttgt

SEQ ID NO: 366 - DNA, 124 bp, Homo sapiens
  DISD22_0012029
  Located on chromosome 1
  Distance between a terminus base of telomere on chromosomal short arm and 5'-terminus of this base sequence : 38707088
  Distance between 3'-terminus of neighbour sequence of sequence listing upward to telomere on chrosomal short arm and 5'-terminus of this base sequence : 140865
gattctgagcctcccagtctgcaaaaacccttccttccccattataccctgaacacacacacacacacacacacacacacacacacacacacacggaggcccctgcttcctcacaccgctttat

SEQ ID NO: 367 - DNA, 430 bp, Homo sapiens
  chr1.fa.O7frz.43105825
  Located on chromosome 1
  Distance between a terminus base of telomere on chromosomal short arm and 5'-terminus of this base sequence : 38832567
  Distance between 3'-terminus of neighbour sequence of sequence listing upward to telomere on chrosomal short arm and 5'-terminus of this base sequence : 125355
atctggcagttctttataggagcatgagaataaactaatacataattaggtgatattttactgattacctagtgtgatggtgaattttatgtgtcaacttgactggcctgcaggatgcctagacctttggtcaaacattattctgggtgtgtgtgtgtgtgtgtgtgtgtgtgtgtgtgtgtgtgtgtgtgtttctaggtgaaattaacatttcaattgatagactgagtaaagcagactgccctccctaatgtgagtgggcctcatccagttagttgaaaatgtacatagaacaaagaggttgggtaagagagaacttctgctacctgactgcatgagctggaacactggtggtctcctgcccttggactggaacttacaccgtcagctctcctggttctcaggcctttagactcaaactggaactaca

SEQ ID NO: 368 - DNA, 412 bp, Homo sapiens
  chr1.fa.O7frz.43563126
  Located on chromosome 1
  Distance between a terminus base of telomere on chromosomal short arm and 5'-terminus of this base sequence : 38895560
  Distance between 3'-terminus of neighbour sequence of sequence listing upward to telomere on chrosomal short arm and 5'-terminus of this base sequence : 62563
taaagatccatgtgcaataaaggataagcatgaaagggaaaaggcaaatctaaactgttgtggaagaaggaaaaaactaattataccgaagacctagctgtggttactttagtggcctgcaatgaactacctgattttcatgcctcgtgtacacccatgaccttgattctgggctggccctgtaatctccttttaccaataggatgtggtggatgtgacactgtgccaattctgagcctaggccttaagtcctggcagtttctgggagtgtgtgtgtgtgtgtgtgtgtgtgtgtgtgtgtgtgcgcgcgcgcgcacgcacctgagtacacacgctttggggaaagccatccactgtctaagatgttagactgtactgaggccatcttgcttatgtgaagatgcctaagcta

SEQ ID NO: 369 - DNA, 294 bp, Homo sapiens
  chr1.fa.O7frz.43548583
  Located on chromosome 1
  Distance between a terminus base of telomere on chromosomal short arm and 5'-terminus of this base sequence : 38910186
  Distance between 3'-terminus of neighbour sequence of sequence listing upward to telomere on chrosomal short arm and 5'-terminus of this base sequence : 14214
atgagctcacgtatactcacacacacctgcacacacacacacacacatgcattcacgcctgaaaatatctgctcacttagttgcacacatatagacaattaaacatgcacatacacattcattaacacactcagacacatacgcctttacacatatgtgatatgagatatgcaatcacatccagctcttacagatcacacacacacacacacacacacacaggtttacaccaatgcatcaatgcattctgcattgctgctgggttgtcacacatgattgagttggctacagtta

SEQ ID NO: 370 - DNA, 435 bp, Homo sapiens
  chr1.fa.O7frz.43455273
  Located on chromosome 1
  Distance between a terminus base of telomere on chromosomal short arm and 5'-terminus of this base sequence : 39003687
  Distance between 3'-terminus of neighbour sequence of sequence listing upward to telomere on chrosomal short arm and 5'-terminus of this base sequence : 93207
aggattgagaataagcctacagtggagtctgagacaggaagacactgtttttattattattattattattattattattattattattattattcctgcagctttcccttacgcctaagctgatgggactagaagaatcttggattagcacaggttgacaaattatcctcacaacagtagtgagaagtagtgattatcccattaaggaggccaaggtgaatggcagaaggcatatcatggaagacacaaggagagctttccaaaggagggagtagcctgctggcccaccatacgccggggcaataactaactctctaggatccagagcccaaagggaatgggatcaagagaacagatgaagacatgttcaagcctttttgtctgggagggaaggtgataaaaggcaaagagttcagaattcatatcagaagcctg

SEQ ID NO: 371 - DNA, 286 bp, Homo sapiens
  AL139222.6_19298
  Located on chromosome 1
  Distance between a terminus base of telomere on chromosomal short arm and 5'-terminus of this base sequence : 39075873
  Distance between 3'-terminus of neighbour sequence of sequence listing upward to telomere on chrosomal short arm and 5'-terminus of this base sequence : 71751
atcacgaggtcaggtgaaaccctgcctctactaaaaaatacaaaaaattagcagggcatgacggcgggcgcctgtagtcccagctactcgggagcctgaggcaggagaatggcgtgaacccaggaggccgaggttgcagtgagccgagatcgtgccactgcactccagcctgggtgacagagcgagactccatctcaaataataataataataataataataataattgttttataatgtatccaaaattttgttataaccagatatggcaagataacaaacgtag

SEQ ID NO: 372 - DNA, 267 bp, Homo sapiens
  D1S432
  Located on chromosome 1
  Distance between a terminus base of telomere on chromosomal short arm and 5'-terminus of this base sequence : 39200548
  Distance between 3'-terminus of neighbour sequence of sequence listing upward to telomere on chrosomal short arm and 5'-terminus of this base sequence : 124389
tccctgggagatgaacagactttcatgtgttttctctagttaaggatttgcttaactagaattccattttctaatttttcttcgcagacaactctttttttctttttcttttttctgtgtgtgtgtgtgtgtgtgtgtgtgtgtgtgtgtgtgtgtgtgcgcgcgcgcgcgcgtgtgtgacttgctgtgtctcccagccaggggtgcagtggtgcaatctctgctcaccagaacctctgcctcaagggttcaagtaattctcatgcc

SEQ ID NO: 373 - DNA, 184 bp, Homo sapiens
  DISD22_0012033
  Located on chromosome 1
  Distance between a terminus base of telomere on chromosomal short arm and 5'-terminus of this base sequence : 39450592
  Distance between 3'-terminus of neighbour sequence of sequence listing upward to telomere on chrosomal short arm and 5'-terminus of this base sequence : 249777
ttactcctttgcacatctgtgtgtgtgtgtgtgtgtatatatatatatatatacactaagtgtatatatgtgtgtgtgtgtatatatatatatatatatatatatatatatatatatatatatatacactaagtgtatatatgtgtgtgtatatatatctaagagggagaacgggactgtggac

SEQ ID NO: 374 - DNA, 243 bp, Homo sapiens
  AC024511.5_131892
  Located on chromosome 1
  Distance between a terminus base of telomere on chromosomal short arm and 5'-terminus of this base sequence : 39533448
  Distance between 3'-terminus of neighbour sequence of sequence listing upward to telomere on chrosomal short arm and 5'-terminus of this base sequence : 82672
gtgcacatgaagatgcctaagcttgctttctatgtggcaataaatcaatcaatcaatcaatcaatcaatcaatcaatcaaatgaaggcgtttacaagactttcttattctgttttcatagtaggatacctaggtcccccggtagaaacttcaagtatactgagaccctgatcctgggctctgctcaacctgaattaggaatgaaaataatcctaaggaagcctgatgctgcacctattagaac

SEQ ID NO: 375 - DNA, 359 bp, Homo sapiens
  AC024511.5_8566
  Located on chromosome 1
  Distance between a terminus base of telomere on chromosomal short arm and 5'-terminus of this base sequence : 39566956
  Distance between 3'-terminus of neighbour sequence of sequence listing upward to telomere on chrosomal short arm and 5'-terminus of this base sequence : 33265
aagtggctgagtatggaatctgaaaaatcaggccatgaaaagaaagagtggagacaatttttgtattatgcttttaaagactttattattaatattattaaataataaataataaaaattattattattattattattatatggatgtggtcttaatatgttgcccaagctggtcttgaactcctggccttaagcaatcttcctacttcagcctcctaaagtgcctggattacaggcatgagccaccatgcccagtcctacattgaacatagtaattgtaataataattgacattaagaccaatagaaggaataagtttgaaatgcattagtatcagagccaagttcaataagcattag

SEQ ID NO: 376 - DNA, 433 bp, Homo sapiens
  chr1.fa.O7frz.43969707
  Located on chromosome 1
  Distance between a terminus base of telomere on chromosomal short arm and 5'-terminus of this base sequence : 39620684
  Distance between 3'-terminus of neighbour sequence of sequence listing upward to telomere on chrosomal short arm and 5'-terminus of this base sequence : 53369
aatggcactatacatctaaacaagaaatcctgaaagctagaaagcaatagagcaatgatttcagagttcagagtaaaaataatttccaggcgggcatggtggctcacacctgtaatcccagcactttggaaggccgaggcgggcagactacttgaggtcaggagttcaagaccagcctggccaacatggtgaaaccctgtctttactaaaaatataaaaattagccggaaatgggggcatgcacctgtgatcccagctacttggcaggctgaggcaggagaatcacttgagcccaggaggtggaggctgccatgtgctaagaccatgcactccactccagcctgggcaacacagcaagactctatctcaataataataataataataataataataataatttcaaaaaatgtatcttgccagttagaggaag

SEQ ID NO: 377 - DNA, 102 bp, Homo sapiens
  DISO7_10007776
  Located on chromosome 1
  Distance between a terminus base of telomere on chromosomal short arm and 5'-terminus of this base sequence : 39811458
  Distance between 3'-terminus of neighbour sequence of sequence listing upward to telomere on chrosomal short arm and 5'-terminus of this base sequence : 190341
aacaggtgaagccacaggcaagggacacccaagtacacacacacacacacacacacacacacacacacctcttgcaggttgagagacaaattgcactggaca

SEQ ID NO: 378 - DNA, 282 bp, Homo sapiens
  AL139015.5_1311
  Located on chromosome 1
  Distance between a terminus base of telomere on chromosomal short arm and 5'-terminus of this base sequence : 39849292
  Distance between 3'-terminus of neighbour sequence of sequence listing upward to telomere on chrosomal short arm and 5'-terminus of this base sequence : 37732
gagtgaaaattccatcaagaaagagaggaaggaaggaaggaaggaaggaaggaaggaaggaaggaaaagaaatttgacctaaatttaattattataagcagccaagaaaggtgtcaaagtaacagcaaaagtaacccaaggacaggtaccagatgggtgtggatggttacgctaggaggctactgtactagtcccagccaaaggtaatgaggctgtcaactggagcagggacgatagagatgggaagggatgttttccactcactgaaacttgctaaggttc

SEQ ID NO: 379 - DNA, 424 bp, Homo sapiens
  AL354888.6_150069
  Located on chromosome 1
  Distance between a terminus base of telomere on chromosomal short arm and 5'-terminus of this base sequence : 40134837
  Distance between 3'-terminus of neighbour sequence of sequence listing upward to telomere on chrosomal short arm and 5'-terminus of this base sequence : 285263
attgtaacctagaatacaaggcagaagatatggcagatgctacatctttatctcaccaggtggcccagcagctaccgaagtacacatgtcctgttgtcattcatccacagggcaattacagctgccacgggctagccaaggtgtgcagcgatcactttgactcatagaacctaaagccttagtcaggcgcagtggctcatacctgtaatcccagcactttgggaggctgaggcaggaggatctcttgggcctagtctgagaccagcctgggtctcaggcaaggccctgtctctttaaataaataaataaataaataaataaataaataagtaagtaagtaaataacctgaaacctctatttctcaccaatatttcctgccattcccagttgcatacgctcatgacctgtatgctcactgacaat

SEQ ID NO: 380 - DNA, 424 bp, Homo sapiens; identical to SEQ ID NO: 379
  AC067884.2_72171
  Located on chromosome 1
  Distance between a terminus base of telomere on chromosomal short arm and 5'-terminus of this base sequence : 40134837
  Distance between 3'-terminus of neighbour sequence of sequence listing upward to telomere on chrosomal short arm and 5'-terminus of this base sequence : -424

SEQ ID NO: 381 - DNA, 120 bp, Homo sapiens
  D1S2892
  Located on chromosome 1
  Distance between a terminus base of telomere on chromosomal short arm and 5'-terminus of this base sequence : 40139760
  Distance between 3'-terminus of neighbour sequence of sequence listing upward to telomere on chrosomal short arm and 5'-terminus of this base sequence : 4499
tgggaccacagagccaccacgcctggctagtgtgtgtgtgtgtgtgtgtgtgtgtgtgtgtgtgtgtgtgtgtgtgtgtgtgtgtgttttgcagagacatgtcttgccatgttgcccagg

SEQ ID NO: 382 - DNA, 247 bp, Homo sapiens
  AL033527.26_62050
  Located on chromosome 1
  Distance between a terminus base of telomere on chromosomal short arm and 5'-terminus of this base sequence : 40235842
  Distance between 3'-terminus of neighbour sequence of sequence listing upward to telomere on chrosomal short arm and 5'-terminus of this base sequence : 95962
cagctacttggatgctgaggcaggagaatccttgaacctgggaggtggagattgcagtgagccaagatggtgccatcacactccagcctggttgacagaacgagactctgtctcaaaaaaagaaaaggaaagaaaaagaagggaaggggaggggaggggagggggaagaaagaaaagagaagagaagaaaggaaaagaaaagaaaagaaaagaaaagaaaaagtgagtgtccacaggaaatggttct

SEQ ID NO: 383 - DNA, 436 bp, Homo sapiens
  AL354888.6_180591
  Located on chromosome 1
  Distance between a terminus base of telomere on chromosomal short arm and 5'-terminus of this base sequence : 40250275
  Distance between 3'-terminus of neighbour sequence of sequence listing upward to telomere on chrosomal short arm and 5'-terminus of this base sequence : 14186
caaactggcttcaaatcctagctcaacaaatgtttatgggatgtgttaactaacttgatggtggtatagatagatagatggatagacagatagatagatagatagatagatagatacacacatacatatatacacatatataaaatcactttatatagtttaaatatatataattttatctgtcgattatatctcaataaatctggataaaaataaaaggctgacttcaagtaaaaaaacaaaaacacaaataagtgcttttaagcagcaggcccttgtagatgccagggataaagcagtgaacaacagacaaacatcgctgccctcaccaagctttatctctgctactcggcaaatatttgcatgtttactctgtgccaaccactgttcattaagctgtgtttataaaatggtgataacagattatcttgtccgt

SEQ ID NO: 384 - DNA, 248 bp, Homo sapiens
  AL354888.6_15659
  Located on chromosome 1
  Distance between a terminus base of telomere on chromosomal short arm and 5'-terminus of this base sequence : 40290988
  Distance between 3'-terminus of neighbour sequence of sequence listing upward to telomere on chrosomal short arm and 5'-terminus of this base sequence : 40277
ttcacttacaatggaggtgaaccaagggacctagaaactcattatttatatgtgtatctatctatctatctatctatctatctatatatatatatgaatgatgagtcgaaaattttgagatttcctttttagcctcttgtaagtctcagtccttctaaaagactgcctttggctgggtgcagtggctcacgcttgtaatcacagcactttgagaggccgaggctggcggatcacctgaggtcaggaga

SEQ ID NO: 385 - DNA, 115 bp, Homo sapiens
  D1S1598
  Located on chromosome 1
  Distance between a terminus base of telomere on chromosomal short arm and 5'-terminus of this base sequence : 40291002
  Distance between 3'-terminus of neighbour sequence of sequence listing upward to telomere on chrosomal short arm and 5'-terminus of this base sequence : -234
aggtgaaccaagggacctagaaactcattatttatatgtgtatctatctatctatctatctatctatctatatatatatatgaatgatgagtcgaaaattttgagatttcctttt

SEQ ID NO: 386 - DNA, 402 bp, Homo sapiens
  AL033527.26_161603
  Located on chromosome 1
  Distance between a terminus base of telomere on chromosomal short arm and 5'-terminus of this base sequence : 40335544
  Distance between 3'-terminus of neighbour sequence of sequence listing upward to telomere on chrosomal short arm and 5'-terminus of this base sequence : 44427
tactatgtagtggtttgctactgtccaacttcaactttgattttttgttttgttttgttttgttttgttttgttttgagatggagtttcattcttgttgcccaggctggagtgcaatggcgcgatcttggctcactgcaacctgtgcttcctgggttcaagtgattctcctgcctcagcctcccaagtagctgggattacaggtgcctgctgccacacctggctaattttgtatttttttagtagagacgaggtttcaccatgttggccaggctggtctcagactcctgagctcaagtgatccacccgcctcagcctcccaaagtgcttggattacgggcgtgagccactgtgcccggcccaacttcaactttggtagcttgcagttggtcatggcagatta

SEQ ID NO: 387 - DNA, 174 bp, Homo sapiens
  D1S2743
  Located on chromosome 1
  Distance between a terminus base of telomere on chromosomal short arm and 5'-terminus of this base sequence : 40626187
  Distance between 3'-terminus of neighbour sequence of sequence listing upward to telomere on chrosomal short arm and 5'-terminus of this base sequence : 290241
tgacctaaatcttgaacaggaatgtgtgtgtgtgtgtgtgtgtgtgtgtgtgtgtgtgtgtgtgtgtgtacgcgcatgcgcatatatatgtgtattgtgaggattaaagaagatattgtatgtgtaaatcttagcacatatattcaataagtggtgctacagtgaaaccccatc

SEQ ID NO: 388 - DNA, 168 bp, Homo sapiens
  AL050341.18_23604
  Located on chromosome 1
  Distance between a terminus base of telomere on chromosomal short arm and 5'-terminus of this base sequence : 40626188
  Distance between 3'-terminus of neighbour sequence of sequence listing upward to telomere on chrosomal short arm and 5'-terminus of this base sequence : -173
gacctaaatcttgaacaggaatgtgtgtgtgtgtgtgtgtgtgtgtgtgtgtgtgtgtgtgtgtgtgtacgcgcatgcgcatatatatgtgtattgtgaggattaaagaagatattgtatgtgtaaatcttagcacatatattcaataagtggtgctacagtgaaacc

SEQ ID NO: 389 - DNA, 255 bp, Homo sapiens
  AL050341.18_41681
  Located on chromosome 1
  Distance between a terminus base of telomere on chromosomal short arm and 5'-terminus of this base sequence : 40644220
  Distance between 3'-terminus of neighbour sequence of sequence listing upward to telomere on chrosomal short arm and 5'-terminus of this base sequence : 17864
catctaaatgcataatttatgctaaatgtgaaataggtctattttttaaaaaaatattttattttgttattttattttattttattttattttattttattttattttattttatttgagacagggtctcagtttattgccttgctggagtgcagtgtcacaatcacggctcactggagccttgacttcccaggctcaggcaatcctgtcacctcagtcccccaagtagctgggtctacaggtacgcactatcag

SEQ ID NO: 390 - DNA, 277 bp, Homo sapiens
  AL031985.10_18652
  Located on chromosome 1
  Distance between a terminus base of telomere on chromosomal short arm and 5'-terminus of this base sequence : 40722638
  Distance between 3'-terminus of neighbour sequence of sequence listing upward to telomere on chrosomal short arm and 5'-terminus of this base sequence : 78163
ttatttcctgatcagcatataaagatctctctcattgttttttaatattttattttagaatacatctattgtgtattataatataacgttaaatttgcatttggctggaggagaaaggaggggaaggtattatgctggagtttctggagtttctttcttttctcttatatattatattatattatattgtattatattgtattgtattatattatattatattatattatattatattatattatattagaaagtagtcttcagacctggtatttct

SEQ ID NO: 391 - DNA, 231 bp, Homo sapiens
  AL031985.10_104246
  Located on chromosome 1
  Distance between a terminus base of telomere on chromosomal short arm and 5'-terminus of this base sequence : 40808344
  Distance between 3'-terminus of neighbour sequence of sequence listing upward to telomere on chrosomal short arm and 5'-terminus of this base sequence : 85429
taagcacttcaagcagactaactatgaagactaactttgaagaatgactaacattgaagaaatgctgaatctcattagtagttggggaaattaaaacaaaacaaaacaaaacaaaacaaaacaggagacatcatgaaatacctaccagaatggctaaaataaaagatcattctaagtgttgacaagaatgtggagcaacagaaactagtaggagtgtaaattgacatgact

SEQ ID NO: 392 - DNA, 371 bp, Homo sapiens
  AL031985.10_124890
  Located on chromosome 1
  Distance between a terminus base of telomere on chromosomal short arm and 5'-terminus of this base sequence : 40828984
  Distance between 3'-terminus of neighbour sequence of sequence listing upward to telomere on chrosomal short arm and 5'-terminus of this base sequence : 20409
acgagaatcgcttgaactaggaaaggggaggtttcagtgagctgagatggcgccactgcactccaggctgggtgacagagcaagaccttgtctcaaaaataaataaataaataaataaatgtagaaagaatgatagaatcttttaccgtaaataaaataattgaaaggttaatggggaacagatactcacatgatatcaaagtattatcccctcaaattacttactaaatggcaaggaatgaacataattttccaatagtgaggtgtggtggtcacagttttaatcaaatgtctcagtaatgggatagccgggcattttatactttgcagatactgtaatataaagcacctggtaccacctacaaggtatt

SEQ ID NO: 393 - DNA, 252 bp, Homo sapiens
  D1S2632
  Located on chromosome 1
  Distance between a terminus base of telomere on chromosomal short arm and 5'-terminus of this base sequence : 40851894
  Distance between 3'-terminus of neighbour sequence of sequence listing upward to telomere on chrosomal short arm and 5'-terminus of this base sequence : 22539
ctccatcctgggcaacagagagagaatctgtctcaaaaaaaaaaaaaaatacacacacacacacacacacacacacacacacacatacatatactcaatatgctatatctattttttaaacctcatggattattgtggattattgagatttttagtctattatttatgttcatttagatttagtcatgttttttactttgttctgtttttactgcaccaggcaagtggaccccagtttggttctataacaat

SEQ ID NO: 394 - DNA, 215 bp, Homo sapiens
  D1S2706
  Located on chromosome 1
  Distance between a terminus base of telomere on chromosomal short arm and 5'-terminus of this base sequence : 40983575
  Distance between 3'-terminus of neighbour sequence of sequence listing upward to telomere on chrosomal short arm and 5'-terminus of this base sequence : 131429
aggcagaagtttcagtgagtcgagatcgcgccactgcactccagcatgggtgacagagtgagactccatctcaaaaacaaacacacacacacacacacacacacacacacacacacaaacttagtctgaaataaaatcttcaagaaccacatagcagcagagaggcaggttaagtgtacaacttggtggtcctccccttctaggaggtcaccagg

SEQ ID NO: 395 - DNA, 302 bp, Homo sapiens
  AL031289.1_51654
  Located on chromosome 1
  Distance between a terminus base of telomere on chromosomal short arm and 5'-terminus of this base sequence : 41047473
  Distance between 3'-terminus of neighbour sequence of sequence listing upward to telomere on chrosomal short arm and 5'-terminus of this base sequence : 63683
agttcttagaacagaccttaggatataaattttccataagtgttagttataattttatatatatatatatatatatatatatatatatatttgagatggagtctcactctgttacccaggaggcagtggcgtgatctctgctcactgcaatctccgcctcccaggttgaagcaattcttctgcctcagcctcctgggtagctgggattacaggcatgtgccactacgcctggctaatttttgtgttttttgtagagatggggtttcaccatattggccaggctagtcttgaatcctgatcca

SEQ ID NO: 396 - DNA, 460 bp, Homo sapiens
  AL158843.4_168735
  Located on chromosome 1
  Distance between a terminus base of telomere on chromosomal short arm and 5'-terminus of this base sequence : 41165904
  Distance between 3'-terminus of neighbour sequence of sequence listing upward to telomere on chrosomal short arm and 5'-terminus of this base sequence : 118129
attaggagaagttgagccttaaagttcaaggtcctgggccgggcgctgtggctcacgcctgtaatcccagcactttgggaggcagaggcaggcagaccacctgaggtcaggagttcgagactagcctggccaacatggtgaaaccccgtctctactgaaaatacaaaaaattatctgggtgtgatggtgcgcacctatagtcccagctacttgggaggttgaggcatcagaatcgcttaaacccgggaggtagaggttgcagtgagccgagatcgtgccactgcactccagcctggatgacagagtgagactccatcaaataaataaataaataaataaataaataaataaatacagttcaaggtcctgctcccaccccgattctaccctggggactcattccttccctctctcgccctttcatttgagaaaccttcacttctaaatgaagttcagctgc

SEQ ID NO: 397 - DNA, 453 bp, Homo sapiens
  AL354914.5_154257
  Located on chromosome 1
  Distance between a terminus base of telomere on chromosomal short arm and 5'-terminus of this base sequence : 41165911
  Distance between 3'-terminus of neighbour sequence of sequence listing upward to telomere on chrosomal short arm and 5'-terminus of this base sequence : -453
gaagttgagccttaaagttcaaggtcctgggccgggcgctgtggctcacgcctgtaatcccagcactttgggaggcagaggcaggcagaccacctgaggtcaggagttcgagactagcctggccaacatggtgaaaccccgtctctactgaaaatacaaaaaattatctgggtgtgatggtgcgcacctatagtcccagctacttgggaggttgaggcatcagaatcgcttaaacccgggaggtagaggttgcagtgagccgagatcgtgccactgcactccagcctggatgacagagtgagactccatcaaataaataaataaataaataaataaataaataaatacagttcaaggtcctgctcccaccccgattctaccctggggactcattccttccctctctcgccctttcatttgagaaaccttcacttctaaatgaagttcagctgc

SEQ ID NO: 398 - DNA, 276 bp, Homo sapiens
  HUMUT862
  Located on chromosome 1
  Distance between a terminus base of telomere on chromosomal short arm and 5'-terminus of this base sequence : 41239435
  Distance between 3'-terminus of neighbour sequence of sequence listing upward to telomere on chrosomal short arm and 5'-terminus of this base sequence : 73071
cttggtgatttggtgtgccaagtcttgccaagtccccattccagatgtcgctgtaccccggtggggtgatacagcagaaagtcattgttatatgcttctgcactgaaaaagaattctcaaagtaactttcactctttctttccttctttctttctttctttctttctttctttctttctttcttttttctttctttctttctttctctttctctctttctttctctctctttctctctctcttttcttttttttgagacagggtctctgtcattca

SEQ ID NO: 399 - DNA, 271 bp, Homo sapiens
  AL158843.4_139160
  Located on chromosome 1
  Distance between a terminus base of telomere on chromosomal short arm and 5'-terminus of this base sequence : 41239515
  Distance between 3'-terminus of neighbour sequence of sequence listing upward to telomere on chrosomal short arm and 5'-terminus of this base sequence : -196
gtcattgttatatgcttctgcactgaaaaagaattctcaaagtaactttcactctttctttccttctttctttctttctttctttctttctttctttctttcttttttctttctttctttctttctctttctctctttctttctctctctttctctctctcttttcttttttttgagacagggtctctgtcattcaggctggagtgcagtggcacgatcttggctcactgcaactcctgcctctctggttcaagtgattctcatacctcag

SEQ ID NO: 400 - DNA, 389 bp, Homo sapiens
  AL158843.4_45365
  Located on chromosome 1
  Distance between a terminus base of telomere on chromosomal short arm and 5'-terminus of this base sequence : 41263993
  Distance between 3'-terminus of neighbour sequence of sequence listing upward to telomere on chrosomal short arm and 5'-terminus of this base sequence : 24207
gtcaggtgttcgagaccagcctggccaacatggtgaagcccgctctctactaaaagtacaaaaactagctgggtgtggtggtgcatgcctgtaatcccagctactcgggaggctgaggcaggagaatcacttgagcccaggaggtagaggttgcaatgagccgagatcttgccactgcactctagcctgggtaacagagtgagactctgtctcaaataaataaataaataaataaataaataaataaataaataaaataagataaaataaaaaactgccaataagccaggtgcagtggctcacatttgtaatcccaacaccttggaaggcccaggcaagaggatggattgagcccaggagttaaagatcagtctggataagatggagaa

SEQ ID NO: 401 - DNA, 358 bp, Homo sapiens
  HUMUT7056
  Located on chromosome 1
  Distance between a terminus base of telomere on chromosomal short arm and 5'-terminus of this base sequence : 41290991
  Distance between 3'-terminus of neighbour sequence of sequence listing upward to telomere on chrosomal short arm and 5'-terminus of this base sequence : 26609
ctgtgaaatccctcattaatcatttttatattaattacaggtttcaatgatattattttggacatactgggttaaataaaatttattaaaattatttcacttgtttctctttactttcttaagtgtggctactagaacattcccaatttaatatatgactcacatttatatttttttctccttccttccttccttccctccctccctttccctccttcttttcttttttctttctttctttttctttctttcttccttccttccttccttccttctttcctttctttctttctttctttcttccttccttccttctctctctctctctctctttctttctttctttctgagacacagc

SEQ ID NO: 402 - DNA, 411 bp, Homo sapiens
  AL162262.9_32478
  Located on chromosome 1
  Distance between a terminus base of telomere on chromosomal short arm and 5'-terminus of this base sequence : 41478022
  Distance between 3'-terminus of neighbour sequence of sequence listing upward to telomere on chrosomal short arm and 5'-terminus of this base sequence : 186673
gtattgcaatgagaaatactccacatcacctgtataatattttttatcaaatctctttagcaggccaggcctagcagtttatgcctgtaatcagagccagcactttgggaggctgaggcggaatgattacttgaggccagaaattcaagaccagcctgggcaatatagcaagtcccccatcactacaaaaaatagaaaaattggccaggtgtggtggtgcacacccttagtcctagttgctcagggggatcacctgagcccaggagttgaaggctgctgtgagccatgattgcaccactgcacaccagcctgggcaacagagaaagaccctgtctcaaaataaataaataaataaataaataaataaataagctcttcagcatgaatgtaattatgaggaaacgatcagaa

SEQ ID NO: 403 - DNA, 339 bp, Homo sapiens
  AC026577.3_93814
  Located on chromosome 1
  Distance between a terminus base of telomere on chromosomal short arm and 5'-terminus of this base sequence : 41478094
  Distance between 3'-terminus of neighbour sequence of sequence listing upward to telomere on chrosomal short arm and 5'-terminus of this base sequence : -339
agcagtttatgcctgtaatcagagccagcactttgggaggctgaggcggaatgattacttgaggccagaaattcaagaccagcctgggcaatatagcaagtcccccatcactacaaaaaatagaaaaattggccaggtgtggtggtgcacacccttagtcctagttgctcagggggatcacctgagcccaggagttgaaggctgctgtgagccatgattgcaccactgcacaccagcctgggcaacagagaaagaccctgtctcaaaataaataaataaataaataaataaataaataagctcttcagcatgaatgtaattatgaggaaacgatcagaa

SEQ ID NO: 404 - DNA, 410 bp, Homo sapiens
  AL110502.1_42151
  Located on chromosome 1
  Distance between a terminus base of telomere on chromosomal short arm and 5'-terminus of this base sequence : 41478096
  Distance between 3'-terminus of neighbour sequence of sequence listing upward to telomere on chrosomal short arm and 5'-terminus of this base sequence : -337
cagtttatgcctgtaatcagagccagcactttgggaggctgaggcggaatgattacttgaggccagaaattcaagaccagcctgggcaatatagcaagtcccccatcactacaaaaaatagaaaaattggccaggtgtggtggtgcacacccttagtcctagttgctcagggggatcacctgagcccaggagttgaaggctgctgtgagccatgattgcaccactgcacaccagcctgggcaacagagaaagaccctgtctcaaaataaataaataaataaataaataaataaataagctcttcagcatgaatgtaattatgaggaaacgatcagaagaagtccaaactgtgggacattctgtaaaacaatccagactcttcaaaaatgtcagtgtcatacaaagcaaac

SEQ ID NO: 405 - DNA, 197 bp, Homo sapiens
  D1S2722
  Located on chromosome 1
  Distance between a terminus base of telomere on chromosomal short arm and 5'-terminus of this base sequence : 41514989
  Distance between 3'-terminus of neighbour sequence of sequence listing upward to telomere on chrosomal short arm and 5'-terminus of this base sequence : 36483
caaataatgctaccattgcataaataaatacacacacacacacacacacacacacaccagaaactatatatagtgtatagattattatatatagtatattgtacaataatatgtaatactgtatatgtattgcttaataaacttgtacacatgtattttcatatttggaggtgtatcttcagggtaaatgaccagaa

SEQ ID NO: 406 - DNA, 202 bp, Homo sapiens
  AL110502.1_78810
  Located on chromosome 1
  Distance between a terminus base of telomere on chromosomal short arm and 5'-terminus of this base sequence : 41514992
  Distance between 3'-terminus of neighbour sequence of sequence listing upward to telomere on chrosomal short arm and 5'-terminus of this base sequence : -194
ataatgctaccattgcataaataaatacacacacacacacacacacacacacaccagaaactatatatagtgtatagattattatatatagtatattgtacaataatatgtaatactgtatatgtattgcttaataaacttgtacacatgtattttcatatttggaggtgtatcttcagggtaaatgaccagaagcggtatt

SEQ ID NO: 407 - DNA, 251 bp, Homo sapiens
  G07846
  Located on chromosome 1
  Distance between a terminus base of telomere on chromosomal short arm and 5'-terminus of this base sequence : 41742620
  Distance between 3'-terminus of neighbour sequence of sequence listing upward to telomere on chrosomal short arm and 5'-terminus of this base sequence : 227426
taattgtgtgagccagtttcctcattatctatctatctatctatctatctatctatctatctatctatctatcatctatctatctatctattcatcaatcaatctgtttaatctatctccagttggctctgtttctctggagaaacctaaggcatcatccaaagtgatccaaggaggcttcttagaagaggtgacagacaagctgactttcaaaggcgttggtcagggatgtgagaaagctgcctgagttc

SEQ ID NO: 408 - DNA, 316 bp, Homo sapiens
  AL354974.3_36218
  Located on chromosome 1
  Distance between a terminus base of telomere on chromosomal short arm and 5'-terminus of this base sequence : 41925460
  Distance between 3'-terminus of neighbour sequence of sequence listing upward to telomere on chrosomal short arm and 5'-terminus of this base sequence : 182589
accttctttctatccatcgatccatccatccatccatccatccatccatccatccatccgtccatctacccacccatccatccacctttcctcccatccaccttctttctatccattgatccatcaatccatccatccatccattcatccatccatctgtccacctacccacccatccatccacctttcctcccatctgccttctttctctccattgatccattcatcatcaaaccttttattcatccttccgttcacacatctactcaaccagcctcccatgcacccatcctccttcatgagaaacaagattgga

SEQ ID NO: 409 - DNA, 482 bp, Homo sapiens
  AL136127.6_113408
  Located on chromosome 1
  Distance between a terminus base of telomere on chromosomal short arm and 5'-terminus of this base sequence : 41998092
  Distance between 3'-terminus of neighbour sequence of sequence listing upward to telomere on chrosomal short arm and 5'-terminus of this base sequence : 72316
caccttacaggcagtctttaattaaagatagtgggaaaaactttcttccttttcttttccctttccttcccttccttccttcctctctttctccttcctcccttcccttcccttccttccttccttccttccttctttccttctttccttcttttccttccttccttccttcctttctttctctctctctctctctctctctctctctctccctctctctctctttctttctttctttcttttcttttgggtataataaacctacaaggaagaggggaatgggataggagactaacagtaaacttttggaagctggaaagagatgaatgactggaagagacagaatcccaagcctgcagcagggaaatctgggaaccaatctgatttacatcccaggatccctcaaagcctctgcaggttggggtggagggaaccaaggtaaggacgattggtggaaagtcttgttagaagctgtcagactc

SEQ ID NO: 410 - DNA, 268 bp, Homo sapiens
  DISO7_00000203
  Located on chromosome 1
  Distance between a terminus base of telomere on chromosomal short arm and 5'-terminus of this base sequence : 42142466
  Distance between 3'-terminus of neighbour sequence of sequence listing upward to telomere on chrosomal short arm and 5'-terminus of this base sequence : 143892
ctgacttagcaaccatcccctctccatcctccatccccattgctgtgctttcctggactcagatgctttggttgttttcctgtttggggtgtgtgtgcgtgtgtgtgtgtgtgtgtgtatgtgtgtgtgtgtgcatgtgcacatgtatggtaggtgctctcttcatagacctgttgcacacatgaagcttctgtcctgggacagagactagagtttgcattttatggatatcaccttcctgaggtccagtcctccagactcagttccc

SEQ ID NO: 411 - DNA, 278 bp, Homo sapiens
  D1S2645
  Located on chromosome 1
  Distance between a terminus base of telomere on chromosomal short arm and 5'-terminus of this base sequence : 42276100
  Distance between 3'-terminus of neighbour sequence of sequence listing upward to telomere on chrosomal short arm and 5'-terminus of this base sequence : 133366
ttccccacattggtgtatagactgatcttgcaaaaacccacatctaattaaccttcctcctgaaagcctctgcacaattcaccctttcctgtggaataaagtccaaactccctaccactgcagtcacagtctctcatcatctaaccccattccctctcctgtagtcatccttagttatccataattctctccccacagcacaggcacacatgtgtacacacacacacacacacacacacacacacacacacacacacacgagtctacactcaagccag

SEQ ID NO: 412 - DNA, 223 bp, Homo sapiens
  D1S463
  Located on chromosome 1
  Distance between a terminus base of telomere on chromosomal short arm and 5'-terminus of this base sequence : 42552780
  Distance between 3'-terminus of neighbour sequence of sequence listing upward to telomere on chrosomal short arm and 5'-terminus of this base sequence : 276402
ttgctttgaactaggaaccctgttacattaatgtagtcttaaccacctcccttcaaaacagaaaacatggtacatcccagttaaatgcctatgactccttgcaaaattaaaatactgtctgcgccttgattcttgtgtgtgtgtgtgtgtgtgtgtgtatttcactttaaagattacagatgtgaaaacaaaatgcatttccatgtactgagttattgtagct

SEQ ID NO: 413 - DNA, 299 bp, Homo sapiens
  chr1.fa.O7frz.47933648
  Located on chromosome 1
  Distance between a terminus base of telomere on chromosomal short arm and 5'-terminus of this base sequence : 42856686
  Distance between 3'-terminus of neighbour sequence of sequence listing upward to telomere on chrosomal short arm and 5'-terminus of this base sequence : 303683
agctcagattccttagcctagctttttaaacacacacacacacacacacacacacacacacacacacagagctttattgatatataccataaaattcacccattttacgtgtacaattaaattatttttagcaaatttacagagtagcgcaaccattagcacaatcaagtttcagaacatttccattaccccaaagagatcccttgtatccatgcgcagtcatttcccattcctgttccagccccagcaaccacttcctgtttctacaaatttgccttctcaggacagttcatacagac

SEQ ID NO: 414 - DNA, 434 bp, Homo sapiens
  AL159175.6_71306
  Located on chromosome 1
  Distance between a terminus base of telomere on chromosomal short arm and 5'-terminus of this base sequence : 43002788
  Distance between 3'-terminus of neighbour sequence of sequence listing upward to telomere on chrosomal short arm and 5'-terminus of this base sequence : 145803
tctaagaaatatttgcctaaccagattttctcttatgatttctcctgcaggttttatagatttagcttttacatctaggtttgttgttcatttttcagatttttatgtatgatgtgatgtaagggtcattgttaatttttctcccatgcagacaattgtttcaacataattttttgaaaagtctttcctttccccactgacttgtctgatgccttcatcaaaaattaagtgactgtggatctatctgtctgtctgtctgtctatctatctatctatctatctatctatctatctatctatctatctatctatctatctatatgggtcttttcttggactctgttctgttgatctatgtctgtcctttctccaaaacttggtcattggaattttacagtaaaccttgaaatctgacggtctaagtcctttatgct

SEQ ID NO: 415 - DNA, 434 bp, Homo sapiens; identical to SEQ ID NO: 414
  AL359754.5_93677
  Located on chromosome 1
  Distance between a terminus base of telomere on chromosomal short arm and 5'-terminus of this base sequence : 43002788
  Distance between 3'-terminus of neighbour sequence of sequence listing upward to telomere on chrosomal short arm and 5'-terminus of this base sequence : -434

SEQ ID NO: 416 - DNA, 190 bp, Homo sapiens
  D1S1641
  Located on chromosome 1
  Distance between a terminus base of telomere on chromosomal short arm and 5'-terminus of this base sequence : 43002985
  Distance between 3'-terminus of neighbour sequence of sequence listing upward to telomere on chrosomal short arm and 5'-terminus of this base sequence : -237
tgacttgtctgatgccttcatcaaaaattaagtgactgtggatctatctgtctgtctgtctgtctatctatctatctatctatctatctatctatctatctatctatctatctatctatctatatgggtcttttcttggactctgttctgttgatctatgtctgtcctttctccaaaacttggtcattgg

SEQ ID NO: 417 - DNA, 402 bp, Homo sapiens
  chr1.fa.O7frz.47603956
  Located on chromosome 1
  Distance between a terminus base of telomere on chromosomal short arm and 5'-terminus of this base sequence : 43160351
  Distance between 3'-terminus of neighbour sequence of sequence listing upward to telomere on chrosomal short arm and 5'-terminus of this base sequence : 157176
tacctgcttaatttactttcagagtaacaattctgttaagattttagtgctccatttgttttatttgtggtaacatgttttccctctttctgcttttaatctgattaggaaatttgtacatagattctaggcaaaatctccctccttcagtgatgccaccccctggttatcctcatatcccacaggcactcagcactccaggaacaacgatggcaggtaagagagagagagagagtgagtgtgtgtgtgtgtgtgtgtgtgtgtgtgagcactccaggaacaacgatggcaggtgagagagagagtgtgtgtgtgtgtgtcagttattacccagagtttaatattgagaagcatgtgtgtgtgtcagttgttacccagagtttaatattgagaagcgttagc

SEQ ID NO: 418 - DNA, 401 bp, Homo sapiens
  chr1.fa.O7frz.48334100
  Located on chromosome 1
  Distance between a terminus base of telomere on chromosomal short arm and 5'-terminus of this base sequence : 43519538
  Distance between 3'-terminus of neighbour sequence of sequence listing upward to telomere on chrosomal short arm and 5'-terminus of this base sequence : 358785
gtttcaatcttgagaggttgtatgtttccaggaatttatccctttcctgtaagctttctagtttgtgtttgcatagaggtgtttgtaatggtctctgagagccttttgtatttctctggtgtcagtgttaatgtctcctttgtcatttctgattgtgtttatttggatcttctctctttttctttgtctatctagcagtctatcaatcttatttattttttcaaagaaccaacttctggttttattgatcgtgtgtgtgtgtgtgtgtgtgtgtgtgtgtgtgtgtgcatgtgtgtgtgtttcattctgttcagctctaattttggctatttcttgtcttctgttaggttcagggttggtttactcttatttttctagttcctctaggtgtaatgttaggt

SEQ ID NO: 419 - DNA, 310 bp, Homo sapiens
  D1S443
  Located on chromosome 1
  Distance between a terminus base of telomere on chromosomal short arm and 5'-terminus of this base sequence : 43708217
  Distance between 3'-terminus of neighbour sequence of sequence listing upward to telomere on chrosomal short arm and 5'-terminus of this base sequence : 188278
agctgagatcatggcactgaactccagcctaggagacagagagagacagtctcaaaaaatatacacacacacacacacacacacacacacacatatatataccataataaaaattatgtgaatgtagcccctttctgtctcaaaatatcttattgtgctgtacttacctattttcagactgcagttgatcatgggtaattaaaactataaaaagtgaaaccacagatgaggggatactgtagtacatttaataaatgttacttgccattaatatttctgtagatttttgatcaacttttgctctggaaga

SEQ ID NO: 420 - DNA, 439 bp, Homo sapiens
  AL358236.6_60137
  Located on chromosome 1
  Distance between a terminus base of telomere on chromosomal short arm and 5'-terminus of this base sequence : 43747292
  Distance between 3'-terminus of neighbour sequence of sequence listing upward to telomere on chrosomal short arm and 5'-terminus of this base sequence : 38765
atccagcatctacttgcactaggggtgctgtctcgtgtaatcctcccagcagcccccatgaggaggtattaccaccccttctccatatttatttatttatttatttatttatttattgagacagagtttcactcttattgcccaggctggagtacagttgcacaatcttggctcaccgcaacctccgccttccaggttcaagtgattctcctgcctcagcctcctgagtagctgggattacaggcatgtgccaccacacccgctaattttgtatttttagtagagacagggtttctccatgttggtcaggctagtctcgaactcccgacctcatgtaatccacctgccttagcctcccaaaaggctgggattacaggcgtgagccaccacgcccggcccttctccatttattcatccacaaatatttaagcgaatgagc

SEQ ID NO: 421 - DNA, 307 bp, Homo sapiens
  AL354972.6_2619
  Located on chromosome 1
  Distance between a terminus base of telomere on chromosomal short arm and 5'-terminus of this base sequence : 43843469
  Distance between 3'-terminus of neighbour sequence of sequence listing upward to telomere on chrosomal short arm and 5'-terminus of this base sequence : 95738
taggctatctggtaagtccataaagtgcaaacagaaataggatatggtctgcccttagcagcatgctatttagtgagtaaaacagaaaagtaaatggataattaacatctgctgcatccattggaagctcacttctcttatttgtgtttgacaaatatccatccatccatccatccatccatccatccaaccaaccattcatctaataaatgtttattgagtacctataatgtagtcatccaatattatggagatactatgttaatcctagagtatagagagtgtaaatcttagcttctgctcttga

SEQ ID NO: 422 - DNA, 284 bp, Homo sapiens
  AJ005128.1_504
  Located on chromosome 1
  Distance between a terminus base of telomere on chromosomal short arm and 5'-terminus of this base sequence : 43983143
  Distance between 3'-terminus of neighbour sequence of sequence listing upward to telomere on chrosomal short arm and 5'-terminus of this base sequence : 139367
acaatggattccaagtaatctccagtcctcatcacagcttgtcacaaacacctggcacgtcttttctgactagagtgaaaacacacacacacacacacacacacacacacacacacacacacacacacactagcttcagggacacagcctcagcctgatgctccaaaagcatttactgcaaacttcctctcactacagagttatttcctggaagaacaacaaaaactgtttttgaattgacaatgtggctttagttgctgctgaagttaagtgaaagtaccaac

SEQ ID NO: 423 - DNA, 125 bp, Homo sapiens
  D1S447
  Located on chromosome 1
  Distance between a terminus base of telomere on chromosomal short arm and 5'-terminus of this base sequence : 44185363
  Distance between 3'-terminus of neighbour sequence of sequence listing upward to telomere on chrosomal short arm and 5'-terminus of this base sequence : 201936
ttagtctgagtttgtggggggtggaagggaagttctctctgtgtgtgtgtgtgtgtgtgtgtgtgtgtgtgtgtgtgtgtgtcccaactgttattcattgcttcaggcagccatgaagttaaaac

SEQ ID NO: 424 - DNA, 193 bp, Homo sapiens
  D1S211
  Located on chromosome 1
  Distance between a terminus base of telomere on chromosomal short arm and 5'-terminus of this base sequence : 44480815
  Distance between 3'-terminus of neighbour sequence of sequence listing upward to telomere on chrosomal short arm and 5'-terminus of this base sequence : 295327
ggattccttgctctggaaaggcaaaaaagggtaaaacaatttcatgtgcatgtgtgtgtctgtgtgtgtctgtgtgtgtgtgtgtgtgtgtgtgtgtgtgtgcgcgcgcgcgcgcgcgtccgcgcgtccgcgtgcgctttttttttagtggtataggagaagattgagaagcttctgatcctgccatgtagct

SEQ ID NO: 425 - DNA, 301 bp, Homo sapiens
  AC026934.2_42264
  Located on chromosome 1
  Distance between a terminus base of telomere on chromosomal short arm and 5'-terminus of this base sequence : 44530778
  Distance between 3'-terminus of neighbour sequence of sequence listing upward to telomere on chrosomal short arm and 5'-terminus of this base sequence : 49770
gtcaagctacttaaccactctgagcctcagtttcatctgtaagatgatgacaataaacttatttcacagagtttttgtaagaatttaattgaaattattaattcatagaggactgtcaagtattgagtatctaatccttccaggatccttccctactaggcttcttggtctctctagcacctagacagtattggcgtatgtttgtcaggtgcccgttaaacactgaatgcttggttggatggatggatggatggatggatggatggatggatggatggatgatggtaggatgactgcgtac

SEQ ID NO: 426 - DNA, 365 bp, Homo sapiens
  AL139220.3_26537
  Located on chromosome 1
  Distance between a terminus base of telomere on chromosomal short arm and 5'-terminus of this base sequence : 44760456
  Distance between 3'-terminus of neighbour sequence of sequence listing upward to telomere on chrosomal short arm and 5'-terminus of this base sequence : 229377
gcatccaatgttctctagacaccaccatcagcaacacagaatcacacatatcacacataactaagctgcacataactcaatgttgtcactaggtagtgtgtcagatctgtgccctccagaccctcctaacacaatcattgtcacccagtcttggtgtatgtagacgttttcttaatatttcttaatattctatttaggatgagcttatcatggaacataagaaaaataaaacagatgtcagcctgtgtatgaagaattcatccacaagatttggtaaaggataataataataataataataataataataataataatagctatcatacattcattgggtacttactagtaccaggccagttcta

SEQ ID NO: 427 - DNA, 267 bp, Homo sapiens
  D1S2713
  Located on chromosome 1
  Distance between a terminus base of telomere on chromosomal short arm and 5'-terminus of this base sequence : 44762412
  Distance between 3'-terminus of neighbour sequence of sequence listing upward to telomere on chrosomal short arm and 5'-terminus of this base sequence : 1591
ccttaggagtctacagacgccatactgcaacacattggcattagaagtaggattgtagtgtcctctagtggacactttgtgaatttacatagtattatttactggatgtggccaataaaggtgggctgaatccagaaaagggaagattggcatccagagtgtttggagagtgggcccataagagaacattgtgtgtgtatgtgtgtgtgtgtgtgtgtgtgtgtgtgtgtgtgtgtgcacgtgcacgcacgtatgtgttgggggctg

SEQ ID NO: 428 - DNA, 322 bp, Homo sapiens
  AL035417.15_79353
  Located on chromosome 1
  Distance between a terminus base of telomere on chromosomal short arm and 5'-terminus of this base sequence : 44921112
  Distance between 3'-terminus of neighbour sequence of sequence listing upward to telomere on chrosomal short arm and 5'-terminus of this base sequence : 158433
ctggaggtctagtgttataggatatgtcacaatgttcccccatgagaacaagttgcttcaccttacaaaacccaaacataaaaagagaaatactactatatacatagtattatgtaatactaatactatgaacctgaggttgaagtgaaccgagatcgcgccactggtctccagcctgggcaatgagcgagactccatctaaaataaaataaaataaaataaaataaaataaaataaaataaaataaaataaaataaaataaataaataaaataaagttgactcgaattaacaataatctgttacttgaaggtcaaatagaa

SEQ ID NO: 429 - DNA, 152 bp, Homo sapiens
  AL035417.15_37392
  Located on chromosome 1
  Distance between a terminus base of telomere on chromosomal short arm and 5'-terminus of this base sequence : 44963241
  Distance between 3'-terminus of neighbour sequence of sequence listing upward to telomere on chrosomal short arm and 5'-terminus of this base sequence : 41807
agtaaggtcacttggtcaactcaagcagctgggaggggtgtacatggggcgtgtgtgtgtatgtatgtgtgtgagagagagtgtgtgtgtgtgtgtgtgtgtgtggtagggggagcagatgctctgctgaaggtcaagtgctcacttatgca

SEQ ID NO: 430 - DNA, 298 bp, Homo sapiens
  AL356653.3_10599
  Located on chromosome 1
  Distance between a terminus base of telomere on chromosomal short arm and 5'-terminus of this base sequence : 44987374
  Distance between 3'-terminus of neighbour sequence of sequence listing upward to telomere on chrosomal short arm and 5'-terminus of this base sequence : 23981
ggctgagcatgagaatcacttgaacctgggaggcagaggttgtagtaagccgagatcatgccaccgcattccagcctaggtgacagagcaagagactgtctcaaaaaataaaataaaataaaataaaataaaataaaataaaataaaataaactacaaatccacgttaaaaaaacaaatttactatagtttttttttccattatgtactttatcattatatacccaaaatacaagttccaccaagtcctgaagaacgaagggaatgtctgtggcgttttctgacattgctaatagctc

SEQ ID NO: 431 - DNA, 291 bp, Homo sapiens
  D1S190
  Located on chromosome 1
  Distance between a terminus base of telomere on chromosomal short arm and 5'-terminus of this base sequence : 45025420
  Distance between 3'-terminus of neighbour sequence of sequence listing upward to telomere on chrosomal short arm and 5'-terminus of this base sequence : 37748
ggtgccagactatgcagaccatgtggtctctaaaccctctttacagtctgtacaccagaaaatcctcctcagccaaagaatcttcccaaaagataaattctggatcttccactgctaaatggtctctctcctctgacccaactccttgcatgtatgtgcacatcgcgcgcgcgcgcacacacacacacacacacacacacacacacacacgtgcaggaatccatgaatcctttccccagggtcacctaagaaaagaggtaaggtgaaactagggctccctaaatcagcata

SEQ ID NO: 432 - DNA, 374 bp, Homo sapiens
  AC004254.1_45743
  Located on chromosome 1
  Distance between a terminus base of telomere on chromosomal short arm and 5'-terminus of this base sequence : 45066836
  Distance between 3'-terminus of neighbour sequence of sequence listing upward to telomere on chrosomal short arm and 5'-terminus of this base sequence : 41125
tgacatgcaacctaaattaaaccaagatcccaaaggccttggtcaaatacattagcaaaagccaaacgagagccaggtgtagtggcacatgcctgtagctccagctacttgtgggcaggagatcacttgaacccaggagttcgagcccagcatgggcaacctagcaaggtctcatagatagatagatagatagatagatagatagatagatagatagataaatgtttaaagccaaatgaagatgtttcttcctattttcttaagatgtgtatttctcaggataatgggctattctggttctattcaaccatcctgaacctaaagtaggtgctcatgagatgcccataaagcagttgtgacagaacttgacagtc

SEQ ID NO: 433 - DNA, 107 bp, Homo sapiens
  DISO7_10000579
  Located on chromosome 1
  Distance between a terminus base of telomere on chromosomal short arm and 5'-terminus of this base sequence : 45184126
  Distance between 3'-terminus of neighbour sequence of sequence listing upward to telomere on chrosomal short arm and 5'-terminus of this base sequence : 116916
ccactgagcaagtttattggtatattattcattcattcattcattcactaaatatttactgagttccttctatgtgtgaggcacagtccctgtcctcatggaaacag

SEQ ID NO: 434 - DNA, 105 bp, Homo sapiens
  DISO7_10000580
  Located on chromosome 1
  Distance between a terminus base of telomere on chromosomal short arm and 5'-terminus of this base sequence : 45211871
  Distance between 3'-terminus of neighbour sequence of sequence listing upward to telomere on chrosomal short arm and 5'-terminus of this base sequence : 27638
taagggtcttcatggttcttggcacgtatctatatgataatctccccttccctgacacacacacacacacacacacacacagagtattgcattgttaatacctgg

SEQ ID NO: 435 - DNA, 137 bp, Homo sapiens
  DISO7_10000581
  Located on chromosome 1
  Distance between a terminus base of telomere on chromosomal short arm and 5'-terminus of this base sequence : 45216577
  Distance between 3'-terminus of neighbour sequence of sequence listing upward to telomere on chrosomal short arm and 5'-terminus of this base sequence : 4601
tctgcaattccaagttggggagtgggcacctggcattccccagctgacttcacaccactgaaacacacacacacacacacacacacacacacacacacacacacacacactttgtaaggctcctggctgcagtatga

SEQ ID NO: 436 - DNA, 172 bp, Homo sapiens
  DISO7_10000583
  Located on chromosome 1
  Distance between a terminus base of telomere on chromosomal short arm and 5'-terminus of this base sequence : 45389422
  Distance between 3'-terminus of neighbour sequence of sequence listing upward to telomere on chrosomal short arm and 5'-terminus of this base sequence : 172708
ctgccatcctctaccagccgcaactgcgagggctggaggtataaaaccgtacaaaacggcctagggggcgcgtgccgacccaacctccacccagtggggttgaggcatattctggatggatggatggatggatggatggatgggtggatgggaagcagtcttcagttgatga

SEQ ID NO: 437 - DNA, 157 bp, Homo sapiens
  chr1.fa.O7frz.51164459
  Located on chromosome 1
  Distance between a terminus base of telomere on chromosomal short arm and 5'-terminus of this base sequence : 45793416
  Distance between 3'-terminus of neighbour sequence of sequence listing upward to telomere on chrosomal short arm and 5'-terminus of this base sequence : 403822
ctactgagatgcctgttaacagataaatggagatatcaaaaaggcagttaaatatacatatctagagttgagaggaaaggtctgggcaagatatgtgtgtgtgtgtgtgtgtgtgtgtgtgtatacacatatatgagctgttagtatgtaaatgatt

SEQ ID NO: 438 - DNA, 198 bp, Homo sapiens
  D1S2802
  Located on chromosome 1
  Distance between a terminus base of telomere on chromosomal short arm and 5'-terminus of this base sequence : 45877166
  Distance between 3'-terminus of neighbour sequence of sequence listing upward to telomere on chrosomal short arm and 5'-terminus of this base sequence : 83593
caaactaattatcaaacaaaggaacactatttataatatacaaagaacacttaaaacacacacacacacacacacacacacacaaaacccaaaaaccaaacaacgcaattagcaaatgggcaaaagacatgaagagacatctcaccaaaaaggatagacagatggcaaataaaaagatgttcaacataacaggccact

SEQ ID NO: 439 - DNA, 262 bp, Homo sapiens
  Z23799.1_147
  Located on chromosome 1
  Distance between a terminus base of telomere on chromosomal short arm and 5'-terminus of this base sequence : 46055116
  Distance between 3'-terminus of neighbour sequence of sequence listing upward to telomere on chrosomal short arm and 5'-terminus of this base sequence : 177752
taggcaattaatcgtctgtagatcagaagaaacaaaacatggcctggcatagtgtgtgtatgtatgtgtgtgtgtgtgtgtgtgtgtgtgtatatatatatatatatatatatatatatatacacagatatatacagagagagagagagagagtacaatgagatttattataaggaaatggctcatacagttatggaggctgcaaagtcccatgatctgttatctgcaggctggagacccaggaaagccagtgatatagatt

SEQ ID NO: 440 - DNA, 178 bp, Homo sapiens
  D1S451
  Located on chromosome 1
  Distance between a terminus base of telomere on chromosomal short arm and 5'-terminus of this base sequence : 46055154
  Distance between 3'-terminus of neighbour sequence of sequence listing upward to telomere on chrosomal short arm and 5'-terminus of this base sequence : -224
atggcctggcatagtgtgtgtatgtatgtgtgtgtgtgtgtgtgtgtgtgtgtatatatatatatatatatatatatatatatacacagatatatacagagagagagagagagagtacaatgagatttattataaggaaatggctcatacagttatggaggctgcaaagtcccatgat

SEQ ID NO: 441 - DNA, 135 bp, Homo sapiens
  D1S2677
  Located on chromosome 1
  Distance between a terminus base of telomere on chromosomal short arm and 5'-terminus of this base sequence : 46089898
  Distance between 3'-terminus of neighbour sequence of sequence listing upward to telomere on chrosomal short arm and 5'-terminus of this base sequence : 34566
agctgtgattgtgccactccagcctgggtgacagagtgagaccctgtctcaaaacatataaacgtgtgtgtgtgtgtgtgtgtgtgtgtgtgtgtattccagggaacattaagacttagaggcaaactccagaac

SEQ ID NO: 442 - DNA, 170 bp, Homo sapiens
  DISO7_10000585
  Located on chromosome 1
  Distance between a terminus base of telomere on chromosomal short arm and 5'-terminus of this base sequence : 46220522
  Distance between 3'-terminus of neighbour sequence of sequence listing upward to telomere on chrosomal short arm and 5'-terminus of this base sequence : 130489
tgacagattctactccatctaattcatttcacaaaaggttaacttagcaaatatacatagaatcttagtcaacaggataaaaaagcccaatgggaatagattaatggatttaatataaacactcacaaacaaacaaacaaacaaacaaacacttgaccacctgctactgc

SEQ ID NO: 443 - DNA, 420 bp, Homo sapiens
  AL356673.5_1493
  Located on chromosome 1
  Distance between a terminus base of telomere on chromosomal short arm and 5'-terminus of this base sequence : 46257468
  Distance between 3'-terminus of neighbour sequence of sequence listing upward to telomere on chrosomal short arm and 5'-terminus of this base sequence : 36776
atggctacttccatgtactgatagcatgtgcacatcactacatttttctgtttatatataaatttcccccacaaacctggctactccttgaggtctgagcctgtcatctgcctgaacccctcactcctagagtacctgtcccatacatacatacatacatacatacatacatacatacatacaatgtacacaatacacacaccacacacacacagcttatgggggagagatcttgacaggttgagtttggccagctggaaggacatttgaggaagtcgctgcctctgtcaccttcttcctttacctgttggaaaacctgaaaagaatcctcttggagaatatcaaagcactttactatactcggcaaaaaatcccagtggaccagatagaatcatactgagattgctcctgtattaaaga

SEQ ID NO: 444 - DNA, 152 bp, Homo sapiens
  DISD22_0000386
  Located on chromosome 1
  Distance between a terminus base of telomere on chromosomal short arm and 5'-terminus of this base sequence : 46423860
  Distance between 3'-terminus of neighbour sequence of sequence listing upward to telomere on chrosomal short arm and 5'-terminus of this base sequence : 165972
attctgttgcctgggaacaatggcagtatttctttatatatatatatatatatatatatacacacacacacacatacactttaagttctggggtacatgtgcagaatgggcagtatttcttaatgtccttctattccctcataatacttggt

SEQ ID NO: 445 - DNA, 111 bp, Homo sapiens
  DISD22_0000387
  Located on chromosome 1
  Distance between a terminus base of telomere on chromosomal short arm and 5'-terminus of this base sequence : 46523029
  Distance between 3'-terminus of neighbour sequence of sequence listing upward to telomere on chrosomal short arm and 5'-terminus of this base sequence : 99017
gacacattaggacaatagccacaaaataaataaataaataaataaataaataaataaataaataaataaaactgatatagtggaagataaaaaggatgcatggaactcaca

SEQ ID NO: 446 - DNA, 176 bp, Homo sapiens
  D1S2884
  Located on chromosome 1
  Distance between a terminus base of telomere on chromosomal short arm and 5'-terminus of this base sequence : 46682382
  Distance between 3'-terminus of neighbour sequence of sequence listing upward to telomere on chrosomal short arm and 5'-terminus of this base sequence : 159242
acagaaacaggagatacaggatcacaagcatattcccaaatgcactccccacgcacaaattcagaaacgcagagccctccctggccaacacacacacacacacacacacacacacacacacacacacacacacacactcttatcaggctggggcaggcactggcactgctgagtca

SEQ ID NO: 447 - DNA, 407 bp, Homo sapiens
  AL009181.1_23887
  Located on chromosome 1
  Distance between a terminus base of telomere on chromosomal short arm and 5'-terminus of this base sequence : 46731907
  Distance between 3'-terminus of neighbour sequence of sequence listing upward to telomere on chrosomal short arm and 5'-terminus of this base sequence : 49349
tttgtaattctgcatcagagactttatttttcctcatctgttcaatcatttatatcagtgtggagtcatactgatatggatatttattttacactttgggttttaatccagtattacttcatttattttgttgctcaaattgttccagctttggccatcaggtgctcttttggttggcctctggttcttttgacattgtgtgtgtgtgtgtgtgtgtgtgtgtgtgtgtgtgtgtattttaatactttcctactttgtggtactacaaaatgctccaggctcatcttgcatatttcctgcccggctcctagaatcagtcatttctccaaggagtccccattccttttattggataatggcattagaaaccaagatctggccaggcacggtgactcaaacgcctgtac

SEQ ID NO: 448 - DNA, 282 bp, Homo sapiens
  AL009181.1_7196
  Located on chromosome 1
  Distance between a terminus base of telomere on chromosomal short arm and 5'-terminus of this base sequence : 46748617
  Distance between 3'-terminus of neighbour sequence of sequence listing upward to telomere on chrosomal short arm and 5'-terminus of this base sequence : 16303
caatttaccaaggatggtattatggcttttggtttttaattattgagaaaatatatctataaaagctgacttctgctgggttcagtggcatgggcctgtagtcacagttaagaggctgagcaacataagaccccattaaaaaaaaaacaaccccaactcttacacatttaccctgtgtcttacacacacacacacacacacacacacacacacacaaatgtgatgtgtgttggaggaattggagcaggagactgaagggactacagtaatggagtagaagca

SEQ ID NO: 449 - DNA, 252 bp, Homo sapiens
  AL357500.6_160322
  Located on chromosome 1
  Distance between a terminus base of telomere on chromosomal short arm and 5'-terminus of this base sequence : 46792000
  Distance between 3'-terminus of neighbour sequence of sequence listing upward to telomere on chrosomal short arm and 5'-terminus of this base sequence : 43101
attgcaattgttactagtaacagcttttattgacaaagtgtgtaattcacatatatgtggaacaaactattttatttatttatttatttatttatttatttatttatttatttgagacagggtcttgctctgttgcccaggttgaagtgcagtggcgcagtgacagctcactgcagcctcaacctcctgggctcaggtgatcctcccacctcagcctcctgagtagctgggactacaggcacataccatcac

SEQ ID NO: 450 - DNA, 451 bp, Homo sapiens
  chr1.fa.O7frz.31204661
  Located on chromosome 1
  Distance between a terminus base of telomere on chromosomal short arm and 5'-terminus of this base sequence : 47076268
  Distance between 3'-terminus of neighbour sequence of sequence listing upward to telomere on chrosomal short arm and 5'-terminus of this base sequence : 284016
tggatcacaaagtcaggagatttcagaccatcctggctaacacggtgaaaccccgtctctactaaaaatacaagaaattagccaggtttggtggcgggcgcctgtagtcccagctactctggaggctaaggcaggagaatggtgtgaacctgggacgtggagcttgcagtgagccaagatagcgccactgcactccagcctgggcgacacagcaagactccgtcacacacacacacacacacacacacacacacacacacacacacaacctactatgttattggcttatatatttactatactatacttttaatcattattttagaatgtactacttattaaaagaaaggctaattgtaaaactgcctctgataggtccttcaggaggtattccagaagaaggtactattttaggagatgacagctgtgtgttactgcttctgaagacttt

SEQ ID NO: 451 - DNA, 128 bp, Homo sapiens
  chr1.fa.O7frz.31873430
  Located on chromosome 1
  Distance between a terminus base of telomere on chromosomal short arm and 5'-terminus of this base sequence : 47176955
  Distance between 3'-terminus of neighbour sequence of sequence listing upward to telomere on chrosomal short arm and 5'-terminus of this base sequence : 100236
ttgatcctcagagtaattcctcccagctgcgggaagagttccaggtgggggatgagtgcgtgtgtataggtgtgtgtgtgtgtgtctgtgtgtgtgttggggcatccttaatactgcaggagtcattg

SEQ ID NO: 452 - DNA, 258 bp, Homo sapiens
  DISO7_00007774
  Located on chromosome 1
  Distance between a terminus base of telomere on chromosomal short arm and 5'-terminus of this base sequence : 47255950
  Distance between 3'-terminus of neighbour sequence of sequence listing upward to telomere on chrosomal short arm and 5'-terminus of this base sequence : 78867
aaggaaaccaaggttctgaggtcacccaaggccacatggaagtgggagaggacaaggacaggcggaagggtggacaggccaggccaatctcttgtgtgtgtttctctgttgctctctttctgtacctacccattctctctctccctttctttctctctctctctctctaacacacacacacacacacacacacacacacacacaccacacacactcttccccagtggcttctggcccctctcctagcaccttcccact

SEQ ID NO: 453 - DNA, 388 bp, Homo sapiens
  AL354887.4_26443
  Located on chromosome 1
  Distance between a terminus base of telomere on chromosomal short arm and 5'-terminus of this base sequence : 47641990
  Distance between 3'-terminus of neighbour sequence of sequence listing upward to telomere on chrosomal short arm and 5'-terminus of this base sequence : 385782
tcgaggtcaggagttcaagaccagcctggccaacatggtgaaaccccgtatctactaaaaatacaaaaattagccaggtgtgatggcaggtgcctgtaatcccagctacttgggaggctgaggcagaagaatcgcttggacccaggaggcggaggttgcagtgagccgagatctcaccactgcactccagcctgggcgacagagtgaaactccatctcaaataaataaataaataaataaataaataaataaataaataaataaataaatgcatgcaaggggtatatttagtattgatgaaaaggttttccctttggggttcccattgggttataaaaatcttctcactgtgcacctccctacagagtcagccacttaagctgataga

SEQ ID NO: 454 - DNA, 388 bp, Homo sapiens; identical to SEQ ID NO: 453
  AL354878.8_58838
  Located on chromosome 1
  Distance between a terminus base of telomere on chromosomal short arm and 5'-terminus of this base sequence : 47641990
  Distance between 3'-terminus of neighbour sequence of sequence listing upward to telomere on chrosomal short arm and 5'-terminus of this base sequence : -388

SEQ ID NO: 455 - DNA, 268 bp, Homo sapiens
  AL354887.4_45626
  Located on chromosome 1
  Distance between a terminus base of telomere on chromosomal short arm and 5'-terminus of this base sequence : 47693011
  Distance between 3'-terminus of neighbour sequence of sequence listing upward to telomere on chrosomal short arm and 5'-terminus of this base sequence : 50633
atgtacttaatgccacatcacttaaaatggttaaaatggtaaattgtatgttatgtatattttaccacaataaacagaaactggttatcatccctgtctccctgaataaaattctcaaaggttggagttggggtccaaatctcttttatttatttatttatttatttatttatttatttttgcactagaggtgattctggaaacaaaaaggtagactcaagacttactggccaacacaatattaaagatgcaggtctaaacatctgaa

SEQ ID NO: 456 - DNA, 160 bp, Homo sapiens
  D1S2754
  Located on chromosome 1
  Distance between a terminus base of telomere on chromosomal short arm and 5'-terminus of this base sequence : 47738645
  Distance between 3'-terminus of neighbour sequence of sequence listing upward to telomere on chrosomal short arm and 5'-terminus of this base sequence : 45366
ctatcaagaatgaagctgggagtataattgctgagtagaatatactaaggagtagaattgctaaattacatggtaggggtgtgtgtgtgtgtgtgtgtgtgtgtgtgtgtgtgtgtatttttgtttttttgagatggagtttcactcttgtcgtccaggc

SEQ ID NO: 457 - DNA, 201 bp, Homo sapiens
  HUMUT5482
  Located on chromosome 1
  Distance between a terminus base of telomere on chromosomal short arm and 5'-terminus of this base sequence : 47763457
  Distance between 3'-terminus of neighbour sequence of sequence listing upward to telomere on chrosomal short arm and 5'-terminus of this base sequence : 24652
aaatatgctgagccttagactctttctctctaaaacagagatgataacaaaacctgtaaggctatcattaaaggatgttttgaagattagatgagattctatctatctatctatctatctatctatctatctatctttgagacagagtctcactttgttacccaggctggagtgcagtagcactatcacagctcactgcat

SEQ ID NO: 458 - DNA, 115 bp, Homo sapiens
  DISD22_0000400
  Located on chromosome 1
  Distance between a terminus base of telomere on chromosomal short arm and 5'-terminus of this base sequence : 47998640
  Distance between 3'-terminus of neighbour sequence of sequence listing upward to telomere on chrosomal short arm and 5'-terminus of this base sequence : 234982
tcagccagtgaatatgtgtaagtatatccagtgattctctctctctctctctctctctctctaccagagggaccacaatcaaggcaccttttgccttgctcaggaccacaaggag

SEQ ID NO: 459 - DNA, 189 bp, Homo sapiens
  DISD22_0000403
  Located on chromosome 1
  Distance between a terminus base of telomere on chromosomal short arm and 5'-terminus of this base sequence : 48071072
  Distance between 3'-terminus of neighbour sequence of sequence listing upward to telomere on chrosomal short arm and 5'-terminus of this base sequence : 72317
caagacagaccaataatggtaatagagaacaattgttaagtactactctctctctcaatctgtttctctctctctctctctctctctctctctctctctctctctctctctatatatatatatatatatatatgttaggtactaatctaattcttctatataatgatggtactcatattatgcttgttt

SEQ ID NO: 460 - DNA, 200 bp, Homo sapiens
  DISO7_10000588
  Located on chromosome 1
  Distance between a terminus base of telomere on chromosomal short arm and 5'-terminus of this base sequence : 48409680
  Distance between 3'-terminus of neighbour sequence of sequence listing upward to telomere on chrosomal short arm and 5'-terminus of this base sequence : 338419
ctatctcccttggaggaggctccagttctctcccttgggaagccttgagtattttagggacagcccccctcccctccaactctacacacacacacacacacacacacacacacacacacacacacacacacacacacacacacacacacacagctttggtcctgcccatctctcctctctccaattctatactcatggtt

SEQ ID NO: 461 - DNA, 328 bp, Homo sapiens
  AL122001.32_99494
  Located on chromosome 1
  Distance between a terminus base of telomere on chromosomal short arm and 5'-terminus of this base sequence : 48562271
  Distance between 3'-terminus of neighbour sequence of sequence listing upward to telomere on chrosomal short arm and 5'-terminus of this base sequence : 152391
gcggttaagaaatcgagaccatcctggccaacattgtgaaaccctgtctctactaaaaacacaaacatattagctgagcgtggtggtgtgcgcctgtagtcccggctactccggaggctgaggcaggagaatcgcttgaacccgggaggtggaggttgcagtgagccgagatctgtgccactacactctagtctggcaacagagcgagactctgactcaaaaaaataaaaaataaaaaatacacacacacacacacacacacacacacacacacacacacgagtaattttacatgaggtaaaatcttatgtggtaaattcttgtccta

SEQ ID NO: 462 - DNA, 243 bp, Homo sapiens
  AL137799.4_26757
  Located on chromosome 1
  Distance between a terminus base of telomere on chromosomal short arm and 5'-terminus of this base sequence : 48672605
  Distance between 3'-terminus of neighbour sequence of sequence listing upward to telomere on chrosomal short arm and 5'-terminus of this base sequence : 110006
atccatcaatccacatttgtatctctccatccatccatccatccatccatccatccatccatccatccatccatccatccgttcatcgtatatgcatgcatgcatccacccatctctcaacccctctctgtgtacccacaccatggcccctattctggggacatagaccactcttggacccagcccctgcccctgctgtgctcttagacacacaaatgagttagtcagaaagtgatcaggtct

SEQ ID NO: 463 - DNA, 167 bp, Homo sapiens
  D1S2797
  Located on chromosome 1
  Distance between a terminus base of telomere on chromosomal short arm and 5'-terminus of this base sequence : 48706015
  Distance between 3'-terminus of neighbour sequence of sequence listing upward to telomere on chrosomal short arm and 5'-terminus of this base sequence : 33167
atcacatcacacacaatgactgtggacacacactgaccacagacaggcactcatcatggacacatacaatggcgatggacacactgttctctctctgacacacacacacacacacacacacacacacacacacaactcccgatagagaccaatcctttgaatggaca

SEQ ID NO: 464 - DNA, 337 bp, Homo sapiens
  AL357392.5_132952
  Located on chromosome 1
  Distance between a terminus base of telomere on chromosomal short arm and 5'-terminus of this base sequence : 48861607
  Distance between 3'-terminus of neighbour sequence of sequence listing upward to telomere on chrosomal short arm and 5'-terminus of this base sequence : 155425
ctagcctaggtgacagaacaagacttttgtctttaaaaagcaagcaagcaagcaagcaagcaagcaagcaagcaagcaagcaagcaagcaagcagagctgagactcaaaaacaggtctcccagctccagtcacagggtctatccttctgcctgacactgcctgagcacttagcaaatatactgttagtaagttaggcaaagaacaagtcagtttgaattggggctagacactttctaaaaaatgctctcctgggaaagtagatgataatgaagacatctgtgcctggatccatgttaaagcaattggcagcattaagtacattgaccatcctcagta

SEQ ID NO: 465 - DNA, 337 bp, Homo sapiens; identical to SEQ ID NO: 464
  AL136373.4_25374
  Located on chromosome 1
  Distance between a terminus base of telomere on chromosomal short arm and 5'-terminus of this base sequence : 48861607
  Distance between 3'-terminus of neighbour sequence of sequence listing upward to telomere on chrosomal short arm and 5'-terminus of this base sequence : -337

SEQ ID NO: 466 - DNA, 250 bp, Homo sapiens
  AL357392.5_41059
  Located on chromosome 1
  Distance between a terminus base of telomere on chromosomal short arm and 5'-terminus of this base sequence : 48892455
  Distance between 3'-terminus of neighbour sequence of sequence listing upward to telomere on chrosomal short arm and 5'-terminus of this base sequence : 30511
aacctcacagaattgtcatgactagctgaaataatgtaggtctgtgcttagctcagcacttgtcacagaataaacactacaaataatgttagcttttgttagatattgtattagtccattctcacactgctaataaagatatacctgagactgggcaatttatttatttatttattattattattattattattattattattgtactttaagttctagggtacatgtgtacaacatgcaggttacatag

SEQ ID NO: 467 - DNA, 115 bp, Homo sapiens
  DISD22_0000407
  Located on chromosome 1
  Distance between a terminus base of telomere on chromosomal short arm and 5'-terminus of this base sequence : 48963593
  Distance between 3'-terminus of neighbour sequence of sequence listing upward to telomere on chrosomal short arm and 5'-terminus of this base sequence : 70888
aatccctgtgttggatggtggggacacacagatgaggtccatttctgctgtgtgtgtgtgcgtgtgcgtgtgtgtgtgtgtgtgtgtgagagagagaggaacaaagtgtgatcaa

SEQ ID NO: 468 - DNA, 138 bp, Homo sapiens
  DISO7_10000589
  Located on chromosome 1
  Distance between a terminus base of telomere on chromosomal short arm and 5'-terminus of this base sequence : 49364619
  Distance between 3'-terminus of neighbour sequence of sequence listing upward to telomere on chrosomal short arm and 5'-terminus of this base sequence : 400911
atgaggctggaaggagtgaaaaggcatgttattctgtgtgtgaacatatatatatatatatatatatataattcattttgcattgttttgtccataaaatactttggttattaaaggtcaacatatctacacagcatt

SEQ ID NO: 469 - DNA, 101 bp, Homo sapiens
  DISO7_10000586
  Located on chromosome 1
  Distance between a terminus base of telomere on chromosomal short arm and 5'-terminus of this base sequence : 49426784
  Distance between 3'-terminus of neighbour sequence of sequence listing upward to telomere on chrosomal short arm and 5'-terminus of this base sequence : 62027
tatatgagagggtaagcaattgggggattttatttatttatttatttatttatttatttatttatttattttgtaggcaaagggaagccattcagaggttt

SEQ ID NO: 470 - DNA, 240 bp, Homo sapiens
  D1S2748
  Located on chromosome 1
  Distance between a terminus base of telomere on chromosomal short arm and 5'-terminus of this base sequence : 49631870
  Distance between 3'-terminus of neighbour sequence of sequence listing upward to telomere on chrosomal short arm and 5'-terminus of this base sequence : 204985
tgaaacctgatggcttcactgatgaattttaccaaatatttaaagcactaataccaatcctacacaaactattctgaaaaaatagacgaggagagaatacttctaaacttattctatgaggccagtagtaccctgataccaaaaccagaaacagacccatgaaaacacacacacacacacacacacacacacacacacacacacacacacaactaaatgctaatatcactgaacaaaaat

SEQ ID NO: 471 - DNA, 232 bp, Homo sapiens
  Z67234
  Located on chromosome 1
  Distance between a terminus base of telomere on chromosomal short arm and 5'-terminus of this base sequence : 49748016
  Distance between 3'-terminus of neighbour sequence of sequence listing upward to telomere on chrosomal short arm and 5'-terminus of this base sequence : 115906
caaaactttccagcaggcaagactaatttgcactgagatgactaaatggaatttgaatggtatttataaaaacccacacacagccaatgatgcgcacgcacacacacacacacacacacacacacacagagattaaaaaacccacacaagaggaagttaaactttaactccatcccatctactctcatctttgccaacaatttctttaaaatggatgtgctggactggatca

SEQ ID NO: 472 - DNA, 171 bp, Homo sapiens
  DISO7_10000592
  Located on chromosome 1
  Distance between a terminus base of telomere on chromosomal short arm and 5'-terminus of this base sequence : 49988865
  Distance between 3'-terminus of neighbour sequence of sequence listing upward to telomere on chrosomal short arm and 5'-terminus of this base sequence : 240617
tgcatttgctcatagatggatggatgatagatagatagatagatagatagccagagccaaacaactttttatgcataagttttatctgagttaatagaggttaaaaaaatagggattttctatttcttctccatttttcagctttccctatctataatgaggaactttcct

SEQ ID NO: 473 - DNA, 241 bp, Homo sapiens
  D1S2720
  Located on chromosome 1
  Distance between a terminus base of telomere on chromosomal short arm and 5'-terminus of this base sequence : 50592130
  Distance between 3'-terminus of neighbour sequence of sequence listing upward to telomere on chrosomal short arm and 5'-terminus of this base sequence : 603094
aatggtccaggcaaagtaaggttaggttggatggtataaagggagaaacctctgctgatactgggatgaaggtctctggctggttgcttcgtctacttaaatgtctctgagtttaattttgtttattttcacttgaggaagggtgactgtgactgaaggaacatgcacccacacaagtgagcatgtgtgtgtgtgtgtgtgtgtgtgtgtgtgtgcgctgtcagtaaagcactttgtagct

SEQ ID NO: 474 - DNA, 242 bp, Homo sapiens
  D1S2874
  Located on chromosome 1
  Distance between a terminus base of telomere on chromosomal short arm and 5'-terminus of this base sequence : 50592478
  Distance between 3'-terminus of neighbour sequence of sequence listing upward to telomere on chrosomal short arm and 5'-terminus of this base sequence : 107
gcaagaattatgtctgatggtggatagttggatgagatacttccacaactgctatttataggagaagcagcagacccttgtgtgtgtgtgtgtgtgtgtgtgtgtgtgtgtgtgtgtgtgtgtgtgaatttatctgagcatattgcttggtgtctgtgtgttggaggatccatatcaggaaaaggtagaaaaaagagggctggggaacaagagcgagatgtacccttataggggcttctagg

SEQ ID NO: 475 - DNA, 324 bp, Homo sapiens
  AL356458.2_94879
  Located on chromosome 1
  Distance between a terminus base of telomere on chromosomal short arm and 5'-terminus of this base sequence : 50617048
  Distance between 3'-terminus of neighbour sequence of sequence listing upward to telomere on chrosomal short arm and 5'-terminus of this base sequence : 24328
tcttccattgcatatgctaatccacccaccagcaatcacccactcaccgattcaattcacccaatatttataacaatgataaaccagataatgaacctaatttttcatccatccatccatccatccatccatccatccttcatgatttccttttcatcgcatttcttttttttttctttttccccaatatcagacaaggaatcattcatggcatttctttatctcagctacccaatttctctgagtggccttcccaatctccttaccttccaatttataaccatccgtttgacactgtaggtaccttcgacaaagcatctataa

SEQ ID NO: 476 - DNA, 319 bp, Homo sapiens
  AL356458.2_55752
  Located on chromosome 1
  Distance between a terminus base of telomere on chromosomal short arm and 5'-terminus of this base sequence : 50680378
  Distance between 3'-terminus of neighbour sequence of sequence listing upward to telomere on chrosomal short arm and 5'-terminus of this base sequence : 63006
ttcaataccagtttcaatccttacagcaatcctatgaagtcaatatcattactattctcattttacaaagacggaaatccccagggttctgggaagattaaataagttaatgcataagacttgcttagctcgctgggcgcagtggctcatgcctgtaatcccagcactttgagaggccaaggcaggcagatcacttgagcttgggagttcgagaccaccctgggcaacatggtgaaatcccatctctacaaagaacaacaacaacaacaacaacaacaacaacaaaaccagacttgcctagcagagtgcctaggatgta

SEQ ID NO: 477 - DNA, 353 bp, Homo sapiens
  chr1.fa.O7frz.53670079
  Located on chromosome 1
  Distance between a terminus base of telomere on chromosomal short arm and 5'-terminus of this base sequence : 50755615
  Distance between 3'-terminus of neighbour sequence of sequence listing upward to telomere on chrosomal short arm and 5'-terminus of this base sequence : 74918
ctgacaaatcaagtgattgaactatatgcctatttaatagtacagaagtatacactgaaaaggtaatattaatgacagaaatcgagaagtggagaaaagaaaaggaaaggagaagaaagaagtacaccactttatcatttttcataggagggaactaatagatgatatctaatgaagtagagaaccaaagaagttatataaagtcctaagtataaatataaccactaaaacaaaaatgcaatttttctaactgtcaaagtaacttcacacacacacacacacacacacacacacacacacaaataaagaaaagagagctcatagtaaagaacttggcaaagtaacatcaatac

SEQ ID NO: 478 - DNA, 475 bp, Homo sapiens
  chr1.fa.O7frz.53792510
  Located on chromosome 1
  Distance between a terminus base of telomere on chromosomal short arm and 5'-terminus of this base sequence : 50888455
  Distance between 3'-terminus of neighbour sequence of sequence listing upward to telomere on chrosomal short arm and 5'-terminus of this base sequence : 132487
aaagtctccactaggcacttagggaattgtagaaacggtaatacattgaatccaggaaaatgaagtgtgaagacccagagatgtgctcagaacataaggtggaggggccaaggcagagttgggccgcactaggctggacagcggtcaagggctctggggttggcccatctcatagatgaactctaggtggcgctgtggccacaaaagttttgggctgaggaattttggcaaagctgttaggaatctgtgggtgggagcgaggaagggagagaggtaaagaaagaatagtggactggagtgaaggagacacacacacacacacacacacacacacacacgtagatgggtgggggggtgggggtggtggtggcaggaataagtgaatggctcagacagtgcttggtccagaagagagaaaataaactgagggatcatcaaattcattcatttacttaatataagcattgatcaagcc

SEQ ID NO: 479 - DNA, 287 bp, Homo sapiens
  G07853
  Located on chromosome 1
  Distance between a terminus base of telomere on chromosomal short arm and 5'-terminus of this base sequence : 50965857
  Distance between 3'-terminus of neighbour sequence of sequence listing upward to telomere on chrosomal short arm and 5'-terminus of this base sequence : 76927
agctcacctcctccaagaaggccttcccttctgctccagcctttatttgtcttcctcttgtgtgagctcctgcaaccgggaagcacagctgcaggccagagcttctttcaacctggagtgtctggggctccaagtgactgagggttgtgtaagaatgtgtgtgcacacatgtgtgggcaagagagaggtagagatggtgacagagatagatagatagatagatagatagatagatagatagatagatagatagatagaaatagagtcaggagtgtggactgtgcttt

SEQ ID NO: 480 - DNA, 289 bp, Homo sapiens
  chr1.fa.O7frz.54081846
  Located on chromosome 1
  Distance between a terminus base of telomere on chromosomal short arm and 5'-terminus of this base sequence : 50972347
  Distance between 3'-terminus of neighbour sequence of sequence listing upward to telomere on chrosomal short arm and 5'-terminus of this base sequence : 6203
ggtacgtttcatgtacagacacaaatagatgcacacagacctctaggcacatgtgtgtacacgtacacacacacacacacacaaacacacatacactcctccagtggagattcagctcacccccgaggcctgaccgatccactacacattgctttgggctctcttcctccttcccacacatctgtgggctcactgtcgggaaagaactctccacctttctactctgggcatctataagtcccagaaattaggcccctgcctggtttttaggttctggagtgaagtgcag

SEQ ID NO: 481 - DNA, 383 bp, Homo sapiens
  AL109659.20_116511
  Located on chromosome 1
  Distance between a terminus base of telomere on chromosomal short arm and 5'-terminus of this base sequence : 51317006
  Distance between 3'-terminus of neighbour sequence of sequence listing upward to telomere on chrosomal short arm and 5'-terminus of this base sequence : 344370
taccatccttatacaggtaaacaggtcgtgtgtagtgactctggaaccagcgtatttccatgtgttctgcgctttgtggtggagacagctggcaactgagctcaacttttccacccagtggagccaagattggcctctataagctattcactatgaattgttctgtgaagggagacagcaacgaaaggatgagaagtggaccaagacaaaatttttatttgaattattatatcacaaacacccatagacacacacacacacacacacacacacacacacacacacacacactttattgagagtacattcttttgttttctcttttccttgaaaacacctttactttgcactttgcttgaatggaaattcatcaaattacttta

SEQ ID NO: 482 - DNA, 264 bp, Homo sapiens
  AL109659.20_41733
  Located on chromosome 1
  Distance between a terminus base of telomere on chromosomal short arm and 5'-terminus of this base sequence : 51391864
  Distance between 3'-terminus of neighbour sequence of sequence listing upward to telomere on chrosomal short arm and 5'-terminus of this base sequence : 74475
caacatcactgatataaggcagagaactgctgtgttttagtttactgagccaccaaaaaggagaagagagaaagccaccagggccatccaaggaagtaaaagtttcatttctcctcacctgaacatctccacttggaggacctgcagactcctgaagcacatcatcatatttgtgtgtgtacatgttctctctctctctctctctctctctttctctatctctttctctctatctctatcccttctttcaccagcactaatacc

SEQ ID NO: 483 - DNA, 159 bp, Homo sapiens
  chr1.fa.O7frz.54839022
  Located on chromosome 1
  Distance between a terminus base of telomere on chromosomal short arm and 5'-terminus of this base sequence : 51696616
  Distance between 3'-terminus of neighbour sequence of sequence listing upward to telomere on chrosomal short arm and 5'-terminus of this base sequence : 304488
caagacaatggttcttaagtctagaagcagagacaaatagcgaggtagtaaaacaaacaaacacacacacacacacacacacacacacacacacatacataatagcaattgatatatactatgaagaaaatgcacagagtctgtacctgcagataatgc

SEQ ID NO: 484 - DNA, 227 bp, Homo sapiens
  Z66924
  Located on chromosome 1
  Distance between a terminus base of telomere on chromosomal short arm and 5'-terminus of this base sequence : 51774562
  Distance between 3'-terminus of neighbour sequence of sequence listing upward to telomere on chrosomal short arm and 5'-terminus of this base sequence : 77787
cccttgaagatgataggcttgcaggtgggttctaaagagtacggaggattttgagagtgtcacttggcttggaatgtttttttctccactttactcagcgaatttgtattttcacaagtctgttcagatgttaattccaggtgtgtgtgtgtgtgtgtgtgtgtgtgtgtgtgcacgtgacagtgtcttgctctattgcccaggctggagggcaatggcgcgatcat

SEQ ID NO: 485 - DNA, 277 bp, Homo sapiens
  D1S2724
  Located on chromosome 1
  Distance between a terminus base of telomere on chromosomal short arm and 5'-terminus of this base sequence : 51919317
  Distance between 3'-terminus of neighbour sequence of sequence listing upward to telomere on chrosomal short arm and 5'-terminus of this base sequence : 144528
tcaagtcccaggaggatttaaaacacacacacacacacacacacacacacacacacacacacacacaagttaaattttaaacttgtatgctccttccaagtgctcgttcctctaagtcattcctttccacagtgggcagtacccacaactaagcaagtcactgttcttctctcagcacctattagtccactgtagttcctaacagttatctatatttaatgagaacctactatatgccagatatttttccatattatcctgctaaataacacagtgg

SEQ ID NO: 486 - DNA, 411 bp, Homo sapiens
  chr1.fa.O7frz.55136918
  Located on chromosome 1
  Distance between a terminus base of telomere on chromosomal short arm and 5'-terminus of this base sequence : 51996073
  Distance between 3'-terminus of neighbour sequence of sequence listing upward to telomere on chrosomal short arm and 5'-terminus of this base sequence : 76479
actgctacatgctaaatactcaagatttgtaagatagatagatagatagacagatagatagatcgatagataagaaaaagaaaagaaaggagaaagaaagaagaaagaaagaaagaaagaaagaaagaaagaaagaaagaaagaaagaaagaaagaaagaaattcatttatagtacgcaaaataaatattgggtatcaagacacaagtacctcctgcctgcttcacactgaccttaaccctctgtttcaggctttaggtcttagatatccctcttatattgcttcattgcctataattcatttaactaccatttatttatttcatgacttttggcacgccctttctcctcttgggctcagttacttcatatccaaagtgaaacaaaccagtttaggcatggtaagtaggtt

SEQ ID NO: 487 - DNA, 260 bp, Homo sapiens
  chr1.fa.O7frz.55263357
  Located on chromosome 1
  Distance between a terminus base of telomere on chromosomal short arm and 5'-terminus of this base sequence : 52093482
  Distance between 3'-terminus of neighbour sequence of sequence listing upward to telomere on chrosomal short arm and 5'-terminus of this base sequence : 96998
ttacagttaatggtccagtcaggaaaacagctgatacaagtaggcagcaccatgtaattataattggaatgaagaggggcacaatgggctaacggagtctgggtggttgtttgttgttgttgttgttgttgttgtggctggtggtggtggtgttgatggtgcctgtgttgatggtggcagtggtatgtatacacgtgtgcgtggtgtggtattaaccctgcctgaggtggaggatgggctaaatgtcatagaaggcttca

SEQ ID NO: 488 - DNA, 263 bp, Homo sapiens
  AC027663.14_31562
  Located on chromosome 1
  Distance between a terminus base of telomere on chromosomal short arm and 5'-terminus of this base sequence : 52257490
  Distance between 3'-terminus of neighbour sequence of sequence listing upward to telomere on chrosomal short arm and 5'-terminus of this base sequence : 163748
aatcttcaggaaagtctgttctacacataaagactttatatagtggattaattgtctgtgtgtatatatgcctgtgggcatgtatgaatatgtgtatgtgtgtgtgtgtgtgtgtgtgagagagagagagagagagagagagagagagagagagagagacaatatttacatgtatccaagagaagggttgaattccttgcctgggtcaataagaacatcatatgcaggatagggggatgatcaataaactgacctaatacagg

SEQ ID NO: 489 - DNA, 156 bp, Homo sapiens
  AC027663.14_68389
  Located on chromosome 1
  Distance between a terminus base of telomere on chromosomal short arm and 5'-terminus of this base sequence : 52294405
  Distance between 3'-terminus of neighbour sequence of sequence listing upward to telomere on chrosomal short arm and 5'-terminus of this base sequence : 36652
tgtgcaatcctattcagtttacctaatctacacacacacacacacacacacacacacacacactcaaacacaaatacacatctgctgctccctcagacctaagctgggttctagtgaccctgatatggatgagacatagtccttacttcaaggact

SEQ ID NO: 490 - DNA, 383 bp, Homo sapiens
  AC027663.14_130726
  Located on chromosome 1
  Distance between a terminus base of telomere on chromosomal short arm and 5'-terminus of this base sequence : 52356783
  Distance between 3'-terminus of neighbour sequence of sequence listing upward to telomere on chrosomal short arm and 5'-terminus of this base sequence : 62222
taaagaactttctgagcattagactttagatggagaggagaggagaggagaggagaggagaggagaggagaggagaggagaggagaggagaggagaggaggtaggaaccaggtgggcggaatgggaactgagggaacaaacctatttgatggattgttttttccgcttgattccccaatctggggagagcttatgatctcaagatgaatgcactattcttagaagaaaataaaattctagcataatttctgcaggtattgttatgtgattagggcaaatagcttttttaaaaaaagactatttagaaatggtctcaggaggctctgggcaggagcgaactataatgcagtctcaggatgatgatcctgtcattggaagtctat

SEQ ID NO: 491 - DNA, 123 bp, Homo sapiens
  DISO7_10000594
  Located on chromosome 1
  Distance between a terminus base of telomere on chromosomal short arm and 5'-terminus of this base sequence : 52416489
  Distance between 3'-terminus of neighbour sequence of sequence listing upward to telomere on chrosomal short arm and 5'-terminus of this base sequence : 59323
cctactctgctatgtgctgagattatataaattaataagactgggccctttgcccttaagtgaggaaaataaacctgtaacacacacacacacacacacacgcgaaggtagagtctgtagcca

SEQ ID NO: 492 - DNA, 257 bp, Homo sapiens
  DISO7_10000596
  Located on chromosome 1
  Distance between a terminus base of telomere on chromosomal short arm and 5'-terminus of this base sequence : 52421440
  Distance between 3'-terminus of neighbour sequence of sequence listing upward to telomere on chrosomal short arm and 5'-terminus of this base sequence : 4828
gctccatagttcaaagtcaactcaattaaaagatagcacacacacacacacacacacacacacacacacacacgtacatatacatatctaaaatacttttgacgttctctcttttctgattctgtttttagatttcttagttgactaaaaccctttttaaattatgtatttggtctgtctgttcactttctttcttacaaaatattctaccatttacttttattcctccctacccctccttcttctccatctttggt

SEQ ID NO: 493 - DNA, 123 bp, Homo sapiens
  DISO7_10000597
  Located on chromosome 1
  Distance between a terminus base of telomere on chromosomal short arm and 5'-terminus of this base sequence : 52438901
  Distance between 3'-terminus of neighbour sequence of sequence listing upward to telomere on chrosomal short arm and 5'-terminus of this base sequence : 17204
gcacaatatcctgcatcaactaaatttacagacatgtcaagaaatagtaacaaatgagacacacacacacacacagagagagagagagagaaagagagagagaggaaggaacctgaccatctg

SEQ ID NO: 494 - DNA, 172 bp, Homo sapiens
  DISO7_10000601
  Located on chromosome 1
  Distance between a terminus base of telomere on chromosomal short arm and 5'-terminus of this base sequence : 52521685
  Distance between 3'-terminus of neighbour sequence of sequence listing upward to telomere on chrosomal short arm and 5'-terminus of this base sequence : 82661
agactgcagaacttcgatttcaaagcatctggataccattttcttggaaattatcattgtgtgtcagtcagagccagtgacttttcaaactctgtgtgtgtgtgtgtgtgtgtgtgtgtgtgtgtgtgtgtgtgtgtgtgtgtttaaatagacacctctattgtaaccctga

SEQ ID NO: 495 - DNA, 143 bp, Homo sapiens
  DISO7_10000602
  Located on chromosome 1
  Distance between a terminus base of telomere on chromosomal short arm and 5'-terminus of this base sequence : 52615097
  Distance between 3'-terminus of neighbour sequence of sequence listing upward to telomere on chrosomal short arm and 5'-terminus of this base sequence : 93240
cctattctgtcatttcatgtagggaaacaataatctcccaaccctgactgtattccctaccctacccctacatacacacacacacacacacacacacacacacacacacacacacacacacacacgcagacatgtcagctggt

SEQ ID NO: 496 - DNA, 158 bp, Homo sapiens
  D1S1564
  Located on chromosome 1
  Distance between a terminus base of telomere on chromosomal short arm and 5'-terminus of this base sequence : 52773879
  Distance between 3'-terminus of neighbour sequence of sequence listing upward to telomere on chrosomal short arm and 5'-terminus of this base sequence : 158639
ttactcacacggttggggtcccatttttctcatctgtagaatgagaataaaacttttacttcatatagttttgatgagagagagtgtgtgtgtgtgtgtgtgtgtgtgtgtgtacacatgtgatgtgaggtgtgcatagaattaaaagcccttagcac

SEQ ID NO: 497 - DNA, 349 bp, Homo sapiens
  chr1.fa.O7frz.57101548
  Located on chromosome 1
  Distance between a terminus base of telomere on chromosomal short arm and 5'-terminus of this base sequence : 52944063
  Distance between 3'-terminus of neighbour sequence of sequence listing upward to telomere on chrosomal short arm and 5'-terminus of this base sequence : 170026
tccagcacttgaagtatttactgtgtgtgtgtgtgtgtgtgtgtgtgtgtgtgtgtgtgtgtgtgtgtgtgtggtgggaacatttaaattctaatcttttagcaattttgaaatatataacacattactaaatatagtcaccctgctgtacgaaagaccattaaaatttattcctcctgtcaaactgaaactgtatcctttgaccaacatctccgctttcctcattcctacccgtccacaccccaccaccagcctctggtaatcactgttctcctctctacttctatgagtttgacttttctagaatccatatataagtgagaacatgtttattcacttagcatgctgt

SEQ ID NO: 498 - DNA, 399 bp, Homo sapiens
  AC055804.3_50988
  Located on chromosome 1
  Distance between a terminus base of telomere on chromosomal short arm and 5'-terminus of this base sequence : 53089802
  Distance between 3'-terminus of neighbour sequence of sequence listing upward to telomere on chrosomal short arm and 5'-terminus of this base sequence : 145390
tggtttctaatgaattgaggtaaccagtcatagatgaattacattaatctgattcattcattcattcattcattcattcatttgtttattttttgaaacaaggtctcgctctgtggcccagactggagtgcagtggcgcaatcttgtctcactgtagactccgcctcccgggttcaagagattatcatacctcagcctccccagcagctggggttacaggtgcccaccatacacccggctaagttttgtatttctaggagagacggggtttcaccatgttggtcaggcttgttttgaactcctgacctcaagtgatctgcccaccttggcctcccaaaatggtgggattataggcataagccaccatacctgccctaatctgattcacttatgctttca

SEQ ID NO: 499 - DNA, 167 bp, Homo sapiens
  DISO7_10007791
  Located on chromosome 1
  Distance between a terminus base of telomere on chromosomal short arm and 5'-terminus of this base sequence : 53421034
  Distance between 3'-terminus of neighbour sequence of sequence listing upward to telomere on chrosomal short arm and 5'-terminus of this base sequence : 330833
agttgtggaagcattgagttacttggttttggggtttgtgtgtgtgtgtgtgtgtgtgtgtgtgtgtgtgtgtgtgtgtgtgtgtgtgtgtatgttttccccaattttgctaataacagttactaagagaaggaatagtatttatttccagagctctacctcctgga

SEQ ID NO: 500 - DNA, 119 bp, Homo sapiens
  D1S197
  Located on chromosome 1
  Distance between a terminus base of telomere on chromosomal short arm and 5'-terminus of this base sequence : 53608539
  Distance between 3'-terminus of neighbour sequence of sequence listing upward to telomere on chrosomal short arm and 5'-terminus of this base sequence : 187338
tcatgtccctcctcccaaagcatcccttctacacacacacacacacacacacacacacacacacacacacacacacacgttcttctcatgcctctgcagtcgtttttggatgcttgctc

SEQ ID NO: 501 - DNA, 169 bp, Homo sapiens
  chr1.fa.O7frz.56255820
  Located on chromosome 1
  Distance between a terminus base of telomere on chromosomal short arm and 5'-terminus of this base sequence : 53700883
  Distance between 3'-terminus of neighbour sequence of sequence listing upward to telomere on chrosomal short arm and 5'-terminus of this base sequence : 92225
atccatacaactgattcataagacctattaagactgtaggggtgagagtgtgtgtgtgtgtgtgtgtgtgtgtgtgtgtgtgtgtgtgtgtgcgtgcacacaaaagcatgtgtgcaaaaggaattgaacacattaaaccagacctttgacattaagacctaaacctcca

SEQ ID NO: 502 - DNA, 88 bp, Homo sapiens
  D1S1661
  Located on chromosome 1
  Distance between a terminus base of telomere on chromosomal short arm and 5'-terminus of this base sequence : 53796585
  Distance between 3'-terminus of neighbour sequence of sequence listing upward to telomere on chrosomal short arm and 5'-terminus of this base sequence : 95533
gcgagattcagtctcaaaaatatagatagatagatagatagatagatagatagatagatagatatgcatcatattttataaccatgaa

SEQ ID NO: 503 - DNA, 295 bp, Homo sapiens
  chr1.fa.O7frz.57439183
  Located on chromosome 1
  Distance between a terminus base of telomere on chromosomal short arm and 5'-terminus of this base sequence : 53864793
  Distance between 3'-terminus of neighbour sequence of sequence listing upward to telomere on chrosomal short arm and 5'-terminus of this base sequence : 68120
aacatagtgaaacctcatctgtacaaaaatacaaaaattaccccggcgtgatggcgggtgcctgtaatcccagctactcgggaggctgaggggggacaattgcttgaacccaggaggtggaggttgcagtgagccgagatcgcaccactgcactccagcctgggtaacagagtgagactccatctcagaaaaataaaataaataaataaataaataaataaataaataaataaataagtctttatatataaataaccagtataagcattgtctctgatagactctaattgatcca

SEQ ID NO: 504 - DNA, 475 bp, Homo sapiens
  chr1.fa.O7frz.57532407
  Located on chromosome 1
  Distance between a terminus base of telomere on chromosomal short arm and 5'-terminus of this base sequence : 53934613
  Distance between 3'-terminus of neighbour sequence of sequence listing upward to telomere on chrosomal short arm and 5'-terminus of this base sequence : 69525
agattaattgcattattgtcagagaacatggtatatataataatgattttataaaacttgttgagtcttggccaggtacagtggctctcacttgaaatctcagcactttgagaggccgaggtgggaggatcccttgaggccaggagctcaagacgaacctgggcaacatagagagattccatctctacaaaaaatttaaaaattagacagggatggtggcacacatgtgtagtcctagatacttaggaggctgaggtgggaggatcagctgggcccaggactttgagactacaatgagctatgatcatgccactgcactccagcctgggcaacagagtgagatcttgtctcgaaaaacacacacacacacacacacacacacacacacacacacaaaaaccacgaaacaaataaaaacttgttgagtcttgctttatggcctgatattattatatgcatgttaaatttcagatgt

SEQ ID NO: 505 - DNA, 186 bp, Homo sapiens
  D1S232
  Located on chromosome 1
  Distance between a terminus base of telomere on chromosomal short arm and 5'-terminus of this base sequence : 54084234
  Distance between 3'-terminus of neighbour sequence of sequence listing upward to telomere on chrosomal short arm and 5'-terminus of this base sequence : 149146
ccatgttcaagggtcaactgtatttcattgtggttttaatttgcattttcccagtgagtagtagagttaaccttttcaagtgctttttggcctttcgggtattgtcttttgtgaagtcttttgtccagtttgtgtgtgtgtgtgtgtgtgtgtgtgtgtgtttgggggggacagagagtcttgctc

SEQ ID NO: 506 - DNA, 286 bp, Homo sapiens
  AC048367.3_51840
  Located on chromosome 1
  Distance between a terminus base of telomere on chromosomal short arm and 5'-terminus of this base sequence : 54154048
  Distance between 3'-terminus of neighbour sequence of sequence listing upward to telomere on chrosomal short arm and 5'-terminus of this base sequence : 69628
ccaggaagcaagaatctttaactgctgtatccccagcaactagtatccagtacaaagtaggcttttaataaatatctgttaggtaaatgaatgaatgaatgaatgaatgaatgaatgaatgaatgaagagtctaaggctaggaaagcaaacccctgacttttctgggtctcagctttcccatataaaaatgagagatgaaactaagagatcccagaagccctgcctatttgatgttttgataatgcctcttctcaaggggcctcctttgagtgaaagaatgttcca

SEQ ID NO: 507 - DNA, 208 bp, Homo sapiens
  chr1.fa.O7frz.58022231
  Located on chromosome 1
  Distance between a terminus base of telomere on chromosomal short arm and 5'-terminus of this base sequence : 54271760
  Distance between 3'-terminus of neighbour sequence of sequence listing upward to telomere on chrosomal short arm and 5'-terminus of this base sequence : 117426
cgtttaaacagaactgtggtacttaaccaaatattaggtagcatttatcaaaatatacattagaaacagaaaggtgtgtgtggggaggaagttgtatacatatatacatgtactgtgtgtgtgtgtgtgtgtgtgtgtgtgtgtgtgtgtatgtgagtaggctgtaattttgctttacatacctctgtaggtcaactatttcattgtt

SEQ ID NO: 508 - DNA, 225 bp, Homo sapiens
  AL138904.4_14519
  Located on chromosome 1
  Distance between a terminus base of telomere on chromosomal short arm and 5'-terminus of this base sequence : 54358853
  Distance between 3'-terminus of neighbour sequence of sequence listing upward to telomere on chrosomal short arm and 5'-terminus of this base sequence : 86885
aaagcactttgcatagtatctgagacatggggagtaagtgctcagcaaatggggactatccaatgatgatggtgatgatgatgatgatgatgatgatgatgatgatgatgatggtgattaagaattgggttatcttttttaaaaaatttttttagatacagggactcaccctgttgcccaggatggagtgcagtggtgcagtcatagctcactgtagactcaaac

SEQ ID NO: 509 - DNA, 284 bp, Homo sapiens
  AL050343.17_94788
  Located on chromosome 1
  Distance between a terminus base of telomere on chromosomal short arm and 5'-terminus of this base sequence : 54660297
  Distance between 3'-terminus of neighbour sequence of sequence listing upward to telomere on chrosomal short arm and 5'-terminus of this base sequence : 301219
tcataacctgtagcttctgaacatttttacctaaagcttttgaatgtaaattataaaataaatgcatatttattttaaaaaattaaacaacatgaatgtgtaaaataaaaactcagagtcactgtctcacatgccctcattcctcagtcccattccctaggggtaactgcaggtgttttgtttcttttgtttcatgtgttatatttcaggggtgtgtgtgtgtgtgtgtgtgtgtgtgtgtgtgtgtgtacattttttaaaatgaaacttctagtgcgtaagta

SEQ ID NO: 510 - DNA, 164 bp, Homo sapiens
  D1S231
  Located on chromosome 1
  Distance between a terminus base of telomere on chromosomal short arm and 5'-terminus of this base sequence : 54660489
  Distance between 3'-terminus of neighbour sequence of sequence listing upward to telomere on chrosomal short arm and 5'-terminus of this base sequence : -92
catgtgttatatttcaggggtgtgtgtgtgtgtgtgtgtgtgtgtgtgtgtgtgtgtacattttttaaaatgaaacttctagtgcgtaagtaaaattacataaaactgcaacttgagtattattcatgtgtgtacttatctagcataaggtaagcactcagtta

SEQ ID NO: 511 - DNA, 226 bp, Homo sapiens
  DISO7_10007797
  Located on chromosome 1
  Distance between a terminus base of telomere on chromosomal short arm and 5'-terminus of this base sequence : 54800285
  Distance between 3'-terminus of neighbour sequence of sequence listing upward to telomere on chrosomal short arm and 5'-terminus of this base sequence : 139632
cgaagttattggacaatatgaactctatttaaaatacatcaaagtccaggcctggcacagtggctcacgcctgtaatcccagtactttgggaggccaagacaggaggattccctaagcccaggagtttgaaattagcctgggcaacatcgcaagacccagactcttattaaaacacacacgcacacacacacacgcaagatacatcatagtcatgatactccatga

SEQ ID NO: 512 - DNA, 112 bp, Homo sapiens
  DISO7_10000609
  Located on chromosome 1
  Distance between a terminus base of telomere on chromosomal short arm and 5'-terminus of this base sequence : 55084301
  Distance between 3'-terminus of neighbour sequence of sequence listing upward to telomere on chrosomal short arm and 5'-terminus of this base sequence : 283790
aagatgattcgtgttgaatgagagagaacagagagacagcagggagagagagtgtgtgtgtgtgtgtctgtgtgtgtgtgtgtgtaaaagtgtatagcattagtgcttctgg

SEQ ID NO: 513 - DNA, 253 bp, Homo sapiens
  D1S546
  Located on chromosome 1
  Distance between a terminus base of telomere on chromosomal short arm and 5'-terminus of this base sequence : 55377780
  Distance between 3'-terminus of neighbour sequence of sequence listing upward to telomere on chrosomal short arm and 5'-terminus of this base sequence : 293367
accgagccaacaatgaatatatatctttatacatctgtctgcgcccagctgacaatgagtatatatctttgtccgtccgtccatccgtccatccatccatccatccatccatcctttgcagacatgcactagaccaaggctaacaaggcattgaggcagaaaaggaaatgaagctatttggctatagatgattgctgctttcctttctaagtaagcacttgcttttggcttttatctgccagtaatcagctgg

SEQ ID NO: 514 - DNA, 285 bp, Homo sapiens
  HUMUT665
  Located on chromosome 1
  Distance between a terminus base of telomere on chromosomal short arm and 5'-terminus of this base sequence : 55472220
  Distance between 3'-terminus of neighbour sequence of sequence listing upward to telomere on chrosomal short arm and 5'-terminus of this base sequence : 94187
gtaacagagagagactctgactcaaaaaaaattttttttaattcattgagtctgagctattatgcttatttcttttcttttcttttatttgctgtactttacttttcttttcttttcttttcttttcttttcttttctctctttctttctttccttccttccttccttcctggcttccttctttcctttctttctttctgtctttctttctttctctctctctctctctctctttctttcttttctttctttcagatggagtctcgctctgtcttccaggctgga

SEQ ID NO: 515 - DNA, 215 bp, Homo sapiens
  DISD22_0000452
  Located on chromosome 1
  Distance between a terminus base of telomere on chromosomal short arm and 5'-terminus of this base sequence : 55819931
  Distance between 3'-terminus of neighbour sequence of sequence listing upward to telomere on chrosomal short arm and 5'-terminus of this base sequence : 347426
gagactctaaggagttgaaacagagaggaccgttagagaggtgctgttgccagattttcaggggcaaagtctttgaaatatatattttaatgtatgaaagctttaaaaaatatatacatatatagaaataatgaatatgtgtgtgtgtgtgtgtgtgtgtgtgtgtgtgtacatgtatatatatatacagtattccccaaacctacacagccggt

SEQ ID NO: 516 - DNA, 227 bp, Homo sapiens
  AL365266.7_57649
  Located on chromosome 1
  Distance between a terminus base of telomere on chromosomal short arm and 5'-terminus of this base sequence : 55922696
  Distance between 3'-terminus of neighbour sequence of sequence listing upward to telomere on chrosomal short arm and 5'-terminus of this base sequence : 102550
agtagtcttaggtggaaggatcacttgggcctgagaggtcaatgctccagtgagctgtgatcatgccactgcactccagcctgggcaaaagagccagaccctgtctcaaaaataaataaataaataaataaataaataaataaagtaaccttttattaaagttaaaaacggtatgtacgtatgtttgtgagtgaaaacagccaaattctagccaagtcagtagcttg

SEQ ID NO: 517 - DNA, 227 bp, Homo sapiens; identical to SEQ ID NO: 516
  AL139255.4_91127
  Located on chromosome 1
  Distance between a terminus base of telomere on chromosomal short arm and 5'-terminus of this base sequence : 55922696
  Distance between 3'-terminus of neighbour sequence of sequence listing upward to telomere on chrosomal short arm and 5'-terminus of this base sequence : -227

SEQ ID NO: 518 - DNA, 289 bp, Homo sapiens
  DISO7_10000611
  Located on chromosome 1
  Distance between a terminus base of telomere on chromosomal short arm and 5'-terminus of this base sequence : 56394843
  Distance between 3'-terminus of neighbour sequence of sequence listing upward to telomere on chrosomal short arm and 5'-terminus of this base sequence : 471920
ggagaatccacttgggaacaatttgatgaagtttgcaaatcagcactttacccccaaattaacaacagcttgtatggaaaaaaaaatgctcttttaaaagtatatggtttggacaggtatatttgttttctcttgtagtttttgtaaaaaagtatcaaaaccttggctttaaatatatatatatatatatatatacacacacacacacgtggctttttaaaaattacttttttatagcacaaagtgtttgtaaatgcagagggtttctgctaattcttgactgtgcaca

SEQ ID NO: 519 - DNA, 120 bp, Homo sapiens
  DISO7_10000612
  Located on chromosome 1
  Distance between a terminus base of telomere on chromosomal short arm and 5'-terminus of this base sequence : 56504914
  Distance between 3'-terminus of neighbour sequence of sequence listing upward to telomere on chrosomal short arm and 5'-terminus of this base sequence : 109782
ccacttgacatatgttaactcattcactctttaaacgagagagagagagagagagagggaatctaggctcagagtgccagaccaggtctgcagggcccaaagattgctctcccttctcct

SEQ ID NO: 520 - DNA, 297 bp, Homo sapiens
  chr1.fa.O7frz.60369494
  Located on chromosome 1
  Distance between a terminus base of telomere on chromosomal short arm and 5'-terminus of this base sequence : 56569291
  Distance between 3'-terminus of neighbour sequence of sequence listing upward to telomere on chrosomal short arm and 5'-terminus of this base sequence : 64257
tgtactgtaaagctttcctcattttgtaccaatgaggagtttgcagtgtgtctcaattgtggaaaacctatggcaaaattgtctagaaataaactgcaaaatagtcaatatttaatttaatatttaagtcatttgctcaccaggtcagtgcctcagttctaacttgaagggactgatcataaatgcagcacttttgcttgtgtgtgtgtgtgtgtgtgtgtgtgtggtattgcagcttcaacgagaggctttatcacaattttttcctctaatcttagttcctacagctaaggaagt

SEQ ID NO: 521 - DNA, 164 bp, Homo sapiens
  DISO7_00008361
  Located on chromosome 1
  Distance between a terminus base of telomere on chromosomal short arm and 5'-terminus of this base sequence : 56824151
  Distance between 3'-terminus of neighbour sequence of sequence listing upward to telomere on chrosomal short arm and 5'-terminus of this base sequence : 254563
cctgaagctgggtactcagtaaatgagggaggaaggaaggaaggaaggaagattcccttgcagcccattctggaggccacgcactgccaagtcagaccgtggccccttgttatctttcagctccacacggcacaattctcccctccggctcagcctactccact

SEQ ID NO: 522 - DNA, 175 bp, Homo sapiens
  AL049745.9_63715
  Located on chromosome 1
  Distance between a terminus base of telomere on chromosomal short arm and 5'-terminus of this base sequence : 56916136
  Distance between 3'-terminus of neighbour sequence of sequence listing upward to telomere on chrosomal short arm and 5'-terminus of this base sequence : 91821
aagcattaatgtatccgattaaggggattctacctcagataccaaaaggaatgtaatatagtatatgatgtgtgtgtgtatatacacacacacacacacacacacacacacacacacactgtcacatttttaaaattaataaacatctgaattctgaaatacatggtaaggtttg

SEQ ID NO: 523 - DNA, 201 bp, Homo sapiens
  AL049745.9_57761
  Located on chromosome 1
  Distance between a terminus base of telomere on chromosomal short arm and 5'-terminus of this base sequence : 56922050
  Distance between 3'-terminus of neighbour sequence of sequence listing upward to telomere on chrosomal short arm and 5'-terminus of this base sequence : 5739
gtgatctttatgaaatcaattcagtgagttttaaccagcattttaaaaaatgaaatagaatgaaaaatattaaaatgcactacacatagtaaaaggtgagtactgttccaagaatcctttatttctgttatctacacacacacacacacacacacacacgcacacactatattttgagtctaatgtaaatgcactgcagat

SEQ ID NO: 524 - DNA, 188 bp, Homo sapiens
  D1S2661
  Located on chromosome 1
  Distance between a terminus base of telomere on chromosomal short arm and 5'-terminus of this base sequence : 57003917
  Distance between 3'-terminus of neighbour sequence of sequence listing upward to telomere on chrosomal short arm and 5'-terminus of this base sequence : 81666
aatccaagtctgactccatgatggacaagaagggaaagtgggcatggaaggtagaggggaagaaaagaaggaaggatacatggatacattctctctctctctctctctctctctctctcacacacacacacacacacacacacacacaggcaaatacatatctttctatgtacacacagtgaactagc

SEQ ID NO: 525 - DNA, 420 bp, Homo sapiens
  AL031427.15_18235
  Located on chromosome 1
  Distance between a terminus base of telomere on chromosomal short arm and 5'-terminus of this base sequence : 57006713
  Distance between 3'-terminus of neighbour sequence of sequence listing upward to telomere on chrosomal short arm and 5'-terminus of this base sequence : 2608
tgaagtaaagattacttcgcttatctaagtgccaaatgttagcatcacagagaaagaagttaaatcagacagagcttgtgcagcatacagaaagagcagggcaaacagaacacatgagggcagagtcgattaaacctaccagttcaccacggttgtgttgagtgtcagtgtgtgtgtgtgtgtgtgtgtgtgcttaaggctttttctttttttttttaatgaaaaagtaatacaatgcactatatacacctactgtctacccacaaaaattaaaattaaaaattaaaaaaagtaatatatgtatatggtccagtgtttcaaaaggtacaaagggaatatggagaacagcaagatccactccctctctgtgccccggctctctatctttcctccctaaagctcaccaaagtaagcagtttc

SEQ ID NO: 526 - DNA, 394 bp, Homo sapiens
  AL357673.5_73147
  Located on chromosome 1
  Distance between a terminus base of telomere on chromosomal short arm and 5'-terminus of this base sequence : 57265337
  Distance between 3'-terminus of neighbour sequence of sequence listing upward to telomere on chrosomal short arm and 5'-terminus of this base sequence : 258204
attagccagatgtacacctgtaatcccagctactcgggaggctgaaacaggagaatcgcttgaacccgggaggcagaggttgtagtagtgagtcgggattgtgccactgtactccagcctggcaataaagtgagactccgtcaaaacaagaaagaaagagaaggaaggaaggaaggagaaaaagaaagaaaagaaagaaagaagaaagaaagaaagaaagaaaagaaagaaagaaaggaaggaaggaaggaaaagaaaagaaaagaaaagaaaagaaaagaaaagaaaagaaaaaagaaaagaaaagaaaaaaaaagaaaactgagccacagaaggaaatgggctcatgaagatgaaggtacctggctggtgaaggtaactgcttgaaggtacc

SEQ ID NO: 527 - DNA, 381 bp, Homo sapiens
  AL354778.2_26287
  Located on chromosome 1
  Distance between a terminus base of telomere on chromosomal short arm and 5'-terminus of this base sequence : 57422073
  Distance between 3'-terminus of neighbour sequence of sequence listing upward to telomere on chrosomal short arm and 5'-terminus of this base sequence : 156342
acgcctgtagttccacttactcgggaggttgaggtcagaggatcgcttgagcccaaaaggttcagccctatctcaaataataataataataataataataataataaaaaaatggggggacaatgtccaccattcagggaggttgcaaggacagcctgagacaaagtgccaaaggtacttcctgcggtgcagagcaggggtgcatggccaatgtgctgctcctggcattatatggccctgggccgtgtctgcccagctactctgagaagctcttggcaggccagtgatttataaatttctgtgccctctgcaagtggctggcatgtcatatagagcaaaagatcaataaatatccatgactcaacgaataaatgaacagac

SEQ ID NO: 528 - DNA, 300 bp, Homo sapiens
  DISO7_00008376
  Located on chromosome 1
  Distance between a terminus base of telomere on chromosomal short arm and 5'-terminus of this base sequence : 57438975
  Distance between 3'-terminus of neighbour sequence of sequence listing upward to telomere on chrosomal short arm and 5'-terminus of this base sequence : 16521
ccaaggaaataacttggcagtggtgagaaattctgcagaggctccaaagtaacaaaaacaaaacacacacacacacacacacacacacacacgagctctgttcaaggtgccacgctgagctgaggataggcatggagatacaaacactcacaaggaacagccacccagggtgtgctgggggttcagtcccactgagggttcgtgcttggttgttattaatatttaatagggaagacaatattttagaagagacaggactctgtgcaggttgcaggccaggctagcatagatgccctgtcc

SEQ ID NO: 529 - DNA, 153 bp, Homo sapiens
  DISO7_10000615
  Located on chromosome 1
  Distance between a terminus base of telomere on chromosomal short arm and 5'-terminus of this base sequence : 57467575
  Distance between 3'-terminus of neighbour sequence of sequence listing upward to telomere on chrosomal short arm and 5'-terminus of this base sequence : 28300
tcctaatgctcaacaggaaagagagggaaaaggaaggaaggaaggaaggaaggaaggaaggaaggaaggaaggaaggaaggaaaacaacaacaagaacaacaacaaaaaaccccccaaaaaaacaggtaagggccaaggcagagttctccatc

SEQ ID NO: 530 - DNA, 171 bp, Homo sapiens
  AL035415.22_7387
  Located on chromosome 1
  Distance between a terminus base of telomere on chromosomal short arm and 5'-terminus of this base sequence : 57600892
  Distance between 3'-terminus of neighbour sequence of sequence listing upward to telomere on chrosomal short arm and 5'-terminus of this base sequence : 133164
gagtacacaggtaccaagcacctcctctgggccaggtcaggtgatgggtgctggagatgacatggggatgggtggggcaccactctgatctcaggagctcacagcccaggaaatagacacacacacacacacacacacacacacacacactcaaaccagtaattcaaactg

SEQ ID NO: 531 - DNA, 440 bp, Homo sapiens
  chr1.fa.O7frz.61911631
  Located on chromosome 1
  Distance between a terminus base of telomere on chromosomal short arm and 5'-terminus of this base sequence : 57640143
  Distance between 3'-terminus of neighbour sequence of sequence listing upward to telomere on chrosomal short arm and 5'-terminus of this base sequence : 39080
gaatcagtatgtcaagttccttagaaatccctgttggaatatcagattggagttgcattaaatttatttatttatttatttatttatttatttatttatttatttattcatttatttatttattttttagacggagttttgctcttgttgtatttttggtagagacagggtttcttcatgttggtcaggctggtctcgaactcctgacctcaggtgatcggcccacctcggcctcctaaagtgctgggattacgggcatgagccaccgcccccggctatctattcatttaaggagaatttatacctttatcattgttaagtctttctcaccatttatttaagtctttttaatgcccttcagttaaatattaacttttttccatgctggttttgcagtttttactccttagacattttataatgttccttagatgcttgtt

SEQ ID NO: 532 - DNA, 455 bp, Homo sapiens
  chr1.fa.O7frz.62021975
  Located on chromosome 1
  Distance between a terminus base of telomere on chromosomal short arm and 5'-terminus of this base sequence : 57815289
  Distance between 3'-terminus of neighbour sequence of sequence listing upward to telomere on chrosomal short arm and 5'-terminus of this base sequence : 174706
gaccttcacttccttatgtataaatattaaacttactctctctctctctctctctctctgtgtgtgtgtgtttgtgtgtgtgtgtgtgtagtgcggagcttgttaacagacgtgcatgcctggcctgtggactgtgcagtaagtgttgaaaaaggcactcttccctgacttgatttctttctgcatctcctcccaggggcccgctcctgcttaaaaacaccatgcatgcaggtgagctgtccctatgattcccacagggagggtagccccagattgagggtaggggtgctgggaggactggggagttcatccagcagttagattgctgtgttaaggcaggtgtttgacagctgccctatggtctcctccacagagcccacttcacccggaacaagcaaactgttaaggctataggcagctttgccagggttgctgtgagaatctagtgccatggg

SEQ ID NO: 533 - DNA, 367 bp, Homo sapiens
  chr1.fa.O7frz.62114404
  Located on chromosome 1
  Distance between a terminus base of telomere on chromosomal short arm and 5'-terminus of this base sequence : 57907621
  Distance between 3'-terminus of neighbour sequence of sequence listing upward to telomere on chrosomal short arm and 5'-terminus of this base sequence : 91877
caagacttggtaacgagtgtaggacttcctggagaaggggccgatgttgtggcctaggccacagctctattcattgagatgcatgtcacccatgatgtccaatgttatctgcccaaaccactgggcattcaacatggccatggccacacacacacacacacacacacacacacacacacacacacacacaagatgaccggcaaaagcatgacaggagagaaaaggttagggcacgaccctcctgctatggtctcccaccatgacaggcacctcgggtgagttttgtaacctctctgagccccagaatcttttgccaaatgatgttaataatagtagctgcactcagtattacagtgaaatgctcctg

SEQ ID NO: 534 - DNA, 203 bp, Homo sapiens
  D1S417
  Located on chromosome 1
  Distance between a terminus base of telomere on chromosomal short arm and 5'-terminus of this base sequence : 58011428
  Distance between 3'-terminus of neighbour sequence of sequence listing upward to telomere on chrosomal short arm and 5'-terminus of this base sequence : 103440
atcctcgttaagggatgtgtgcctgtgtgtgtgtgtgtgtgtgtgtgtgtgtgtgtgtgtgtgtatctcctattgattgtttctctggagaacactgattaatacaacagaacaagccctgattcgtagtgctgctaatttctgtggtgtaaatgctccccctgtgggtgatttcaggctgccaatgtcactgaacatggaag

SEQ ID NO: 535 - DNA, 449 bp, Homo sapiens
  AL354867.2_36639
  Located on chromosome 1
  Distance between a terminus base of telomere on chromosomal short arm and 5'-terminus of this base sequence : 58060697
  Distance between 3'-terminus of neighbour sequence of sequence listing upward to telomere on chrosomal short arm and 5'-terminus of this base sequence : 49066
tcagacttgaacttggaatgagcgaagccactgttccctggttctccatcttgtggacagcataccatgggacttctcagcctccataattgcatgagccaattcccataataaatctccttttatctatctatctatctatctatctatctatctatctatctatctgtctgtctatctatctatctctgtctgtcgtctgtctatgtatccatccattcatccatctatcctattggttctgtttctctattgaaccctaactaatacaagcacagttctaaatgctttacatttaaatataatacaataatgtgattaaatacaacagtaaaaagtagaatgtgctaaatattatacttcccaagctgtccaatactgagtaagtacttaaaaggagggaaaatcttctgactcaataataacaggtattgagtttcatgcacgtc

SEQ ID NO: 536 - DNA, 383 bp, Homo sapiens
  AL354867.2_51602
  Located on chromosome 1
  Distance between a terminus base of telomere on chromosomal short arm and 5'-terminus of this base sequence : 58075592
  Distance between 3'-terminus of neighbour sequence of sequence listing upward to telomere on chrosomal short arm and 5'-terminus of this base sequence : 14446
gctaacatggtgaaaccaatctctaccaaaaatacaaaaaattagccgggcatggtggtgggagtctgtagtcccagctactcaggaggctgaggcaggagaatggtgtgaacccgggaggcggaggttgcagtgagccaagattgtgccactgcactccagcctgggtgacagagcgagactccatctcaaaataaataaataaataaataaaataaaataaaataaaataaaataaaataaaataaacagattccccctctttcggcggttagcaagtctaaagctgtctgattttgaaggactactgctgctagggagttaagttgatcttgcaatgtgaccagggagtcagcgacccgttccatgtcaccatttagttc

SEQ ID NO: 537 - DNA, 98 bp, Homo sapiens
  D1S2652
  Located on chromosome 1
  Distance between a terminus base of telomere on chromosomal short arm and 5'-terminus of this base sequence : 58164335
  Distance between 3'-terminus of neighbour sequence of sequence listing upward to telomere on chrosomal short arm and 5'-terminus of this base sequence : 88360
tacggctgattgggagaacacagtgggatcgtgtgtgtgtgtgtgtgtgtgtgtgtgtgtgtgtgtgtgtgttgggggagacctggcatcacacctgc

SEQ ID NO: 538 - DNA, 298 bp, Homo sapiens
  AL158848.3_109692
  Located on chromosome 1
  Distance between a terminus base of telomere on chromosomal short arm and 5'-terminus of this base sequence : 58179721
  Distance between 3'-terminus of neighbour sequence of sequence listing upward to telomere on chrosomal short arm and 5'-terminus of this base sequence : 15288
catgtaggacttgctcatttattctagttttgttgttgttgttgttgtttgtttgttgttttgagacaaggtcttgccgtattgcttaggctggtctcaaactcctggatcaagtgatcctctggcctcagcctcctgagtagctgggattacaggagcacaccacagtgcctggctttatcctgataatttaccctaaggaagaaatcagacaactgtgctagactatacttacagaaggcagtttatcatagcgttgatgatggtagatgaaatgtggaaagaatctcaatgttca

SEQ ID NO: 539 - DNA, 242 bp, Homo sapiens
  AL158848.3_58442
  Located on chromosome 1
  Distance between a terminus base of telomere on chromosomal short arm and 5'-terminus of this base sequence : 58202888
  Distance between 3'-terminus of neighbour sequence of sequence listing upward to telomere on chrosomal short arm and 5'-terminus of this base sequence : 22869
aacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgcta

SEQ ID NO: 540 - DNA, 414 bp, Homo sapiens
  AL158848.3_51652
  Located on chromosome 1
  Distance between a terminus base of telomere on chromosomal short arm and 5'-terminus of this base sequence : 58238644
  Distance between 3'-terminus of neighbour sequence of sequence listing upward to telomere on chrosomal short arm and 5'-terminus of this base sequence : 35514
ctctgcttgtataggatcttcaataacctgggaaaggaagaaacaaaaattagtaaataaaagaaggaacttgtcatagccacgggtgctttctttataattctacccaagagattaatttagtgtttgacaacaacaacaacaacaacaacaacaacaacaacaacaaaaccaatacaggacgggcatggtggctcatgcctgttatctcagcactttgcaaggccaaggcaggaggatcacttgaggccaggagttctgaactagcctgggcaacaaagcaagatcccatctctaaaaaataaaaaaagaaattagttgggcacagtgacatgtgcctgtagtcccagctatacaggaggctgaggcaaaaggatcatttgtgcctaggagtttgaggctacagtgagctac

SEQ ID NO: 541 - DNA, 356 bp, Homo sapiens
  chr1.fa.O7frz.62844652
  Located on chromosome 1
  Distance between a terminus base of telomere on chromosomal short arm and 5'-terminus of this base sequence : 58429056
  Distance between 3'-terminus of neighbour sequence of sequence listing upward to telomere on chrosomal short arm and 5'-terminus of this base sequence : 189998
gtatgctctgtcaaatgcttcagtgttgtgtgtgtgtgtgtgtgtgtgtgtgtgtgtgtgtgtgtgagagagagagagagagagagagagataggggcatgggaggatagaggtatcagaggtctctgtgtaaaaaccagatctacttactgttctggaattgttttacgatccgaaggctgttacaggtcactaatggcttggtgtcttagcttttcaccttgctttgctgtggaagaagagaccctgagcaccaggaacagcatgaaatgcaggaaaggggacagtaaaagcagttttacttacttcaggattttacttaatgcctatttgtagaaacctactcattgaaatga

SEQ ID NO: 542 - DNA, 350 bp, Homo sapiens
  AL049710.18_106919
  Located on chromosome 1
  Distance between a terminus base of telomere on chromosomal short arm and 5'-terminus of this base sequence : 58516228
  Distance between 3'-terminus of neighbour sequence of sequence listing upward to telomere on chrosomal short arm and 5'-terminus of this base sequence : 86816
gtagctcactttggcctttgcaatgagaaggagaggctttgaaggctggttgggtgtgtgggagagcagagacaggggctttgggcagccaggtcctgagcggagcacctttttaccccggggagatgccaggagagaagctagggtcaaagcccgagttcagtgcctcttccctgtgaagaaaggagtgatccctctgtgtgtgtgtgtgtgtgtgtgtgtgtgtgtgtgtgtgtgagagagagagagagtgagaaggaatgtgagcaggaggattgggagggcttgtgtaagagtttgtacgtgttagaaatgtgtagagcgatgataaactcagagcgtttctaaga

SEQ ID NO: 543 - DNA, 429 bp, Homo sapiens
  AL049710.18_41019
  Located on chromosome 1
  Distance between a terminus base of telomere on chromosomal short arm and 5'-terminus of this base sequence : 58582168
  Distance between 3'-terminus of neighbour sequence of sequence listing upward to telomere on chrosomal short arm and 5'-terminus of this base sequence : 65590
gaacttggagaccagttagaagataattgcagtgctcactttggcagcacatatagtaaaattggaatgatacagagaaggttaccatggcccttgtgcaaacatttcatgcaaattcatgaaatgttccatatatatatatatatatatatatatatatatatatatatatatatatatatatatatatatatataaagaaggtaattgcagtcatcaaggtgagagaacatggtggcttgaaccagggtgttaactttggacttggggagaacagcttacagtgtatttgtggaataataaaggaattaaatttctttatattgagctcccctaggagcctgtaagtctttggaaggcaaggcctgtgtctgatttatcattatattctgagtacattatattgaaatcctgttaaatatcaggagt

SEQ ID NO: 544 - DNA, 327 bp, Homo sapiens
  AL049710.18_20834
  Located on chromosome 1
  Distance between a terminus base of telomere on chromosomal short arm and 5'-terminus of this base sequence : 58602347
  Distance between 3'-terminus of neighbour sequence of sequence listing upward to telomere on chrosomal short arm and 5'-terminus of this base sequence : 19750
ttcattagagtaacaagagtccttagttaccgcggcagtgcaaatattattatatacacatacctggaccgagtaggccccagctaaatatctcaggtactattctgctgcctagggtgggcagaacgagattcacactccccttcagactgctgactgactggatactgagggtttgtgtgtgtgtgtgtgtgtgtgtgtgtatgtgtacagcagactgggctcacgtaaccatgactttggtcaagtttccaaagcaacggaaacaaacagggagaagacttcatgttgctatgatgtgaatacttatgacatttactgagagca

SEQ ID NO: 545 - DNA, 172 bp, Homo sapiens
  D1S200
  Located on chromosome 1
  Distance between a terminus base of telomere on chromosomal short arm and 5'-terminus of this base sequence : 58728174
  Distance between 3'-terminus of neighbour sequence of sequence listing upward to telomere on chrosomal short arm and 5'-terminus of this base sequence : 125500
gtactgtaacttgggtaactgaaactgtggaatgtgaaactgtggataaagggggacaactgtagacacacacacacacacacacacacacacacacacacacacacacaccatgttatatagatctcaatttattcatccatccattcatctatgatgttcaggtctgcca

SEQ ID NO: 546 - DNA, 120 bp, Homo sapiens
  DISO7_10000616
  Located on chromosome 1
  Distance between a terminus base of telomere on chromosomal short arm and 5'-terminus of this base sequence : 58757613
  Distance between 3'-terminus of neighbour sequence of sequence listing upward to telomere on chrosomal short arm and 5'-terminus of this base sequence : 29267
tgcagatgcctgtgactacgtgtgtgtgtgtgtgtgtgtgtgtgtgtgaagagagagagagagacagagggaaagagagagagagagaaagcagaacatgcacacaagctgtcatgtggg

SEQ ID NO: 547 - DNA, 200 bp, Homo sapiens
  DISO7_10000618
  Located on chromosome 1
  Distance between a terminus base of telomere on chromosomal short arm and 5'-terminus of this base sequence : 58833248
  Distance between 3'-terminus of neighbour sequence of sequence listing upward to telomere on chrosomal short arm and 5'-terminus of this base sequence : 75515
tgatgctatcctaaatgaataaccttaaatgcataaaaaggtttgttttcatattctttttttaaaaaagtacacacacacacacacgcatgcacacacgcacacacacgcacacgcacacacgcacacacacacacacacacacacacacctttctcactaatttaattcctaaacactctccatacatactcagtgtg

SEQ ID NO: 548 - DNA, 393 bp, Homo sapiens
  chr1.fa.O7frz.63777756
  Located on chromosome 1
  Distance between a terminus base of telomere on chromosomal short arm and 5'-terminus of this base sequence : 59227992
  Distance between 3'-terminus of neighbour sequence of sequence listing upward to telomere on chrosomal short arm and 5'-terminus of this base sequence : 394544
caagcactaaggatagtgacagggaaagctaaaaggaatctaggtctgtatcaatcatggtcccaccataagcaaaaccagtgggagatgagtgatagatagatagatagatagatagatagatagatagatagatagatatacagatagatagatatacagatgacagatagatagatagatagatagatagatagacagatagacaggcagatttattgcaagagactggcttatacaattgtgggggctgtctaggcaagtctgaaatctgtagggcaggccatcaggaagggcaggctggaactcaggggcacaggataaaactgtagtccataggtggaatgaggcttcttcagcaaagcatcagttctgctcttaagacctttagat

SEQ ID NO: 549 - DNA, 416 bp, Homo sapiens
  chr1.fa.O7frz.63852152
  Located on chromosome 1
  Distance between a terminus base of telomere on chromosomal short arm and 5'-terminus of this base sequence : 59302354
  Distance between 3'-terminus of neighbour sequence of sequence listing upward to telomere on chrosomal short arm and 5'-terminus of this base sequence : 73969
gtgcctgtaatcctagctacttgggaggccgagacaggagaatcacttgagccccagggactgaggttgcagcgggccaagatcatgccactgcactctagcctgggcaacagagcgagactctgtctcaaataaaataaaataaaataaaataaaataaaataaaataaaataaaataaaataataaaataaaataaaataaaataaaataaaataaaaatagcaaaataaaaaacagggatgggtgccctagtggggagatccatttgacagagtgggtgctgagcctcatgcaggagggcatgactcacatgaactaagatagtgaaaattccagcagcttcagtgactgaacaccttggcctggcttagttgccataggaggactgggattcagctgtactcaattcctaaa

SEQ ID NO: 550 - DNA, 245 bp, Homo sapiens
  D1S2742
  Located on chromosome 1
  Distance between a terminus base of telomere on chromosomal short arm and 5'-terminus of this base sequence : 59411425
  Distance between 3'-terminus of neighbour sequence of sequence listing upward to telomere on chrosomal short arm and 5'-terminus of this base sequence : 108655
attcggcaaatgctgattcatatttagtatgggttctggacatgtgggataaatccacaggtcgttttcaataaaacctgcccccaaatctctactcttctcttctacacacacacacacacacacacacacacacacacagaggcacacacacgcacacacacacacacaaattttcttgttcttggtttactgagcacagtagaggacagttaactatcctgagtataagagtgtctccacca

SEQ ID NO: 551 - DNA, 253 bp, Homo sapiens
  AL354768.6_10115
  Located on chromosome 1
  Distance between a terminus base of telomere on chromosomal short arm and 5'-terminus of this base sequence : 59690224
  Distance between 3'-terminus of neighbour sequence of sequence listing upward to telomere on chrosomal short arm and 5'-terminus of this base sequence : 278554
aggaaatctaaggcataccaactactaaatgtattcagtcttctaggttctatggttaagcttggtaggaaaaaaaaatacaaaaccatacaatactggaaagagagaaagacaaagaaagaaagaaagaaagaaagaaagaaagaaagaaagaaagaaagagaaggaagagatggaagaaaaggaagaggaagaaaggaaggaaggaaagtaactttggtttacacttctatgtactcagttccataccagg

SEQ ID NO: 552 - DNA, 363 bp, Homo sapiens
  AL354768.6_80128
  Located on chromosome 1
  Distance between a terminus base of telomere on chromosomal short arm and 5'-terminus of this base sequence : 59705126
  Distance between 3'-terminus of neighbour sequence of sequence listing upward to telomere on chrosomal short arm and 5'-terminus of this base sequence : 14649
cctcaaagagttcacagtcaatagatgagatagatagatagatagatagataaatagatagatagatagatagatagatagatagatagatagatagatagtcaattacagagcaagaaagaagtagaaggccggcaaagccattcaatctaacctcagggctcagttttcctggtgaaggtggaggtggatctgatccttgaagaggactaggaagaagtaaatacatatgccaaagcaaagtggtatgagtttgggaaaactgcaagtagttcagaatggctggattttaggggacaaaaggaaaggaggatgtgttgaaagaaatagtggtagagagataggcaagttctaaatcatgaa

SEQ ID NO: 553 - DNA, 440 bp, Homo sapiens
  AL365197.8_85258
  Located on chromosome 1
  Distance between a terminus base of telomere on chromosomal short arm and 5'-terminus of this base sequence : 59812170
  Distance between 3'-terminus of neighbour sequence of sequence listing upward to telomere on chrosomal short arm and 5'-terminus of this base sequence : 106681
tatggtccttatctgactgcagcttattttccaacttgttcgtacaccttaaggatattggccttctctctaatatcataggtaccatgatatctgtcaactcatagatattaagttccttcctaatatggggccttattattactattattattattattattactgccccttttattatgttctttccttcctttctattacctctcttttttacaaaacagatttatagcaatgtaatatagaaatgtaattcacataccataacatacacccatttatgctataccatgcaatggttttagtccattcacagagacccgtatcatcaccacgatccattttagaacatttttatcatccctaaaagaaaccctatagcaattagcagtcactccctgtttcctccaacccctctagccctaggtagttcctaattg

SEQ ID NO: 554 - DNA, 200 bp, Homo sapiens
  D1S2690
  Located on chromosome 1
  Distance between a terminus base of telomere on chromosomal short arm and 5'-terminus of this base sequence : 59909411
  Distance between 3'-terminus of neighbour sequence of sequence listing upward to telomere on chrosomal short arm and 5'-terminus of this base sequence : 96801
agctttggatgcctagaaacacagacacacagacacacacacacacacacacacacacacacacacacacactcttaatttttcatgatgggaattgtttaacatttacaaaagtaacgcggtgaaaccccatgcatgtcttattcaccttcaacagtagtcaattcattgttttatctacgccagattattttgaagca

SEQ ID NO: 555 - DNA, 447 bp, Homo sapiens
  chr1.fa.O7frz.64506529
  Located on chromosome 1
  Distance between a terminus base of telomere on chromosomal short arm and 5'-terminus of this base sequence : 60037642
  Distance between 3'-terminus of neighbour sequence of sequence listing upward to telomere on chrosomal short arm and 5'-terminus of this base sequence : 128031
cttacaagcacgctaaatctattcagcctggcactttcccgtcaaggaggagtttcttaaaaattgctaagtggtatggtcgaggtgggggtggcggggagaactcagaggagggagatgaagtcataccaacatgcccctgctcacccctttccaaaactcagctatttggactggagtgatttgccacagagagaaacatgccctttgccctgagacaaaggggagcttttcctgaccagcaaaagctaaaatggatcctctgccctgatttaaaaccaaacttgtgggtgagaagccacatgattcatgggagaaaatgacttgactccaaatatataataaaaagtatggaagcaacacacacacacacacacacacacacacacacacacacacacacatgcacacgcacatcaaaagaaactgacttactgaagacggaaa

SEQ ID NO: 556 - DNA, 304 bp, Homo sapiens
  D1S519
  Located on chromosome 1
  Distance between a terminus base of telomere on chromosomal short arm and 5'-terminus of this base sequence : 60160901
  Distance between 3'-terminus of neighbour sequence of sequence listing upward to telomere on chrosomal short arm and 5'-terminus of this base sequence : 122812
tggtaaataggtaggtagataggagagtagataggaagatagatgataggtaagtaggtagataggtgataggagatagataatagattgatagaaagatagacagacagataaatagatagataatagtagataatagtagatagatagatacatagatagatagatagatagatagatagatagatagatagataatagacagacagacacacagacaggtagatggatagatagagagagagatagacaggctatgatattttcttttaccagatagcaattttaggagcccagcattatt

SEQ ID NO: 557 - DNA, 396 bp, Homo sapiens
  AL157907.3_8076
  Located on chromosome 1
  Distance between a terminus base of telomere on chromosomal short arm and 5'-terminus of this base sequence : 60340528
  Distance between 3'-terminus of neighbour sequence of sequence listing upward to telomere on chrosomal short arm and 5'-terminus of this base sequence : 179323
gtctgtaggataaagtggagtcagccagataaaggaaggggcaaagagatagtgggtaggggagacaggagaagaatgtcctaagcagaaaagaagaggaagaagaagaggaagaagaagaagagaagaagaaggaggaggaggaggaggaggaggagaaggaggagaaggaggagaaggagaagaaagagaagaaggagaaggagaagaaggagaaggaggggaaggggaagaagaagaggaagaggaagaggaggaagcatacttgtgcaaagaacatatttgctatccaatggctttcacacaagaccaggacccctcactccctcactctctctatcagggagagagttggaaatatgtaaaagtacccttctgcttgtcactatgaaagat

SEQ ID NO: 558 - DNA, 315 bp, Homo sapiens
  AL080278.7_62261
  Located on chromosome 1
  Distance between a terminus base of telomere on chromosomal short arm and 5'-terminus of this base sequence : 60463903
  Distance between 3'-terminus of neighbour sequence of sequence listing upward to telomere on chrosomal short arm and 5'-terminus of this base sequence : 122979
tatcgcatggatagaggatagtctctgtttctaaagtagattgggagccaataccttagtagttatacagtttggatttttatgaattagtgaaattaaaaataaataccttacagtgaccattatagggttgctacctttatattttactaatcaagaatagtttttaaaatattatctactatcacagtcatttcatctaaaaagaggcatttcaacacacacacacacacacacacacacacacataaacactccagaaggaaaatctcagaataaaagatagcctttccattcaatcagtatggctttaga

SEQ ID NO: 559 - DNA, 203 bp, Homo sapiens
  AL080278.7_69669
  Located on chromosome 1
  Distance between a terminus base of telomere on chromosomal short arm and 5'-terminus of this base sequence : 60471441
  Distance between 3'-terminus of neighbour sequence of sequence listing upward to telomere on chrosomal short arm and 5'-terminus of this base sequence : 7223
ccaataagtgatcttcaacctaaaaacaagagtgagcccttcaaaaagcaagtcagatcctgtcactcaaaagtggttaaaaaaaaaatatatatatatatatatatatatatcagtgtttagaagtgaggaaacaggctgagaaaggttaagtaaacagtcataccctcaagaagtggtaattagtaatcagcagtggaaca

SEQ ID NO: 560 - DNA, 406 bp, Homo sapiens
  AL080278.7_70516
  Located on chromosome 1
  Distance between a terminus base of telomere on chromosomal short arm and 5'-terminus of this base sequence : 60472161
  Distance between 3'-terminus of neighbour sequence of sequence listing upward to telomere on chrosomal short arm and 5'-terminus of this base sequence : 517
ctatgcctggcagtattctaggactggggatccagcaatgaagactaaagactatcattacagagcttatagtctaatgagagagagagacacagtaaaacaaaatagataatgtccatgtgttaagctttaaagagtaataaagctgggtaaatagataaggagcaacagagaatgactagggaaagaagtggaggcaggattttttttcttttgtgtgtgtgtgtgtgtgtgtgtgtgtgtgtgtgtgtgtgtgtttggttttgttgaaataagagtctccctctgtcacccaggctggagggcagtggcatgatctcggttcactgcaacctccacctcccaggctcaagcgagccttccacttcagcgtccctagtaactgggactacaggtgtgcaccatt

SEQ ID NO: 561 - DNA, 215 bp, Homo sapiens
  D1S2665
  Located on chromosome 1
  Distance between a terminus base of telomere on chromosomal short arm and 5'-terminus of this base sequence : 60472315
  Distance between 3'-terminus of neighbour sequence of sequence listing upward to telomere on chrosomal short arm and 5'-terminus of this base sequence : -252
tagataaggagcaacagagaatgactagggaaagaagtggaggcaggattttttttcttttgtgtgtgtgtgtgtgtgtgtgtgtgtgtgtgtgtgtgtgtgtttggttttgttgaaataagagtctccctctgtcacccaggctggagggcagtggcatgatctcggttcactgcaacctccacctcccaggctcaagcgagccttccacttca

SEQ ID NO: 562 - DNA, 382 bp, Homo sapiens
  AL080278.7_81857
  Located on chromosome 1
  Distance between a terminus base of telomere on chromosomal short arm and 5'-terminus of this base sequence : 60483544
  Distance between 3'-terminus of neighbour sequence of sequence listing upward to telomere on chrosomal short arm and 5'-terminus of this base sequence : 11014
cttcactgtcagttaaagctctaggaagaaatataagtgaacaacaatccatgtacaatgactggaaatagttctatagtactgggcagaaataaggggagagaagaaaaaataatacacacatacacacactggcaggcgtgtgcacatgcgcacacacacacacacacatacacacacacacacacacacacacacacacacacccctaacttgaaatggttttcttagctataaaggtgagtcccgaatataattttttatggcccaataagattttttttctgtaaatctatttaccaatcatagaagaaaatacttcttttgacttcatgtccccagttttggtttggaaactctgtcttttacagaagtccaggac

SEQ ID NO: 563 - DNA, 474 bp, Homo sapiens
  chr1.fa.O7frz.65001130
  Located on chromosome 1
  Distance between a terminus base of telomere on chromosomal short arm and 5'-terminus of this base sequence : 60556326
  Distance between 3'-terminus of neighbour sequence of sequence listing upward to telomere on chrosomal short arm and 5'-terminus of this base sequence : 72400
tagctgacttagaatgataggagttgttcttccccacctcctgccaaccaccacacacacacacacacaccacttcttggctggaacctgtctgaaggggaggaaggacattcagttatgttagggagcatgtgtttatggccctggaccttgctcccaataaatgaagattcggtttaactcatctggaaaagttaacttttctggatgctctaacacttggaatgtcccacaccctttatttcctacacaatctatatccaggcaaaggtcatcagtggacaccttaactcaaaccaatataacttgatattgactgtgtttgtgttaccatccatgtgaatgcatctttcttgtgaccataatacaatggcaataaacatgatgatggtgatggtaaaaataatgaagaccacaaggtgaagtcagtcttctacttaatccctggcgctaaacgttatggtttcttaacct

SEQ ID NO: 564 - DNA, 188 bp, Homo sapiens
  D1S2890
  Located on chromosome 1
  Distance between a terminus base of telomere on chromosomal short arm and 5'-terminus of this base sequence : 60652582
  Distance between 3'-terminus of neighbour sequence of sequence listing upward to telomere on chrosomal short arm and 5'-terminus of this base sequence : 95782
ggtaggactgttgtgaagatggaagaggaagatatctgaagtgtgtgtgtgtgtgtgtgtgtgtgtgtgtgtgtgtgtgtttgtacatatatgaaatacttgacaaatgtaagattaccactgctagagtgtggatttacctagatattcacccgctggcttccttcattacatctaaatgtccagca

SEQ ID NO: 565 - DNA, 171 bp, Homo sapiens
  Z67418
  Located on chromosome 1
  Distance between a terminus base of telomere on chromosomal short arm and 5'-terminus of this base sequence : 60659985
  Distance between 3'-terminus of neighbour sequence of sequence listing upward to telomere on chrosomal short arm and 5'-terminus of this base sequence : 7215
agtttggttagggcaaaagagtggctaaaacatatgcttagaaattgactctaagttccaggaaaatcatttttccatatgaaagaaaattagaataaatgcctacctcacacaacacacacacacacacacacacacacacacacacatatatgcacacactccacatgg

SEQ ID NO: 566 - DNA, 287 bp, Homo sapiens
  AL355004.5_67695
  Located on chromosome 1
  Distance between a terminus base of telomere on chromosomal short arm and 5'-terminus of this base sequence : 60685998
  Distance between 3'-terminus of neighbour sequence of sequence listing upward to telomere on chrosomal short arm and 5'-terminus of this base sequence : 25842
acttgcctagaaatgcagtctcttgatgcatccatgtgactgcaaaggacacaatttcattctttttatgtgcatagtattttatgcacaggtacaatcttttcttttcttttcttttctttctttctctttctttctttctttctttctttctttctttctttctttctttcttctttcctccttcttctttctttctttctttttttctttcttctttctttttttttgaggcagggttctcactttggagaggctggagtgtactgacctgaacatagctcatt

SEQ ID NO: 567 - DNA, 93 bp, Homo sapiens
  Z67642
  Located on chromosome 1
  Distance between a terminus base of telomere on chromosomal short arm and 5'-terminus of this base sequence : 60738593
  Distance between 3'-terminus of neighbour sequence of sequence listing upward to telomere on chrosomal short arm and 5'-terminus of this base sequence : 52308
aggcaggctgacgtattcacagctcacacacacacacacacacacacacattgactgacattgctttcccactgagaatgtccaccccactga

SEQ ID NO: 568 - DNA, 359 bp, Homo sapiens
  chr1.fa.O7frz.67678991
  Located on chromosome 1
  Distance between a terminus base of telomere on chromosomal short arm and 5'-terminus of this base sequence : 60947626
  Distance between 3'-terminus of neighbour sequence of sequence listing upward to telomere on chrosomal short arm and 5'-terminus of this base sequence : 208940
actatcacaagaacagcatgaggaaaccacccccataatccaatcacttcctaccaggtccctccctcaatacgtggggattacaatttgagatgagatttaggtggagacacagaatgaaactatatcacacacacacacacacacacacacacacacacactggaagagtgctttccaaactatgaaatgccgcccacaggtggacaattagccacccagtccaggccaagaatgaagtggctgtcagcatgccacagccatcacacaaggaatctacttgcaagtgagaggagcggaggaaacatttagaggcaagcacctatcagttaggtcagtagttctcaaatgtcactgga

SEQ ID NO: 569 - DNA, 443 bp, Homo sapiens
  AL035416.7_64760
  Located on chromosome 1
  Distance between a terminus base of telomere on chromosomal short arm and 5'-terminus of this base sequence : 61048600
  Distance between 3'-terminus of neighbour sequence of sequence listing upward to telomere on chrosomal short arm and 5'-terminus of this base sequence : 100615
ggaccacaggtaaatacaactaagcccagctaatgtctttattttctttctttctttctttctttctttctttctttctttctttctttctttctttctttctctctctttccttctttctttctctctctctctctccctctctctctctccctctctctctgtctctctctctctctccctctctctctgtctctctctctctctctctctctcttttgagatgggggttccctatgttgcccaggctggtcttgaactcctaggctcaagtgattttccctccttggcttaccaaagtgttgggattacaggcatgagctactgcaccaggcataatttctttcttaaactctattttgtctgatagtcatatatttactccagctgtcttttagttagtgtttgcatgaaggagcttcttccatttcttagctttcaac

SEQ ID NO: 570 - DNA, 217 bp, Homo sapiens
  AL035416.7_60125
  Located on chromosome 1
  Distance between a terminus base of telomere on chromosomal short arm and 5'-terminus of this base sequence : 61053191
  Distance between 3'-terminus of neighbour sequence of sequence listing upward to telomere on chrosomal short arm and 5'-terminus of this base sequence : 4148
tagttgaaccaaatctgatcaccaagaaacaatccaacaaatctactagactcttcaaaaatgttgctgtcatgaaagatctctctctctctcacacacacacacgcgcacacacacacacacacacacacacacacacacacacacggagtggagaactgacctagatcagaggagactgaagcaacatgtcaaatacaatgcataatcctgattc

SEQ ID NO: 571 - DNA, 434 bp, Homo sapiens
  AL138845.6_81235
  Located on chromosome 1
  Distance between a terminus base of telomere on chromosomal short arm and 5'-terminus of this base sequence : 61193672
  Distance between 3'-terminus of neighbour sequence of sequence listing upward to telomere on chrosomal short arm and 5'-terminus of this base sequence : 140264
catggctattcaatttgctaactaatctatcttcttcctactgatttaaaatgctatcttaatcagaaagtaaaattctctctatctctttctgtcatctatctatctatctatctatctatctatctctctatctatctatgtatctgtctatctacttatctatccagttaaaactatttggggcctccatgggctctattgagctttctgtctacttatatgctaatatgagccttttttaaattatagaagcataattattatcttccataaattttagacttagtccccatacttcccaatttccttttcttcagaatttcctggctattctttaaatttcaattttcattatacacttgagaatcagctgctctagccaattacgagaaaagtcctgttggcaacttgaataggttcctatcaaacct

SEQ ID NO: 572 - DNA, 475 bp, Homo sapiens
  AL138845.6_90790
  Located on chromosome 1
  Distance between a terminus base of telomere on chromosomal short arm and 5'-terminus of this base sequence : 61203271
  Distance between 3'-terminus of neighbour sequence of sequence listing upward to telomere on chrosomal short arm and 5'-terminus of this base sequence : 9165
cacttgagtccaggagtttaataccagcctgggcaacatggcacaaccccttctctacaaaaaaatacaaaaattagttgggtgtggtgacatgcacctgtagtcccagctacttgggaggctgaggtgggaggattgcttgagcctgggaggcggatgttgcagtgagccaagattatgccactgcatttcagcctggtgatagagtgagaccatctccaaaattaaaataaataaataaataaataaataaataattaaaaaaataaaaaatatgtgcatatgcacgtgtgtatgtatgcatatatatgtatacgaataaggatatatatatatccatatatatatccatatatatatatccatatatatatatccatatatatatatccatatatatatatccatatatatatggataaggacgggttcttgcttacgagagaatgctgagtgccaacttgtagataggaag

SEQ ID NO: 573 - DNA, 224 bp, Homo sapiens
  D1S2873
  Located on chromosome 1
  Distance between a terminus base of telomere on chromosomal short arm and 5'-terminus of this base sequence : 61236562
  Distance between 3'-terminus of neighbour sequence of sequence listing upward to telomere on chrosomal short arm and 5'-terminus of this base sequence : 32816
gttgagcccaatatctctcccctactgcaaaactccattgcagtggttcctatgactattgtgatagttttgagtaaaacctgccttacgattttaacaagagtcagaataattttttctttaagacagacagacagacacacacacacacacacacacacacacacacacacacacacacaccccttggggaaaagcagtggagaattccaggagacgatgca

SEQ ID NO: 574 - DNA, 134 bp, Homo sapiens
  DISO7_00000220
  Located on chromosome 1
  Distance between a terminus base of telomere on chromosomal short arm and 5'-terminus of this base sequence : 61332619
  Distance between 3'-terminus of neighbour sequence of sequence listing upward to telomere on chrosomal short arm and 5'-terminus of this base sequence : 95833
aagttaattgggagtctggtgtctgccaagcacccacccactttgtttcctccctccctccctccctccctccctccctccctccctcccttccttccttcctccctccctctctctgtcagtggatctgtcct

SEQ ID NO: 575 - DNA, 444 bp, Homo sapiens
  AC021913.4_162763
  Located on chromosome 1
  Distance between a terminus base of telomere on chromosomal short arm and 5'-terminus of this base sequence : 61454465
  Distance between 3'-terminus of neighbour sequence of sequence listing upward to telomere on chrosomal short arm and 5'-terminus of this base sequence : 121712
tgctatctaccagcgtataaagagcctattctgtaccttgccaaaacagaattcaatcacgccttataacctttgccaatctgagagggtaaaagattacctgtcttacttcaatttacagttttaaaaatctctagtaagattaaacatctatctatctatctatctatctatctatctatctatctatcatctatctatgttctttttatatcatatttagtaattacctgctaatgtctttttaccacatttttattaggcagcctttattcttaacctcttaacatgtgccttatgcatagttttggattgaaatttaaattagtctgattccaaagcccgtttcttttagtgccattataactcaatagaaatggaatacttatctccaaggcctatatccttgagtattgttggctgaaagcataaattctagaaaca

SEQ ID NO: 576 - DNA, 450 bp, Homo sapiens
  chr1.fa.O7frz.68341335
  Located on chromosome 1
  Distance between a terminus base of telomere on chromosomal short arm and 5'-terminus of this base sequence : 61633469
  Distance between 3'-terminus of neighbour sequence of sequence listing upward to telomere on chrosomal short arm and 5'-terminus of this base sequence : 178560
taattagttattctgtggttccagtcatcatgagtcagaatgtctgggaattcaaatccaattagaatttctaaagaaaaatgtaagtttggaattaggtatgtggattcaaagatgtcagtggaaatgccagcggacttttgctgataaatgggaagctaagaagacagtggccaaagctagagctattggttgtggtaacatggcgttgatgatgatgatgatgttgatgacactgatgatgatgatgatgatgatgatgatgatgatgatgatgatgataaatcttcattttgtgcttcccatgtgatagacactatgctaagtgcttcatatgtactatctcatgtaatcctgaccttaatgttataaaggaagtacactcattatatagatgatcaaatggaatgactgagaaattagtaactttcttgagtcttcatagtcaac

SEQ ID NO: 577 - DNA, 261 bp, Homo sapiens
  DISO7_10000626
  Located on chromosome 1
  Distance between a terminus base of telomere on chromosomal short arm and 5'-terminus of this base sequence : 61701853
  Distance between 3'-terminus of neighbour sequence of sequence listing upward to telomere on chrosomal short arm and 5'-terminus of this base sequence : 67934
cagattcagcaatgattgattacattcaggtagtgggcttggcactttcctgtgtcattagttattcccacaacaactttgtaaaatatgtgttatctccatttcacagatgcacaaacaatgagtaaaccaagcctcagagatgctcagggaccaacctaaagctaattattgatagattttggactagcaacccctggtgtgtgtgtgtgtgtgtgtgtgtgtgtgtctgtttgtttttaccatgctgactgtttctga

SEQ ID NO: 578 - DNA, 246 bp, Homo sapiens
  D1S1643
  Located on chromosome 1
  Distance between a terminus base of telomere on chromosomal short arm and 5'-terminus of this base sequence : 61897947
  Distance between 3'-terminus of neighbour sequence of sequence listing upward to telomere on chrosomal short arm and 5'-terminus of this base sequence : 195833
gacaggcccagaagtgaatattctggttaatgtctaaagctattacattaaaacgttaaagcatatagtgttctaagcaggatttatcagagctagcaaaagataaatactctgggtctcttaatcaaataaattggttacatagatagacagatagatagatagatagatagatagataatatagatagataatagacagatcacgctggataatagccatagccaaaggcaaaccacaggtcta

SEQ ID NO: 579 - DNA, 303 bp, Homo sapiens
  AC058796.1_60100
  Located on chromosome 1
  Distance between a terminus base of telomere on chromosomal short arm and 5'-terminus of this base sequence : 62026813
  Distance between 3'-terminus of neighbour sequence of sequence listing upward to telomere on chrosomal short arm and 5'-terminus of this base sequence : 128620
taccactgtctgacactccatatatttctatatctgtatctctcttcccatttgtgtgttgccaccactataatggaaactccaaaagagcaaggattcttgacttttcatgtatttctaatccttagcacatatggggacttagtaagtatttgttgaatgagtaagtatttgttgaatgagtaagtatttgttgaatgagttagtgaatggatggatagatggatggatggatggatggatggatggatggatggatgggcaagtgaaacattaaaaggtactcattaaatgttagctgaa

SEQ ID NO: 580 - DNA, 127 bp, Homo sapiens
  D1S203
  Located on chromosome 1
  Distance between a terminus base of telomere on chromosomal short arm and 5'-terminus of this base sequence : 62081431
  Distance between 3'-terminus of neighbour sequence of sequence listing upward to telomere on chrosomal short arm and 5'-terminus of this base sequence : 54315
agctaggatttagggccagtcttcacttttttgtttgtttgttcaaaacacatgcacacacacacacacactcacacacacacacacacacactcacacacacacactgcacaggtgataacaaagt

SEQ ID NO: 581 - DNA, 435 bp, Homo sapiens
  AC058796.1_8049
  Located on chromosome 1
  Distance between a terminus base of telomere on chromosomal short arm and 5'-terminus of this base sequence : 62141102
  Distance between 3'-terminus of neighbour sequence of sequence listing upward to telomere on chrosomal short arm and 5'-terminus of this base sequence : 59544
taagactggtctttgaggatgtacatatattcaaagtagaatggtgcccatttttttcattaaagtccatactcaatggctcaattattgtttttaagactttatttatttatttatttatttatttattttgagacagggtctcactccgtcaccagggtggggcgggaatgcagtggcacaatcacagctcactgcaacctctacttcccgggctcaggagatcctcccacctcagcctctctgagtagctgggactacaggtacgcaccaccacccccagctaattttttgtatgttttgtagacatggagtttcgccatgttgcccaggctgatcttgaactccggggctccagcagtccccctccttgagccccccaaagtgctgacactacaagcgtgagtcaccactcctggccaagactcctatttc

SEQ ID NO: 582 - DNA, 475 bp, Homo sapiens
  chr1.fa.O7frz.69374855
  Located on chromosome 1
  Distance between a terminus base of telomere on chromosomal short arm and 5'-terminus of this base sequence : 62203488
  Distance between 3'-terminus of neighbour sequence of sequence listing upward to telomere on chrosomal short arm and 5'-terminus of this base sequence : 61951
tctcagatacctttaatgagtcatcaagggttttttccctcaaacaaagacaatttcctccccttacacacacacacacacacacacacacacacacacacaaaatattgttggtgccaactgttaaaataacaaataattctgccttattacacacaaagggatatgatgccattctatttagtattccctgccattttctgatcatcttctatgtcctaggaaatgtcccaggccctccaagcatgcaaattcacttaatccttgccacaatttactgtggtaaagaaactgaagatgggagcagttacattgtccggggccacctagagcattctgatcctaaaactgttatcttaagcaataaattactctgcctcccataattcagaaggctgaattatttgcaaggtactatgagaggtataaagagcaaaaggcaggggcccaggtcacttaacatagtaagccattg

SEQ ID NO: 583 - DNA, 470 bp, Homo sapiens
  AL390858.6_10376
  Located on chromosome 1
  Distance between a terminus base of telomere on chromosomal short arm and 5'-terminus of this base sequence : 62294028
  Distance between 3'-terminus of neighbour sequence of sequence listing upward to telomere on chrosomal short arm and 5'-terminus of this base sequence : 90065
gtacttacctactggccatgtacttatcctctgacaccataccaattggtccactttggctcctcactttctgttttttattttttattttatttatttatttatttatttatttatttatttatttattttgagacggagtctcgctctgtcacccaagctggagtgcagtggcgcgatctcggctcactggaagctccccctcccgggttcacgccattctcctgcctcagcctcccaagtagctgggactacaggcgcccgccttcacgcccagctaatttttttttttttaagtagagacggggtttcactgtgttagccaagatggtctcgatctcctgacctcgtgacccacccgcctcggccgcctaaagctctgggattacaggtgtgagccaccgcgtccagcctggctcctcattttctatgtttcttgctaaccatccatttacctttggactgacacc

SEQ ID NO: 584 - DNA, 143 bp, Homo sapiens
  D1S2822
  Located on chromosome 1
  Distance between a terminus base of telomere on chromosomal short arm and 5'-terminus of this base sequence : 62332199
  Distance between 3'-terminus of neighbour sequence of sequence listing upward to telomere on chrosomal short arm and 5'-terminus of this base sequence : 37701
caactgcactctaacctggacaacagagaacctgtctcaaacaaaaaaaaaagtaaaaatagtaaatgttatgttatatatatttacacacacacacacacacacacacacacagtcattttccaccagtacagggtcagact

SEQ ID NO: 585 - DNA, 160 bp, Homo sapiens
  D1S2846
  Located on chromosome 1
  Distance between a terminus base of telomere on chromosomal short arm and 5'-terminus of this base sequence : 62467241
  Distance between 3'-terminus of neighbour sequence of sequence listing upward to telomere on chrosomal short arm and 5'-terminus of this base sequence : 134899
ttggaaactacagggtgctttacagactgtgtgtgtgagtgtgtgtgtgtgtgtgtgtgtgtgtgtgtgtgtgtgtgtgtacagaaaatcctttatctctttgcttctcaatttcttttcttaggaaaatcagattatttaaatcccattatgcacagct

SEQ ID NO: 586 - DNA, 266 bp, Homo sapiens
  AL356112.3_115387
  Located on chromosome 1
  Distance between a terminus base of telomere on chromosomal short arm and 5'-terminus of this base sequence : 62507970
  Distance between 3'-terminus of neighbour sequence of sequence listing upward to telomere on chrosomal short arm and 5'-terminus of this base sequence : 40569
cctttgtagctagaacatgcttagattttggtattcttgaaaatgtggcctcctccccaatgccagtgtataggatttaaaaaaaaacaaaaaaacacatctcaaaccttggcatttattgaatattaacaggccaggcaccaaagcattattcagcattgacacttaaacttttctgtattgattattattattattattattattttttgagacaggatctcactctcttgcccaggctggagtacagtgacataatcttggct

SEQ ID NO: 587 - DNA, 351 bp, Homo sapiens
  AL096888.30_112951
  Located on chromosome 1
  Distance between a terminus base of telomere on chromosomal short arm and 5'-terminus of this base sequence : 62685642
  Distance between 3'-terminus of neighbour sequence of sequence listing upward to telomere on chrosomal short arm and 5'-terminus of this base sequence : 177406
aatgcgcctttagtaatagaagataacaaagtagtgggttcagccccaaaagactgtcggtctcgttggggagataaagcaaatatgcatgtggcaagattaaatacacacacacacacacacacacacacacgcacacacactaaaaaactgtgaactaaattgtgtgacacaggctaaaaatagttaaagagagctttatgcaaaaagaataccttgtttccagctctaaatgttggttagggttggtgagatagaaaggaaaaggaatggaattctgggtggggtgaaaaatgagcaaaggcttggaggaaggatggatgatgaacataacatgttctcaggaaatga

SEQ ID NO: 588 - DNA, 247 bp, Homo sapiens
  AL096888.30_103909
  Located on chromosome 1
  Distance between a terminus base of telomere on chromosomal short arm and 5'-terminus of this base sequence : 62694711
  Distance between 3'-terminus of neighbour sequence of sequence listing upward to telomere on chrosomal short arm and 5'-terminus of this base sequence : 8718
cctgaatcctttgtagtcattaaataactgaagtttaatggctgaatcctttttggtaagaggtgtgtgtgtgtgtgtgtgtgtgtgtgtgtgtgtgtgtgtgtgtacgtacacatatatattcttagagaatccctcacagttgtattcctggactgactctccattctctatccccatttcattacagaaaaatgcagtttcatggtatatgtttatagggagtgatagaggacagtggataaac

SEQ ID NO: 589 - DNA, 215 bp, Homo sapiens
  D1S2788
  Located on chromosome 1
  Distance between a terminus base of telomere on chromosomal short arm and 5'-terminus of this base sequence : 62724298
  Distance between 3'-terminus of neighbour sequence of sequence listing upward to telomere on chrosomal short arm and 5'-terminus of this base sequence : 29340
tgcttcaaccttccaaagtgctgggattacaacagcaaataagttatgcccttagataactaagtactgaggatttaagacatacaaaatgcgaacacaaggttaaaccccacttctttatgaatcaaacacacacacacacacacacacacacacacacacacacacacacacacacacaggcagtttagaagtaaaattgccttgattctggc

SEQ ID NO: 590 - DNA, 417 bp, Homo sapiens
  AL096888.30_72444
  Located on chromosome 1
  Distance between a terminus base of telomere on chromosomal short arm and 5'-terminus of this base sequence : 62726099
  Distance between 3'-terminus of neighbour sequence of sequence listing upward to telomere on chrosomal short arm and 5'-terminus of this base sequence : 1586
ggtttagcttaacctaagttgattccatgtatagactcattatttattttccttttttcagcatagaataaaaaattcaagattgaacttgtatctcctctttatgtggaatggtttcttctgcctcgccctctccctctctctctctctctctctctctctctctctctctctctctctctccctctttctctccctctctccccgtctctccccctccccaaccccacccgcacccaggtctgctattctctgtgtgagctttgtgcttaggctaaatatcctcagactgtggcccagatagccacagtgagcagctccagccttaatttccaccaatttaataatcccaagagaaaaaagagcagcttttcaacaacagatttagggaagggcctactcctgcatgcttatgat

SEQ ID NO: 591 - DNA, 404 bp, Homo sapiens
  AL096888.30_26695
  Located on chromosome 1
  Distance between a terminus base of telomere on chromosomal short arm and 5'-terminus of this base sequence : 62771865
  Distance between 3'-terminus of neighbour sequence of sequence listing upward to telomere on chrosomal short arm and 5'-terminus of this base sequence : 45349
gattggtatgagtgactgaaataccgcagggacttaaataagtggtgcatatggtattacttaggctgcatcctttagccaaggtgaaggcttcgttttctgtccattcctaacatgcatgcagacacacacacacacacacacacacacacacacacacacacacctgctacatatgcgtccatctagtccagaagctccacactgaacatcaattacctatctagagtaaggctggctggcctttacttccttccctttgccctgtgttacctgagtgcacccccaagcccccacactctccagtgtagataatggtgtatcagattagtctgccttgctgctgcatcaagacccagatcaatttattgactctgccagagtggctggtacagtaattgtta

SEQ ID NO: 592 - DNA, 232 bp, Homo sapiens
  Z67671
  Located on chromosome 1
  Distance between a terminus base of telomere on chromosomal short arm and 5'-terminus of this base sequence : 62771876
  Distance between 3'-terminus of neighbour sequence of sequence listing upward to telomere on chrosomal short arm and 5'-terminus of this base sequence : -393
gtgactgaaataccgcagggacttaaataagtggtgcatatggtattacttaggctgcatcctttagccaaggtgaaggcttcgttttctgtccattcctaacatgcatgcagacacacacacacacacacacacacacacacacacacacacacctgctacatatgcgtccatctagtccagaagctccacactgaacatcaattacctatctagagtaaggctggctggc

SEQ ID NO: 593 - DNA, 238 bp, Homo sapiens
  D1S473
  Located on chromosome 1
  Distance between a terminus base of telomere on chromosomal short arm and 5'-terminus of this base sequence : 62774141
  Distance between 3'-terminus of neighbour sequence of sequence listing upward to telomere on chrosomal short arm and 5'-terminus of this base sequence : 2033
catggtttccattttacaaaggtgttttataaaagcccaatatcattagactgactcaaacgcattgcaattccaaggaacaaatgcatgtaattcagaagttcactttgcaggatttactttcatagactgccgtgcaggggtgtgtgtgtgtgtgtgtgtgtgtgtgtgtgtgtgtgtgtgtctgtctgtctgtctgtctgtgtaacctgtgcttccgtctatgctcctggacagc

SEQ ID NO: 594 - DNA, 150 bp, Homo sapiens
  Z24046.1_57
  Located on chromosome 1
  Distance between a terminus base of telomere on chromosomal short arm and 5'-terminus of this base sequence : 62774220
  Distance between 3'-terminus of neighbour sequence of sequence listing upward to telomere on chrosomal short arm and 5'-terminus of this base sequence : -159
acaaatgcatgtaattcagaagttcactttgcaggatttactttcatagactgccgtgcaggggtgtgtgtgtgtgtgtgtgtgtgtgtgtgtgtgtgtgtgtgtctgtctgtctgtctgtctgtgtaacctgtgcttccgtctatgctc

SEQ ID NO: 595 - DNA, 313 bp, Homo sapiens
  AL096888.30_24401
  Located on chromosome 1
  Distance between a terminus base of telomere on chromosomal short arm and 5'-terminus of this base sequence : 62774249
  Distance between 3'-terminus of neighbour sequence of sequence listing upward to telomere on chrosomal short arm and 5'-terminus of this base sequence : -121
tgcaggatttactttcatagactgccgtgcaggggtgtgtgtgtgtgtgtgtgtgtgtgtgtgtgtgtgtgtgtgtctgtctgtctgtctgtctgtgtaacctgtgcttccgtctatgctcctggacagcttttttttgcatattttcctatcttctgatcttcacagtgcagacaaaggtcaaaattcccatctaccttcacaggcaaacactttaaagtgcttctacatgaggcaggttgtagggaggacctttgatttaaagttcagcatttacatttgtaattttgactaatttctgtgctagcattaa

SEQ ID NO: 596 - DNA, 421 bp, Homo sapiens
  AL137855.8_20703
  Located on chromosome 1
  Distance between a terminus base of telomere on chromosomal short arm and 5'-terminus of this base sequence : 62943587
  Distance between 3'-terminus of neighbour sequence of sequence listing upward to telomere on chrosomal short arm and 5'-terminus of this base sequence : 169025
gagccactttcataatttattgagagataaatcttgctgcacatctctagagacagtagacaatctcactttctctctcctcttctctttctcctttctctctttttctctgtttctcaccctcttctgcttccttccttctctccttccttccttccttccttccttccttcctctcttcctctctccccttctctccctctgtctctcataatggagtgtggttggaaaatcctgcttaattcctacatttaactcttaagtgccaccttttcacaatatctggctcagcaaatcacagagatgcagataaataaggaccagacaagtttcattttcaaggctgggagtagggtggaggagggtgtcagacagatgtaggaggaagaaagtgggcctcataagctatggttcttgaagt

SEQ ID NO: 597 - DNA, 163 bp, Homo sapiens
  D1S476
  Located on chromosome 1
  Distance between a terminus base of telomere on chromosomal short arm and 5'-terminus of this base sequence : 62989302
  Distance between 3'-terminus of neighbour sequence of sequence listing upward to telomere on chrosomal short arm and 5'-terminus of this base sequence : 45294
gcccattttgaattggattatttatcttcttgttattgagttgtatacacacacacacacacacacacacacacacagacacgtacacacaaacactttggataccagttatttgccagacaaacactttgtgaatgttttttccaagtctatggcttgtctt

SEQ ID NO: 598 - DNA, 174 bp, Homo sapiens
  Z24081.1_103
  Located on chromosome 1
  Distance between a terminus base of telomere on chromosomal short arm and 5'-terminus of this base sequence : 62989322
  Distance between 3'-terminus of neighbour sequence of sequence listing upward to telomere on chrosomal short arm and 5'-terminus of this base sequence : -143
tttatcttcttgttattgagttgtatacacacacacacacacacacacacacacacagacacgtacacacaaacactttggataccagttatttgccagacaaacactttgtgaatgttttttccaagtctatggcttgtctttcatttccttaacaaggtctttatttcaaga

SEQ ID NO: 599 - DNA, 365 bp, Homo sapiens
  AL109944.19_93044
  Located on chromosome 1
  Distance between a terminus base of telomere on chromosomal short arm and 5'-terminus of this base sequence : 63122779
  Distance between 3'-terminus of neighbour sequence of sequence listing upward to telomere on chrosomal short arm and 5'-terminus of this base sequence : 133283
tgaatagaatgactgcctaagtcccttctcgttctaaaattctgcccttctcttggtgctcaataaatatttgtggaatggataaatgaatagatgtgtatgcacataggcaatacacattttcttagcagacacacatataaaaataagaatataatatgcagatagatagatagatagatagatagatagatagatagatagatagatagatttgctaagcaaaggaacattgtaagcaacaaaagcacctagcttcagggaactgaatgtaaaaacacttatacacattaataacattgttttataattacgtcacatgccaattaagcaaaaacacaactgctccatatcattagttattc

SEQ ID NO: 600 - DNA, 233 bp, Homo sapiens
  AL390761.4_47205
  Located on chromosome 1
  Distance between a terminus base of telomere on chromosomal short arm and 5'-terminus of this base sequence : 63122875
  Distance between 3'-terminus of neighbour sequence of sequence listing upward to telomere on chrosomal short arm and 5'-terminus of this base sequence : -269
tgtatgcacataggcaatacacattttcttagcagacacacatataaaaataagaatataatatgcagatagatagatagatagatagatagatagatagatagatagatagatagatttgctaagcaaaggaacattgtaagcaacaaaagcacctagcttcagggaactgaatgtaaaaacacttatacacattaataacattgttttataattacgtcacatgccaatta

SEQ ID NO: 601 - DNA, 239 bp, Homo sapiens
  D1S2650
  Located on chromosome 1
  Distance between a terminus base of telomere on chromosomal short arm and 5'-terminus of this base sequence : 63350510
  Distance between 3'-terminus of neighbour sequence of sequence listing upward to telomere on chrosomal short arm and 5'-terminus of this base sequence : 227402
gatccagaatccatgtgaagaagaaataggaactctacctccatcaaaggagaatggtgtgtgtgtgtgtgtgtgtgtgtgtgtgtgtgtgtgtgtgtgggtggggagagactgaagttcccgctgctgggctgctaagagaagggtgagcaaggactgtgctgtggctcctctaggtgtctgtgctgagaaaggcatggtgtcattgctttttgacatggcactgatgtttggttcac

SEQ ID NO: 602 - DNA, 246 bp, Homo sapiens
  chr1.fa.O7frz.66002807
  Located on chromosome 1
  Distance between a terminus base of telomere on chromosomal short arm and 5'-terminus of this base sequence : 63398300
  Distance between 3'-terminus of neighbour sequence of sequence listing upward to telomere on chrosomal short arm and 5'-terminus of this base sequence : 47551
taggcactcaatctatgtgaactactattttaatagtagcaagcattgaacaaatatttatctgcaatctcttgtctgaattataaaatccaaagagctctgaaaatcaaatattgtgtgtgtgtgcgtgtgtgtgtgtgtgtgtgtgtgtgtgtgtatgcttaattcaatttggcagcaaaatctaagctggcctgaactaatttggtggcacaaactgacatgaactgacagaatgctacttat

SEQ ID NO: 603 - DNA, 265 bp, Homo sapiens
  chr1.fa.O7frz.66038047
  Located on chromosome 1
  Distance between a terminus base of telomere on chromosomal short arm and 5'-terminus of this base sequence : 63433566
  Distance between 3'-terminus of neighbour sequence of sequence listing upward to telomere on chrosomal short arm and 5'-terminus of this base sequence : 35020
tacaatctaggcagaatgtgaggagcagaaaaatgcaccaccagatcaccaggcttgaaacagacaggagtcctgtgtcatgcagttcttcattcattcattcattcattcattcattcattagcaatgtgctaggaatacagaaaggaatgtggtgtggtttctgctctcaagactttacaacctggcaggaaaaacagagatatatatatacagggctctgccacaggtaagaagcacctgtaccaagtaccaggagactaaa

SEQ ID NO: 604 - DNA, 201 bp, Homo sapiens
  D1S2869
  Located on chromosome 1
  Distance between a terminus base of telomere on chromosomal short arm and 5'-terminus of this base sequence : 63575087
  Distance between 3'-terminus of neighbour sequence of sequence listing upward to telomere on chrosomal short arm and 5'-terminus of this base sequence : 141256
aagcagcaaaatggcatgcttggtccagaacgtgtgtgtgtgtgtgtgtgtgtgtgtgtgtgtgtgtgtttgcaagtgtgtttgagtgcatatgtgtggtgagtggtgatgagaaagatttaaggctgataagagaggattcatgttcacttttggctttcttagtcattagcaaagcactttatggggaacgctgtatgc

SEQ ID NO: 605 - DNA, 252 bp, Homo sapiens
  HUMUT2271
  Located on chromosome 1
  Distance between a terminus base of telomere on chromosomal short arm and 5'-terminus of this base sequence : 63623390
  Distance between 3'-terminus of neighbour sequence of sequence listing upward to telomere on chrosomal short arm and 5'-terminus of this base sequence : 48102
aatgctgggggtgacagtccatggttctgactcatctagcagtagctgctagagttttctctaccactgggatgctgagctcttgtctctataactggaacatatagatggatggatggatggatggatggatggatggatggatggatggatagatggatggagaaaaggaaaaccagggagaaatgtgtgcactctaggtagttccttagacttacacttttgaaatggagcagaatggttttcaggggc

SEQ ID NO: 606 - DNA, 287 bp, Homo sapiens
  D1S2648
  Located on chromosome 1
  Distance between a terminus base of telomere on chromosomal short arm and 5'-terminus of this base sequence : 63713754
  Distance between 3'-terminus of neighbour sequence of sequence listing upward to telomere on chrosomal short arm and 5'-terminus of this base sequence : 90112
agcttctggcaagagactttgtgctgcgacatcccatggtagaaggctgaagggcaagagagtccatgcataagagagagagagagagagagagagagagagtgtgtgtgtgtgtgtgtgtgtgtttgtgtgtgtgtgtgcttgtctgtgtctgtgtggagggggggaggcgggggagagagagagagagagaaagagaaaaggctgaactgattttttaaatcaggaacccattcacacaataacccattcctgaaagaatagtattaactcatttatgagggcag

SEQ ID NO: 607 - DNA, 489 bp, Homo sapiens
  AL365187.7_75636
  Located on chromosome 1
  Distance between a terminus base of telomere on chromosomal short arm and 5'-terminus of this base sequence : 63750228
  Distance between 3'-terminus of neighbour sequence of sequence listing upward to telomere on chrosomal short arm and 5'-terminus of this base sequence : 36187
gccttcaataaacgtttgtagaagtgtacaatcatctcatttactcttcacagcagccccaggaagtacactgaggccattcttcccatttgacaaagagggaatttgaggttggcagctacaaaacagcaaagctgggactttctctttatttatttatttatttatttatttatttatttatttatttttatttttaattttatttatttatttatttttgagatggagtctcattctgtcacccaggttggagtgcagtggtgcagtctcggctcactgcaacctctgcctcacaggttcaagagattcttgtgcctcagcctcccaagcaggtgggattacaggtgtgcagcaccgcacccagctaatttttgcagttttagtagagatggggttttgccatgtttcccaggctggtcttgaactcctaacctcaagtgatccgcctgccttggcctcccaaagtgctgaaattataggcatgag

SEQ ID NO: 608 - DNA, 354 bp, Homo sapiens
  AL109845.8_120679
  Located on chromosome 1
  Distance between a terminus base of telomere on chromosomal short arm and 5'-terminus of this base sequence : 63779617
  Distance between 3'-terminus of neighbour sequence of sequence listing upward to telomere on chrosomal short arm and 5'-terminus of this base sequence : 28900
cctatagtcctagctactctggaggctgaagtgggaaaattgctttagcccaggacttcaaagctgcagtgaactatgattccaccactgcactccagcctagggaacaaagccagactatagatagatagatagatagatagatagataaatagatagatagatagatattaaaaagtataaactttcagtcaggaaaagtagcttctggagatctactacacagcattgttactacagttaataaaaatgtactgtatatttgaaaattgctaagagaatagattttaaacattcttgccacaaaaagtaagtatgtgaggtgattaatatcttagttggtttgatttaacc

SEQ ID NO: 609 - DNA, 297 bp, Homo sapiens
  AC027052.3_101717
  Located on chromosome 1
  Distance between a terminus base of telomere on chromosomal short arm and 5'-terminus of this base sequence : 63779681
  Distance between 3'-terminus of neighbour sequence of sequence listing upward to telomere on chrosomal short arm and 5'-terminus of this base sequence : -290
tgcagtgaactatgattccaccactgcactccagcctagggaacaaagccagactatagatagatagatagatagatagatagataaatagatagatagatagatattaaaaagtataaactttcagtcaggaaaagtagcttctggagatctactacacagcattgttactacagttaataaaaatgtactgtatatttgaaaattgctaagagaatagattttaaacattcttgccacaaaaagtaagtatgtgaggtgattaatatcttagttggtttgatttaaccattacac

SEQ ID NO: 610 - DNA, 243 bp, Homo sapiens
  AC025008.2_159285
  Located on chromosome 1
  Distance between a terminus base of telomere on chromosomal short arm and 5'-terminus of this base sequence : 63921482
  Distance between 3'-terminus of neighbour sequence of sequence listing upward to telomere on chrosomal short arm and 5'-terminus of this base sequence : 141504
taaagctaggtgatccagaattaagagtatggaaagaaggcttgcctttgggtccttgtcactccatctgctggccatggtatcctaaacagatcacccatcaatccatccatgtatccatccatccatatatccattcattcatgtatccatccatccatccatccatccatccatccatccatccatccatccatccaacatttactatgcatttactatatgacagatgctgtgctagac

SEQ ID NO: 611 - DNA, 358 bp, Homo sapiens
  AL035411.27_90268
  Located on chromosome 1
  Distance between a terminus base of telomere on chromosomal short arm and 5'-terminus of this base sequence : 63921485
  Distance between 3'-terminus of neighbour sequence of sequence listing upward to telomere on chrosomal short arm and 5'-terminus of this base sequence : -240
agctaggtgatccagaattaagagtatggaaagaaggcttgcctttgggtccttgtcactccatctgctggccatggtatcctaaacagatcacccatcaatccatccatgtatccatccatccatatatccattcattcatgtatccatccatccatccatccatccatccatccatccatccatccatccatccaacatttactatgcatttactatatgacagatgctgtgctagaccctggagatagagatgagccatttcagccctcaaggagcacccccttttgcgaaaaagggaaaaaaaaccaatttcatatttaagaagtaagcagtggcaacaagtccaatgttgctg

SEQ ID NO: 612 - DNA, 244 bp, Homo sapiens
  D1S2752
  Located on chromosome 1
  Distance between a terminus base of telomere on chromosomal short arm and 5'-terminus of this base sequence : 63929074
  Distance between 3'-terminus of neighbour sequence of sequence listing upward to telomere on chrosomal short arm and 5'-terminus of this base sequence : 7231
tgcagtgagccgaaatcacaccactgcactccagcctgggtggcacagtgagactgtctcaaacacacacacacacacacacacacacacacacacacacacacacacacacacacagagagagagagagagagagagagagagagagagagagaaagtgggtttaagatgtagttatcccttagtggcttcctgcttccttagcaggctactgaccatctcacccccaagagggtagtcgctg

SEQ ID NO: 613 - DNA, 176 bp, Homo sapiens
  D1S2700
  Located on chromosome 1
  Distance between a terminus base of telomere on chromosomal short arm and 5'-terminus of this base sequence : 63931984
  Distance between 3'-terminus of neighbour sequence of sequence listing upward to telomere on chrosomal short arm and 5'-terminus of this base sequence : 2666
gggttgagtggctagggcaaaaagcagaggcaggagtgtgtgtgtgtgtgtgtgtgtgtgtgtatttgtatttgaaggcaggagtggcaggaggttaggctagagaggggtgcatcgtaagtaagggtcttctgcgcttccgcgtcaggagtggtgcagaaaactcgccaagccat

SEQ ID NO: 614 - DNA, 211 bp, Homo sapiens
  AL136985.11_107345
  Located on chromosome 1
  Distance between a terminus base of telomere on chromosomal short arm and 5'-terminus of this base sequence : 64109351
  Distance between 3'-terminus of neighbour sequence of sequence listing upward to telomere on chrosomal short arm and 5'-terminus of this base sequence : 177191
aagcactcagtaaatgtttatgacacacacacacacacacacacacacacacacacacacacacaacgtcattgtcagattattttattttaggtggtcttgagtttttacttagactgcgaactctcacagacagctgtcctctgttgaagcaacagggagccactgcaggtttttgaggcagagagtttcttgatccataggtaacata

SEQ ID NO: 615 - DNA, 342 bp, Homo sapiens
  AL136985.11_137318
  Located on chromosome 1
  Distance between a terminus base of telomere on chromosomal short arm and 5'-terminus of this base sequence : 64139151
  Distance between 3'-terminus of neighbour sequence of sequence listing upward to telomere on chrosomal short arm and 5'-terminus of this base sequence : 29589
taagtgacttgcataaggtcacacaactgctatgttagcagagcttgggagccaaaccattttatggtcccctaatttctatgaatgaagctggtgctgaagaattagaactggccagaacaacactttgagcaggaagaaagtgctcattgtgataatttattttttcttgaaagttggatagagaaaaatatatgtgtgtgtgtgtgtgtgtgtgtgtgtgtgtaatagtcataaaagtatttctcagaacttgaggttttaataaaatgtgaaaaacatttttaccagcaccctcttttccctcctggtttttaggtactgcataatttaaagaaatgc

SEQ ID NO: 616 - DNA, 188 bp, Homo sapiens
  DISO7_10000621
  Located on chromosome 1
  Distance between a terminus base of telomere on chromosomal short arm and 5'-terminus of this base sequence : 64240767
  Distance between 3'-terminus of neighbour sequence of sequence listing upward to telomere on chrosomal short arm and 5'-terminus of this base sequence : 101274
aaggtatggcctatattcaactcttttgaggagttttgctatacaagagcaaagagagttggaggaggatgtgggctcaaaagaagagtgtgcatgtgtgtgtgtgtgtgtgtgtatttttgtgtgtataggagaaataacagtatttttttttgtgctactaagaattatgaagtcttagaggcaaa

SEQ ID NO: 617 - DNA, 87 bp, Homo sapiens
  DISO7_10000624
  Located on chromosome 1
  Distance between a terminus base of telomere on chromosomal short arm and 5'-terminus of this base sequence : 64393061
  Distance between 3'-terminus of neighbour sequence of sequence listing upward to telomere on chrosomal short arm and 5'-terminus of this base sequence : 152106
tctaatcaggaatttgctggcaacacacacacacacacacacacacacacacagacagacactcacactggaacccacacttcacct

SEQ ID NO: 618 - DNA, 228 bp, Homo sapiens
  D1S2741
  Located on chromosome 1
  Distance between a terminus base of telomere on chromosomal short arm and 5'-terminus of this base sequence : 64539888
  Distance between 3'-terminus of neighbour sequence of sequence listing upward to telomere on chrosomal short arm and 5'-terminus of this base sequence : 146740
atttcatatcagggacttgagcatctgcagattttggtgtctgaggggtcctggaaccaaaccaccatggataacaagggccaatgatacttggtaagtatttgccaaatgaatgaggggtgtgtgtgtgtgtgtgtgtgtgtgtgtgtgtgtgtgtgcaaatgcacatgcctgtgtgtgcgtgtgtacctaggccccttgaaaaattataaatgccagatgtgctgg

SEQ ID NO: 619 - DNA, 128 bp, Homo sapiens
  D1S2801
  Located on chromosome 1
  Distance between a terminus base of telomere on chromosomal short arm and 5'-terminus of this base sequence : 64715441
  Distance between 3'-terminus of neighbour sequence of sequence listing upward to telomere on chrosomal short arm and 5'-terminus of this base sequence : 175325
tgccacttgcttatttccttcctcacgtgtgtgcctgcgtgtgtgtgtgtgtgtgtgtgtgtgtgtgtgtgtgtgtgtattttctgatgcctccacttgactgtaagctccaggagtgcaaagatttt

SEQ ID NO: 620 - DNA, 275 bp, Homo sapiens
  D1S2770
  Located on chromosome 1
  Distance between a terminus base of telomere on chromosomal short arm and 5'-terminus of this base sequence : 64795553
  Distance between 3'-terminus of neighbour sequence of sequence listing upward to telomere on chrosomal short arm and 5'-terminus of this base sequence : 79984
aaggcttcaggttgcttcaaattgttaaattggttaccatttatctttttactttttaactttcatgattttgttgctgctattattttctgtcatatttttgtcttgatgggtttgtatattttaaaaaaatacctcttccatgtcatactcattaggatggctactattaccaaacaaaacacacacacacacacacacacacacacacacacaaaacagaaagtaagtgttggtgaagatgtggagaaattggaaaccttgtgcagtgttgg

SEQ ID NO: 621 - DNA, 299 bp, Homo sapiens
  AL390787.4_50436
  Located on chromosome 1
  Distance between a terminus base of telomere on chromosomal short arm and 5'-terminus of this base sequence : 64991320
  Distance between 3'-terminus of neighbour sequence of sequence listing upward to telomere on chrosomal short arm and 5'-terminus of this base sequence : 195492
ctggctaacacggtgaaaccccgtctctactaaaaatacaaaaaaattagccaggcgtggtggctggcgcctgtagtcccagctactcgggaggctgaggcaggagaatggcgtgaacccaggaggcggagcttgcagtgagccgagattgcgccactgcactccagcctgggcgacagagtgagactccgtctcaaaaaataaataaataaataaataaatagatatcaattaatcaacaatagaattaaaaacagagccctataaaatgcagctggttctgacaggctaaatactgg

SEQ ID NO: 622 - DNA, 360 bp, Homo sapiens
  AL390787.4_4547
  Located on chromosome 1
  Distance between a terminus base of telomere on chromosomal short arm and 5'-terminus of this base sequence : 65019581
  Distance between 3'-terminus of neighbour sequence of sequence listing upward to telomere on chrosomal short arm and 5'-terminus of this base sequence : 27962
ctcaggctattagttaagtgacaaatttgaatttgctttctagtgtgtgaggaagtttctcagcatgttttactagttttacatccttgttcaaaaatatatcctaaggtctaaatttattttctttctttctttctttctttctttctttctttctttctttctttctttctttctttctttctttttctttctttctttcttttttttcttcctttcttcctttctattttcttcccctttctttccccccttcctctcttccttccttctccttccttccttccttccctccctccctccttccttccgtctttccttccctctttccttccctccttctatccttgcttcatcttg

SEQ ID NO: 623 - DNA, 163 bp, Homo sapiens
  D1S209
  Located on chromosome 1
  Distance between a terminus base of telomere on chromosomal short arm and 5'-terminus of this base sequence : 65288680
  Distance between 3'-terminus of neighbour sequence of sequence listing upward to telomere on chrosomal short arm and 5'-terminus of this base sequence : 268739
aaacatcagtgttccatcatagactatgtcatcctaattatatatattatgtccccaaaagccatacacacacacacacacacacacacacacacacacacacacacacatatatatacacacatatatatatatatttatacatgttatgtcccccaaagct

SEQ ID NO: 624 - DNA, 401 bp, Homo sapiens
  AL356853.8_46595
  Located on chromosome 1
  Distance between a terminus base of telomere on chromosomal short arm and 5'-terminus of this base sequence : 65331142
  Distance between 3'-terminus of neighbour sequence of sequence listing upward to telomere on chrosomal short arm and 5'-terminus of this base sequence : 42299
cattctgttgatgttatgtgtcacataaattgatttgcatttattgaatcatccttaggataaatgccacttgatcatgaagaatgatcttttaaatttgttgtagatttcagtttgctagtattttgtggaggatttttgcatcagtgttcatcagggggatattggcctgtagttttctttctctttctttctttctttctttctttctttctttctttctttctttctttctttctttctttctttcttcctttctttctttcttgtttctttctctcttttgacatgtctttgtctggtttttgtatcaaggtaatactggccacatagaatgagttcagaagtattctttcctcctctagttttcagaataggttgagtaggattggtgttagttc

SEQ ID NO: 625 - DNA, 220 bp, Homo sapiens
  D1S246
  Located on chromosome 1
  Distance between a terminus base of telomere on chromosomal short arm and 5'-terminus of this base sequence : 65682846
  Distance between 3'-terminus of neighbour sequence of sequence listing upward to telomere on chrosomal short arm and 5'-terminus of this base sequence : 351303
cctgggctcaagcaatcctcctgcctcagtctcccaaagtgctgggattataggcatgaaccactgaacctaacctagattctgtctcaacacacacacacacacacacacacacacacacacacacacacacacacacagagatgttagtgttatttcttctagtgtaagtgagtatttaatcttttttatgtcaaaagagccaccattatttattgct

SEQ ID NO: 626 - DNA, 182 bp, Homo sapiens
  D1S230
  Located on chromosome 1
  Distance between a terminus base of telomere on chromosomal short arm and 5'-terminus of this base sequence : 65724985
  Distance between 3'-terminus of neighbour sequence of sequence listing upward to telomere on chrosomal short arm and 5'-terminus of this base sequence : 41919
cagctgcatgtaagtgctgaggatttttatgttttgcggtgtgtgtgttgtgtgtgtgtgtgtgtgtgtgtgtgtctgtgtgtgtgtgtggtgtgttgtttttttgagacagggtctcactctgtcccccaggctggagtgcagtggcacaatcatggctcacagcagccttgatctgccag

SEQ ID NO: 627 - DNA, 444 bp, Homo sapiens
  chr1.fa.O7frz.71018793
  Located on chromosome 1
  Distance between a terminus base of telomere on chromosomal short arm and 5'-terminus of this base sequence : 65773277
  Distance between 3'-terminus of neighbour sequence of sequence listing upward to telomere on chrosomal short arm and 5'-terminus of this base sequence : 48110
tagaagcaagatagagctgattaggttagatctctttcactgtctcagtcataattttgcaaaggcggtttcaatgctagactatgaactactgccaggctatgagctactacatgagccataggctatcagctactgctttcctacatatcaggaatagactaggggaaaagtatcattcacaatagtaatgaacatcaattttacaattttactcaggaataatatatatatatataatatatatattttaaacagggtctcactccaacacccaggttggagtgcagtggtgcattctcagctcactgcagcctcaacttcctgggctcacgtgatccacccaccacagcctcctgagtagctgggactacaggtgcgtaccaccatgcctgggtaatttttacactttttatagagatagggtttcgtcatgttgtccag

SEQ ID NO: 628 - DNA, 433 bp, Homo sapiens
  chr1.fa.O7frz.71130849
  Located on chromosome 1
  Distance between a terminus base of telomere on chromosomal short arm and 5'-terminus of this base sequence : 65881303
  Distance between 3'-terminus of neighbour sequence of sequence listing upward to telomere on chrosomal short arm and 5'-terminus of this base sequence : 107582
ggatcacctgttctacacaaggaagtcagctgatcactgatttgtcagcctgctggacagggtagtggcaaaagtcagctttggaatccaacagacacgggttcaaatgctgcttttcctatatattgagaccttgggcaagttaactaactcgtctcatggtccctgtctagtcctgccatccacctttgtcactggataattgcctaatgcttcttgctggactgaaagctccctgacagcaagaatcaagccttcttcttctgggtctttcacagttcccagagatctcttaatagggccctagaaatgcccctgccattaagtgtctcaatctttgtgtgtgtgtgtgtgtgtgtgtgtgtgtgtgtgtgtgtgtgtgagacagagtgtcactctgttgcccaggctggagtacaatggcacaatctcg

SEQ ID NO: 629 - DNA, 372 bp, Homo sapiens
  chr1.fa.O7frz.71266282
  Located on chromosome 1
  Distance between a terminus base of telomere on chromosomal short arm and 5'-terminus of this base sequence : 65998500
  Distance between 3'-terminus of neighbour sequence of sequence listing upward to telomere on chrosomal short arm and 5'-terminus of this base sequence : 116764
aggaacttgacaggaaggtgtgaaagtagagagtggagacaaactaaggccacagagagaaagggacagattcaaaagttttttgtgatgtccattttgttgctatgaaagactagagatccttaaattcttctgctgtatatcatctaaaaatactcaacaaaatactaacacacacacacacacacacacacacacacacacacacacacacaggctctgtctgactcttagatgattagaaggaaagggaaacctgaagaagtccgggatgaaatgggaacataaaagcagggaggggagtatgaatgaggaaattaacccaagaagttgatggtgacaccatcagataacctagaagcatacatggac

SEQ ID NO: 630 - DNA, 432 bp, Homo sapiens
  chr1.fa.O7frz.71421857
  Located on chromosome 1
  Distance between a terminus base of telomere on chromosomal short arm and 5'-terminus of this base sequence : 66088564
  Distance between 3'-terminus of neighbour sequence of sequence listing upward to telomere on chrosomal short arm and 5'-terminus of this base sequence : 89692
tggattagaaactctagtgaaagagagagattaacaaaccagatttttaagatacaagaaaaaaatctaactatatgctgtttttaaaagaagtatctaaaacataatacaaaaatgttgaaagggatgaaaaagtcatgctatacacacacacacacacacacacacacacagagcaaagaaaacctagtgtaattataactactttaaaaagcatcatagttcatgtagatgaaagtgcaatccaccaaaaattatataaaagtgttaaatgtttcataatcaggcctcaaaagaaacaaaaatctgacagaatgacaaggagaaattacaaaaccacaattgtagtgggatattagaataagcatgcaaaatttagtaaagaccaaaaagatttaaacaacaagagtacaggacatagaatgctgtaac

SEQ ID NO: 631 - DNA, 343 bp, Homo sapiens
  chr1.fa.O7frz.71620276
  Located on chromosome 1
  Distance between a terminus base of telomere on chromosomal short arm and 5'-terminus of this base sequence : 66318720
  Distance between 3'-terminus of neighbour sequence of sequence listing upward to telomere on chrosomal short arm and 5'-terminus of this base sequence : 229724
gatcaacatcagtatcgatcagggagatgcaaattaaaaccacagtgagatgccacctcacagccactagactgactagaatcataaggacagatattaataagagttgatgagggtgtggagaaattggagttctcatatacaactggtgggaatgtaatatggtgcagtcactttggaaaacattctatcaactccttaaaaggttaaacataagttactatatgacctaggaattccactcctagaaatatacccaagagaaatgaagatagatagatagatagatagatagatagatagatagatagatagatagagaaacttgtacaccaatattcat

SEQ ID NO: 632 - DNA, 283 bp, Homo sapiens
  chr1.fa.O7frz.71711702
  Located on chromosome 1
  Distance between a terminus base of telomere on chromosomal short arm and 5'-terminus of this base sequence : 66410890
  Distance between 3'-terminus of neighbour sequence of sequence listing upward to telomere on chrosomal short arm and 5'-terminus of this base sequence : 91827
agttaggctttatgaagtctgatcagctgctctaaaatcaacctaacttctactttttcccttatttttttctttttactttcaaacctgtaaaaacattgaaatggtagtatgacaaatacctgtacatccttttacctagattcactagttgttaacatagtgcctcttttgctctcattccttgctgttagacaagtgctgtttctctctctataaatacacacacacacacacacacacacacacacctttttttcttgctgaactatttgaaagtaag

SEQ ID NO: 633 - DNA, 189 bp, Homo sapiens
  D1S2835
  Located on chromosome 1
  Distance between a terminus base of telomere on chromosomal short arm and 5'-terminus of this base sequence : 66484002
  Distance between 3'-terminus of neighbour sequence of sequence listing upward to telomere on chrosomal short arm and 5'-terminus of this base sequence : 72829
gtgagccgtgagccgtgatcatgccactgcactccagcctggacgacagagtgagagtatgtttcagaagaaagaagcttggaaaatagaacacacacacacacacacacacacacacacacacacacacacacacacacagagagacacaaacacatgagaaaaatcactgtttcattcagaggtaac

SEQ ID NO: 634 - DNA, 271 bp, Homo sapiens
  AL354886.9_119987
  Located on chromosome 1
  Distance between a terminus base of telomere on chromosomal short arm and 5'-terminus of this base sequence : 66595584
  Distance between 3'-terminus of neighbour sequence of sequence listing upward to telomere on chrosomal short arm and 5'-terminus of this base sequence : 111393
gtggaacagtctacctgtatgattaggggacatttatttatttatttatttatttatttatttatgagacagggtcttgctgtgtcacccaggctcgagtgcagtggcaggatcacggctcactgcagcctcgccctccccagctcaaggaatcctcctgcttcagcctcccaagtagctgagactacaggcacatgccaccagacctcgctaattttttatttttttatttttttatttttggtacagacaagttctcactatgttggct

SEQ ID NO: 635 - DNA, 451 bp, Homo sapiens
  chr1.fa.O7frz.72138335
  Located on chromosome 1
  Distance between a terminus base of telomere on chromosomal short arm and 5'-terminus of this base sequence : 66745010
  Distance between 3'-terminus of neighbour sequence of sequence listing upward to telomere on chrosomal short arm and 5'-terminus of this base sequence : 149155
attcaagtactaaccaggcttaactctgcctcatctccaagatcagatgagatcaagagaaaagatttacttataaagacctttatgggcctgacgtggtggctcatgcctgtaatcccagcactttgggaggctgaggagggcagatcacttgaggtcaggtgttcaagaccagcctggccaacatggtgaaaccccgtctctactaaaaatacaaaaattagctgggcgggatgcgctcctgtaatcccagctactcgggaggctgaagcaggaaaatcgcttgaacccaggaggtggaggttgcagtgagccgagattgcgccaccgcactccagcctgggcaatagagtgagattcagtctcaaaaaaagaaagaaagaaagaaagaaagaaagaaagaaagaaagaaagaaagaaagaaagaaagaaagacctttatgacagcatt

SEQ ID NO: 636 - DNA, 220 bp, Homo sapiens
  D1S2638
  Located on chromosome 1
  Distance between a terminus base of telomere on chromosomal short arm and 5'-terminus of this base sequence : 66846646
  Distance between 3'-terminus of neighbour sequence of sequence listing upward to telomere on chrosomal short arm and 5'-terminus of this base sequence : 101185
aggtttcagggtggctcccaaattattaggcttttaaaatattgtgtgtgtgtgtgtgtgtgtgtgtgtgtgtgtaattttgagtatctactatgtaccaggtactttagaaggccctttaaaaatatgtactactgttattaggtaagaatgaatgcttgagtccagattcattcaatcaagtcatttgacaagtttctttagtacccaccaatccaag

SEQ ID NO: 637 - DNA, 170 bp, Homo sapiens
  D1S438
  Located on chromosome 1
  Distance between a terminus base of telomere on chromosomal short arm and 5'-terminus of this base sequence : 67089354
  Distance between 3'-terminus of neighbour sequence of sequence listing upward to telomere on chrosomal short arm and 5'-terminus of this base sequence : 242488
ctgagataggaggatcaacttagcccaggatgatcaaggctgctactgtatgtactccagcgtgggtgacagagggagatgcacacacacacacacacacacacacacacacacacacacacacacacacaatgaatgctatttgtaatacattcacaggatcacaggat

SEQ ID NO: 638 - DNA, 185 bp, Homo sapiens
  Z23669.1_96
  Located on chromosome 1
  Distance between a terminus base of telomere on chromosomal short arm and 5'-terminus of this base sequence : 67089395
  Distance between 3'-terminus of neighbour sequence of sequence listing upward to telomere on chrosomal short arm and 5'-terminus of this base sequence : -129
gctactgtatgtactccagcgtgggtgacagagggagatgcacacacacacacacacacacacacacacacacacacacacacacacacaatgaatgctatttgtaatacattcacaggatcacaggattttaagaattgggtagaacctttgagattattgagtatgaaacctccaaagtttat

SEQ ID NO: 639 - DNA, 288 bp, Homo sapiens
  HUMUT6372
  Located on chromosome 1
  Distance between a terminus base of telomere on chromosomal short arm and 5'-terminus of this base sequence : 67094656
  Distance between 3'-terminus of neighbour sequence of sequence listing upward to telomere on chrosomal short arm and 5'-terminus of this base sequence : 5076
tacactctagccagggcgacagagccagaatctgtctcaaaaaaggaacgaaggaaaggaaagaaggaaggaaggaaggaaaggaaggaaggaaggaaggaaaggaaggaaggaaggaaggaaggaaggaaggaaggaaggaaggaaggaaggaagggcatatttcttagctctttccacagaaaggactaaaaccaaaaagcaacccaatagcaatgagcatcctcagcacatagaatgtggtcttgaaataccatttcctgctaaaaggaaccagggttcttgaag

SEQ ID NO: 640 - DNA, 315 bp, Homo sapiens
  AL109925.11_30296
  Located on chromosome 1
  Distance between a terminus base of telomere on chromosomal short arm and 5'-terminus of this base sequence : 67400846
  Distance between 3'-terminus of neighbour sequence of sequence listing upward to telomere on chrosomal short arm and 5'-terminus of this base sequence : 305902
gaggtcaggagttcgagaccagcctggccaacatggcgaaaccctgtctctactaaaactacaaaaattagctgagcatggtggcgggcacctataatcccagctactcgggaggctgagacaggagaatcgcttgagcctggggggcagaggttgcagtgagccaagatcatgccactttactccagcctgggcgaaagagcgaaactccgtctcaaaaaataaaattttacatatatatatatatatatatatatatatatatatatatatatatatatagtattaaacatctaccttaagtgctatccactt

SEQ ID NO: 641 - DNA, 304 bp, Homo sapiens
  D1S1613
  Located on chromosome 1
  Distance between a terminus base of telomere on chromosomal short arm and 5'-terminus of this base sequence : 67522359
  Distance between 3'-terminus of neighbour sequence of sequence listing upward to telomere on chrosomal short arm and 5'-terminus of this base sequence : 121198
tatttgtcctaatgctctccctcccctttcccccaacctccaatgggccccggtatatgatgttcccctccctgtatccatgtgttctcaaacaatgtcttttgaaaagcaaaagattttaattttgaataagtccagtttatcaagtcttccttccttccttccttccttccttccttccttccttccttctttccttcctttcttccctccttctttgtctcactctgtctgacaccatcttggctcactgcaacctctacctcctgggctcaagtgattctcccatctcagccttttgagt

SEQ ID NO: 642 - DNA, 336 bp, Homo sapiens
  AC025544.4_128966
  Located on chromosome 1
  Distance between a terminus base of telomere on chromosomal short arm and 5'-terminus of this base sequence : 67541136
  Distance between 3'-terminus of neighbour sequence of sequence listing upward to telomere on chrosomal short arm and 5'-terminus of this base sequence : 18473
cactgtcaagtattaagcattgactgtggacccagcacctggcaaggcattttgtattttgtagtggaatcatattattttctccctgtagaactattgcctttctttccttccttccttccttccttccttccttccttccttccttcctgccttcctgccttcctgacttcctttctttccttccttctcttttttttttttttcttttttgatggagtttcactcttgttgcccaagctggagtgcaatggtgcgatctcagctcactacaacctccgcctcccaggttcaagcaattctccagcctcagcctcctgagtagctggaattaca

SEQ ID NO: 643 - DNA, 329 bp, Homo sapiens
  AC025544.4_163987
  Located on chromosome 1
  Distance between a terminus base of telomere on chromosomal short arm and 5'-terminus of this base sequence : 67592974
  Distance between 3'-terminus of neighbour sequence of sequence listing upward to telomere on chrosomal short arm and 5'-terminus of this base sequence : 51502
aagtcagatctgtccatctaagatgcttttaagtaacatttaccttaaagaaatagatggttgattggtttaaagaaagagacagctgaattggacggggaagccagattttgaccatatttctaagaggagctgttctgtaatgttttggtaaaagaatgtctgtctccatatcatctatctatctatctatctatctatctatctatctatctatctatctatctatctaatttggcatctatttatccattaatctgtctgtaatacaaatattccaaacatttaaaaagtataagaaggctctgtagtgcaatggatagcacatt

SEQ ID NO: 644 - DNA, 351 bp, Homo sapiens
  AL353713.7_81934
  Located on chromosome 1
  Distance between a terminus base of telomere on chromosomal short arm and 5'-terminus of this base sequence : 67617275
  Distance between 3'-terminus of neighbour sequence of sequence listing upward to telomere on chrosomal short arm and 5'-terminus of this base sequence : 23972
aggtcctggactagatgtacagaatgatcgtgatcactgaggttccttctaatttgtcaccatctatgggtctgtgataatgcaaagctgtgtgcttgccagctgaaactgaaatgaaggaaagtgattaattcatttcacaaactgaaatgaaggaaagctattaatctgatggcgtatttttctttatttgtgataagtttcacagactacattttccagcattcaacactgccattgtattgtattgtattgtattgtattgtattgtattgtattgtattgtattgtattgtattgtattgtattgtattgtattgtattgtattgtatcatagatggcgatacttg

SEQ ID NO: 645 - DNA, 215 bp, Homo sapiens
  D1S515
  Located on chromosome 1
  Distance between a terminus base of telomere on chromosomal short arm and 5'-terminus of this base sequence : 67630409
  Distance between 3'-terminus of neighbour sequence of sequence listing upward to telomere on chrosomal short arm and 5'-terminus of this base sequence : 12783
tccatgaaagagtatgtatgcatgtgtttccacgaaaggggtgtgtgtgtgtgtgtgtgtgtgtgtgtgtgtgtgtgcgcgtgtgtgtgtgagaacatgtgtttaggtcagttctttcattcgttctctttcttcctcttctttttgtcgtttcaaggctatgttttaggttggctatacagcaatgaggttgcactacacagcctcatccccta

SEQ ID NO: 646 - DNA, 345 bp, Homo sapiens
  AL359769.4_153658
  Located on chromosome 1
  Distance between a terminus base of telomere on chromosomal short arm and 5'-terminus of this base sequence : 67694052
  Distance between 3'-terminus of neighbour sequence of sequence listing upward to telomere on chrosomal short arm and 5'-terminus of this base sequence : 63428
aaggtacaaattaagcctggagcactttgttgtaccagaaagtatacaaacatgatcagtgatgtcaagaagacagagagaaaccagcttgaaggtcttctgctggccaaatctgggacactttgagtgatggaatagataaggacagcaatggattataaggcattgaataaaatatgaagccacaagtctattcggtgacaggtaggtaagtacgtagatagatagatagacagatagatagacagacagatagatagatagatagatagatagatagatagatagatagataatgtgaaggaaaggaaagggctcttccttaacagtgtaatgccaactgac

SEQ ID NO: 647 - DNA, 276 bp, Homo sapiens
  AL137859.3_38954
  Located on chromosome 1
  Distance between a terminus base of telomere on chromosomal short arm and 5'-terminus of this base sequence : 67761206
  Distance between 3'-terminus of neighbour sequence of sequence listing upward to telomere on chrosomal short arm and 5'-terminus of this base sequence : 66809
cttgtatgccttatagctaatgaccctgggtcctctaaggtcctgtccagccctaatattctctagtaatgttctgagtgtgtgtgtgtgtgtgtgtgtgtgtgtgtgtagacatagcctgaggggaggttagtataaccccattacaatatattagtagcgtggattaaattttcaaaaaacaagaacaacaaccaagattatttgtatattacagtctattattaaagagttttaacagcccgtaagtacttctaacagtccataagtacttca

SEQ ID NO: 648 - DNA, 233 bp, Homo sapiens
  D1S2617
  Located on chromosome 1
  Distance between a terminus base of telomere on chromosomal short arm and 5'-terminus of this base sequence : 67761223
  Distance between 3'-terminus of neighbour sequence of sequence listing upward to telomere on chrosomal short arm and 5'-terminus of this base sequence : -259
taatgaccctgggtcctctaaggtcctgtccagccctaatattctctagtaatgttctgagtgtgtgtgtgtgtgtgtgtgtgtgtgtgtgtagacatagcctgaggggaggttagtataaccccattacaatatattagtagcgtggattaaattttcaaaaaacaagaacaacaaccaagattatttgtatattacagtctattattaaagagttttaacagcccgtaagt

SEQ ID NO: 649 - DNA, 137 bp, Homo sapiens
  D1S2684
  Located on chromosome 1
  Distance between a terminus base of telomere on chromosomal short arm and 5'-terminus of this base sequence : 67867372
  Distance between 3'-terminus of neighbour sequence of sequence listing upward to telomere on chrosomal short arm and 5'-terminus of this base sequence : 105916
ttgatctgggcagcatatttttaacatctggatttttttgttttcttgttgtgtgtgtgtgtgtgtgtgtgtgtgtgtgtgtgtgtgtttaaatcactgtttaggctgggcatggtggctcatgcctgtaatctcag

SEQ ID NO: 650 - DNA, 225 bp, Homo sapiens
  D1S2710
  Located on chromosome 1
  Distance between a terminus base of telomere on chromosomal short arm and 5'-terminus of this base sequence : 67957192
  Distance between 3'-terminus of neighbour sequence of sequence listing upward to telomere on chrosomal short arm and 5'-terminus of this base sequence : 89683
gcaaacctatccagttgctacacagatgctagatgctaggtacacacacacacacacacacacacacacacacgcacacatgcacacacgcacacatgcatgcacaggataagatatgctatgactgcgccaaggcactccagcctaagcaacagaggaaaactctctaaaaaacaaaaagatagaaaaaatacaagatgctggccagccagtgagtatatctgt

SEQ ID NO: 651 - DNA, 398 bp, Homo sapiens
  AC025697.2_36289
  Located on chromosome 1
  Distance between a terminus base of telomere on chromosomal short arm and 5'-terminus of this base sequence : 67961529
  Distance between 3'-terminus of neighbour sequence of sequence listing upward to telomere on chrosomal short arm and 5'-terminus of this base sequence : 4112
agacctttgttcacttgtttatctgctgaccttccctccactattgtcctatgaccctgccaaatccccctctgcgagaaacacccaagaatgatcaataaaataaataaataaataaataaataaataaataaatcagagcatgacactctcctgtttaaacccattaaatggattcccatagctattcaaataaagcccaaacttcctactgtatagtgcccatctttatcacacccctcccaggctcctccacaacctccctgaccttcccttgttcccttttcaagacaagctctttcctgactcaaaaatatcttgttttcctcttcctagaactctctgccctcaatatttcatgtagcaggctccttctcatctttcatgtatgagttcaa

SEQ ID NO: 652 - DNA, 297 bp, Homo sapiens
  AC025697.2_93556
  Located on chromosome 1
  Distance between a terminus base of telomere on chromosomal short arm and 5'-terminus of this base sequence : 68121352
  Distance between 3'-terminus of neighbour sequence of sequence listing upward to telomere on chrosomal short arm and 5'-terminus of this base sequence : 159425
tgcctgcagtcctagctacttgggaggctgaagaggagggattgcttgagcccaggaagttgaggctgcagtgagccgtgatcgtgccacttcactccagcctgggcgacagggtgagaacaaagaaagatgaaagagaggaaggaaggaaagaaggaaggaaggaaggaaggaaggaaggaaggaaggaaggaaggaagggaaattctgacacatactataacatagatgaatcttaaagacaagtcagtcactaaaggacaaatattgtaagtttccacttaaatatggtacctg

SEQ ID NO: 653 - DNA, 387 bp, Homo sapiens
  AC061976.2_169707
  Located on chromosome 1
  Distance between a terminus base of telomere on chromosomal short arm and 5'-terminus of this base sequence : 68157707
  Distance between 3'-terminus of neighbour sequence of sequence listing upward to telomere on chrosomal short arm and 5'-terminus of this base sequence : 36058
aaggaagaaattagtcaggcacgatggtgcacgcctgtagtcccagctacttgggaggctgaggtgggaggattgcttgagcctggaaggtagaggcttcagtgaaccaagattgcaccactgcactccagcctgggtgatccctgactcaaaaataaataaataaataaataaataaataaataaataaataaataaataagctattgctgagtcatataactggctttatgaaagaagaactgtgtggagttggagccactccatgaagtcactctcagagtgtcaactgatagttgtcttttgagtccgcttgattctaaaataaacttaaacttctatttttcatgatcaatgccccctctctttatggtactagagctgtgc

SEQ ID NO: 654 - DNA, 333 bp, Homo sapiens
  chr1.fa.O7frz.73845209
  Located on chromosome 1
  Distance between a terminus base of telomere on chromosomal short arm and 5'-terminus of this base sequence : 68402784
  Distance between 3'-terminus of neighbour sequence of sequence listing upward to telomere on chrosomal short arm and 5'-terminus of this base sequence : 244690
ctacagtaatctgaggcatgagaatcgcttgaaccctggaggaggagattgcagtaagctgagatcatactactgcactccagcctgggtaacagagcaagactcagtcttaaaatatatatatatacagacacacacacacacacacacacacacacacacacacacactctcaacattatatatatatatatatatatatatgttaaatcaaagaattacagattaggaagaagatgtaaaagtccagctctctgacttccctctttttattgtggtcatttagcctctgcttatttatctctaattgtaggaaattaatcacctttgttt

SEQ ID NO: 655 - DNA, 283 bp, Homo sapiens
  D1S2866
  Located on chromosome 1
  Distance between a terminus base of telomere on chromosomal short arm and 5'-terminus of this base sequence : 68484954
  Distance between 3'-terminus of neighbour sequence of sequence listing upward to telomere on chrosomal short arm and 5'-terminus of this base sequence : 81837
cattacagatattgacatttggggtgtgtgtgtgtgtgtgtgtgtgtgtgtgtgtgtgtgtgtgtcatagccagtttttaaaaccttcaaaaatattgctggggaaataaattttctatactttcattctgttacagtctaaaaaaaacccaataaaatgggttcacctgttccctcctcaagatatggtacatgtggacaaatcttattataaaaatagattgccaaatggggttcattcctttattctttcactcattcattcactcagcaaatacctgct

SEQ ID NO: 656 - DNA, 429 bp, Homo sapiens
  chr1.fa.O7frz.74739939
  Located on chromosome 1
  Distance between a terminus base of telomere on chromosomal short arm and 5'-terminus of this base sequence : 68549022
  Distance between 3'-terminus of neighbour sequence of sequence listing upward to telomere on chrosomal short arm and 5'-terminus of this base sequence : 63785
taacatctgcttaaatacttccagtgactggcaacccagtgtgtcctaaagagccccattgtcagatgattctagagcagtgtgactagagatgtggttctaggaccaccaacatccacacaacctggaatctggttagaaatgaagagtctcagaccccaatccagacctgaatcagaatctacattcaataggatctccaggtaattcatgtggacatccaaatttgaaaagtattgctctagtgttcatatatatatgtatacacacacacacacacacacacacacacacacacacacacacgtgtatttttcccaaaagatggcaaccaaggtcttgcaatcacattgccccattcattaattcatctgtgtattcacaaaacattttttaagagcatatgtgctaagaactgatttaacttga

SEQ ID NO: 657 - DNA, 271 bp, Homo sapiens
  chr1.fa.O7frz.74891473
  Located on chromosome 1
  Distance between a terminus base of telomere on chromosomal short arm and 5'-terminus of this base sequence : 68668474
  Distance between 3'-terminus of neighbour sequence of sequence listing upward to telomere on chrosomal short arm and 5'-terminus of this base sequence : 119023
ctttctagaatctgtatgttggatgatggaccctctgcgtagatcttccacatctcttaccttttatctcatattttcggtttctttgttttgtgtgtgtgtgtgtgtgtgttatattctgagaccttgccataccctcttcttccagtgcttctgttggatttttatatactattatttttgtaaatttccaagtattctttctcagagtattctgttctggttttatgcatattttcttaaatgttgctagaaataccaattcgaggat

SEQ ID NO: 658 - DNA, 143 bp, Homo sapiens
  DISD22_0000482
  Located on chromosome 1
  Distance between a terminus base of telomere on chromosomal short arm and 5'-terminus of this base sequence : 68937711
  Distance between 3'-terminus of neighbour sequence of sequence listing upward to telomere on chrosomal short arm and 5'-terminus of this base sequence : 268966
acttgtgctttccagcatacctctcccactctacacacacacacacacacactctctctctctctctctctctctctctctcgctctcgctctcgctctctctccatcctgttgcatttttaaagcaggctcagtcaggttac

SEQ ID NO: 659 - DNA, 475 bp, Homo sapiens
  chr1.fa.O7frz.75157426
  Located on chromosome 1
  Distance between a terminus base of telomere on chromosomal short arm and 5'-terminus of this base sequence : 69031289
  Distance between 3'-terminus of neighbour sequence of sequence listing upward to telomere on chrosomal short arm and 5'-terminus of this base sequence : 93435
caaatttccatcaatgatagactggattaagaaaatgtggcacatatacaccatggaatactatgaagccataaaaaaggatgagttcacgtcctttgtagggacatggatgaagccggaaacgatcattctcagcaaactatcacaagaacaaaaaaccaaacaccacatgttctcactcataggttggaattgaacaatgagaacacttggacacagggcggggaacatcacacactggggcctgttgtggggtgggggaagtggggagggaaagcattaggagatatacctaatgtaagtgatgagttaatgggtgcagcacaccaacatggcacatgtatacatatgtaacaaacctgcatgttgtgcacatgtaccctaaaacttaacgtataataataataataataataataataataataataataatagcatcccttgctgtgttaagaattctgtagatctgtgc

SEQ ID NO: 660 - DNA, 226 bp, Homo sapiens
  chr1.fa.O7frz.75279606
  Located on chromosome 1
  Distance between a terminus base of telomere on chromosomal short arm and 5'-terminus of this base sequence : 69187517
  Distance between 3'-terminus of neighbour sequence of sequence listing upward to telomere on chrosomal short arm and 5'-terminus of this base sequence : 155753
gctttgtaacagcattaatcacaacatatagcatgtcattttcctgctcctctctttctgggtcatgaataacttgaggaggaagaatctattttacttttgctttgaaatacacacacacacacacacacacacacacatacacacacacacacacacagaatacctaatgtatgattcaacataatgtctggcttagtaggtcatcagtaggttcaaagaataa

SEQ ID NO: 661 - DNA, 283 bp, Homo sapiens
  chr1.fa.O7frz.75394387
  Located on chromosome 1
  Distance between a terminus base of telomere on chromosomal short arm and 5'-terminus of this base sequence : 69306988
  Distance between 3'-terminus of neighbour sequence of sequence listing upward to telomere on chrosomal short arm and 5'-terminus of this base sequence : 119245
ctaacaactcctacagaacatcagcagcgatatagatgattatgctgaaggtaaaattagtacagtgaagcctgtttcagcaccgacatgcacaaacaggtacaggcgtcaaacctgaacacacacacacacacacacaatcacacacaatggtctttttgttttctttttaatgtattctcagaaagggtgctaagaaattgtcccctttgtcagcttttgatactcactcagtctgaagtatcagaataatcttaccctaaatgcatttctggtttaatac

SEQ ID NO: 662 - DNA, 459 bp, Homo sapiens
  AL356736.3_89951
  Located on chromosome 1
  Distance between a terminus base of telomere on chromosomal short arm and 5'-terminus of this base sequence : 69536637
  Distance between 3'-terminus of neighbour sequence of sequence listing upward to telomere on chrosomal short arm and 5'-terminus of this base sequence : 229366
attccatggtaacaacctgattttaaaattcatcgaaaaggtcaaagcaagagagtagctgaatacattttgaaagaaaaaatagatgacatgggtcgggcacagtggctcacgcctgtaatcccagcactttgggaggccgaggggggtggatcacgaggtcaggagatcgagaccatcctggttaacatggtgaaaccctgtctctactaaaaaatacaaaaaattagccgggcgtggtggcaggtgcctatagccccagttactctggaggctgaggcaggagaatggcgtgaatgctggaggcggagcttgcagtgagccgagatcacgccgctgcaatccagcctgggcgacagtgcgagactctgtcttaaaataaaataaaataaaataaaataaaataaaataaaataaataaaaataaaaaatataaaacgtgaacttccaggtaactaa

SEQ ID NO: 663 - DNA, 138 bp, Homo sapiens
  chr1.fa.O7frz.75711470
  Located on chromosome 1
  Distance between a terminus base of telomere on chromosomal short arm and 5'-terminus of this base sequence : 69589071
  Distance between 3'-terminus of neighbour sequence of sequence listing upward to telomere on chrosomal short arm and 5'-terminus of this base sequence : 51975
ctttgtaccttcactagaaatcagttgtctctctctctatatatatatatgtgtgtgtgtgtgtgtgtgtgtgtgtgtgtgtgtgtgtgtgtgtgtgtagtttatttctggaccctctattctgatccactgatttac

SEQ ID NO: 664 - DNA, 308 bp, Homo sapiens
  D1S198
  Located on chromosome 1
  Distance between a terminus base of telomere on chromosomal short arm and 5'-terminus of this base sequence : 69691328
  Distance between 3'-terminus of neighbour sequence of sequence listing upward to telomere on chrosomal short arm and 5'-terminus of this base sequence : 102119
caggaaagtggatgtgacgataacagtctttctcatgggtaatttaaacatgtaagtttgaaaaaattaaatcagaaagtgcacttgtagcacttggagttctccagagagacagaactgaacaaattgtgtgtgtgtgtgtgtgtgtgtgtgtgtgtgtgtgtgtgtatacatacagagagaaagagagagaggaatttttaagtaaggaattggctcacatgattgtggggactggcatggcaggtccaaaatttgtagcacaggctggcaggccagtaactcaggcaggcgttgatggtgaagtc

SEQ ID NO: 665 - DNA, 296 bp, Homo sapiens
  chr1.fa.O7frz.75906441
  Located on chromosome 1
  Distance between a terminus base of telomere on chromosomal short arm and 5'-terminus of this base sequence : 69783209
  Distance between 3'-terminus of neighbour sequence of sequence listing upward to telomere on chrosomal short arm and 5'-terminus of this base sequence : 91573
caaagatatttgtaagaatccactggcataactgagaccaaattcctctaataaagccgtgtgtgtgtgtgtttgtgtgtgtgtgtgtgtgtgtgtgtgtgtgtgtgttgaatatctgccaaaaataatgtattgttatgatttgttgtttgtttttagtattcgtttttaaagtgtccctatttttgaagaaaaaatttctacaagttttgttttccctttatctcaatcttcctttggttttcatgcaaactgggaaattttcactctgcctagatcgtcaaatttagaactca

SEQ ID NO: 666 - DNA, 235 bp, Homo sapiens
  DISO7_10000628
  Located on chromosome 1
  Distance between a terminus base of telomere on chromosomal short arm and 5'-terminus of this base sequence : 69838930
  Distance between 3'-terminus of neighbour sequence of sequence listing upward to telomere on chrosomal short arm and 5'-terminus of this base sequence : 55425
aagtgcacagtttagaatcaatgagccaggtatggtggtgtgcggtggtaatctggtggtaatgccagctgagatgggaggattacatgaccccaggaattcaggacaagcctgggcaacatagcaagattctcatctcagtttttaaaaataataaataaataaataaataaataaataaaaaacagtaatttcttttgcactagtaaaagctcacaggacctctactatatga

SEQ ID NO: 667 - DNA, 153 bp, Homo sapiens
  D1S2806
  Located on chromosome 1
  Distance between a terminus base of telomere on chromosomal short arm and 5'-terminus of this base sequence : 69880752
  Distance between 3'-terminus of neighbour sequence of sequence listing upward to telomere on chrosomal short arm and 5'-terminus of this base sequence : 41587
cattacatcacagcctgattagaatgaatttccaaaatagattaaaattaaagccttgcaaaactctctctctctctctctcacacacacacacacacacacacacacacacacacacacacacaaatatttgcaacaggtcaggcatggtgg

SEQ ID NO: 668 - DNA, 185 bp, Homo sapiens
  DISO7_10000630
  Located on chromosome 1
  Distance between a terminus base of telomere on chromosomal short arm and 5'-terminus of this base sequence : 69900717
  Distance between 3'-terminus of neighbour sequence of sequence listing upward to telomere on chrosomal short arm and 5'-terminus of this base sequence : 19812
aagagattggctcctatctaattcatattctctctctctctctctctctttctctgtgtgtgtgtgggggtgtgtgtgtgtgtgtgtgtgtgtgtgtgtgtctctttcctctctgtctaaggggaattggaaaattgctgctgaataatttttcttgaaaaagccaagtgttgatatgatgatat

SEQ ID NO: 669 - DNA, 289 bp, Homo sapiens
  DISO7_10000631
  Located on chromosome 1
  Distance between a terminus base of telomere on chromosomal short arm and 5'-terminus of this base sequence : 69967254
  Distance between 3'-terminus of neighbour sequence of sequence listing upward to telomere on chrosomal short arm and 5'-terminus of this base sequence : 66352
tcattaacatttggctgtaagtaacaaaaaaactaattaatggttttttgttgttgtttaatctcccaaaaaatataaccctaagcctttcaaatatagtgaccaaaaacatgaaaaacatatttgtatccaaaaattatatttatttactaacaatatgaaattgatttgttaagaaaattattcttaccagccttgaaatcacacacacacacacacacacacacacacacacacacacacacacacaggtttgccaaaaatgttcagattctctaagcttagcttt

SEQ ID NO: 670 - DNA, 313 bp, Homo sapiens
  chr1.fa.O7frz.76644813
  Located on chromosome 1
  Distance between a terminus base of telomere on chromosomal short arm and 5'-terminus of this base sequence : 70172232
  Distance between 3'-terminus of neighbour sequence of sequence listing upward to telomere on chrosomal short arm and 5'-terminus of this base sequence : 204689
ctatctgctaacaaggtaacaaaggcttaccccatcacacaggagagggtgaactgcagaagaaagagggtgtcagcccagccttcaaactccacagcctgcaacacacaagaaagcattaaattttagaccaggccttcaaaatcagctatcccgttttaatgtaaatccttctacgagtctgcctccaacacagacacagacacagacacagacacagacacacacacacacacacacacacacacacacacaggtatatgtttccctgaattactccaaggatagagagtgatgttcaaagatttcatgt

SEQ ID NO: 671 - DNA, 326 bp, Homo sapiens
  AL133320.8_100218
  Located on chromosome 1
  Distance between a terminus base of telomere on chromosomal short arm and 5'-terminus of this base sequence : 70252012
  Distance between 3'-terminus of neighbour sequence of sequence listing upward to telomere on chrosomal short arm and 5'-terminus of this base sequence : 79467
aaagtgacaagttatgatcgttacatttctctccaaatattgctaacacagactttgaatgctgctgacttacaataaggaaaggaatcccaagggggacaattttgcatctttctctgacctatcattggtaacaaactccatttctttatgttgaatgtaagagtgtgtgtgtgtgtgtgtgtgtgtgtgtgtgtgtgtgtgatggagtaggtggttataacaggggatttttttcagaatattctctactggctctttcaatggttattcctttctcctaagaaatggaattgtgcactgacttctggaagattctttcaaac

SEQ ID NO: 672 - DNA, 303 bp, Homo sapiens
  chr1.fa.O7frz.76807638
  Located on chromosome 1
  Distance between a terminus base of telomere on chromosomal short arm and 5'-terminus of this base sequence : 70335193
  Distance between 3'-terminus of neighbour sequence of sequence listing upward to telomere on chrosomal short arm and 5'-terminus of this base sequence : 82855
aactcaggagacaggagcttgcagtgagccaagatcgtgccattgcactccagcctgggcaacaagagggaaactctgtctcaaaaaataaataaaataaaataaataaaataaaataaaataaaataaaataaaataaaataaaataaaataagccttctgtggtgttgttgaagtatgcttttttttttctgtcactaattcttaaaaatttcacaaaccattttgtaaagcatttattggacccttactgtttgccaagcactgggccaagagctttataaatgctgcctcatttaatac

SEQ ID NO: 673 - DNA, 303 bp, Homo sapiens
  AC025693.5_162527
  Located on chromosome 1
  Distance between a terminus base of telomere on chromosomal short arm and 5'-terminus of this base sequence : 70434468
  Distance between 3'-terminus of neighbour sequence of sequence listing upward to telomere on chrosomal short arm and 5'-terminus of this base sequence : 98972
atcacttctcagtcatggctaataagggttatcttctcatgctggaacaggcaaggcagctttttctttctttctttctttctttctttctttctttctttctttctttctttctttctctctttctctctttctctctttctctctttctctttctctctttctttctttcctttaagttctgggatacatgtgcagaatgtgcacgtttgttgcataggtatacacgtgccatggtggtttgctgcacctatcaacccgtcatctaggttttaagccccacatgcattagctatttgtcct

SEQ ID NO: 674 - DNA, 459 bp, Homo sapiens
  chr1.fa.O7frz.77273038
  Located on chromosome 1
  Distance between a terminus base of telomere on chromosomal short arm and 5'-terminus of this base sequence : 70730492
  Distance between 3'-terminus of neighbour sequence of sequence listing upward to telomere on chrosomal short arm and 5'-terminus of this base sequence : 295721
caaagtgatcttcagattcaatacaattcctaacaaaataccaacataatttttcacagaattagaaatcataatcctaaaattcatatggaaccaaaaagagccaaaataaccaaagcaaccctaagcaaaacaaacaaacaaacaaacaaaaaacaaatctggaggcatcacactaccagatttcaaattctactacaaggctatagtaatcaaaacagcatggtactggtataaaagaagacacatagagaacagaatagagaacccagaaataaagccaaatacctacagccaactgatcttcaacaaagcagacaaaagcataccctggaaaaaggagactctatccaacaaggggtgctgggaaaattggatagccacacacagaagaaagaaactagatccctatctcttgccatatacaaaaattaactcaaagtggattaaagacttaaa

SEQ ID NO: 675 - DNA, 121 bp, Homo sapiens
  DISO7_10000632
  Located on chromosome 1
  Distance between a terminus base of telomere on chromosomal short arm and 5'-terminus of this base sequence : 70823029
  Distance between 3'-terminus of neighbour sequence of sequence listing upward to telomere on chrosomal short arm and 5'-terminus of this base sequence : 92078
tcaagccagagtggtgtcacggcaagcatgggtatgcacaatgtgtgtgtgtgtgtctgtgtgtgtgtgtgtgtgtgtgtgtgtgtgtgtgtgtgtagggggtggtcaggaaaccttccag

SEQ ID NO: 676 - DNA, 304 bp, Homo sapiens
  HUMUT415
  Located on chromosome 1
  Distance between a terminus base of telomere on chromosomal short arm and 5'-terminus of this base sequence : 70893824
  Distance between 3'-terminus of neighbour sequence of sequence listing upward to telomere on chrosomal short arm and 5'-terminus of this base sequence : 70674
tagtgggctttacgtctgccacaaccccaaggagtgaaaggaaactcaagactaacaatgatttgttgtaactagacgtagtggtgaaaatctggccaaaaaaaagtccactataaatgtaacagctgtgagccttaagcctggtggcatttaaaccattttattctttatagctataagagtattcaaccctaagtttacaataatatctcaaggcaaaaactcaaacaaaacaaggcacacacgcacacacacacacacacacacacacacacacacacacacacacccctaaacaatgccc

SEQ ID NO: 677 - DNA, 217 bp, Homo sapiens
  D1S2829
  Located on chromosome 1
  Distance between a terminus base of telomere on chromosomal short arm and 5'-terminus of this base sequence : 70914863
  Distance between 3'-terminus of neighbour sequence of sequence listing upward to telomere on chrosomal short arm and 5'-terminus of this base sequence : 20735
gcactccagcctaggtaacagagacttatatatatatgtgtgtgtgtgtgtgtgtgtgtgtgtgtgtgtgtgtgtgtgtgtgtgtgtatgtatatatatgtgtatatctgtgtgtgtgtatatatgtatgtgtataagtgtgtgtgtgtgtgtgtgtgtgtgtgtgtgtgtatagtccccctcctcaaggaacccacagtaagtcatataaacaact

SEQ ID NO: 678 - DNA, 155 bp, Homo sapiens
  DISO7_10000636
  Located on chromosome 1
  Distance between a terminus base of telomere on chromosomal short arm and 5'-terminus of this base sequence : 71002114
  Distance between 3'-terminus of neighbour sequence of sequence listing upward to telomere on chrosomal short arm and 5'-terminus of this base sequence : 87034
ggtggagaaccagaaaggaaaacaaaaacaaacaaacaaacaaacaaaaaacaatgttcaagaaatgaagggaagaaagaattgaaggaatggagggagtagatggtggaaagtgtgagtttctatggaaaacagatggtaaaggattaagaagc

SEQ ID NO: 679 - DNA, 447 bp, Homo sapiens
  chr1.fa.O7frz.77566015
  Located on chromosome 1
  Distance between a terminus base of telomere on chromosomal short arm and 5'-terminus of this base sequence : 71070126
  Distance between 3'-terminus of neighbour sequence of sequence listing upward to telomere on chrosomal short arm and 5'-terminus of this base sequence : 67857
tgactttcagcaaggtatttagctaagcctggtttctcattcctcatacgaagaaataatgatgtctacttagatgggaaattgtggggaccagtgagataatggacttcaagcacctcttacagtgcctagttcttagtgtttgcttaagtgaaggtaggtgttattcatagtattaatgaccagaaatgtgttataggacctttggaaaaccatcatagccctctgggcctcagatccccaagtggaaactgaaagtatggccctaaacaacttctaagctctgatatttaagatgatgaaatatcttgcaggtttattctccattccaatgtttaaaaagcctcctgccaatttcctgttttccccacccctgacacacacacacacacacacacacacacaccacatacacacaaaaaatcctatttccatcctcattctgat

SEQ ID NO: 680 - DNA, 101 bp, Homo sapiens
  DISO7_10000634
  Located on chromosome 1
  Distance between a terminus base of telomere on chromosomal short arm and 5'-terminus of this base sequence : 71087277
  Distance between 3'-terminus of neighbour sequence of sequence listing upward to telomere on chrosomal short arm and 5'-terminus of this base sequence : 16704
gctttggaagcacaacagagaaacaacagatggattaactgaaaagtgtgtgtgtgtgtgtgtgtgtgtgtgtgtgcttgtgtataacaagggagcgttcc

SEQ ID NO: 681 - DNA, 314 bp, Homo sapiens
  AL157407.4_62723
  Located on chromosome 1
  Distance between a terminus base of telomere on chromosomal short arm and 5'-terminus of this base sequence : 71171098
  Distance between 3'-terminus of neighbour sequence of sequence listing upward to telomere on chrosomal short arm and 5'-terminus of this base sequence : 83720
caggaatggtggctgtaatcccagctacttgggaggctgaggtggaaggattgcttgagcctgggaggtggaggctgcagtgagccaagactgtgccactgcacttcagcctgggcaacaaggtgagaccctgtctctgaatgaatgaatgaatgaatgaatgaatgaatcagaactgtaagaaaacctgctaacctctccacattgtcccgagtccattaatttcccagctgtttgtggcctgaagcctccagccaccacagaaaccaagattttccagacaatggttcctctcagttcaagtatggcagatt

SEQ ID NO: 682 - DNA, 374 bp, Homo sapiens
  chr1.fa.O7frz.77910165
  Located on chromosome 1
  Distance between a terminus base of telomere on chromosomal short arm and 5'-terminus of this base sequence : 71301111
  Distance between 3'-terminus of neighbour sequence of sequence listing upward to telomere on chrosomal short arm and 5'-terminus of this base sequence : 129699
aatctttcgctaacaaagctagagaactcagaaccatctaagttagcaagtgttaaaacactggaaagcaaatgtggcaacagcactttcctatttgaccataatcaacatcaatgtggaaagaaaacaaacctgaaagcaagtgaggaaaacacacagtgggtttctttgctttctctccaggacactgtcagtacacagagcatttagaatagctgatttgatcgttgtgaaaatctacctgcgtgcccctctctctctctctctctctctgaatgcaattagagaagacagcttcattcacactgtgtctaaaaatagatgatggcagagttcacagactgacagctgcattgtcatacagtaaccaggaa

SEQ ID NO: 683 - DNA, 452 bp, Homo sapiens
  AL161795.2_107998
  Located on chromosome 1
  Distance between a terminus base of telomere on chromosomal short arm and 5'-terminus of this base sequence : 71371981
  Distance between 3'-terminus of neighbour sequence of sequence listing upward to telomere on chrosomal short arm and 5'-terminus of this base sequence : 70496
ctcacacctgtaatcccagcactttgggaggccaaggcgggtggatcacctgaggtcaggaatttgagatcagcctggccaacatggtgaaaccccatctctactaaaaataaaaatttgccaggtgtggtggtgcacacctgtagtcccagctactcaggaggctgaggcaggagaattgcttgaacccggaaggtggaggttgcagtgagcggggatcatgacaatgcattccagactgggcgacagagcgagactttgtctcgataatagatagatgatatagatagatgatagatagatagatagatagatagatagatagatagatagatagaaaaaataaaaagcttagcaaaatgccaggcatttgataagcactcaataacaaggagaaactagaggaggtggaggaggaaaaggataatcttggaggtggatactgttattta

SEQ ID NO: 684 - DNA, 294 bp, Homo sapiens
  G10056
  Located on chromosome 1
  Distance between a terminus base of telomere on chromosomal short arm and 5'-terminus of this base sequence : 71380769
  Distance between 3'-terminus of neighbour sequence of sequence listing upward to telomere on chrosomal short arm and 5'-terminus of this base sequence : 8336
acatcttttgtttggatagatgaatctatctatctatctatctatctatctatctatctatctatcatctatctatctatctatctatctatctatctatatctatcatctatctatctatatctgtctatctacctacctacctatctattttttagtgggattaagtggtttattcaaagttatctgattagtaacatttttctaaagtttatgttcctatgttacttctctgcatacaatttttttttttactttaagttctggggtacacgtgcaaaatgtgcagttttg

SEQ ID NO: 685 - DNA, 190 bp, Homo sapiens
  D1S2803
  Located on chromosome 1
  Distance between a terminus base of telomere on chromosomal short arm and 5'-terminus of this base sequence : 71617026
  Distance between 3'-terminus of neighbour sequence of sequence listing upward to telomere on chrosomal short arm and 5'-terminus of this base sequence : 235963
atctaactctgggactggtaaatgtgttggggaaataaaaggcataaaaaaggattaccggtgggtttctggtttctggtacaattcattcagataatgcacaccgtgtgtgtgtgtgtgtgtgtgtgtgtgtgtgtgatgtttcagggatacagagaaaatgaattctgattgtgatttgaacttattt

SEQ ID NO: 686 - DNA, 354 bp, Homo sapiens
  AL033530.1_77365
  Located on chromosome 1
  Distance between a terminus base of telomere on chromosomal short arm and 5'-terminus of this base sequence : 71870048
  Distance between 3'-terminus of neighbour sequence of sequence listing upward to telomere on chrosomal short arm and 5'-terminus of this base sequence : 252832
caccagctttgtacctcattagaagatttttagatggaatcctgcaccagggtgcctcagtcaactgattttccagtgaagacatgaattttaaagcatcctcatatatagcctctagtaaaattggatttgatctttagttaggctttttagttagtcatccttacccagcagtcagttttatctgcctcattgagtgattatttaaagaaggtttcactgttcatctttgtgtgtgtgtgtgtgtgtgtgtgtgtgagagagagagagacagagagagagagagagaaagagagagagagaccaccagaagtctcaacaataaactttaaaagttgaaagcgaaagtctatc

SEQ ID NO: 687 - DNA, 209 bp, Homo sapiens
  D1S448
  Located on chromosome 1
  Distance between a terminus base of telomere on chromosomal short arm and 5'-terminus of this base sequence : 71870199
  Distance between 3'-terminus of neighbour sequence of sequence listing upward to telomere on chrosomal short arm and 5'-terminus of this base sequence : -203
agttagtcatccttacccagcagtcagttttatctgcctcattgagtgattatttaaagaaggtttcactgttcatctttgtgtgtgtgtgtgtgtgtgtgtgtgtgagagagagagagacagagagagagagagagaaagagagagagagaccaccagaagtctcaacaataaactttaaaagttgaaagcgaaagtctatctctgca

SEQ ID NO: 688 - DNA, 160 bp, Homo sapiens
  Z23762.1_115
  Located on chromosome 1
  Distance between a terminus base of telomere on chromosomal short arm and 5'-terminus of this base sequence : 71870256
  Distance between 3'-terminus of neighbour sequence of sequence listing upward to telomere on chrosomal short arm and 5'-terminus of this base sequence : -152
agaaggtttcactgttcatctttgtgtgtgtgtgtgtgtgtgtgtgtgtgagagagagagagacagagagagagagagagaaagagagagagagaccaccagaagtctcaacaataaactttaaaagttgaaagcgaaagtctatctctgcatttgttat

SEQ ID NO: 689 - DNA, 348 bp, Homo sapiens
  AL033530.1_57576
  Located on chromosome 1
  Distance between a terminus base of telomere on chromosomal short arm and 5'-terminus of this base sequence : 71889974
  Distance between 3'-terminus of neighbour sequence of sequence listing upward to telomere on chrosomal short arm and 5'-terminus of this base sequence : 19558
tccattagacagtgtttatcagtcatcatatgctctgcttgtcatgactcccctgttcagtagcagtaacacccccagaacaatactgtgtgtgtgtgtgtgtgtgtgtgtgtgtgtgtgtaaaaacaaaactgtctgggatgccttacagaagaggtatcttctgtgtagtaatgaacataaaatagaaagagactgagtaggcagcattaaaatgtaggtaccccacaaataaacatattattgtgcttttaattcaggaatgagatctgcagcaataaccagaaagcacctgaaaacatcagacgtggattatttaggctgtttaggtgacctaaattatgcagt

SEQ ID NO: 690 - DNA, 458 bp, Homo sapiens
  chr1.fa.O7frz.78545295
  Located on chromosome 1
  Distance between a terminus base of telomere on chromosomal short arm and 5'-terminus of this base sequence : 71962042
  Distance between 3'-terminus of neighbour sequence of sequence listing upward to telomere on chrosomal short arm and 5'-terminus of this base sequence : 71720
tgagcttccttgcaaataaaaaaaaggtcatgggtcattttgttgcaatgactgtgtggataaaagtcgaaaagaacagaaccacatttatttatttatttatttatttatttatttatttatttatttatttatttatttttgagacagagttttgctctattgcggctggagggcaatggagcgatctcggctcactgcagcctccacctctcgagttcaagcaattctgccttagcctcccgagtagctgggattacagtcatgtgctaccacacctggctaatttttgtattttcagtagagacagggtttcttcatgttgatcaggctggtctggaactcctgacctcaggtgatctgcccacctcagcctcccaaagtgctgggattacaggcatgagccaccacgcccggcctatttatttcatttttaatgcacgataacctatagtttg

SEQ ID NO: 691 - DNA, 170 bp, Homo sapiens
  DISO7_10000641
  Located on chromosome 1
  Distance between a terminus base of telomere on chromosomal short arm and 5'-terminus of this base sequence : 72197925
  Distance between 3'-terminus of neighbour sequence of sequence listing upward to telomere on chrosomal short arm and 5'-terminus of this base sequence : 235425
tggcaagtaagcctttctgggggaagagaaagagactgtttttcaattgttcaatttattttttaaaaaactcagacctagaaagaaaattgtaagaatattacaaagaacacacacacacacacacacacacacacacacacacactcacattcttcatctaggtttgc

SEQ ID NO: 692 - DNA, 101 bp, Homo sapiens
  DISO7_10000642
  Located on chromosome 1
  Distance between a terminus base of telomere on chromosomal short arm and 5'-terminus of this base sequence : 72301416
  Distance between 3'-terminus of neighbour sequence of sequence listing upward to telomere on chrosomal short arm and 5'-terminus of this base sequence : 103321
ccaaagctgcagagaagtagaatgtgtgtgtgtgtgtgtgtgtgtgtgtgtgtgtgtgtgtgtgtgtgtatgtgtgtaccagaactctggttcatcatgat

SEQ ID NO: 693 - DNA, 135 bp, Homo sapiens
  DISO7_10000643
  Located on chromosome 1
  Distance between a terminus base of telomere on chromosomal short arm and 5'-terminus of this base sequence : 72368298
  Distance between 3'-terminus of neighbour sequence of sequence listing upward to telomere on chrosomal short arm and 5'-terminus of this base sequence : 66781
ttcttaattcatgaatgcagtgatatatatatatattactgcatatatatattatatgtgtgtgtatatatatatatatatatacatataattttcttaatttagaactctctttgtattccttggaaagaagcc

SEQ ID NO: 694 - DNA, 428 bp, Homo sapiens
  chr1.fa.O7frz.78948511
  Located on chromosome 1
  Distance between a terminus base of telomere on chromosomal short arm and 5'-terminus of this base sequence : 72469251
  Distance between 3'-terminus of neighbour sequence of sequence listing upward to telomere on chrosomal short arm and 5'-terminus of this base sequence : 100818
aaacctcagatttaagttccagttctgctgcttccaaactctgtggccttggccatgtcaattaacctctctgtgtttttttttcttcaacctcagagaaaggacattaatacacacacacacacacacacacacacacacacacacacatcacaactattgcaaggatcaaataagagaagctatatgaaagtacctagaaaagttctataaacaactgtgtgaatttgttaataataggaaagtaatgattccccgttgtagtcctcagaaagggaataggctaaaagactgatttaggagtgttactaactacaaaagtcatctatagtagctggaacaaattgacttgaaaactaggcagtgctgctgatagttcatatttgagaacaagtgcagtttttatgaactgctatgagctgtatcaa

SEQ ID NO: 695 - DNA, 160 bp, Homo sapiens
  D1S219
  Located on chromosome 1
  Distance between a terminus base of telomere on chromosomal short arm and 5'-terminus of this base sequence : 72566488
  Distance between 3'-terminus of neighbour sequence of sequence listing upward to telomere on chrosomal short arm and 5'-terminus of this base sequence : 96809
gaagatgctgatacccaagtgccctccactccaagcccaagatcttcactttctttccaagggggaaaaataaacagaatcaaggcagatgtgtgtgtgtgtgtgtgtgtgtgtgtgtgtgtgtgtgttgatgacactcaggctagagagagtgactgga

SEQ ID NO: 696 - DNA, 204 bp, Homo sapiens
  D1S411
  Located on chromosome 1
  Distance between a terminus base of telomere on chromosomal short arm and 5'-terminus of this base sequence : 72780199
  Distance between 3'-terminus of neighbour sequence of sequence listing upward to telomere on chrosomal short arm and 5'-terminus of this base sequence : 213551
aaggtttctgagaactttttgtgttaccacttcataaaaagggtgtgtgtgtgtgtgtgtgtgtgtgtgtgtgtgtgtgtatgtctgtgtgtgtgtgagagagagagacatgctgtgggaggggtacttattccctgtgccatcctcttcctctgctgtctctgacctctgctgaggtgtccaaccactggatcaactgacctc

SEQ ID NO: 697 - DNA, 188 bp, Homo sapiens
  D1S1603
  Located on chromosome 1
  Distance between a terminus base of telomere on chromosomal short arm and 5'-terminus of this base sequence : 72833854
  Distance between 3'-terminus of neighbour sequence of sequence listing upward to telomere on chrosomal short arm and 5'-terminus of this base sequence : 53451
agactgaaaactttatgaaaattgcaaaagtcattgtatcagttggtattctctagagaaacagaactaatgacagatgatacatagatagatagatagatagatagatagatagatagatagatagattatacgattgattggaagagatttattgtggaaaatggctaatgtaattatgaaggctg

SEQ ID NO: 698 - DNA, 235 bp, Homo sapiens
  AL117353.6_5354
  Located on chromosome 1
  Distance between a terminus base of telomere on chromosomal short arm and 5'-terminus of this base sequence : 72833882
  Distance between 3'-terminus of neighbour sequence of sequence listing upward to telomere on chrosomal short arm and 5'-terminus of this base sequence : -160
agtcattgtatcagttggtattctctagagaaacagaactaatgacagatgatacatagatagatagatagatagatagatagatagatagatagatagattatacgattgattggaagagatttattgtggaaaatggctaatgtaattatgaaggctgagaagtcccatgatatgccatctgcaggctggagagccaggaaagccagaggtgtaatccagtctgaattagaac

SEQ ID NO: 699 - DNA, 380 bp, Homo sapiens
  chr1.fa.O7frz.79418486
  Located on chromosome 1
  Distance between a terminus base of telomere on chromosomal short arm and 5'-terminus of this base sequence : 72969844
  Distance between 3'-terminus of neighbour sequence of sequence listing upward to telomere on chrosomal short arm and 5'-terminus of this base sequence : 135727
aatctactgattagcactaccagtggagaaaatctccagttataccatgagccatcttctctctggctcactgaccttggcagagctagtcagcaaagttaggccttttgtcactcatgactgatcagggcatagaatggcaaaaacaaatatatacacacacatacacacacacacatatatatatacacacacatacacacacacactcatatatatacacatatatacacacacacaaacatatatatatatatacacacacactcatatatatacacatatatacacacacacaaacatatatatatatacacacacacacacacagatacatacacaaaccagcttacactagtatggaactttagattaatgcc

SEQ ID NO: 700 - DNA, 256 bp, Homo sapiens
  chr1.fa.O7frz.79538240
  Located on chromosome 1
  Distance between a terminus base of telomere on chromosomal short arm and 5'-terminus of this base sequence : 73089602
  Distance between 3'-terminus of neighbour sequence of sequence listing upward to telomere on chrosomal short arm and 5'-terminus of this base sequence : 119378
aattgatagcaagacaagttaaacttagaaactaagcaaaagcaattttaaaagaacactacagtgtaataccattgcaacagcaccaaacactgaatgccacagtttgcactggtactctgccagcgctgggcactggccactgctactgcatcatcagcttgcagtttctgttgctatcatcactgctgctgctgctgctgctgctgctgctcaaatgataatcaattctaagtggtcaggaacttctgtagat

SEQ ID NO: 701 - DNA, 156 bp, Homo sapiens
  G10031
  Located on chromosome 1
  Distance between a terminus base of telomere on chromosomal short arm and 5'-terminus of this base sequence : 73263717
  Distance between 3'-terminus of neighbour sequence of sequence listing upward to telomere on chrosomal short arm and 5'-terminus of this base sequence : 173859
cattccccaacatcattcatcacagcctatagcccaagagagacaaaaaactgctgctgctgctgctgctgctgctgctgctgctgctgctaacagaatgactttacagcatgttcttttcatgcccattgtttgttttgccaagccatctaagag

SEQ ID NO: 702 - DNA, 168 bp, Homo sapiens
  D1S2798
  Located on chromosome 1
  Distance between a terminus base of telomere on chromosomal short arm and 5'-terminus of this base sequence : 73390330
  Distance between 3'-terminus of neighbour sequence of sequence listing upward to telomere on chrosomal short arm and 5'-terminus of this base sequence : 126457
gatcctgtctcaatcaataaataaactaaattagataaaaaaataaaaaatagcagtcaaattatacatagtctcacacacacacacacacacacacacacacacacacacagtattagaagaaaaacctccacaacattaacagtgactaactctggttggcttctt

SEQ ID NO: 703 - DNA, 294 bp, Homo sapiens
  AL353771.8_63090
  Located on chromosome 1
  Distance between a terminus base of telomere on chromosomal short arm and 5'-terminus of this base sequence : 73395788
  Distance between 3'-terminus of neighbour sequence of sequence listing upward to telomere on chrosomal short arm and 5'-terminus of this base sequence : 5290
caataagaaagcaatcattagaaggaaaatggaaggttttaatcagtcttaaaacctaaatataaatgaagaaaaacattacaggaaaaatgctctatttctccatctctccattcccctccctctctctcttacacacacacacacacacacacacacacgacaatcagaagagcatctggccattcattcatggtacccagatttgtgcttcttggtctttaacaggtttctcaggatgtccccacattcaaacactctgtgtggcatctatcctgatcttcaacttagaaa

SEQ ID NO: 704 - DNA, 238 bp, Homo sapiens
  D1S462
  Located on chromosome 1
  Distance between a terminus base of telomere on chromosomal short arm and 5'-terminus of this base sequence : 73395813
  Distance between 3'-terminus of neighbour sequence of sequence listing upward to telomere on chrosomal short arm and 5'-terminus of this base sequence : -269
aaaatggaaggttttaatcagtcttaaaacctaaatataaatgaagaaaaacattacaggaaaaatgctctatttctccatctctccattcccctccctctctctcttacacacacacacacacacacacacacacgacaatcagaagagcatctggccattcattcatggtacccagatttgtgcttcttggtctttaacaggtttctcaggatgtccccacattcaaacactctgt

SEQ ID NO: 705 - DNA, 241 bp, Homo sapiens
  AL354721.8_55651
  Located on chromosome 1
  Distance between a terminus base of telomere on chromosomal short arm and 5'-terminus of this base sequence : 73412565
  Distance between 3'-terminus of neighbour sequence of sequence listing upward to telomere on chrosomal short arm and 5'-terminus of this base sequence : 16514
gctagtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggag

SEQ ID NO: 706 - DNA, 239 bp, Homo sapiens
  D1S2897
  Located on chromosome 1
  Distance between a terminus base of telomere on chromosomal short arm and 5'-terminus of this base sequence : 73445605
  Distance between 3'-terminus of neighbour sequence of sequence listing upward to telomere on chrosomal short arm and 5'-terminus of this base sequence : 32799
aaatatcttaggtgagtaccatgacaattcttttatcagtggtaatattctttagaatatacttaaggtttatcatagaagatggttagcaatcgtgtgtgtgtgtgtgtgtgtgtgtgtgtgtgtgtgtgtgtgtgtgtgacggagtttcgttctgtcatggtcgtcgccaggctggagggcagtgatgcaatcttggctcactgaaacctccgcctcccgggttcaagcaactctcc

SEQ ID NO: 707 - DNA, 210 bp, Homo sapiens
  AL158839.5_48389
  Located on chromosome 1
  Distance between a terminus base of telomere on chromosomal short arm and 5'-terminus of this base sequence : 73530900
  Distance between 3'-terminus of neighbour sequence of sequence listing upward to telomere on chrosomal short arm and 5'-terminus of this base sequence : 85056
tccgctaatgatatacgatgacatttgaatttatactgatgtaacacttctgattcctaatatctgttatttgtgccttctttttctcttgatcagtacgtttattattattattattattattattattattattattattattattattattttgaaacagggtcttgctctgtcacccaggctggagtatagtggcaaaatcatggc

SEQ ID NO: 708 - DNA, 172 bp, Homo sapiens
  D1S501
  Located on chromosome 1
  Distance between a terminus base of telomere on chromosomal short arm and 5'-terminus of this base sequence : 73630003
  Distance between 3'-terminus of neighbour sequence of sequence listing upward to telomere on chrosomal short arm and 5'-terminus of this base sequence : 98893
ttgaaggcagcagtaagtcttattattgtgtgtgtgtgtgtgtgtgtgtgtgtgtctgctttatcttgggcatggggggtcactatatttacaaagtgtggtctcactgtgaactctaaagcttttctgttcctgtaatagaccaggtgtataaataaacgtatagggagct

SEQ ID NO: 709 - DNA, 421 bp, Homo sapiens
  chr1.fa.O7frz.80751253
  Located on chromosome 1
  Distance between a terminus base of telomere on chromosomal short arm and 5'-terminus of this base sequence : 73846961
  Distance between 3'-terminus of neighbour sequence of sequence listing upward to telomere on chrosomal short arm and 5'-terminus of this base sequence : 216786
tcaactcatggattatctgtctccttttgagattttactaattcagtctgggctgggtgatacttctctgtgctctcattacacactaggcattactctccctctttcattgcacactgcactgtattataactgtttcatccattacaatcatttatttttttcaagtatttttgatccacatttggtcgaatccacagatgtgcaaccacagatacagagggctgacatctatctatctatctatctatctatctatctatctatctatctatcatctatcatctatctgtctgtcaatctatcttcttcatcatcatcatcatctatctatatttcacatatttaaaattcagtaattaatataaaatagttttatgcttcttggtgattagatgtctaggaaccaaatgttctaagc

SEQ ID NO: 710 - DNA, 310 bp, Homo sapiens
  chr1.fa.O7frz.80643026
  Located on chromosome 1
  Distance between a terminus base of telomere on chromosomal short arm and 5'-terminus of this base sequence : 73911570
  Distance between 3'-terminus of neighbour sequence of sequence listing upward to telomere on chrosomal short arm and 5'-terminus of this base sequence : 64188
ggctcgtagaagtgtttaaatctaaaccctacattgtagggaggtagaaactgatcaaggaataaagtaactcaaagttacccagccaggaagaaggtagtggagtcagaattcaagcctttctcaagtcttttccctccctccccttccttccttccttccttccttccttccttccttccttccttccttccttccttccttccttccttcctccctccctccctccctccctccctgtcttccctccctccctccttccctctctcttgccatttatttttcagtgtctataatttgccagtcactg

SEQ ID NO: 711 - DNA, 253 bp, Homo sapiens
  AL031429.11_5207
  Located on chromosome 1
  Distance between a terminus base of telomere on chromosomal short arm and 5'-terminus of this base sequence : 74125841
  Distance between 3'-terminus of neighbour sequence of sequence listing upward to telomere on chrosomal short arm and 5'-terminus of this base sequence : 213961
tgacttgctacaattagcattcattactgataattataatttaaaaacaagtacacaatagaaaatttcagaaattcacattgcttcattagcctgtttttccaccctaggaatttacagatacacacacacacacacacacacacacactatatatatacacacatacatatatataaacacatatattcacaacccaggaactagggaacccaaatctaacacttgacttaaacaaaatttctgcttgtta

SEQ ID NO: 712 - DNA, 257 bp, Homo sapiens
  AL031429.11_12011
  Located on chromosome 1
  Distance between a terminus base of telomere on chromosomal short arm and 5'-terminus of this base sequence : 74132602
  Distance between 3'-terminus of neighbour sequence of sequence listing upward to telomere on chrosomal short arm and 5'-terminus of this base sequence : 6508
ctgcatgacaactcagtatgtaagttcacattcctttttgcaatattttggtttgcttttattgtttatttttgcttttacttaacaaatattttacaaataattgggatactttgaaaatacttctattgagacattgtgttggtactaaggatacaaatataaatatatatatatatatatatatgttctgctttctgccttttaagcattcagaatgtgcatgcaaagatattctcagtggtcttgacaagtac

SEQ ID NO: 713 - DNA, 300 bp, Homo sapiens
  AL031429.11_97036
  Located on chromosome 1
  Distance between a terminus base of telomere on chromosomal short arm and 5'-terminus of this base sequence : 74217614
  Distance between 3'-terminus of neighbour sequence of sequence listing upward to telomere on chrosomal short arm and 5'-terminus of this base sequence : 84755
gatttcatttggcaaataattaaaacctacaggaaataggtgtgaaacaaaagtcaaaattcctcttcaaaaaaaaactccaaggggcaaatggaggaaagagaaaaattacaaagttagaagacagtgtatgagaacaagggactagattcatgaagctttggtgtatgttagcagagtgtgtgtgtgtgtgtgtgtgtgtgtgtgtgtgtgtagtggggtgggggtatttttattaaaagaaatagcagattctggcaaacatactgaccaagagttaaagaacttccataagtctga

SEQ ID NO: 714 - DNA, 208 bp, Homo sapiens
  D1S192
  Located on chromosome 1
  Distance between a terminus base of telomere on chromosomal short arm and 5'-terminus of this base sequence : 74217646
  Distance between 3'-terminus of neighbour sequence of sequence listing upward to telomere on chrosomal short arm and 5'-terminus of this base sequence : -268
gaaataggtgtgaaacaaaagtcaaaattcctcttcaaaaaaaaactccaaggggcaaatggaggaaagagaaaaattacaaagttagaagacagtgtatgagaacaagggactagattcatgaagctttggtgtatgttagcagagtgtgtgtgtgtgtgtgtgtgtgtgtgtgtgtgtgtagtggggtgggggtatttttattaaa

SEQ ID NO: 715 - DNA, 160 bp, Homo sapiens
  Z16482.1_269
  Located on chromosome 1
  Distance between a terminus base of telomere on chromosomal short arm and 5'-terminus of this base sequence : 74217770
  Distance between 3'-terminus of neighbour sequence of sequence listing upward to telomere on chrosomal short arm and 5'-terminus of this base sequence : -84
agctttggtgtatgttagcagagtgtgtgtgtgtgtgtgtgtgtgtgtgtgtgtgtgtagtggggtgggggtatttttattaaaagaaatagcagattctggcaaacatactgaccaagagttaaagaacttccataagtctgactcaattctgcttcta

SEQ ID NO: 716 - DNA, 168 bp, Homo sapiens
  AL031429_106265
  Located on chromosome 1
  Distance between a terminus base of telomere on chromosomal short arm and 5'-terminus of this base sequence : 74226970
  Distance between 3'-terminus of neighbour sequence of sequence listing upward to telomere on chrosomal short arm and 5'-terminus of this base sequence : 9040
agatcacgctactgcactccagcctgggtgacagagtgagactccatctcaaataataataataataataataataataataataacaaaataagtaaataaataaataagtttctaggttcagagaaacccctgtctgccaaaacagcagatgctttgtaggtattt

SEQ ID NO: 717 - DNA, 231 bp, Homo sapiens
  AL031429.11_107584
  Located on chromosome 1
  Distance between a terminus base of telomere on chromosomal short arm and 5'-terminus of this base sequence : 74228227
  Distance between 3'-terminus of neighbour sequence of sequence listing upward to telomere on chrosomal short arm and 5'-terminus of this base sequence : 1089
acataacaggcattcagtaaatagaagtccttttattttttgtggctctcttcagtttgcgctccaccagtctcactgctaccccaatttcccaacagataggtggcaggaaaacacacacacacacacacacacacacacacacacacacaaacgtgcacacacgcacatgtgcacaaggcttcaaaagtatgttactattataatgtttctacgaataaattggataga

SEQ ID NO: 718 - DNA, 207 bp, Homo sapiens
  D1S2895
  Located on chromosome 1
  Distance between a terminus base of telomere on chromosomal short arm and 5'-terminus of this base sequence : 74359430
  Distance between 3'-terminus of neighbour sequence of sequence listing upward to telomere on chrosomal short arm and 5'-terminus of this base sequence : 130972
tcctcagccatgtggaactgtgagtcaattaaacttctttcctttataaattactcagtctcaagtatttctttatagtagtgtgaaaacaaattggtacagatacagacatacacacacacacacacacacacacacacacacacacaaatggaaatgtattatgaggaataggctcacatgattcttagtcagtttgggctgcta

SEQ ID NO: 719 - DNA, 293 bp, Homo sapiens
  chr1.fa.O7frz.80957710
  Located on chromosome 1
  Distance between a terminus base of telomere on chromosomal short arm and 5'-terminus of this base sequence : 74431410
  Distance between 3'-terminus of neighbour sequence of sequence listing upward to telomere on chrosomal short arm and 5'-terminus of this base sequence : 71773
ttcaggaataagtactcacatgtctgtctccacaaataaactataaacttcaagagacggagaactatgtatgcttatttgttgtgctatatcttgtggctagcacagtgcctgacatatatacacacacacacacacacacacacacacacacacacacacacacacacacacacatgattaataaatgtttgttaaatgagtagttgaatccatggattatttttatgtacgctgtaggtatgccttaatccaaagcatcagttttctagtggtagcattaaagtcaccta

SEQ ID NO: 720 - DNA, 416 bp, Homo sapiens
  chr1.fa.O7frz.81035997
  Located on chromosome 1
  Distance between a terminus base of telomere on chromosomal short arm and 5'-terminus of this base sequence : 74509507
  Distance between 3'-terminus of neighbour sequence of sequence listing upward to telomere on chrosomal short arm and 5'-terminus of this base sequence : 77804
gacagctttaggagtctaggacgtggaaaccaacagtctgcaaaagacactgctatcaaaatgaatcaaccatgttcagttttcctgtcactgtgaataagattaaaattccaaggaggaaaaaaataattctctctgaaaaattcagagactcaaaaaggaatttaattttttttctctctctcctctcctgtctccctccctccttcctttcagttttatatttactagcatatttaccatttccctgctttttatttctttcaaatttgagttaccatctgctgtaatttcctttcagcctgaaggacgtcttttatttatttatttatttatttatttatttatttatttatttatttattttaggttaggttaggttaggtttgccagcaagaacttctcaccaatttgtt

SEQ ID NO: 721 - DNA, 271 bp, Homo sapiens
  Z67559
  Located on chromosome 1
  Distance between a terminus base of telomere on chromosomal short arm and 5'-terminus of this base sequence : 74671223
  Distance between 3'-terminus of neighbour sequence of sequence listing upward to telomere on chrosomal short arm and 5'-terminus of this base sequence : 161300
cccacagacttgcactgaaagaaactaaaaatatttattaacagaaagaaaagtgaacccagagggaaggtgaaagaaacaatggagaacacagaaagtggtttattttcataaagttaattaaccatggaataaataaagaaaacaggaaaatgtgtgtgtgtgtgtgtgtgtgtgtgtgattaaaacggcaaaatataaatttaaaacagcatgaggaagactgtgtctatgtgtgacaatgagagaagaaattgttcagggccaggag

SEQ ID NO: 722 - DNA, 417 bp, Homo sapiens
  AC068047.3_84486
  Located on chromosome 1
  Distance between a terminus base of telomere on chromosomal short arm and 5'-terminus of this base sequence : 74724165
  Distance between 3'-terminus of neighbour sequence of sequence listing upward to telomere on chrosomal short arm and 5'-terminus of this base sequence : 52671
atctgagtttgaagagtgcattacacatatttctcttatagcacatattgtattacataaatctgttttgttttcatgtccctctcattcattgaaatgtgagattcacaaaaataaataatggtccaatcacttttgcatctctgatgcatggttcagtgtctcacacattcagatgctcaataattttttgagaactgacagaaaccacagaaggtgacttactcccaacttccaccagtttccctacttttctaaagctctacctctatgaaccacaaataagtgtgtcttccattcatccaccatccatccatccatccatccaaccaccatccatccatccatccatccatccatccatccatccatccatccatgggtaatcaggcatatgcatctggtctagtcattaag

SEQ ID NO: 723 - DNA, 302 bp, Homo sapiens
  chr1.fa.O7frz.81334613
  Located on chromosome 1
  Distance between a terminus base of telomere on chromosomal short arm and 5'-terminus of this base sequence : 74794397
  Distance between 3'-terminus of neighbour sequence of sequence listing upward to telomere on chrosomal short arm and 5'-terminus of this base sequence : 69815
acctcaaggaccatagttctacctgaaactctgaagatgacatgaagatagcatacaggtcccttccacaacacatcctataatgcctttctcaaggatggagttttatttatatatatatatatatatgtctctctctctctctctctctctctctctctctctctctctgtgtgtgtgtgtgtgtgtgtgtgtgtgtgtaggctgtgaatcagactgtatttctagtcttttcaatgtgaccaggaatgctttatgtatgtgggacattttatctgttctcaatacatttatgactgaag

SEQ ID NO: 724 - DNA, 126 bp, Homo sapiens
  D1S224
  Located on chromosome 1
  Distance between a terminus base of telomere on chromosomal short arm and 5'-terminus of this base sequence : 74871631
  Distance between 3'-terminus of neighbour sequence of sequence listing upward to telomere on chrosomal short arm and 5'-terminus of this base sequence : 76932
cataatcctttggcccaatcgaaatactctgcaggcttttgctgggagggcacacacacacacacacacacacacacacacacaaatgtatacagtacttagcactgtattctaaaatgtgtgatg

SEQ ID NO: 725 - DNA, 341 bp, Homo sapiens
  AL158079.11_234627
  Located on chromosome 1
  Distance between a terminus base of telomere on chromosomal short arm and 5'-terminus of this base sequence : 75065316
  Distance between 3'-terminus of neighbour sequence of sequence listing upward to telomere on chrosomal short arm and 5'-terminus of this base sequence : 193559
atggcaataactgaaagtaactacaatacatggaaacaaatgaattacatttaaaaatcccactaaatctcaatcaaatgaattcccaaatcaatttccttttaagtggccattccaatgtcttctaacacaagggaaatcatagaaagaaatagccatcttaaacaaatgagttaacataccttaccttaaattaaatagatagatgatagaagatagatagatagatagatagatagatagacagaatacatacatacatacatacatacatacatacatacatacatacatggatttatattatataaatactttgctaaagtcacttccaggaactt

SEQ ID NO: 726 - DNA, 231 bp, Homo sapiens
  chr10.fa.O7frz.12835086
  Located on chromosome 1
  Distance between a terminus base of telomere on chromosomal short arm and 5'-terminus of this base sequence : 75132576
  Distance between 3'-terminus of neighbour sequence of sequence listing upward to telomere on chrosomal short arm and 5'-terminus of this base sequence : 66919
atgtgaaacaatacttgtgtacagtttttttaagtgtgtagtgtgtgtgtgtgtgtgtgtgtgcatgttcgtgtgtgtgtgtttcaactgaaagttagtcaaaagcctttttcattctgtctggatgacacatctaaataaagctaaattagtttacacaattttctgcattaaagcctatttcattgtttgaaattatgagaagcagtaaaggtcatgatttagactgac

SEQ ID NO: 727 - DNA, 477 bp, Homo sapiens
  chr1.fa.O7frz.81693134
  Located on chromosome 1
  Distance between a terminus base of telomere on chromosomal short arm and 5'-terminus of this base sequence : 75145286
  Distance between 3'-terminus of neighbour sequence of sequence listing upward to telomere on chrosomal short arm and 5'-terminus of this base sequence : 12479
catggatcagcgaattaaaatatttatgttctctcttgaaaataaaaattgtgccctattctactaaattctatgggcttgaatatcgtttgtatttagtcaatatttatgtactttagaaaaacttaagctgatatccatatattataaatatttatttttaaatatgtgtttgtagtctagggtttcttttcattttgagaaatataaaaatatatctttatgatcaactctttgttattgttaaatatttgcttcttcaagggatatgtgtgcttcaaaaggggcgtgtgtgtgtgtgtgagagagagagagagagagagacaggagatatttggtacgaaaatggacaagacatgaaaatgagtatttattattacatgtatagtaaaaaaagtgacacactttgaatatgaaaccaatatataatttaaattaatttcatctgagctctttcttacagaaagtgccagaatc

SEQ ID NO: 728 - DNA, 428 bp, Homo sapiens
  chr1.fa.O7frz.81985843
  Located on chromosome 1
  Distance between a terminus base of telomere on chromosomal short arm and 5'-terminus of this base sequence : 75396136
  Distance between 3'-terminus of neighbour sequence of sequence listing upward to telomere on chrosomal short arm and 5'-terminus of this base sequence : 250373
tcagaatttatctggatgtcacctgttttgccactaatgtccttttgcccttcaaggatccaatccagaatatcatatagtatttagtacattggagatctatctagatagacagacagagagagagagagagagagagagagagagagagactacataatatgtatcttgggggctgcataacatgtatactgtaaaggggctgcataacatgtatactgcgctactctggggggggtgccatgcacattgctgtgccaggtactatttatatgcttatctatcaacttgtttaattatcacaacatctctagaaggtagacaatataaatatccctattttaaaaatatgggcattgaggacaaagagcttaagtaaccttaaaagagcacaaagctaataagtggagaaattgagattgtagtta

SEQ ID NO: 729 - DNA, 408 bp, Homo sapiens
  chr1.fa.O7frz.82212526
  Located on chromosome 1
  Distance between a terminus base of telomere on chromosomal short arm and 5'-terminus of this base sequence : 75729755
  Distance between 3'-terminus of neighbour sequence of sequence listing upward to telomere on chrosomal short arm and 5'-terminus of this base sequence : 333191
cctctgcctcaaataagtaaagtttttgtctgaaaaggctagtaatcacttaaacaagaaaggtataatgtaatttctaaaagttaaaaatgcagttttataatttacattctaatatagggaagacatcctcccagggggataaatgtaacaacaaaaaacatcaagaaagaagagaaagtaaaacatgagaagatgggaaaaatatgaagcatgaaaagatatactaaatctgaatatatcagttgttacagtaaatctaattgtgcaaaattttccaattaaaagacaagtttatatgactggatttaaacataaatacacaacacatacacacacacacacacacacacacacacacacacacatcccaatcaaattataagctgttaggagcaatcacactta

SEQ ID NO: 730 - DNA, 440 bp, Homo sapiens
  chr1.fa.O7frz.82293600
  Located on chromosome 1
  Distance between a terminus base of telomere on chromosomal short arm and 5'-terminus of this base sequence : 75810877
  Distance between 3'-terminus of neighbour sequence of sequence listing upward to telomere on chrosomal short arm and 5'-terminus of this base sequence : 80714
catataccttaaaggtagtcgctattacgacttctatcaactcgattcatttcaattgattttgacatttaccatgaaattatataggacgtactattttgtgtttgagattcttctgctcagcatgaatctatgagattgatatgtactgttgctagaaatagtactcttctctatttcattgctgtataatagttcattatataaatatattgtgtaatatgtttatttcctgttttattattgagggggattattgtgaattattcttaatgatcattctgtacatgtctatgtttttatatatatatatatatatatatgaatttctatgtggtgcctaagcaggaattgaattgcttggtcataatatatgcatgtatttaggtatagaagctgctgataacggttttacatactgactgtacaatttccatcac

SEQ ID NO: 731 - DNA, 185 bp, Homo sapiens
  D1S494
  Located on chromosome 1
  Distance between a terminus base of telomere on chromosomal short arm and 5'-terminus of this base sequence : 75999934
  Distance between 3'-terminus of neighbour sequence of sequence listing upward to telomere on chrosomal short arm and 5'-terminus of this base sequence : 188617
aagaagatgtttaccattaagaggaagttgttgaagtttgtaaaaagtatgattccatttatatagagttcaaaatataggctgtgtgtgtgtgtgtgtgtgtgtgtgtgtgtgtgtttgtgaatagaccatggaaatgaaaatgagaatcacaaaattcaggatagtggttgtagagttggtgg

SEQ ID NO: 732 - DNA, 180 bp, Homo sapiens
  HUMUT2152
  Located on chromosome 1
  Distance between a terminus base of telomere on chromosomal short arm and 5'-terminus of this base sequence : 76016089
  Distance between 3'-terminus of neighbour sequence of sequence listing upward to telomere on chrosomal short arm and 5'-terminus of this base sequence : 15970
gggttgtcatcctatatgcagttttctctttttgtgtttgtgtttgtcagagttctccagagagacagaaccaacataaaggataaattatagatagatagatagatagatagatagatagatagatagatagatgagatgggacttattaggtgaattggctcacatggttatggaggc

SEQ ID NO: 733 - DNA, 395 bp, Homo sapiens
  chr1.fa.O7frz.82618697
  Located on chromosome 1
  Distance between a terminus base of telomere on chromosomal short arm and 5'-terminus of this base sequence : 76157928
  Distance between 3'-terminus of neighbour sequence of sequence listing upward to telomere on chrosomal short arm and 5'-terminus of this base sequence : 141659
acaattgaacttgtggacatagagaacagaatgatggttaccagagactggaaaggttagtgtgtttgtgtgtgtgtgtttgtgtgtgtgtgtgtgtgtgtgtgtgtgtgtgtgtgtgtgtatagaaggggggttgggggaaatggggttggttaatgggtataaaaatatatttagatacaataaataagatctagtatttgttagcacaacagggtgagtacagtcaataataatttactgtatattttaaaataactcaaaaagtataactggaatatttgtaacacaaagaaaggataaatgcttgaggggatggatacccctttgactctggtgtgattactactcatcatgtgactatattaatatatctcatgtacctggtaaataca

SEQ ID NO: 734 - DNA, 424 bp, Homo sapiens
  AL356362.4_64727
  Located on chromosome 1
  Distance between a terminus base of telomere on chromosomal short arm and 5'-terminus of this base sequence : 76353263
  Distance between 3'-terminus of neighbour sequence of sequence listing upward to telomere on chrosomal short arm and 5'-terminus of this base sequence : 194940
cttgaagtcaggagttcaagaccagcctggataacatgacgaaaccccatctctactaaaaatataaaaatcagctgggcgtggtggtgcatgcctgtaatcccagctatttgggaggctgaggcaggagaatcacttgaacccgggggggcggaggttgcagtgagctgagattacaccactgcactgcagcctgggcaacagagcaagactctatctcaaaataaataaataaataaataaataaataaataagcattaaacaacaagagctagaagtgggtttaacaactatcataattttgaagtagtgataagtaaaaatgacatcatgtaatgtgataggaaattatttgtgatttctattgcctcaaagccacaggttctgttgatactactgtagtttgttgcctacattgatcat

SEQ ID NO: 735 - DNA, 212 bp, Homo sapiens
  chr1.fa.O7frz.39577067
  Located on chromosome 1
  Distance between a terminus base of telomere on chromosomal short arm and 5'-terminus of this base sequence : 76422741
  Distance between 3'-terminus of neighbour sequence of sequence listing upward to telomere on chrosomal short arm and 5'-terminus of this base sequence : 69054
agtaattcacaagatttgctgtatagattaagagttaatacacgtaaagggttctgaatggtacctggcatatagtaaatgctcagtaaacatcagttattgctgctgtcatcatcatcatcatcatcatcatcatcatcatcatcaccatcaccatcattaaagactacctcagtgtccacatgggtaactcatttaacacgttctttgag

SEQ ID NO: 736 - DNA, 230 bp, Homo sapiens
  AL157951.5_19904
  Located on chromosome 1
  Distance between a terminus base of telomere on chromosomal short arm and 5'-terminus of this base sequence : 76509541
  Distance between 3'-terminus of neighbour sequence of sequence listing upward to telomere on chrosomal short arm and 5'-terminus of this base sequence : 86588
gagcatgtgtttccatgagtgtgagtatcctgtgtttcttctagtgggatgtgtggcctagggtgtgtcctgctctgtgtgtgtgtgtgtgtgtgtgtgtgtgtgtgtgtgtgtgtgtgtgtgattgcctgtgcatctggagctagtcatatggatgtttacatatctgtgccactgtgtgggagtggcatgtgtgcagtcataggggttatctccttactcctagcgtc

SEQ ID NO: 737 - DNA, 164 bp, Homo sapiens
  DISD22_0000494
  Located on chromosome 1
  Distance between a terminus base of telomere on chromosomal short arm and 5'-terminus of this base sequence : 76747873
  Distance between 3'-terminus of neighbour sequence of sequence listing upward to telomere on chrosomal short arm and 5'-terminus of this base sequence : 238102
tgagcaggatacaggatacagattatatatatatatatatatatatatatatatatatatatatatatacacacacacacatatatctatatagtatatacacacattattgatatatgtgtatgtatatgaataaaattatgaagtgattgattgtaaaggca

SEQ ID NO: 738 - DNA, 456 bp, Homo sapiens
  chr1.fa.O7frz.83030061
  Located on chromosome 1
  Distance between a terminus base of telomere on chromosomal short arm and 5'-terminus of this base sequence : 76910563
  Distance between 3'-terminus of neighbour sequence of sequence listing upward to telomere on chrosomal short arm and 5'-terminus of this base sequence : 162526
gtcttgaattcctttcaagaacagaaaccttaaatgagttcagcatcctttcaccttcaaggcattttaagtatctatatacagcagtggaagggctaagaaatagaaaaaaaacctgagggattcatgaagatagcaagaaaaattgtattttgtttcttgtaatgtaagtttcctaacaaacattccaggatacaaattggagcactaaacaactacatttgtgaattaagagtaaaccaataagggcccagtcctcacaaaggaaaaaacacagctatttatttatttatttatttatttatttatttgtgtttgagacactatctcacagtcacctaggctgaagtgcccccactggatctcagctcactgcaacctcaggctcctggggtcaaggggtcctcctacttcaccttccccagtagctgggactacaagtgcaggtgaatctag

SEQ ID NO: 739 - DNA, 158 bp, Homo sapiens
  chr1.fa.O7frz.83106627
  Located on chromosome 1
  Distance between a terminus base of telomere on chromosomal short arm and 5'-terminus of this base sequence : 76987338
  Distance between 3'-terminus of neighbour sequence of sequence listing upward to telomere on chrosomal short arm and 5'-terminus of this base sequence : 76319
ggataccagtcctttatcagatatttgatttacaaagattttttctcccattctaggctcttttgttctttttgttttgttttattttgttttgagataggttctcctatgttgcccaggttggagatcagttgctattaataggcatgctcttagtg

SEQ ID NO: 740 - DNA, 337 bp, Homo sapiens
  chr1.fa.O7frz.83278651
  Located on chromosome 1
  Distance between a terminus base of telomere on chromosomal short arm and 5'-terminus of this base sequence : 77156572
  Distance between 3'-terminus of neighbour sequence of sequence listing upward to telomere on chrosomal short arm and 5'-terminus of this base sequence : 169076
gtcattaagattcagtgaggttataagggtagtaccctaatccactatgggcagtgacgtataaaactaggaagaggcggtacaagggatgcacacacacacacacacacagagagagagagagagagagacagagagagtaaaggctatgtgaaaatagcaagaagatggctacctgctagctaaggaaagagacctcaataaaaaccaagcctgtcaataccttgatcttggacttccagcaaccagaattgtgagaaaataaatttctattgtttactctctgtgctgtcttgccatagcaactctagcaattcatcgtattagctgacaaagt

SEQ ID NO: 741 - DNA, 214 bp, Homo sapiens
  chr1.fa.O7frz.83408762
  Located on chromosome 1
  Distance between a terminus base of telomere on chromosomal short arm and 5'-terminus of this base sequence : 77358650
  Distance between 3'-terminus of neighbour sequence of sequence listing upward to telomere on chrosomal short arm and 5'-terminus of this base sequence : 201741
tcaatatcattaaatagccagaatcttctccaaattccaattcactcatatataacacatttttctttctgcagtctatttttgtgtgttacattctgtctcctctctttttcaatctctagatagataaatgttaaaagatagatagatagatgatagatagatagatagatagatagacagatagacagacatgtaggtacatacgcttatc

SEQ ID NO: 742 - DNA, 175 bp, Homo sapiens
  G07836
  Located on chromosome 1
  Distance between a terminus base of telomere on chromosomal short arm and 5'-terminus of this base sequence : 77403687
  Distance between 3'-terminus of neighbour sequence of sequence listing upward to telomere on chrosomal short arm and 5'-terminus of this base sequence : 44823
taagttagttcaaattcatcagtgctatgtggaataaaaaatagatataagaaagatagatgatagttagatgatagatagatagatagatgatagatagatagatagatagatagatagatagatagatgatagagagatagatagattatatccttttgtaggtggcaacagg

SEQ ID NO: 743 - DNA, 225 bp, Homo sapiens
  D1S1665
  Located on chromosome 1
  Distance between a terminus base of telomere on chromosomal short arm and 5'-terminus of this base sequence : 77403687
  Distance between 3'-terminus of neighbour sequence of sequence listing upward to telomere on chrosomal short arm and 5'-terminus of this base sequence : -175
taagttagttcaaattcatcagtgctatgtggaataaaaaatagatataagaaagatagatgatagttagatgatagatagatagatagatgatagatagatagatagatagatagatagatagatagatgatagagagatagatagattatatccttttgtaggtggcaacaggccatttccttccccttctttgtgtacttgctgacactgtgaagcttggaa

SEQ ID NO: 744 - DNA, 189 bp, Homo sapiens
  chr1.fa.O7frz.83737457
  Located on chromosome 1
  Distance between a terminus base of telomere on chromosomal short arm and 5'-terminus of this base sequence : 77643396
  Distance between 3'-terminus of neighbour sequence of sequence listing upward to telomere on chrosomal short arm and 5'-terminus of this base sequence : 239484
cagtatactgcctgaacagaacagggactttcttctgctttcagttgtgtccagcatgactagaagagtgtttggcttaataggcattatatatatatatatatatatatatatatattttacatatattattaattatatataattaatagccaatttattgaagaataaactatgttcactgccatc

SEQ ID NO: 745 - DNA, 232 bp, Homo sapiens
  chr1.fa.O7frz.84093592
  Located on chromosome 1
  Distance between a terminus base of telomere on chromosomal short arm and 5'-terminus of this base sequence : 77937125
  Distance between 3'-terminus of neighbour sequence of sequence listing upward to telomere on chrosomal short arm and 5'-terminus of this base sequence : 293540
gagtggtagccaagaaatagtcaccacaggctttgggcaagacccagtactatgctgacttcaggtgtgacccagcgcagtctcagctataggaaagtaatttatcctcccttggcctcaattttctagttttagaaagtggattatactatcacccacaataatagatgtgtgtgtgtgtgtgtgtgtgtgtgtaatgtcaatatatgtcaaatgcttagacactacctag

SEQ ID NO: 746 - DNA, 468 bp, Homo sapiens
  chr1.fa.O7frz.84352040
  Located on chromosome 1
  Distance between a terminus base of telomere on chromosomal short arm and 5'-terminus of this base sequence : 78130907
  Distance between 3'-terminus of neighbour sequence of sequence listing upward to telomere on chrosomal short arm and 5'-terminus of this base sequence : 193550
cattcctgaaatgaatcactagcattagagggcccattcttctaacatgtcatgctctgggaaggttgcttactgcagaattggcattagagctcgaaggatgttggaataaaagctgatactagctatcccatagatcttaacagcactattgctatttaaaaggctacttttttctttttttaacattgttaggtgttgggcctcaaaatttacttttagcagtcaggagatgcactgtcagctcctaaaagtaagaacacttcatctccacctcagcccacacacacacacacacacacacacacacacacacacacagtatttttagaaaaggaatagactagtgctatagtgatttttatagtatttcctgttgaggaaattaaaggagggaggctccctccttcaaaaagaattaaacggagtgggattttctaaaacaagacaaactcaccttctgttctt

SEQ ID NO: 747 - DNA, 241 bp, Homo sapiens
  D1S2761
  Located on chromosome 1
  Distance between a terminus base of telomere on chromosomal short arm and 5'-terminus of this base sequence : 78307084
  Distance between 3'-terminus of neighbour sequence of sequence listing upward to telomere on chrosomal short arm and 5'-terminus of this base sequence : 175709
tggctgaccacaggtaattgaaaccaccggaagtgaaatcacggataagaggggactactgtgtgtgtgtgtgtgtgtgtgtgtgtgtgtgtgtatacttatatacacatagaaagagagagagagagagagaaagacaaagaggaagacagacagagatagacagaggcagagtcagggagaggcagagaaagaaagagaacaagaaagcttaaagatagtccaaacgcaaagctgtctt

SEQ ID NO: 748 - DNA, 379 bp, Homo sapiens
  chr1.fa.O7frz.84867581
  Located on chromosome 1
  Distance between a terminus base of telomere on chromosomal short arm and 5'-terminus of this base sequence : 78422282
  Distance between 3'-terminus of neighbour sequence of sequence listing upward to telomere on chrosomal short arm and 5'-terminus of this base sequence : 114957
gtcagtatcttgctaatgctttatggtaaccaggggatttctttctcatttgtgagagtaacagctctaagagcagtgaaaaagcttccctaagcttaactggcaaccctcaaacctttccagtatgtgttgtttaatgaaagtctagtttgtatttcaatagcaataatgatttttaaactaggtaaaaattttctggagtactgtgtaaaaagaaaacacacacacacacacacacacacacacacacacacacttggctgcaagagtgcagctagcttgattttggagccattacaatcagtgagccactcaagactctctcagccttcccttttccatagcatccaattttctacctcttagtcctgaggttatt

SEQ ID NO: 749 - DNA, 441 bp, Homo sapiens
  chr1.fa.O7frz.84938934
  Located on chromosome 1
  Distance between a terminus base of telomere on chromosomal short arm and 5'-terminus of this base sequence : 78668478
  Distance between 3'-terminus of neighbour sequence of sequence listing upward to telomere on chrosomal short arm and 5'-terminus of this base sequence : 245817
taatttgacaaagtaagcctctagtctcatcactccatatcaatatgaatgtcttcttctctttacaaggctatcttacagataaaatttatcttggaaagtattctttacatacatacatacatacatacacacacacacacacacacacacacacacacaccacacacatatatacacacagataaaaagcgttgggaattttaaaaattctgacgaggctctttgcttaataaatgtggtgttcctatatgtattttaagcatatctatctagaaatttgttgtttcctatgcagaaaataaaacactgtatagaaataatgagaaactcaaactccctcaccctttgttgcataataatcaatgtaagatattataaggaagtatttattatatcaaaacgaaggacattattctgatagctgttggatctaaaata

SEQ ID NO: 750 - DNA, 427 bp, Homo sapiens
  chr1.fa.O7frz.85139065
  Located on chromosome 1
  Distance between a terminus base of telomere on chromosomal short arm and 5'-terminus of this base sequence : 78769096
  Distance between 3'-terminus of neighbour sequence of sequence listing upward to telomere on chrosomal short arm and 5'-terminus of this base sequence : 100177
atttactggaatactgttgacaacaaaaaagtgacatcaacctaactattcttcacttggggataaaaaactgtttatttacacactgaaatatatagcaattaaaataaattaactgattttagtgtatcagtatggataaatttcaaaaaatgttaataaaaaaagttaacaaagtttcaaaatggtacatagagtaggataatgtaaaagtctgagcacatatcaataacgtgtgtgtgtgtgtgtgtgtgtgtgtgtgtgtgtgtgtgtataaatgcatacatattctggacctatacatatgtagtaaaaaatatatgcatagaaaaatgccccaaactcaaaatactactgtagtttctcatgatgtgagacagaaaaggaagtgccaggagagtggaactttagctacctccgtaacatt

SEQ ID NO: 751 - DNA, 480 bp, Homo sapiens
  chr1.fa.O7frz.85216378
  Located on chromosome 1
  Distance between a terminus base of telomere on chromosomal short arm and 5'-terminus of this base sequence : 78828599
  Distance between 3'-terminus of neighbour sequence of sequence listing upward to telomere on chrosomal short arm and 5'-terminus of this base sequence : 59076
caggacatagaaattgactcaccgcccagaggcttacagctcaaggaggggtgcgcgcagctgcaccccgggacaggtcagcatcccacaaggcgcctggagtaaagcgaggccagaccaatctttcacgtcttctgctcctgtctgacgaccattcttcttccccaagcccagaaacctctaaaaatgaatcattttctccacttatgcagagatagacgctcttagatcaaggttagtattttgaaaacctgactgagagccgcctgattaggcgagggtgggtggaaagaccgcataaatgcccgcacccccgccctgcttccctaacacagctccagctctctctggatctccaaatgacccgcgcgataaattctcctcgatagtagccagacagtaccccagattcactttaaaccctaacacacacacacacacacacacacacacacactgtaattaaatatccaaaccgga

SEQ ID NO: 752 - DNA, 117 bp, Homo sapiens
  D1S464
  Located on chromosome 1
  Distance between a terminus base of telomere on chromosomal short arm and 5'-terminus of this base sequence : 78966242
  Distance between 3'-terminus of neighbour sequence of sequence listing upward to telomere on chrosomal short arm and 5'-terminus of this base sequence : 137163
gcctaaatttcttacacatcctaacatagatgcatttcattttggcatagaaatacacacacacacacacacacacacacacacacacacacacatttatttgtggtgtttaaaaca

SEQ ID NO: 753 - DNA, 249 bp, Homo sapiens
  D1S481
  Located on chromosome 1
  Distance between a terminus base of telomere on chromosomal short arm and 5'-terminus of this base sequence : 79123580
  Distance between 3'-terminus of neighbour sequence of sequence listing upward to telomere on chrosomal short arm and 5'-terminus of this base sequence : 157221
atgtccatgttttacctaattgtccttgatctccactactccttcctaaatcatattcttcccgaccactgacttggtcaagatcaaatttgaattgttataacaccttgggctttatatatacacatatatacatacatacatacatacatacatacatacatatccacatacacacacacacacacacacacacacacacacatatatcttttcctcttgtgaagagagagatgcaccagcaaacct

SEQ ID NO: 754 - DNA, 390 bp, Homo sapiens
  AL096829.17_74985
  Located on chromosome 1
  Distance between a terminus base of telomere on chromosomal short arm and 5'-terminus of this base sequence : 79363073
  Distance between 3'-terminus of neighbour sequence of sequence listing upward to telomere on chrosomal short arm and 5'-terminus of this base sequence : 239244
tagctttctgagaatttctaacatcattcaaaaagaacactattaagatttacagctaatatcaaatcttctaataaccaattggtacaagtccctgaatatattaatagcaaattcactttttctttttctttcatgggcccacacttaacctttaggctcagatgatactgagtttcttcaaactaaagtgatagttcaacatagtagacacatgcacacacacacacacacacacacacaatgtaatgttcacgagagaaaattgaatccctgaacagaccaataatgagctctgaaattgaggcagtaataaatagcctaccaaccaaaaaaaagttgaagttgcaccagacagattcacagctgaattctaccagatgtacaaag

SEQ ID NO: 755 - DNA, 244 bp, Homo sapiens
  D1S2855
  Located on chromosome 1
  Distance between a terminus base of telomere on chromosomal short arm and 5'-terminus of this base sequence : 79382401
  Distance between 3'-terminus of neighbour sequence of sequence listing upward to telomere on chrosomal short arm and 5'-terminus of this base sequence : 18938
ggaaatggatgcagaacttgtcaccctagggacgaaggggcggagggaggggggattggaagaaaagaatagaagagaccatgaaaaactctctctctctcttacacacacacacacatacatacacacacacacacacacacacacacacacacacacacacacgagagggagagagagagagattccggaaaagacaagatgctaggagcccagtcgcttctctccccactgcccagaggct

SEQ ID NO: 756 - DNA, 467 bp, Homo sapiens
  chr1.fa.O7frz.85844369
  Located on chromosome 1
  Distance between a terminus base of telomere on chromosomal short arm and 5'-terminus of this base sequence : 79503104
  Distance between 3'-terminus of neighbour sequence of sequence listing upward to telomere on chrosomal short arm and 5'-terminus of this base sequence : 120459
attaatgtgaacctgtaactgaagaaatagcaacttatttgttgaatgactgaatgacttgggaagaatagttgtagagtttatttaaacctctgaaagcaactcaacaaatttttaaattagatttttttaacaagataaatacacacacagacatacacacacacacacacacacacacacacacacgctctattctgaaactgttgtttacctaaggatttttacttcttgtttactcaaacatatttcaatctaaggtgtggttgttatactgaaatacagtagatgtattagttttgagctaatgatgagaattcatcttaaagaacagaaaataatatttgaaaataaatgttttttatttcagatacctaaaatttcaagcaaactgtttaataaaggaatttgtacatatttgctaggaaatttgcaattttttttaacaattgagaggttagctaaac

SEQ ID NO: 757 - DNA, 390 bp, Homo sapiens
  AL359206.2_41262
  Located on chromosome 1
  Distance between a terminus base of telomere on chromosomal short arm and 5'-terminus of this base sequence : 79536803
  Distance between 3'-terminus of neighbour sequence of sequence listing upward to telomere on chrosomal short arm and 5'-terminus of this base sequence : 33232
atttaaccttttgatggtcaattaactttgtttgtttgtttgtttgtttgatttttgagatgcagtcttgctctgtcacccaggctgaagtgcagtggtgtgatctcggatctcagctcactgcaacctctgcctcctgagttcaccctattctcctgtctcagcctctcgagtagccgggattataagcatgtaccaccatgcccagctaatttttgtatttttttagtagatacggggttttgccatgttggtcagactggtctcaaactcctgacctcaggtgatctgcctgcctcagcctcccaaagtgctgggattacaggcatgagccactgggcccgaccaattaaaattttttaaatcttttgctattacaaagactgctcc

SEQ ID NO: 758 - DNA, 335 bp, Homo sapiens
  chr1.fa.O7frz.86038618
  Located on chromosome 1
  Distance between a terminus base of telomere on chromosomal short arm and 5'-terminus of this base sequence : 79679928
  Distance between 3'-terminus of neighbour sequence of sequence listing upward to telomere on chrosomal short arm and 5'-terminus of this base sequence : 142735
cagtatggaagatctgttctttactaccttcagactcaaactgaaacattggctttttctgggtctggaacctgccagctttggactggagttgtaccattggctctcctggacctatagctagcccattttagaccttggtacttgttagccttcataaatcacatgagccagtttcttatgatgaatctcttcacacgcacacacatacacactctctctctctctctctttctctctctcactctcactcctgccccaccccctctctattggtcctctttctctggagaaccctaatacaaatcttggttctggtatgatctgacaatagt

SEQ ID NO: 759 - DNA, 388 bp, Homo sapiens
  chr1.fa.O7frz.86142115
  Located on chromosome 1
  Distance between a terminus base of telomere on chromosomal short arm and 5'-terminus of this base sequence : 79783450
  Distance between 3'-terminus of neighbour sequence of sequence listing upward to telomere on chrosomal short arm and 5'-terminus of this base sequence : 103187
tgattctaatggatctgacacttcttagataaggtatttatacttaaatctgcacacacaagcttcaggtgacacctgcaaatgttaacagctgtaagagagatagggctggaaatagagtggtggtcatgattgccaacttagaacgtaagattacaatttattcttttgtaaactttccagaacctatcctatttaaaccttttccctagtatcactgggtacaagaaagagcttcatagtgctttgggtttcttcctcactcatattctatggactacagaacagctttcaattcaatactcaaaaactattgtttttgtgtgtgtgtgtgtgtgtgtgtgtgtgtgtgtgtgtgtgtgtgatctatcgactacatagaatctgc

SEQ ID NO: 760 - DNA, 469 bp, Homo sapiens
  chr1.fa.O7frz.86254996
  Located on chromosome 1
  Distance between a terminus base of telomere on chromosomal short arm and 5'-terminus of this base sequence : 79896402
  Distance between 3'-terminus of neighbour sequence of sequence listing upward to telomere on chrosomal short arm and 5'-terminus of this base sequence : 112564
aaaggatcagtctttacaggagttgtcttctgagcctgggtatgaagggtctctaaactattttatgggaaatttaaatccctcgatcgaaacaaattatcataggagggaagaaaaagtaaatctcattaatggttaggtgtagtgggttaagtatttgcaaaagtcttggtcattttgaaaatggtaataccagtgcaatgagttctgaaatctgtagacatagtgtgtgtgtgtgtgtgtgtgtgtgtgtgtgtgtgtgtttctgaagaaaataaaaattttcacatctaaaataaaggctcagtttcctttggggtgccttagttcacagcagtatgacagctaaccagaaagctgccatactgtgattctgtttttatattatttaattagatgatttaaagattctctaaaaattctggtgcagcctttgtgttcctgggaggaatcttacataacttggagt

SEQ ID NO: 761 - DNA, 113 bp, Homo sapiens
  DISO7_10000648
  Located on chromosome 1
  Distance between a terminus base of telomere on chromosomal short arm and 5'-terminus of this base sequence : 79958832
  Distance between 3'-terminus of neighbour sequence of sequence listing upward to telomere on chrosomal short arm and 5'-terminus of this base sequence : 61961
gaacagttattcattgagaggggtgtgtgtgtgtgtgtgtgtgtgtgtgtgtgtgctgaagatagtattatcccaaataatcatattatatagaggctacaactcagtcttgc

SEQ ID NO: 762 - DNA, 124 bp, Homo sapiens
  DISO7_10000649
  Located on chromosome 1
  Distance between a terminus base of telomere on chromosomal short arm and 5'-terminus of this base sequence : 79989979
  Distance between 3'-terminus of neighbour sequence of sequence listing upward to telomere on chrosomal short arm and 5'-terminus of this base sequence : 31034
atgcttccaagccaattctttaaagaggtgtgggtggagagtgtgtgtgcatgcatgtgtgtgtgtgtgtgtgtgtgtgtgtgtgtgtgtatgtacatacacacatatacaattagctccaagg

SEQ ID NO: 763 - DNA, 261 bp, Homo sapiens
  AL139155.3_26772
  Located on chromosome 1
  Distance between a terminus base of telomere on chromosomal short arm and 5'-terminus of this base sequence : 80134871
  Distance between 3'-terminus of neighbour sequence of sequence listing upward to telomere on chrosomal short arm and 5'-terminus of this base sequence : 144768
tagttctttcagaaatctccaaactgcttttctttctttctttctttctttctttctttctttctttctttctttctttctttctttctttctttctttctttccttctttctttctttctttctttccttctttctttcttttaattatactttaagttctgggatacttgtacagaatgtgcaggtttgttacataggtatacatgggccatgatggtttgctgcacccatcaacctgtcacctacattaggtgtttct

SEQ ID NO: 764 - DNA, 258 bp, Homo sapiens
  AL139155.3_54431
  Located on chromosome 1
  Distance between a terminus base of telomere on chromosomal short arm and 5'-terminus of this base sequence : 80185152
  Distance between 3'-terminus of neighbour sequence of sequence listing upward to telomere on chrosomal short arm and 5'-terminus of this base sequence : 50020
atgtaatgctggagaagtcagtggaaggtgaattaaccagctaacaaaacatttggataattgaatgttctttagaaacaaatcgtaagccattaggaaagaccttccttccttccttccttccttccttccttccttccttccttcctcccacttccctttcaccttccccttccccttcccttcccttcccttccttttcttttcctatagcacataacattggaattgactctactcactttcatccaactatcc

SEQ ID NO: 765 - DNA, 396 bp, Homo sapiens
  chr1.fa.O7frz.111915759
  Located on chromosome 1
  Distance between a terminus base of telomere on chromosomal short arm and 5'-terminus of this base sequence : 80209219
  Distance between 3'-terminus of neighbour sequence of sequence listing upward to telomere on chrosomal short arm and 5'-terminus of this base sequence : 23809
gttatgagttcaaaccgaaactttcaattcaaatccagggctatcaggttttaagtttacatcctctatcttatatctgttccttctttttaccatgctgacaatcacaggtctcagagatttcaatgtaattattcatctgctttattccacaacacacacacacacacacacacacacacacacacacacacataatcttagaataagaataacagcacaacaagcaatataattatggtaaacactttaaggatattttgcatcaaagaaaacatttgaatggcaaacatttatgtggatctgtgctcacaaagtatatgttggtaatagtctccaaaaaagaacatttttctcctaagtaaataggagtgaattaagtggtatacatcactg

SEQ ID NO: 766 - DNA, 288 bp, Homo sapiens
  DISO7_10000655
  Located on chromosome 1
  Distance between a terminus base of telomere on chromosomal short arm and 5'-terminus of this base sequence : 80337075
  Distance between 3'-terminus of neighbour sequence of sequence listing upward to telomere on chrosomal short arm and 5'-terminus of this base sequence : 127460
gtcctacagagtggtcaacttcttattttgctaagtaaagatcattaatttttttccttttcactcatttgttaattcagtgaatatttattgagcacatactatctgcagctactaaagtatgtctgggaatgcgattaaaatcaaagctagatatagcccatgacctcaagcatcatatagtctagtgggggagatagtcatcattaattaattacatttatatatatatatatatatatgagatttaaattgagctacgtactctacaggaaatagacatggttc

SEQ ID NO: 767 - DNA, 102 bp, Homo sapiens
  DISO7_10000653
  Located on chromosome 1
  Distance between a terminus base of telomere on chromosomal short arm and 5'-terminus of this base sequence : 80392937
  Distance between 3'-terminus of neighbour sequence of sequence listing upward to telomere on chrosomal short arm and 5'-terminus of this base sequence : 55574
attcctcccactaccgtatcgtgtgtgtgtgtgtgtgtgtgtgtgtgtgtgtgtgtgtaatgttgctcagaaaatatagataaatacttccattctccatca

SEQ ID NO: 768 - DNA, 408 bp, Homo sapiens
  chr10.fa.O7frz.70528212
  Located on chromosome 1
  Distance between a terminus base of telomere on chromosomal short arm and 5'-terminus of this base sequence : 80401749
  Distance between 3'-terminus of neighbour sequence of sequence listing upward to telomere on chrosomal short arm and 5'-terminus of this base sequence : 8710
tacttgatataggatcgtcaagagagaaccctctcagaaggagctgttgtcaggggaagatcaaaagccctgagctggaaatgtgtgtgtgtgtgtgtgtgtgtgtgtgtgtgtgtgtgtgtgtgtgtgtgtacctggcccacttctttttccttcagtgtttgtctttttataacctgtttaaaagagcaatttttatattaaaaaattaaccctttgaattccgtttatgttaccaacgttttcccctcacttcgtcagtgtatttctcttttgtgatatttttgcaccagtggaatttttatcagaattgcactcaaatatattaattatttgggaagaatttacatgtctgcagccttcagtcctcccatttagtaaaactggtagtccagtcttaaaagtacc

SEQ ID NO: 769 - DNA, 217 bp, Homo sapiens
  chr1.fa.O7frz.86666338
  Located on chromosome 1
  Distance between a terminus base of telomere on chromosomal short arm and 5'-terminus of this base sequence : 80504725
  Distance between 3'-terminus of neighbour sequence of sequence listing upward to telomere on chrosomal short arm and 5'-terminus of this base sequence : 102568
aattggcttcagacttgtttacagtttattagtcccagtaactttcctataaagaaaagacttgactttaaaatatttaatatgtatattttaaatatttatacacacacacacacacacacacacacacacacgtcatcccaaaaactccatcaaagtttcccatcccctaaattctaccatccctaaaactatcaaagtgtcagagtatttctgt

SEQ ID NO: 770 - DNA, 117 bp, Homo sapiens
  DISO7_10000658
  Located on chromosome 1
  Distance between a terminus base of telomere on chromosomal short arm and 5'-terminus of this base sequence : 80664406
  Distance between 3'-terminus of neighbour sequence of sequence listing upward to telomere on chrosomal short arm and 5'-terminus of this base sequence : 159464
acttggagctttcctctgagtatttcttgatttaatgtgtggtgtgtgtgtgtgtgtgtgtgtgtgtgtgtgtgtgtgtgtgtgtgtgtgttagcttggttatacattaggctacag

SEQ ID NO: 771 - DNA, 113 bp, Homo sapiens
  DISO7_10000656
  Located on chromosome 1
  Distance between a terminus base of telomere on chromosomal short arm and 5'-terminus of this base sequence : 80859396
  Distance between 3'-terminus of neighbour sequence of sequence listing upward to telomere on chrosomal short arm and 5'-terminus of this base sequence : 194873
gagactggaagagaagcagggtgtgtgtgtgtgtgtgtgtgtgtgtgtgtgtgtgtatgtgttagaaaggggagctataagagacatattttggatacattcctcagagatgc

SEQ ID NO: 772 - DNA, 151 bp, Homo sapiens
  Z66995
  Located on chromosome 1
  Distance between a terminus base of telomere on chromosomal short arm and 5'-terminus of this base sequence : 80914198
  Distance between 3'-terminus of neighbour sequence of sequence listing upward to telomere on chrosomal short arm and 5'-terminus of this base sequence : 54689
tggacattttcacctggatgctttatagacatcttaaatcatgttgaaaaactaactcattatcttaagcattcccaaacaaccttctaactcacgcgtgtgcgcacacacacacacacacacacacacagacaccctgcctattcctgaa

SEQ ID NO: 773 - DNA, 293 bp, Homo sapiens
  AL035409.15_78149
  Located on chromosome 1
  Distance between a terminus base of telomere on chromosomal short arm and 5'-terminus of this base sequence : 80937453
  Distance between 3'-terminus of neighbour sequence of sequence listing upward to telomere on chrosomal short arm and 5'-terminus of this base sequence : 23104
tactcggtattagtcggaattctccagagaaacagaaacaataggacactcgcacacaaacacacacacacacacacacacacacacacacacacatggagctttattatgagaagttggcttatgcaattacggaggccaagacatcccatgatcagcagattgcaagctggggactcaggaaagccagtagggtaaatcagtccaacctgagacccaggggagctgatgatataaatcccagtccaaaagcaggaggagatgagatgagatgtcctaatttaagcactgag

SEQ ID NO: 774 - DNA, 127 bp, Homo sapiens
  G07787
  Located on chromosome 1
  Distance between a terminus base of telomere on chromosomal short arm and 5'-terminus of this base sequence : 80949213
  Distance between 3'-terminus of neighbour sequence of sequence listing upward to telomere on chrosomal short arm and 5'-terminus of this base sequence : 11467
atggtgcctggaagatagtggaccactaaagaacactttctgaatgaatgaatgaatgaatgaatgaatgaatgaatgaatgaatgaaaatgtgttaggtacaagtgttgtgctgtggaacacactc

SEQ ID NO: 775 - DNA, 398 bp, Homo sapiens
  AC026874.4_79561
  Located on chromosome 1
  Distance between a terminus base of telomere on chromosomal short arm and 5'-terminus of this base sequence : 80949225
  Distance between 3'-terminus of neighbour sequence of sequence listing upward to telomere on chrosomal short arm and 5'-terminus of this base sequence : -115
agatagtggaccactaaagaacactttctgaatgaatgaatgaatgaatgaatgaatgaatgaatgaatgaatgaaaatgtgttaggtacaagtgttgtgctgtggaacacactcctggattctggctcctgccccacaggcttgtccccaaactgatgaagagcaaggcaggcactgcgcacagtggtttgggtcatcagcagtccaagaatgttttccccagtgtaggtgctcccccaggttgatgggagtctgggagaggtggtgctgacaagagagtttcttcacctccactccaaagacagaaagcaacgaaagttaatgacagaagcaagcagcaggtgccagtgccagctccactgctcagtgcttctggatcctttcacggttctgtaat

SEQ ID NO: 776 - DNA, 340 bp, Homo sapiens
  AL035409.15_14947
  Located on chromosome 1
  Distance between a terminus base of telomere on chromosomal short arm and 5'-terminus of this base sequence : 81000692
  Distance between 3'-terminus of neighbour sequence of sequence listing upward to telomere on chrosomal short arm and 5'-terminus of this base sequence : 51069
cagatgtctttcaccatagattacccattattcttgcgtgtgtgtgtgtgtgtgtgtgtatgtgtgtgtaccgtttattctgtctataaaagtcttcttcattgaacaggtgtcaaaactgttgggcttatgctggcacacaaataaagaagtgacatagcaacggacaaaaaagggatcccaagttgtctgattcaactccaaaaggacagagtcactgcaagcagagagcaggtagaagctgtacgctccagtgcagcaaaagatctgtaagccagcccatctctcaaggccactccaacctcccttctcagctgtgtgactctcaatgactttgcta

SEQ ID NO: 777 - DNA, 282 bp, Homo sapiens
  chr1.fa.O7frz.87058785
  Located on chromosome 1
  Distance between a terminus base of telomere on chromosomal short arm and 5'-terminus of this base sequence : 81156551
  Distance between 3'-terminus of neighbour sequence of sequence listing upward to telomere on chrosomal short arm and 5'-terminus of this base sequence : 155519
taaccatagtctgcgtttaaactagaactcaatttagttattcattaatttattattgagatattcattaagtgagttaatacaatttggcaactaaaaccaaatatgagtatttgattgatcaaaattacacacacacacacacacacacacacacacacacgcatatatatttctggcttctctaataaaagtttttataactgaccctcacagtaagtcatgccacaaagcctatccatgctgtttttactgttgttcttcaatcgaatgacaacttaa

SEQ ID NO: 778 - DNA, 199 bp, Homo sapiens
  D1S499
  Located on chromosome 1
  Distance between a terminus base of telomere on chromosomal short arm and 5'-terminus of this base sequence : 81265241
  Distance between 3'-terminus of neighbour sequence of sequence listing upward to telomere on chrosomal short arm and 5'-terminus of this base sequence : 108408
tgtccaccactgctttaaaaattcaattaattaagtgtggaacatattaaaaaaaagttcaccatttgcgtgtgtgtgtgtgtgtgtgtgtgtgtgtgtgtgtgtcttactcatggctatagaataagactaaaactaattttcgtgtatgcctatagagccacctcatttatgtgtataaaccaatggtggcaaaaag

SEQ ID NO: 779 - DNA, 241 bp, Homo sapiens
  AC019136.5_144613
  Located on chromosome 1
  Distance between a terminus base of telomere on chromosomal short arm and 5'-terminus of this base sequence : 81329442
  Distance between 3'-terminus of neighbour sequence of sequence listing upward to telomere on chrosomal short arm and 5'-terminus of this base sequence : 64002
agcactgtcctctgtcagtaagttattttcagcattcaggtagtctttgccactaaatctttaacatctgagaaacccaaagccatgtaaaagaacctggtcgttcttttggttgttttgttgttgttgttgttgttgtttttgcattaagcattcctcatgtatgggaaactatgataattcagaatgaaaaacgtgggagaaatacctttaaaatgttatcagctacataaagcctgac

SEQ ID NO: 780 - DNA, 263 bp, Homo sapiens
  Z67293
  Located on chromosome 1
  Distance between a terminus base of telomere on chromosomal short arm and 5'-terminus of this base sequence : 81417654
  Distance between 3'-terminus of neighbour sequence of sequence listing upward to telomere on chrosomal short arm and 5'-terminus of this base sequence : 87971
tgtgaggtgttttgctgtttttttaaaaaaaaaaaacaggtataaggaaagtgcaaaaaaattcattttcaggtaaaaagatgaggaaatagcctgatctatttttgattgttctttttagtgtgtgtgtgtgtgtgtgtgtgtgtgcgtgtgtgtgtttctgagacagggtctcactctgtcatccaggctagagtgtactgatgcagtcatggcttactgcagcctcaacctcctaggcccaagccgtcctccagccttag

SEQ ID NO: 781 - DNA, 479 bp, Homo sapiens
  chr1.fa.O7frz.88162274
  Located on chromosome 1
  Distance between a terminus base of telomere on chromosomal short arm and 5'-terminus of this base sequence : 81613700
  Distance between 3'-terminus of neighbour sequence of sequence listing upward to telomere on chrosomal short arm and 5'-terminus of this base sequence : 195783
gctatgagtctatggtattgctagacctttactgaacatattatgtattttgacaattataatgtaaaaaaaattggccggtcatggtggttcacgcctgtaatcccaacactttgggaggccaaggcgggtggattgcttgagttcaggagatcgaaaccagcctgggtgacatggcaaaatgctgcctctacaaaaaatacaagaattagctgggtgtggtggcatattcttgtagttccagctactcaggatgctgaggtgggagaattgcttgagcccaggaggtcgaggtcgcatgtgagctgagattgcaccactgcactccagcctgagcgacagagtgagaccctgtctcgaaaaaactattaaaaaaaaatatatatatatatatatatatataagctcttagggaccagtatctttatcttattatatatcccaataacagacactactgatatgactgataccacaac

SEQ ID NO: 782 - DNA, 226 bp, Homo sapiens
  D1S1611
  Located on chromosome 1
  Distance between a terminus base of telomere on chromosomal short arm and 5'-terminus of this base sequence : 81628451
  Distance between 3'-terminus of neighbour sequence of sequence listing upward to telomere on chrosomal short arm and 5'-terminus of this base sequence : 14272
cagaaaagagatgacagtggcctacattagaaagaaagaaagaacgaaagaatggaaggaaggaaggaaggaaggaaggaaggaaggaaggaaggaaggaaggaaactgagctgaatcagtaagaacagtaggagaggaaggtgtagtaaacaagtagttgaagaatactttgctttttctggattgggcaagtaaaagactccaccaaatcaaggaaaaaacgtg

SEQ ID NO: 783 - DNA, 322 bp, Homo sapiens
  AC025412.3_92026
  Located on chromosome 1
  Distance between a terminus base of telomere on chromosomal short arm and 5'-terminus of this base sequence : 81628459
  Distance between 3'-terminus of neighbour sequence of sequence listing upward to telomere on chrosomal short arm and 5'-terminus of this base sequence : -218
agatgacagtggcctacattagaaagaaagaaagaacgaaagaatggaaggaaggaaggaaggaaggaaggaaggaaggaaggaaggaaggaaggaaactgagctgaatcagtaagaacagtaggagaggaaggtgtagtaaacaagtagttgaagaatactttgctttttctggattgggcaagtaaaagactccaccaaatcaaggaaaaaacgtgaatattcaatgtgagtatgaaagaagcagtaagttcagtttcagacatgttccactgggtatactatgggacatggaaatgcagctatccactaaatggtctga

SEQ ID NO: 784 - DNA, 313 bp, Homo sapiens
  AL390880.4_38000
  Located on chromosome 1
  Distance between a terminus base of telomere on chromosomal short arm and 5'-terminus of this base sequence : 81875668
  Distance between 3'-terminus of neighbour sequence of sequence listing upward to telomere on chrosomal short arm and 5'-terminus of this base sequence : 246887
ttgcaatcttaatcctgtaacacaaagacccccctgtggcgtctctagttttactctacatttcttcaatttgaatttttaatattctgaggtttttgttgttgttgttgttgttgttgttgttttaagaaaacgggctctgtcacccaggctgtagtgcagtggcacaattagctcactgtaaccttgaactcctaggttcaagtgatcctcctgcctcagcctcccaagtaggtaagactacaggtacatgacaccatatccagccataaacttgtaatattaacagaagctgtgaatgttaagtttccta

SEQ ID NO: 785 - DNA, 243 bp, Homo sapiens
  AL157947.4_76151
  Located on chromosome 1
  Distance between a terminus base of telomere on chromosomal short arm and 5'-terminus of this base sequence : 82011923
  Distance between 3'-terminus of neighbour sequence of sequence listing upward to telomere on chrosomal short arm and 5'-terminus of this base sequence : 135942
attatgaacaaggttactgcaaagattatatatatatatatatatatatatatatatatatatatatatatatatacacacacacacacacacacacacaccaagatagatagatagatagatagatagatagatagatagatagatgatatgcaaaaagtttccctaaggtgtatgactaagagtcaaagagctagctcatcaggtctgcatatcatcaactttactggaaacaatgcaaat

SEQ ID NO: 786 - DNA, 382 bp, Homo sapiens
  AL354946.4_76094
  Located on chromosome 1
  Distance between a terminus base of telomere on chromosomal short arm and 5'-terminus of this base sequence : 82091959
  Distance between 3'-terminus of neighbour sequence of sequence listing upward to telomere on chrosomal short arm and 5'-terminus of this base sequence : 79793
acatttgagttgcttctaccttatggtgactgtgaatagcgctgttataagcatttgtgtacacgtttttgtctgaatacctgtttcaattcctttggtatatacccaaagatgaaattgcaggatcatatgctaattatatgtttaaccttttgaggaacttccaaacagtttcccaaagtagattcggttttacattgttatttttacatcctcaccagcaatgtacaaaggctctaatttcttcacatcctcactaccacttgttattttcttgtttttttattattattattattattattattattattattttcaacctagtttgtgtgaagtggtatctcattgtggttctgttaccagtggagaatcttgatta

SEQ ID NO: 787 - DNA, 217 bp, Homo sapiens
  D1S2876
  Located on chromosome 1
  Distance between a terminus base of telomere on chromosomal short arm and 5'-terminus of this base sequence : 82168645
  Distance between 3'-terminus of neighbour sequence of sequence listing upward to telomere on chrosomal short arm and 5'-terminus of this base sequence : 76304
ggtgtctaaattcctagatcatggtctatctaacatgcaatacatgctctgctataaatgcgtatgtgtgtgtgtgtgtgtgtgtgtgtgtgtgtgtgtgtgtgtgtgtgtgtgtgtcttttatactgtaatgacaaatgctgcagtggtggaacctttctcttttgtattaaagtaattactagggcacttcaaaactgattctctagggtcaaga

SEQ ID NO: 788 - DNA, 163 bp, Homo sapiens
  chr1.fa.O7frz.88943717
  Located on chromosome 1
  Distance between a terminus base of telomere on chromosomal short arm and 5'-terminus of this base sequence : 82246099
  Distance between 3'-terminus of neighbour sequence of sequence listing upward to telomere on chrosomal short arm and 5'-terminus of this base sequence : 77237
atcctatcatgccaataaagacgcttgtcaacagcatacacacacaaacacacacacacacacacacatatatccatgttaccagctagtttcatgccatcaaagtaatcatttgattactttgatgtttcttaccttactctagtgcctagcagtatgatag

SEQ ID NO: 789 - DNA, 463 bp, Homo sapiens
  chr1.fa.O7frz.88770361
  Located on chromosome 1
  Distance between a terminus base of telomere on chromosomal short arm and 5'-terminus of this base sequence : 82419207
  Distance between 3'-terminus of neighbour sequence of sequence listing upward to telomere on chrosomal short arm and 5'-terminus of this base sequence : 172945
attcatgtcagttaatgctcacagtcaggatgtaggtatggtgatgagctccattttacaggtgagagaggttcagttttcaagagtcatactcttaccactactctgtacccactaccatataagggaagcatgagaatgtagtgtgcctatttttaaattactgttctcaagttagggactcctgtatggtgctatattcatttctggatttttttaaaggcgtggcagggaaaaaaaccggggaaagaagaagaggtgtatttctttccattgttaagaaaaataagcaaatggaaggaaggaaggaaggaaggcatgaaggaaggaagggagggagggagggagggaggggagatgattttatttcagggacatattttgatgtagttccaacccaattttttacactttctatattgactttatcttatattgaggattgatcttcaattgagacttg

SEQ ID NO: 790 - DNA, 267 bp, Homo sapiens
  D1S2614
  Located on chromosome 1
  Distance between a terminus base of telomere on chromosomal short arm and 5'-terminus of this base sequence : 82546932
  Distance between 3'-terminus of neighbour sequence of sequence listing upward to telomere on chrosomal short arm and 5'-terminus of this base sequence : 127262
atttaccacccctcactgtggtcactatgggtcttactcctcctgttctgtgccatgctgagagatcaggaatcttctgaagacttttgttcctgtctaaacgctccatgtggccacaatatgcctatgaaaaaacaagaaacagtctttttctatttgaatgtctaaaggcatcactctccccatcctaaacacacacacacacacacacacacacacacacacacacacacacacacacattctttatagcctttagtctacacc

SEQ ID NO: 791 - DNA, 232 bp, Homo sapiens
  chr1.fa.O7frz.90593643
  Located on chromosome 1
  Distance between a terminus base of telomere on chromosomal short arm and 5'-terminus of this base sequence : 82926765
  Distance between 3'-terminus of neighbour sequence of sequence listing upward to telomere on chrosomal short arm and 5'-terminus of this base sequence : 379566
gtatagttccattaaactgctcattcttttatatgtttatgtacatgtgtgtgtatatatgtatatatacacgtacacatatatatgcacatatatacacacacagacacacacacacacacacacacacactatactgtccattactgaaccatatatgtatatgtgggttttggtcacaggtggcatccttttctaatatgccaaaaaatgctacataagataatggcag

SEQ ID NO: 792 - DNA, 304 bp, Homo sapiens
  chr1.fa.O7frz.90522337
  Located on chromosome 1
  Distance between a terminus base of telomere on chromosomal short arm and 5'-terminus of this base sequence : 82998002
  Distance between 3'-terminus of neighbour sequence of sequence listing upward to telomere on chrosomal short arm and 5'-terminus of this base sequence : 71005
tttatattgactcattgaccagactttttattattgactcattgaccaaacactgttttgcagtgtttcaccttatggcattgcttcctcatagtgtcatttggctttttcttttaaaatagatgatgatgatgatgatagatatagatagatagataggtagatagatgacagatagatagatagatagatagatagatagatagatagatagataatggacagacaactgggaatgtgtatctaaaaggactgacgaatgaatattaaacatttttggctagaataccaaatagatggtgtg

SEQ ID NO: 793 - DNA, 393 bp, Homo sapiens
  chr1.fa.O7frz.90284642
  Located on chromosome 1
  Distance between a terminus base of telomere on chromosomal short arm and 5'-terminus of this base sequence : 83232965
  Distance between 3'-terminus of neighbour sequence of sequence listing upward to telomere on chrosomal short arm and 5'-terminus of this base sequence : 234659
cacgatccagattgtgaagcatttatgtgccttgctaaagaatttggaatttattctaagcaaagagagtttttagcagggaagtaacatgatcctctttgtaatgcattacttcttgcctagttctgtaaaagagctcctgctgtagtatttctagtatttgggctgtttaatttgtgtgtgtgtgtgtgtgtgtgtgtgtgtgtgtttacatttgtataaaagcaatgaaagaagcataatgattcttgggacaaaatgtacatttaacagtactaaaaatatgaccctgattcttaattcagattattgtaatgtgagaaacaatacttgattccaccctaagacgtaactttgaaaaacaatacatgtctgtaccgtattctgcgtcac

SEQ ID NO: 794 - DNA, 269 bp, Homo sapiens
  chr1.fa.O7frz.90127527
  Located on chromosome 1
  Distance between a terminus base of telomere on chromosomal short arm and 5'-terminus of this base sequence : 83381781
  Distance between 3'-terminus of neighbour sequence of sequence listing upward to telomere on chrosomal short arm and 5'-terminus of this base sequence : 148423
cgctgataattgagtatctgatagcacctggaggggatctcattctgaaactaagttctcaatattgtattgtcctggaaaggtagatataaagattaacacaaatttgactcactccaagacggagacaggaagcttaaaatttctatgaaacacacacacacacatacacacacacacacacacaccttttcctatattttataacgttcttctaaagtttaagataagccaaataatttttcactagttcaggattcagtttgatt

SEQ ID NO: 795 - DNA, 177 bp, Homo sapiens
  D1S500
  Located on chromosome 1
  Distance between a terminus base of telomere on chromosomal short arm and 5'-terminus of this base sequence : 83456014
  Distance between 3'-terminus of neighbour sequence of sequence listing upward to telomere on chrosomal short arm and 5'-terminus of this base sequence : 73964
ctctgatacgccaagtgcttattcttaacaattgactatggctttatgactttaatcaagaagtgtatgtgtgtgtgtgtgtgtgtgtgtgtgtgtgtgtgtgtgtgcacgtggaggataaagagacaggatgattatacatggttattctttagagttccatgccagtgacattac

SEQ ID NO: 796 - DNA, 248 bp, Homo sapiens
  Z24561.1_235
  Located on chromosome 1
  Distance between a terminus base of telomere on chromosomal short arm and 5'-terminus of this base sequence : 83456026
  Distance between 3'-terminus of neighbour sequence of sequence listing upward to telomere on chrosomal short arm and 5'-terminus of this base sequence : -165
aagtgcttattcttaacaattgactatggctttatgactttaatcaagaagtgtatgtgtgtgtgtgtgtgtgtgtgtgtgtgtgtgtgtgtgtgcacgtggaggataaagagacaggatgattatacatggttattctttagagttccatgccagtgacattactggtatttctgagatgaagcatcatgtattataattaaatatcaacactgattgctgatgtctaccttggttcttgaaagagt

SEQ ID NO: 797 - DNA, 434 bp, Homo sapiens
  chr1.fa.O7frz.89626659
  Located on chromosome 1
  Distance between a terminus base of telomere on chromosomal short arm and 5'-terminus of this base sequence : 83643099
  Distance between 3'-terminus of neighbour sequence of sequence listing upward to telomere on chrosomal short arm and 5'-terminus of this base sequence : 186825
tctgagtttagcaattatggacttatgagtaatctggtttcattttcatttatacccctccttcttctctcacagacccagatttcattataatccataaatatgcctgtatgcatctcgaaaagacacaaacacaccaataaaatgaccataatataattatcacagttaaaattaacattaactttataatacaatcaaaacaccagtcagagttcaaaagtccctttttcatattgtttgtttgtttgtttgtttgtttgtttgtttgtttgaataaggattcaaaccagctgcagtctgcatttgattgatttgcctcgtaggcctcttttaatctatatgtttccattctctctttttttttattttgcaatttatttgttgacaaaactgggtcatttctcccctagagttctcatgttctggacttt

SEQ ID NO: 798 - DNA, 398 bp, Homo sapiens
  AL122000.11_22433
  Located on chromosome 1
  Distance between a terminus base of telomere on chromosomal short arm and 5'-terminus of this base sequence : 83714407
  Distance between 3'-terminus of neighbour sequence of sequence listing upward to telomere on chrosomal short arm and 5'-terminus of this base sequence : 70874
aggtagaggcaattaggtaattagttttagatgaggtcaggagaatggagtccccatgataagattagcgtccttataagaagagaaaaagactagagttgtttgtttgtgtgtgtgtgtgtgtgtgtgtgtgtgtgtgcaccaaataaagcaggtaaagccatgggaggacataaccaagaagagggtcctcactaaaacctgaccctgatgacaccctccagaactgtcagaaataaatttatgtttttaagctacatagtttgtattagttcattctctcactgctataaagaattgcccaagactgggtagtttaataatgaaaagagatttaattgactcacagttctgcatggctggggaggcctcaaggaacttacaattatggcagaagg

SEQ ID NO: 799 - DNA, 343 bp, Homo sapiens
  AL122000.11_45433
  Located on chromosome 1
  Distance between a terminus base of telomere on chromosomal short arm and 5'-terminus of this base sequence : 83737331
  Distance between 3'-terminus of neighbour sequence of sequence listing upward to telomere on chrosomal short arm and 5'-terminus of this base sequence : 22526
atgttcttgaaggcaaactatctacataaattatttgaaatatacctgcattgagagtttcacctcttatctctcatttatttattcattcaatcttacagtaatgtcagtattgactaatatataattattttatactttgagtagttatatatattatattatattaccacacacatacatacacacacacacacacacacacacacacacacacacatatatatatatatatatttttttttttttgagacgcaaccttactttgtcacctgtccctcaggctggagtgtgcaatggcatgatcttggctcactgcaacctgttcctctcaggttcaagc

SEQ ID NO: 800 - DNA, 186 bp, Homo sapiens
  D1S2618
  Located on chromosome 1
  Distance between a terminus base of telomere on chromosomal short arm and 5'-terminus of this base sequence : 83751191
  Distance between 3'-terminus of neighbour sequence of sequence listing upward to telomere on chrosomal short arm and 5'-terminus of this base sequence : 13517
caaacctccttgtaaccacatttctagtgccattctctcataaacatgacaattttacattctaactggcttttatttttctacactttttcagaacatgacaataagaaggggtgtgtgtgtgtgtgtgtgtgtgtgtgtgtaaaatttaatgatatttagtttcccttttagtgttttccaaga

SEQ ID NO: 801 - DNA, 219 bp, Homo sapiens
  AL122000.11_105041
  Located on chromosome 1
  Distance between a terminus base of telomere on chromosomal short arm and 5'-terminus of this base sequence : 83797089
  Distance between 3'-terminus of neighbour sequence of sequence listing upward to telomere on chrosomal short arm and 5'-terminus of this base sequence : 45712
atccagagatgttggtttaaacaaagatagggatgtgtgtgtgtgtgtgtgtgtgtgtgtattttgtatatatgtatataaatatgcctatacctacatatgtatgtatatacatatatacatatgcctatacatatatacacatctacctttatatagccatacactgtatgtgcatgtgtgtgaagacttttaaaactttgataagctaatgtgcat

SEQ ID NO: 802 - DNA, 455 bp, Homo sapiens
  AL160011.20_173282
  Located on chromosome 1
  Distance between a terminus base of telomere on chromosomal short arm and 5'-terminus of this base sequence : 83862736
  Distance between 3'-terminus of neighbour sequence of sequence listing upward to telomere on chrosomal short arm and 5'-terminus of this base sequence : 65428
gtagatacttggagccaaatttattaattagaattctttcaaataaccctgagtctcctgccaaggacatcactaaagaagagtaaatgaatgtgttcctctgcaggaatactgcctctacactgcctctacactgccctgccttagatggtggtgtttggcatgggaagtttcacactagcaatgaaagaatacaattcagaagaatttgtgtaagaagatcccatttttgtgaagtaatagcaaaaatgatttctgtacatgtctactacatgtctgcagatagatgatgacaatgataggttagagagagatgatagatagatgatagatagatagatagatagatagatagatagatagatagatgataggtagatagatgatagataggtttgttttataattaaataaagctgtaagaaaataaactagtgaatatgacttatggcaat

SEQ ID NO: 803 - DNA, 414 bp, Homo sapiens
  chr1.fa.O7frz.89884355
  Located on chromosome 1
  Distance between a terminus base of telomere on chromosomal short arm and 5'-terminus of this base sequence : 83997870
  Distance between 3'-terminus of neighbour sequence of sequence listing upward to telomere on chrosomal short arm and 5'-terminus of this base sequence : 134679
gcactatgagctatcgtcttaacactgcttttgctgtatgccagaggattttataggttgtgtctctacgttcatttgaaataattttttgatttctaccttaatttctttgattccctcaaagtcattcaggagcaagttgtttagtttccacgtacttgtgtgattttcatttaatcttccttttgaagtgaaccctatgtcattatataacaaccttctctgtgtgtgtgtgtgtgtgtgtgtgtgtgtatgtgtgttgttctgtttattgttgtgggtttaaaatctgttttatctattacaagaatggcaacctctgctctttttggtttttcatttatgtgatctgtctttctccacccctttactttgaacctctgggtctcagtacatgttaggtacatctcctga

SEQ ID NO: 804 - DNA, 281 bp, Homo sapiens
  D1S2841
  Located on chromosome 1
  Distance between a terminus base of telomere on chromosomal short arm and 5'-terminus of this base sequence : 84034852
  Distance between 3'-terminus of neighbour sequence of sequence listing upward to telomere on chrosomal short arm and 5'-terminus of this base sequence : 36568
tggctataaataccctgatgcatacaactttaccaaaatctggatttggtgtgtgtgtgtgtgtgtgtgtgtgtgtgtgtgtgtgtgtttgtgtgtgtgcatgttttagaatatattttaaaaatggaaactactgagtcaaaagtaagaatccttttaaggctatggacaaacattgagaaattgttctctaaatcagtttgtttgtttgtttgttttcacttgcttgcttgcttgctttactaattagttaacaactgcagagaattttcactagaagg

SEQ ID NO: 805 - DNA, 400 bp, Homo sapiens
  chr1.fa.O7frz.89405350
  Located on chromosome 1
  Distance between a terminus base of telomere on chromosomal short arm and 5'-terminus of this base sequence : 84145025
  Distance between 3'-terminus of neighbour sequence of sequence listing upward to telomere on chrosomal short arm and 5'-terminus of this base sequence : 109892
atcttatggcattcctatacctacatttttgtattaaaattaaataaaaagacattttaaaaccatgatttttacagcaaaacattatatgcaagggaatgtatgtgtagccaactatagtgtgtgtgtgtgtgtgtgtgtgtgtttagatcttgatttttaaaatattagtgaataagtagcagtatttaattatagcaagatatgattattatacgtgtgtctgtttttatatagaatttgttagaagtctctagtacaccataccagaaaaagtttagctaaaacaaagtaaacatgaaatattgcaaagaaaaccaatagaaacttaacagaataaataatatttattttccagaataaagacacaatataagtgaagcttcaaatttaaataggt

SEQ ID NO: 806 - DNA, 299 bp, Homo sapiens
  chr1.fa.O7frz.90851574
  Located on chromosome 1
  Distance between a terminus base of telomere on chromosomal short arm and 5'-terminus of this base sequence : 84356741
  Distance between 3'-terminus of neighbour sequence of sequence listing upward to telomere on chrosomal short arm and 5'-terminus of this base sequence : 211316
gaatagaccaataacaagttctgaaattgaggcagtaattaatagcctaccaaccaaaaaaagcccaggaccagacgggttcacagccaaattctaccagaggtacaaagaggagctggtaccattccttctcaaaccattccaaacaataggaaaagaggcactcctccctaattcattttatgaggctagcatcatcctgataccaaaacctggcagacacacacacacacacacacacacacacacaaaatttcaggccaatatccctgatgaatatcaatgcataaatcctcaat

SEQ ID NO: 807 - DNA, 205 bp, Homo sapiens
  chr1.fa.O7frz.90957060
  Located on chromosome 1
  Distance between a terminus base of telomere on chromosomal short arm and 5'-terminus of this base sequence : 84439481
  Distance between 3'-terminus of neighbour sequence of sequence listing upward to telomere on chrosomal short arm and 5'-terminus of this base sequence : 82441
tagcctatgcaatcagaatataaggtgtttgtgtggaggatggtggtagtggtggaattcagacttctctataagttcattttccagactaggaaagagcaatatgtcctaggaaccacgtaaaataaataaataaataaataaataaataaataaataataaataaacattacaactctgcttacctgtcttgacctatagtga

SEQ ID NO: 808 - DNA, 404 bp, Homo sapiens
  chr1.fa.O7frz.91073500
  Located on chromosome 1
  Distance between a terminus base of telomere on chromosomal short arm and 5'-terminus of this base sequence : 84555893
  Distance between 3'-terminus of neighbour sequence of sequence listing upward to telomere on chrosomal short arm and 5'-terminus of this base sequence : 116207
catgtatcagttacggctttattcattgatgaaatgtagtcaccacagggagaaatgtagcaacaacttagcatccagaaataatacagaacactgtgctgcattaaatgaaaaatacctgcaagaggaagtgagttaataaaaattcaattactcaaatgggaacttttccaagaccccagggttaacacctagattaaactctcactctcactctctctctctctacacacacacacacacacacacacatgcacacacacacacctggctttattagttgtcagaagtgtttaaaatactccttttccttttatataaatacaagagatacatttatggctaaaatagtttttatatcatcaagctgagaactagttttacataggaagctaacaataaca

SEQ ID NO: 809 - DNA, 225 bp, Homo sapiens
  D1S465
  Located on chromosome 1
  Distance between a terminus base of telomere on chromosomal short arm and 5'-terminus of this base sequence : 84730156
  Distance between 3'-terminus of neighbour sequence of sequence listing upward to telomere on chrosomal short arm and 5'-terminus of this base sequence : 173859
caagaagcccaatgaacttcaagaacacacacagaaatacacacacacacacacacacacacacacacacacacacaccctaaaggaaactacactaagatatatctataatctaatttgtcaaaaacagtgataacaagaaaaccttaaaagtaaagaggcaaagaggacatactatctacagaggatgacttaagatttatcttcttgtggacatgatgtaaa

SEQ ID NO: 810 - DNA, 293 bp, Homo sapiens
  AL137858.4_9071
  Located on chromosome 1
  Distance between a terminus base of telomere on chromosomal short arm and 5'-terminus of this base sequence : 84780837
  Distance between 3'-terminus of neighbour sequence of sequence listing upward to telomere on chrosomal short arm and 5'-terminus of this base sequence : 50456
ttctaaactcggtagattaaacagccactcaactgattctttggagcagctattatggaaattaaaatgcccttttaaaaaccagataagtccctactagagctacgtttcatcccctatgccatcttgcttctctatgcatacacacacacacacacacacacaaaagaagcttatggataatgttcattgcactgggaatatccaaagcaatgaatggcttttagagttgattaaatgctaaagtgaagctttttgataaccatgagagctgactattgtaagtgtactcc

SEQ ID NO: 811 - DNA, 302 bp, Homo sapiens
  AL137858.4_59499
  Located on chromosome 1
  Distance between a terminus base of telomere on chromosomal short arm and 5'-terminus of this base sequence : 84831245
  Distance between 3'-terminus of neighbour sequence of sequence listing upward to telomere on chrosomal short arm and 5'-terminus of this base sequence : 50115
gatagaaatacttgcctggaactcatcatatttaattccagatttagtgtcatttcccatgccaatgtaattcttgtcagtatcaatgtcattgtataaatgtatccatggagaagaaatggagaaaggattcactgtagaatgaaacacacacacaaacaaacacacacacacacacacacacacacacacacacacacacacactggggcttgttactgtaagtgaatgaatacacagacgtgcatataaaacatttattgtcactttgggcttaccttgtaccagacatagtttgaact

SEQ ID NO: 812 - DNA, 191 bp, Homo sapiens
  D1S430
  Located on chromosome 1
  Distance between a terminus base of telomere on chromosomal short arm and 5'-terminus of this base sequence : 84831281
  Distance between 3'-terminus of neighbour sequence of sequence listing upward to telomere on chrosomal short arm and 5'-terminus of this base sequence : -266
tccagatttagtgtcatttcccatgccaatgtaattcttgtcagtatcaatgtcattgtataaatgtatccatggagaagaaatggagaaaggattcactgtagaatgaaacacacacacaaacaaacacacacacacacacacacacacacacacacacacacacacactggggcttgttactgtaagtg

SEQ ID NO: 813 - DNA, 271 bp, Homo sapiens
  AL137858.4_79104
  Located on chromosome 1
  Distance between a terminus base of telomere on chromosomal short arm and 5'-terminus of this base sequence : 84850817
  Distance between 3'-terminus of neighbour sequence of sequence listing upward to telomere on chrosomal short arm and 5'-terminus of this base sequence : 19345
aaacgacagattatgatcaagtatgatttatctcagaacatacaaggacggctcagcattaaaagctatgatttgaagtttaagtttgtaacgtgtatgatcatttaaatgtcaaaaatttttaaaaattaaaaaattattttaaattgaaaactaccacacatgcccttttcatatgcatagaagcatgtgcatacacacacacacacacacacacaagacaatagaagaaaacttacttttaaaggacatttggtagaatatgcaataa

SEQ ID NO: 814 - DNA, 260 bp, Homo sapiens
  AL137858.4_80489
  Located on chromosome 1
  Distance between a terminus base of telomere on chromosomal short arm and 5'-terminus of this base sequence : 84852278
  Distance between 3'-terminus of neighbour sequence of sequence listing upward to telomere on chrosomal short arm and 5'-terminus of this base sequence : 1190
accttgaaacatgtctttgatatattgctaactgtaaaaagcaagttgtagacaaatatgtatagcatgatgcatttcttaatgatatactatatagaggtatacaggtattttgtgtctgtgtgtgtgtgtgtgtgtgtgtgtgtattagggtgtatatattcttcctacagtgtcattagaagagcagaggaagtttcatttatttaacaaatattgtttcatttatttatataataaacataaagtttgctaagcac

SEQ ID NO: 815 - DNA, 309 bp, Homo sapiens
  chr1.fa.O7frz.91444397
  Located on chromosome 1
  Distance between a terminus base of telomere on chromosomal short arm and 5'-terminus of this base sequence : 84907760
  Distance between 3'-terminus of neighbour sequence of sequence listing upward to telomere on chrosomal short arm and 5'-terminus of this base sequence : 55222
ggataagcatagtaatatgcaaacacattttatatcagggacttgagcacccatagatttcagtatccacagggagttcggcaaccaatacttgctcatacggaggggtaactgtgtgtgtgtgtgtgtgtgtgtgtgtgtgtgtgtgtgtgtgtgtgtgtgtgtgtaaagttttaaaagccaaggcaacaataagcactaaatttaagataatgcttatctgtagggaaagataggaatatagaaaaagaatcatagaagtaaacacaatgacctttgcgatgccttaattgtgaaattgaatagtgg

SEQ ID NO: 816 - DNA, 385 bp, Homo sapiens
  chr1.fa.O7frz.91759520
  Located on chromosome 1
  Distance between a terminus base of telomere on chromosomal short arm and 5'-terminus of this base sequence : 85020610
  Distance between 3'-terminus of neighbour sequence of sequence listing upward to telomere on chrosomal short arm and 5'-terminus of this base sequence : 112541
ttcctgctatcatgatagtgagtgagttctcacaagatctggttgtttgaaagtgtgtagcacttccccacttctctctctctctctctctctcctgccagccatatgaagacgcgcttgcttcccctttgccttctgccacgaatgtaaacttcctgaagcctctcctgaagcagaagcttgtacagcttcatcctccattcttccaatgggcaattctaggaccactttgcatgcttctcagagattcaaaggaatgaagctcctgttgccttctgtggcaatgtcaataatgcacacttacatgagcttttctttcttccatttgccactgtcttttttttcctttccttctcccataaataaactagctgcatcaaatctt

SEQ ID NO: 817 - DNA, 364 bp, Homo sapiens
  chr1.fa.O7frz.91574927
  Located on chromosome 1
  Distance between a terminus base of telomere on chromosomal short arm and 5'-terminus of this base sequence : 85099305
  Distance between 3'-terminus of neighbour sequence of sequence listing upward to telomere on chrosomal short arm and 5'-terminus of this base sequence : 78310
agcaactacataaccgtagtaactattctagtgtacactcattgtctctagcctgagctacaactgcactatacatatccattcttgtttatctactctatttttatagaagtcatagtcatgttaacacacacacacacacacacacacacacacacacacatatattagacagagtctcactctgtcacccattctgtagtgcagtggcacaatcacagctcattgcagctcattgaactcctgcgctcaagcaattcttccacctcagcctcctgagtagctgggcctacaggcacatgccaccacacccagctattttttttttaatgttttgtagagatgaagtcttgctacattatcc

SEQ ID NO: 818 - DNA, 468 bp, Homo sapiens
  chr1.fa.O7frz.91853184
  Located on chromosome 1
  Distance between a terminus base of telomere on chromosomal short arm and 5'-terminus of this base sequence : 85263238
  Distance between 3'-terminus of neighbour sequence of sequence listing upward to telomere on chrosomal short arm and 5'-terminus of this base sequence : 163569
aaatcctcatcgctaagttaagcatattctcaatgggttcataagctttgctggaagagtacttgtaattttctgaaactttagggggtcatgttcactcttcatccattaaatcagaaagaataagaaaagttcaagctaaaaaaaaaattaaaggattaaaaccaggaaatgtttaaaagtgcctcttaaatattgtattgccattactttaaaacaatcattcagagtgattgtaaagggtaaattattttttaaaaaaatttatgccattcactgaaagactgtatttggatcatattgtaaaataggactaaagcttatattcacgagtaggactttgtaatacacacacacacacacacacacacatatatatgtacacacacacatacatatataatctcctaaattcagcaggtcctgataactccaaaaggtagagtacaacctccatggtacatagta

SEQ ID NO: 819 - DNA, 273 bp, Homo sapiens
  chr1.fa.O7frz.91924055
  Located on chromosome 1
  Distance between a terminus base of telomere on chromosomal short arm and 5'-terminus of this base sequence : 85352037
  Distance between 3'-terminus of neighbour sequence of sequence listing upward to telomere on chrosomal short arm and 5'-terminus of this base sequence : 88331
caatgttcttccttaaatgtacaggactaattcatatatatatatatatatatatacacatatatatatacacacacacacgtacatatatatacatatacatacacacatatgtacatgtatatacatatacatatacatatatatatacgcacacactgtataaacaaaaatatgtgattctttgaccctacctggggggtgaaatacaaatttctgcctttggcccttgctttttgtacattgaatgtgatcaaagtaaatatggttagc

SEQ ID NO: 820 - DNA, 266 bp, Homo sapiens
  D1S2862
  Located on chromosome 1
  Distance between a terminus base of telomere on chromosomal short arm and 5'-terminus of this base sequence : 85522317
  Distance between 3'-terminus of neighbour sequence of sequence listing upward to telomere on chrosomal short arm and 5'-terminus of this base sequence : 170007
gtgtgagccaccatgcccggcctcaaattatattttaaacattatttatttgaaaatgataatataggatgtattcaacatagtcctttatttgactgaaaaataatttttcctttaatgtttgtgtgtgtgtgtgtgtgtgtgtgtgtgtgtgtgtaagagacagagagagagaaggagtgagaaagagacaaagtatgtgtagaaacacataagactggtagatttctttttattggattttttcatttaattctgggaatctt

SEQ ID NO: 821 - DNA, 259 bp, Homo sapiens
  D1S2856
  Located on chromosome 1
  Distance between a terminus base of telomere on chromosomal short arm and 5'-terminus of this base sequence : 85667273
  Distance between 3'-terminus of neighbour sequence of sequence listing upward to telomere on chrosomal short arm and 5'-terminus of this base sequence : 144690
cagaacataataagtgtggctaataagtgtgtgtgtgtgtgtgtgtgtgtatgtgtgtgtggttttatttcagagttgctttattttaatttatgatgaatttcagtttctattagagtagtgcttttaggttgagatacatttttttatccatcaatctttgtaccaacactgtgaattaatttaatatcatgactgcttttcaaatgaagagattggggactgatatttgaagtgatttatccaatgtcacagagct

SEQ ID NO: 822 - DNA, 416 bp, Homo sapiens
  AL359705.9_29805
  Located on chromosome 1
  Distance between a terminus base of telomere on chromosomal short arm and 5'-terminus of this base sequence : 85685278
  Distance between 3'-terminus of neighbour sequence of sequence listing upward to telomere on chrosomal short arm and 5'-terminus of this base sequence : 17746
ctttgaaaatagtacaattgccaggtgcagtggctcacgtctgtaatcccagcactttgcgaggccgaggcaggtggatcacctgagttcaggagttcaagaccagcctggccaacatggtgaaaccctgtctctactaaaaatataaagattagccaggcgtggtggcaggcacctgtaatcccagctacttgggaggctgaggcagaagaatctgttgaacccaagagacggaggttgcagtggccaagatcacgccactgaactccaacctgggcaacggagtgagactctgcctaaaaaacaataataataataataataataataataatactacaattgagaaaggtagagatgaatataaagtatacgtatgtcctaatatgatagactacctcaattcctgagttgaa

SEQ ID NO: 823 - DNA, 331 bp, Homo sapiens
  chr1.fa.O7frz.92538027
  Located on chromosome 1
  Distance between a terminus base of telomere on chromosomal short arm and 5'-terminus of this base sequence : 85781736
  Distance between 3'-terminus of neighbour sequence of sequence listing upward to telomere on chrosomal short arm and 5'-terminus of this base sequence : 96042
taaggaagatttactttcatgaagtgaaagtaagtgttttaaatgaagtcaaatactcttgaggtcttttatcacccactaaagcttagagaggccgttttatcctagagttgagtttgattatcagaaaccagcataaactttgccctaaataaacagttcaggtaaggaaaggatttttccttagtaaaattaatgttttgatactattgtattatggttctagagagaaacagaaccagtacaatgtgtgtgtgtgtgtgtgtgcgtgtgtgtgtgtgtgtgtgtgtacacacagagagagatttattttatggaattggcttacaag

SEQ ID NO: 824 - DNA, 160 bp, Homo sapiens
  D1S1672
  Located on chromosome 1
  Distance between a terminus base of telomere on chromosomal short arm and 5'-terminus of this base sequence : 85896698
  Distance between 3'-terminus of neighbour sequence of sequence listing upward to telomere on chrosomal short arm and 5'-terminus of this base sequence : 114631
ccacagtgaatcgtgactgaaccactgaactgtagtctgggccacagagtgagaccctgtctcaaaaaaaacaacaaaaaattctatctatctatctatctatctatctatcatctatctatctatctatctatcccaatgaataaatgaacatacttct

SEQ ID NO: 825 - DNA, 370 bp, Homo sapiens
  AL138799.4_76280
  Located on chromosome 1
  Distance between a terminus base of telomere on chromosomal short arm and 5'-terminus of this base sequence : 85921116
  Distance between 3'-terminus of neighbour sequence of sequence listing upward to telomere on chrosomal short arm and 5'-terminus of this base sequence : 24258
tttccactgtaactcattccttagttttgagacatcctctttgataacctgctctggtttctggacaaataactgcaatattttttgtaagaaaaagcattctggtgacagagcaagacagacagaaagagagagagagaaagagagagagaaaaagaaagaaagaaagagagaaagaaagaaagaaagaagaaagaaagaaagaagaaagaaagaaagaaagaaagaaagaaagaaagaaagaaagagaagaaagaaagaaagcaagaaaaagaaagaaagagcattctgtctttctttcaatatccagaaacttctggctacactgagcaataacagtttgaatgtcttcctaatcagtgcagttgac

SEQ ID NO: 826 - DNA, 263 bp, Homo sapiens
  chr1.fa.O7frz.94028107
  Located on chromosome 1
  Distance between a terminus base of telomere on chromosomal short arm and 5'-terminus of this base sequence : 86166871
  Distance between 3'-terminus of neighbour sequence of sequence listing upward to telomere on chrosomal short arm and 5'-terminus of this base sequence : 245385
gtggagctagtaaagtgcctacacacctctctttgcaaaacaaacaaacaaacaaacagaaaaagcagaaaacaaaacaaaacaatacatcaatccttctagctgagtgggagggaaaatgttagcaagcaatctttcagttgattatttgatatgcaaaagtaatataaactccaagttactgcataaaatctggtggcaaacatgattgcataatatggaaagtttatcccagagaaaaatcaaattctaggtcagtcttt

SEQ ID NO: 827 - DNA, 134 bp, Homo sapiens
  DISD22_0000505
  Located on chromosome 1
  Distance between a terminus base of telomere on chromosomal short arm and 5'-terminus of this base sequence : 86310749
  Distance between 3'-terminus of neighbour sequence of sequence listing upward to telomere on chrosomal short arm and 5'-terminus of this base sequence : 143615
tggatagtgtgatggcattcaaattattctgattttccccaataatctagcattgttcataacacacacacacacacacacacacacacacactcatctagtaaccatcaaaacccggaagaacaaccaatgtt

SEQ ID NO: 828 - DNA, 101 bp, Homo sapiens
  DISD22_0000511
  Located on chromosome 1
  Distance between a terminus base of telomere on chromosomal short arm and 5'-terminus of this base sequence : 86482164
  Distance between 3'-terminus of neighbour sequence of sequence listing upward to telomere on chrosomal short arm and 5'-terminus of this base sequence : 171281
gttatgcataatctaagccagccatgtcacacacacacacacacacacacacacacacacacacacacacacaaataggatgaataggaataaatccatcc

SEQ ID NO: 829 - DNA, 185 bp, Homo sapiens
  AL035706.10_15137
  Located on chromosome 1
  Distance between a terminus base of telomere on chromosomal short arm and 5'-terminus of this base sequence : 86560098
  Distance between 3'-terminus of neighbour sequence of sequence listing upward to telomere on chrosomal short arm and 5'-terminus of this base sequence : 77833
tcagtctccttaaccgtatttctagtgttttcagggggtttcattgttctaggattcatttttatgttttcacatttctagtagaatgtatttcaaacagattgcgtgcgtgtgtgtgtgtgtgtgtgtgtgtgtgtgtgtgtctgacctttcaggacttcaggtattaccttgtgaccattgaa

SEQ ID NO: 830 - DNA, 200 bp, Homo sapiens
  AL035706.10_40423
  Located on chromosome 1
  Distance between a terminus base of telomere on chromosomal short arm and 5'-terminus of this base sequence : 86585353
  Distance between 3'-terminus of neighbour sequence of sequence listing upward to telomere on chrosomal short arm and 5'-terminus of this base sequence : 25070
tattcagtgcacctagagatttatagataaaatgagaaatttcaattggaaaatatgtgtaaagataaatgctgcttttattattaattcatattctcacagaatgttgcagcttaaaatgtaaaactatgcacacacaaacacacacacacacacacacacacacacacaggcctctcctctacttaatttcctgagtt

SEQ ID NO: 831 - DNA, 225 bp, Homo sapiens
  AL035706.10_120959
  Located on chromosome 1
  Distance between a terminus base of telomere on chromosomal short arm and 5'-terminus of this base sequence : 86665958
  Distance between 3'-terminus of neighbour sequence of sequence listing upward to telomere on chrosomal short arm and 5'-terminus of this base sequence : 80405
gagtacttggatccttcagaagagggaataccttctatctcctacctaaaaacatgccaaaggtgtgtgcttgtgtgtgtgtgtgtgtgtgtgtgtgtgtgtgtgtgtgtgtaaggcctaaaccaattctcttgggttttcctgcaatcttatacattattccataacgagcacttatgagttattttctgtagacacaggatgtatcttaacagcagtcgtacg

SEQ ID NO: 832 - DNA, 261 bp, Homo sapiens
  AL035706.10_141817
  Located on chromosome 1
  Distance between a terminus base of telomere on chromosomal short arm and 5'-terminus of this base sequence : 86686792
  Distance between 3'-terminus of neighbour sequence of sequence listing upward to telomere on chrosomal short arm and 5'-terminus of this base sequence : 20609
aaggccagacataagtagctagagaaatgaaatttatttgttgaaatcaatttgtggggtactttcatacatttaaatttactcagtttttaaattgtgtgtgtgtgtgtgtgtgtgttttctgtgaggagtgtttctcctagtgatgggcattcttattttttgttttaaatacaaattttgctctggtacaaaagttgcaaagcacacactccagcaaattaagtaattatttgtgatttaagataatgcaaatgagtg

SEQ ID NO: 833 - DNA, 176 bp, Homo sapiens
  DISO7_10000661
  Located on chromosome 1
  Distance between a terminus base of telomere on chromosomal short arm and 5'-terminus of this base sequence : 86773089
  Distance between 3'-terminus of neighbour sequence of sequence listing upward to telomere on chrosomal short arm and 5'-terminus of this base sequence : 86036
tctcatggctaaagttctgaagtaaaagctatagggtctttgtgtgtgtgtgtgtgtgtgtgtgtgtgtgtgtgtgtgtgtgtgtatgtgtgtgtatttaaaaggtccttataatttctataattttttgtttaattggcaattaaatctgttttaacttccctctagcacaccag

SEQ ID NO: 834 - DNA, 180 bp, Homo sapiens
  DISO7_10000662
  Located on chromosome 1
  Distance between a terminus base of telomere on chromosomal short arm and 5'-terminus of this base sequence : 86917701
  Distance between 3'-terminus of neighbour sequence of sequence listing upward to telomere on chrosomal short arm and 5'-terminus of this base sequence : 144436
ggaactaatttgttgcattataagctgtgtgtgtgtgtgtgtgtgtgtgtgtgtgtttgtgtgtgtcttcatattggtgattgagcatttaatatgtgccagggattgtactaggtacatgtatgcacacacttactcaaagacacatgtatatatgctcacccagggatacacatgcac

SEQ ID NO: 835 - DNA, 432 bp, Homo sapiens
  AL359273.9_163234
  Located on chromosome 1
  Distance between a terminus base of telomere on chromosomal short arm and 5'-terminus of this base sequence : 87044618
  Distance between 3'-terminus of neighbour sequence of sequence listing upward to telomere on chrosomal short arm and 5'-terminus of this base sequence : 126737
tttgtgagaaggtaggctatgtagttacattgctttctctagattcttcctccctttcctccttatggagaaataacatagaatttcattttaatctcttgagcgtcatttccttcaagagtcttttgccactgaatcacattttcttctgtagttcaatctcagacttttaaaacttcaactgtattcagtttttctttccctgctgatcatccagggacagttttctcctaggacatcattttttcttttcttttcttttcttttcttttcttttcttttcttttcttttcttttcttttcttttctctttctttctttctttctttctttctttctttctttctttctttctttctttctttttgagacagggtctcattcgttgctcaggctggagtgtagtggtatattgctcactctagccttgat

SEQ ID NO: 836 - DNA, 189 bp, Homo sapiens
  D1S2889
  Located on chromosome 1
  Distance between a terminus base of telomere on chromosomal short arm and 5'-terminus of this base sequence : 87095725
  Distance between 3'-terminus of neighbour sequence of sequence listing upward to telomere on chrosomal short arm and 5'-terminus of this base sequence : 50675
ttcaaacatgacgggaaatttaccctaaaatgcccactgggccctggtgccaaactatgaagacagtctagtgatgctcaatatgtttgttgaatggtgtatgtgtgtgtgtgtgtgtgtgtgtgtgtgtgtgtgtgtgtgtgtgtgtgtgtaggggaatgggaagtgaggtgttttgtttttggcatt

SEQ ID NO: 837 - DNA, 363 bp, Homo sapiens
  chr1.fa.O7frz.94865597
  Located on chromosome 1
  Distance between a terminus base of telomere on chromosomal short arm and 5'-terminus of this base sequence : 87200425
  Distance between 3'-terminus of neighbour sequence of sequence listing upward to telomere on chrosomal short arm and 5'-terminus of this base sequence : 104511
agcagatagactggtctagaaatagctacccgtcattactatatatatatatatatatatatatatatatatatatatatatacacacctctatttcttaaaaaagttcccatatccgaggttctactgtggaatttaagagacgataaagggaataatagtcatgcacgcttcataaatggctcccagattattcactgtcctaaagaagatgcaggctctggactgcagacttcctgtaggtcagagtatgaaagcacagggtcccactgaggcaagagcagctttacagcttctctgcagttgtctagaatttcccagagaaagcaaaagatgaggctaaatgtagactttcaccttgaa

SEQ ID NO: 838 - DNA, 458 bp, Homo sapiens
  AL359256.6_152209
  Located on chromosome 1
  Distance between a terminus base of telomere on chromosomal short arm and 5'-terminus of this base sequence : 87539449
  Distance between 3'-terminus of neighbour sequence of sequence listing upward to telomere on chrosomal short arm and 5'-terminus of this base sequence : 338661
gcgaagacagaaatcaatacagggcacatatacattagttcagcagaaaaggcaggctatcttgaagtagggggcttacagaggtaagcaggggttttatagatgataggcagattcagagatttttaaaatttgcattagaggagtaaggctctaaaacttggagtcagcagaaaggactgatttttaatttttatttatttatttatttatttatttatttatttatttatttaagacagagtcttgctctgttgccgggctggagtgcagtagcgcaatctcggctcactccaacctccgcctcccggattcaagtaattctcctgcctcggcctcccagacagctgggactacaggcgcttgccaccatgcccagctaatttttgtatttttagtacagacggggtttcaccatgttggccaggatggtctcaatctcttgacctcatgatccg

SEQ ID NO: 839 - DNA, 292 bp, Homo sapiens
  AL359256.6_116631
  Located on chromosome 1
  Distance between a terminus base of telomere on chromosomal short arm and 5'-terminus of this base sequence : 87633113
  Distance between 3'-terminus of neighbour sequence of sequence listing upward to telomere on chrosomal short arm and 5'-terminus of this base sequence : 93206
tgcttgaacctgataggtagaggttgcaatgagctgagatcgtgacactgcactccagcctgggtgacagagcaagactctatctcaaaataaataaataaataaataaataaataaataaataaataaataaaaatttaaatataacacacatttattatcttacagttctggaaatcagaagtccaaaatgggtttccctgggctgaattcaaggtgtcagcagggccatactccctccaggggctctagggagaatcccctttcttgcctttcctagcatctacaagcc

SEQ ID NO: 840 - DNA, 480 bp, Homo sapiens
  AC026067.4_80571
  Located on chromosome 1
  Distance between a terminus base of telomere on chromosomal short arm and 5'-terminus of this base sequence : 87738866
  Distance between 3'-terminus of neighbour sequence of sequence listing upward to telomere on chrosomal short arm and 5'-terminus of this base sequence : 105461
aacctaagcttgactaatcagaaacccctaactaacctctaaccagagacattctattttaaccaaatacatatatacacatacatatatacatagatgtctatttttatgtatgtatacttgttgttgttgttgtagttgttgttgttgttgttgttgagacaaggtcttcttatgttgcccaggctgctcttgaactcctgggcttaaacaatcctcccacctcggcctcccagagggctgggattacaagtgtgagccactgtgcacagccccaaatacattttgttttgctttcatgaacaccttataaaagtttcctttctcaccaccccccacccagtggagtgctaaactgcttgtgctgcccaattcgtgaatcattgaatgctcaaacaagtgctttatatttttaatgtatctaagtttatctttttaacaccttgtgacaactctataagtgaggtacatcaaaccatt

SEQ ID NO: 841 - DNA, 213 bp, Homo sapiens
  Z67628
  Located on chromosome 1
  Distance between a terminus base of telomere on chromosomal short arm and 5'-terminus of this base sequence : 87837408
  Distance between 3'-terminus of neighbour sequence of sequence listing upward to telomere on chrosomal short arm and 5'-terminus of this base sequence : 98062
ggcaacaaaaagttaaaatcagagattactacatagaacaaagaggaaacactacgtttctctggtgtgtgtgtgtgtgtgtgtctgtgtgtgcacatacacctgtgaccaagcaagaacaggcaacaacattcattaagcgccaactatattccaggtgctttatatacattgtctttgtatggggtaggctaggtattattattatcccca

SEQ ID NO: 842 - DNA, 439 bp, Homo sapiens
  AC021172.3_141232
  Located on chromosome 1
  Distance between a terminus base of telomere on chromosomal short arm and 5'-terminus of this base sequence : 87843760
  Distance between 3'-terminus of neighbour sequence of sequence listing upward to telomere on chrosomal short arm and 5'-terminus of this base sequence : 6139
gactgaggtgatctcaagtgagaaagagagaaaagcctaattcacaaagtatttagaagcccaaaattccagtgggcaagggaagaccagcagagtcacagaattcgtatcaaacagggagaagctgagaaagggagcatggggtgctttagagcttaggttcttttttggcagagtttaagatggatgtgccctgtaccaaattctcctctatttcaagtttcatatcttcagcatatcatatacagtaaaattcacctctttctctctaccccctcatatctatttatctatctatctatctatctatctatctatctatctatctatctatctatcatctatctaatctatcatctatcattataattataatagcactatttactgaaagtctatttgtcactttctttaactgacagccttacagtaatcctag

SEQ ID NO: 843 - DNA, 237 bp, Homo sapiens
  AC021172.3_42124
  Located on chromosome 1
  Distance between a terminus base of telomere on chromosomal short arm and 5'-terminus of this base sequence : 87911758
  Distance between 3'-terminus of neighbour sequence of sequence listing upward to telomere on chrosomal short arm and 5'-terminus of this base sequence : 67559
gacaatgtccttactttcaaagagtttgtgttccctgttcatcttcctcactgtttatctactctagccctttctaaacagtcctgaagtaatctatttcagcccacattaatcttttattgtttgacccccgcccctagacggataatcagaatcatgctgttttggcattcattcattcattcattcattcattcattcattaactgactcattcatggtttattgagttcctac

SEQ ID NO: 844 - DNA, 173 bp, Homo sapiens
  chr1.fa.O7frz.95420118
  Located on chromosome 1
  Distance between a terminus base of telomere on chromosomal short arm and 5'-terminus of this base sequence : 88157436
  Distance between 3'-terminus of neighbour sequence of sequence listing upward to telomere on chrosomal short arm and 5'-terminus of this base sequence : 245441
tctgtagtcttggagaattcatagagaatgtggagatgtcaggaacattcaaacaggtaactggactaattcttaaaagtgaggggtgtgtgtgtgtgtgtgtgtgtgtgtgtgtgatagatcctggaaaatatttatcacttagttgcctaccaatctacataaatccagaa

SEQ ID NO: 845 - DNA, 462 bp, Homo sapiens
  chr1.fa.O7frz.95935276
  Located on chromosome 1
  Distance between a terminus base of telomere on chromosomal short arm and 5'-terminus of this base sequence : 88222733
  Distance between 3'-terminus of neighbour sequence of sequence listing upward to telomere on chrosomal short arm and 5'-terminus of this base sequence : 65124
cttcaagtagctcctagctgttgcatcctggctgtgctccccatggcctacccactctttgagggggaggctaggaggtatgcagaggctgtgattgtgagaaaagcctgggacagtacatgagctcattccggatggggagagagactataatcttttctcaataaagttttgttgcatgaatgaatgagtggtgaaagaaggcagttccatttagtcagtcttcctaaatcagtttttccaaatccatgggctttttgacgtactcaaactccccgtttgctacagtttgggaagtggcccggggatgccgagagagagagagagagagagagagagagagagagagagaaagagaggtctgttttttaaagagcctttgcagtccctgggttttcagagggatgttccatgaagaaactggccaagcagggccaacacttgtctttcctttagagtgtc

SEQ ID NO: 846 - DNA, 350 bp, Homo sapiens
  HUMUT1344
  Located on chromosome 1
  Distance between a terminus base of telomere on chromosomal short arm and 5'-terminus of this base sequence : 88423546
  Distance between 3'-terminus of neighbour sequence of sequence listing upward to telomere on chrosomal short arm and 5'-terminus of this base sequence : 200351
aaagtgctgagaatacaggcataagccactgcacccggctgatgttctttaaagttcatctatctatctatctatctatctatctatctatctatctatctatctatccatctatctatccatccatctatctatctactaagcccatgaaggtaccaggttctgttcccagtacttggaatacaagatagacaagatgcctgctatcatggagcttccaataaacacacaaactaacatcacctactgataagtacaatattggacagtggtaagtgatgagaagaaaataaagcaggaagatgggataggaaatagtggcaggaaaacatgagatagggagatgaggg

SEQ ID NO: 847 - DNA, 222 bp, Homo sapiens
  AL162260.4_76817
  Located on chromosome 1
  Distance between a terminus base of telomere on chromosomal short arm and 5'-terminus of this base sequence : 88423549
  Distance between 3'-terminus of neighbour sequence of sequence listing upward to telomere on chrosomal short arm and 5'-terminus of this base sequence : -347
gtgctgagaatacaggcataagccactgcacccggctgatgttctttaaagttcatctatctatctatctatctatctatctatctatctatctatctatctatccatctatctatccatccatctatctatctactaagcccatgaaggtaccaggttctgttcccagtacttggaatacaagatagacaagatgcctgctatcatggagcttccaataaa

SEQ ID NO: 848 - DNA, 184 bp, Homo sapiens
  D1S2766
  Located on chromosome 1
  Distance between a terminus base of telomere on chromosomal short arm and 5'-terminus of this base sequence : 88526684
  Distance between 3'-terminus of neighbour sequence of sequence listing upward to telomere on chrosomal short arm and 5'-terminus of this base sequence : 102913
ctcagcctagtgcagcctctcgtttgctctgttcacacacacacacacacacacacacagtcatgcatgtatgcacatacgcacgcacacatgagaaacacaagaaagcacctttaaaaaaaattagcggatgatactttccctttgtggatggttgcacctcataccaatcatgggtttaagc

SEQ ID NO: 849 - DNA, 387 bp, Homo sapiens
  AL356153.4_109180
  Located on chromosome 1
  Distance between a terminus base of telomere on chromosomal short arm and 5'-terminus of this base sequence : 88719085
  Distance between 3'-terminus of neighbour sequence of sequence listing upward to telomere on chrosomal short arm and 5'-terminus of this base sequence : 192217
ctgaggtactatgcttgtacagaagttgaactcgatgaaaacatcatggtagactcatttactacagatgtgctaagttgactggcctcaaaacactcattttcacagaaggaaattcacacaggcaacggtgagcctcccctgtactgtccctcagttacagtcacatgatcttgaaaaaacattgaaactgcagagtgaatatgccaagaattctttaattccttggccacataaaagaaagaaagaaagaaagaaagaaagaaagaaagaaaagaaaagaacattgtttaggaaaatcaggcagttgcataatgctaaaaatcccagaataaatatttttctcagtggaaaaacccagcagtctttaaaggtaagccaaggaac

SEQ ID NO: 850 - DNA, 218 bp, Homo sapiens
  AL356153.4_34950
  Located on chromosome 1
  Distance between a terminus base of telomere on chromosomal short arm and 5'-terminus of this base sequence : 88744927
  Distance between 3'-terminus of neighbour sequence of sequence listing upward to telomere on chrosomal short arm and 5'-terminus of this base sequence : 25455
aagaatgccttaggaaagagttatcagtcccatctcctgggctagaagatgagattgcatacataggctaacaatatttattcttttattattattattattattattattattatacttgaagttttagggtacatgtgcacaatgtgcaggttagttacatatgtatacatgtgccatgctggtgtgctgcactcactaacttgtcatctagcatt

SEQ ID NO: 851 - DNA, 478 bp, Homo sapiens
  chr1.fa.O7frz.96873048
  Located on chromosome 1
  Distance between a terminus base of telomere on chromosomal short arm and 5'-terminus of this base sequence : 88916801
  Distance between 3'-terminus of neighbour sequence of sequence listing upward to telomere on chrosomal short arm and 5'-terminus of this base sequence : 171656
acgtagttactatgtatcaggcactgttcttgcactgatcacatactagaaaacaaacaaaaagattccttggtttcatagaatgtatattctggagactgtttatctcagagattctctccctttcaatgtgtgtatgtttgcagcatggagtgggaagttaggtgattaaaaaagatttatattgttatgaggaactggcatgtctcaattacctacttttgttttagatacacagctatgggtctatggtcactctatgttgtttcacattctctctttcttcaaatgggatatcttgttttctttcatatatatatgtgtgtgtgtatatatatatatatgtgtgtgtgtgtgtatatatatatatatatatatatataccagttagtagaaatgtatacaggtacttaggcctcattgaaaataatgcatcttaccctgagaacttggccttagacatgtaagcaataattgg

SEQ ID NO: 852 - DNA, 452 bp, Homo sapiens
  chr1.fa.O7frz.96760293
  Located on chromosome 1
  Distance between a terminus base of telomere on chromosomal short arm and 5'-terminus of this base sequence : 89091808
  Distance between 3'-terminus of neighbour sequence of sequence listing upward to telomere on chrosomal short arm and 5'-terminus of this base sequence : 174529
agaaatgcatgttaagtacctaagaaaatcggtttcacaaaatcaaacactacaagctttatatgatacatttgtgacacaatggtaatttatttatttatttatttatttatttatttatttatttatttatagacggagtctgctccgtcgcccaggctggagtgcagtggcccgatcttggctcactgtaagctccgcctcccgggttcacgccattctcctgcctcagcctcctgagtagctgggactacaggcgcctcccaccacgcccggctaatttttttgtatttttagtagagacggggtttcaccgtgttagccaggatggtctcgatctcctgacctcgtgatctacccgcctcggcctcccaaagtggtaatttttaatacttgtcacaaatctactatcttccacaaatatatgcagttaaatcatggtcagttttagc

SEQ ID NO: 853 - DNA, 429 bp, Homo sapiens
  AF039401.1_31418
  Located on chromosome 1
  Distance between a terminus base of telomere on chromosomal short arm and 5'-terminus of this base sequence : 89428248
  Distance between 3'-terminus of neighbour sequence of sequence listing upward to telomere on chrosomal short arm and 5'-terminus of this base sequence : 335988
gaatacatttcttgaggcagtctgaggtttaaaacacttagtctttaggcccggcacagtggctcactcctgtaatcccagcactttgggaggctgaggcaggtggatcacctgaggttaggagttcgagaccaggctggccaacatggtgaaaccccatgtctactaaaaatacaaaaattagctcggtgtggtggcacatgcctgtaatcccagctactcaggaggctgaggcaggagaatcacctgaacccaggaggcagaggttgtagtgagccaagattgcgccacaccagcctggatgacaagagcgaaactccatctcaaaaacaaaaacaaagaaaggaaggaaggaaggaaggaaggaaggaaggatggaaggaaggaaggaaggaaaaaacagatgtagtatttaaactgaccttgtgg

SEQ ID NO: 854 - DNA, 323 bp, Homo sapiens
  AL122002.16_31126
  Located on chromosome 1
  Distance between a terminus base of telomere on chromosomal short arm and 5'-terminus of this base sequence : 89428354
  Distance between 3'-terminus of neighbour sequence of sequence listing upward to telomere on chrosomal short arm and 5'-terminus of this base sequence : -323
atcacctgaggttaggagttcgagaccaggctggccaacatggtgaaaccccatgtctactaaaaatacaaaaattagctcggtgtggtggcacatgcctgtaatcccagctactcaggaggctgaggcaggagaatcacctgaacccaggaggcagaggttgtagtgagccaagattgcgccacaccagcctggatgacaagagcgaaactccatctcaaaaacaaaaacaaagaaaggaaggaaggaaggaaggaaggaaggaaggatggaaggaaggaaggaaggaaaaaacagatgtagtatttaaactgaccttgtgg

SEQ ID NO: 855 - DNA, 293 bp, Homo sapiens
  AL122002.16_70722
  Located on chromosome 1
  Distance between a terminus base of telomere on chromosomal short arm and 5'-terminus of this base sequence : 89468143
  Distance between 3'-terminus of neighbour sequence of sequence listing upward to telomere on chrosomal short arm and 5'-terminus of this base sequence : 39466
tgttgaacacttactatgtgacaggcagtgttctaagtgtctcatatatatatatatatatatatatatatatatatatataaaatacatattttttaattcttcgtgttggaagtttaattagaagtagaaatataggacattttctacctctgtgattttgacatcgcttttgaacacaattctggtatgtgttcttccttcataaaatatagaatacaatagtaaaataaaataaaaataacagagtaaaataaaatattaaaattctaccaattctttaagacctagct

SEQ ID NO: 856 - DNA, 470 bp, Homo sapiens
  chr1.fa.O7frz.97554675
  Located on chromosome 1
  Distance between a terminus base of telomere on chromosomal short arm and 5'-terminus of this base sequence : 89598841
  Distance between 3'-terminus of neighbour sequence of sequence listing upward to telomere on chrosomal short arm and 5'-terminus of this base sequence : 130405
ctaatctgagcaacagaacaagagcaagatcccatcattcaagaaaacaaaactaagaagagaaaaataggtagtaaataatacctttacgtgaaaacatgctagttatgctcctaattatatttctctgtgtgtgtgtgtgtgtgtgtgtgtgtgtgtgtgtttaataataaaatgagtcgtttattggcaccaactcatttcaacttttttggcctaataaaaggcatcaatttctggagtaccttgactcaattaagttggggagaggtttaagagaaatataggaaactaccttaaaatattgtaactataaatttataagtggcagtattctctcacaggtagagtatttgtccatgagtgggcccatctccggtggggagtatttgatgagtataatgtggaccagccattctatatttccagaagaaacactactgaagcaacaaggtatcattgtattgagc

SEQ ID NO: 857 - DNA, 353 bp, Homo sapiens
  chr1.fa.O7frz.97661115
  Located on chromosome 1
  Distance between a terminus base of telomere on chromosomal short arm and 5'-terminus of this base sequence : 89663758
  Distance between 3'-terminus of neighbour sequence of sequence listing upward to telomere on chrosomal short arm and 5'-terminus of this base sequence : 64447
atgcctgtaatcacagcactttgggaggccgaggcaggcagattacagagtttgagaccaccctggccaacatggcaaaaacccgtctccactaaaaatacaaaaattagctgggcatggtagcaggcacctgtaatcccagctacttgggaggctgaggcaggagaatcacttgaactcgggaggcagaggttgcagtgagccaagactgtgccactgcactccagcctgggcaacacagtgagactccatctcaaaaaataacataacataacataacataacataacataacataacataacataacataacataacataacactgtcattgtacaacatgaagatgtat

SEQ ID NO: 858 - DNA, 207 bp, Homo sapiens
  AL049597.29_26517
  Located on chromosome 1
  Distance between a terminus base of telomere on chromosomal short arm and 5'-terminus of this base sequence : 89746562
  Distance between 3'-terminus of neighbour sequence of sequence listing upward to telomere on chrosomal short arm and 5'-terminus of this base sequence : 82451
aaccagtctataagaccaggagaggtggctgagttttcaattgcccgagtcgcaattccctgcacccctgccagcccccactccaaaaaaaggcacacaaagaaacagggaacatggtgcaatacacacacacacacacacacacacacacacacacgaaaatctccagaaactgaacctaaagaaatggagatttacaagttacct

SEQ ID NO: 859 - DNA, 413 bp, Homo sapiens
  chr1.fa.O7frz.98088952
  Located on chromosome 1
  Distance between a terminus base of telomere on chromosomal short arm and 5'-terminus of this base sequence : 89786035
  Distance between 3'-terminus of neighbour sequence of sequence listing upward to telomere on chrosomal short arm and 5'-terminus of this base sequence : 39266
taaggacctttgtgattacactagataatccaggcccacctggataatctaggaaaatcttcctgttttaaagtcaggtgattagcaaacttaattccatctgcaaccttaatttccccttgccatgtaacatagcatatgtgaaggttctgggaattaggaatgtggacatctttgggagattgttccaagcactggctgttatgcatacatgcatgtacacacacacacacacacacacacacacacacacacacccctgagagactcccaaagaggaaagttgaacaatgagctcactcatttctagaagctcctgcatctgccaaatatcgtcccgcttctaaataaggctgggctttactttttcagatgtcagcggtctaccacttgctttcaatcttacattaagt

SEQ ID NO: 860 - DNA, 436 bp, Homo sapiens
  chr1.fa.O7frz.97924337
  Located on chromosome 1
  Distance between a terminus base of telomere on chromosomal short arm and 5'-terminus of this base sequence : 90033393
  Distance between 3'-terminus of neighbour sequence of sequence listing upward to telomere on chrosomal short arm and 5'-terminus of this base sequence : 246945
gacaccagtttcagtattcctagcaaattattatgatttactttaaaggatatgcccagtaattactgaatcaatcaccataactctgtgtgtgtgtgtgtgtgtgtgtgtgtgtgtgtcagagagagagagaaagagagagagagagagagagagatgagttcatcggtttagcccaagacacctggtgggccacatagaatgtgctcctagaataatgtgtggtgttcaaaccaaaatggaagtggttgagaagcgggacatagaacctcaggattggcagaggccttgaaagttggtcagtacagcctctcttatagtgcttctacctcctagaataatccttttctttgaacaattcagtcttttagaatactaatatctgaatctagaccctagtggtaggtccaagttcacttagaataagcctaatctc

SEQ ID NO: 861 - DNA, 298 bp, Homo sapiens
  AL109625.3_38009
  Located on chromosome 1
  Distance between a terminus base of telomere on chromosomal short arm and 5'-terminus of this base sequence : 90386982
  Distance between 3'-terminus of neighbour sequence of sequence listing upward to telomere on chrosomal short arm and 5'-terminus of this base sequence : 353153
aaagttgcatcctgttaacattactatcacatcatctattctgtcctaagtgtgaacatctctcatcactcaacatactgcattcgccactttcagaaaaatgtggccaagagaattcaggagggacaagtaaaagatttgactctactagctcaccttaacatcacccaacaggaagcctcagaaaacaaacaaacaaacaaacaaacaaacaacacacacttaagatatccagtctggaagacaagttctttttcattaaaatgtgaccctcgtggttttgtagttaacaggctta

SEQ ID NO: 862 - DNA, 101 bp, Homo sapiens
  DISD22_0000530
  Located on chromosome 1
  Distance between a terminus base of telomere on chromosomal short arm and 5'-terminus of this base sequence : 90464157
  Distance between 3'-terminus of neighbour sequence of sequence listing upward to telomere on chrosomal short arm and 5'-terminus of this base sequence : 76877
tggatgataatgtgggttactcacattgtgtgtgtgtgtgtgtgtgtgtgtgtgtgtgtgtgtgtgtgtatgaattactccaagtcccaagtccacctgtt

SEQ ID NO: 863 - DNA, 201 bp, Homo sapiens
  DISD22_0000537
  Located on chromosome 1
  Distance between a terminus base of telomere on chromosomal short arm and 5'-terminus of this base sequence : 90759656
  Distance between 3'-terminus of neighbour sequence of sequence listing upward to telomere on chrosomal short arm and 5'-terminus of this base sequence : 295398
  misc_feature (94)...(94): N = A, T, C, or G
ttctccttcagaccctctgaaaaaaaatgttacctttttgaggatggctctctatttttttctccctagcccctatgttttaaaaaagctaagnctgtgtgtgtgtgtgtgtgtgtgtgtgtgtgtgtgtgtgtgtgttttgaagggagcaggcacaaaagggaggggagtggaaagtaattattatcatcccaacgtctt

SEQ ID NO: 864 - DNA, 390 bp, Homo sapiens
  chr1.fa.O7frz.98633272
  Located on chromosome 1
  Distance between a terminus base of telomere on chromosomal short arm and 5'-terminus of this base sequence : 90842473
  Distance between 3'-terminus of neighbour sequence of sequence listing upward to telomere on chrosomal short arm and 5'-terminus of this base sequence : 82616
gaggttgactagtcctttaatgtacttttattaaagacactcataaagtcatgtgtcacatttgaagactcaggtatctatcagctatgatttaaacttgctttgtgtgctgtgagacaaagaatcactgataactcatgtttataaaaggcagaatagaatattggaaaggtcctgagctttgcaggcagagatacgtgtttttcaattccacttgctgaattctttgaaagcatggagagagtccctctctctctctctctctctctctttcctttctctctgtctctctctgtgcacgtgtgtgcatgtgtgtgtgtgtgtgtgtgtgtgtgtgtgtatttggggggaaagaatgaccattttgtgatcattaaacatcttcaagtc

SEQ ID NO: 865 - DNA, 231 bp, Homo sapiens
  D1S2865
  Located on chromosome 1
  Distance between a terminus base of telomere on chromosomal short arm and 5'-terminus of this base sequence : 91014480
  Distance between 3'-terminus of neighbour sequence of sequence listing upward to telomere on chrosomal short arm and 5'-terminus of this base sequence : 171617
agtgccatgtactgccctctcttgactgtaaacctggcgctgttcaaagaacatttattagtttataacccttacattttaaattcctgccaagaacttcctaggtgaagaataagtttgcaataaatacacacacaagcacacacacacacacacacacacacacacacactccactaccaccaccaccttcaccaacatcaccatcacttctaccagaattatggagcc

SEQ ID NO: 866 - DNA, 245 bp, Homo sapiens
  Z66886
  Located on chromosome 1
  Distance between a terminus base of telomere on chromosomal short arm and 5'-terminus of this base sequence : 91139941
  Distance between 3'-terminus of neighbour sequence of sequence listing upward to telomere on chrosomal short arm and 5'-terminus of this base sequence : 125230
tcattgtctgcaaggtcttcatatgaaatgcagaggtgatcaatgggttaagtatcatcacaattataaaaattgttgagattgaaaaaaaagttttctcccatttatgttagactgaacctgccaaattgagtcatgtttttgctatatgcacagaaacacacatactctccctctctctctcacacacacacacacacacacacacacaaacacacaggcttgcaccttccagaagcctgatt

SEQ ID NO: 867 - DNA, 286 bp, Homo sapiens
  chr1.fa.O7frz.99017594
  Located on chromosome 1
  Distance between a terminus base of telomere on chromosomal short arm and 5'-terminus of this base sequence : 91236602
  Distance between 3'-terminus of neighbour sequence of sequence listing upward to telomere on chrosomal short arm and 5'-terminus of this base sequence : 96416
gaaggacactttaagcaagttccactgtctctctctctctctacacacacacacacacacacaaaatcaggatatgtataataaaaggcaaccacaaaatctcagaaattcgacaatgatgaatagaaataatttgattagagaatgtaacctttgaaatcaaagaaagctacacaaaatcctcaaagctgaattcagtactttgggctggggagaggagaaatgagatttaaaaaatattttattaaagtttcatagttcagaatgctcgtctgtaaccgttctg

SEQ ID NO: 868 - DNA, 222 bp, Homo sapiens
  D1S1673
  Located on chromosome 1
  Distance between a terminus base of telomere on chromosomal short arm and 5'-terminus of this base sequence : 91420145
  Distance between 3'-terminus of neighbour sequence of sequence listing upward to telomere on chrosomal short arm and 5'-terminus of this base sequence : 183257
cagggttctccagagaaacagattgatttgtaggtaggtaggtaggtaggagatagatagatagatagatagatagatagatagatagatggatgacagagagatagatagatagatagatagatagatagatagatagatagattgattgattagtggggctcaagcaggctggcactgcttctcctgggaagggaatgagttgacaggtttgcatcaaga

SEQ ID NO: 869 - DNA, 257 bp, Homo sapiens
  AL049861.18_65874
  Located on chromosome 1
  Distance between a terminus base of telomere on chromosomal short arm and 5'-terminus of this base sequence : 91420480
  Distance between 3'-terminus of neighbour sequence of sequence listing upward to telomere on chrosomal short arm and 5'-terminus of this base sequence : 113
ttgcagacatttattagtggactcatctatctatctatctatctatctatctatccatccatccatctctatatttgtatctatatctatatccatatcatattggttctgtattgattctatatatctatatttttatctagctagctagctacagagagaaaaggatattttaaggaattggctcactcaatgataggggttgataagcctgaaatccatagagaaagatggcaggctagaaattcaggtaagag

SEQ ID NO: 870 - DNA, 211 bp, Homo sapiens
  AL049861.18_72618
  Located on chromosome 1
  Distance between a terminus base of telomere on chromosomal short arm and 5'-terminus of this base sequence : 91427137
  Distance between 3'-terminus of neighbour sequence of sequence listing upward to telomere on chrosomal short arm and 5'-terminus of this base sequence : 6400
gctagacatctgtaagcactctatgtatacagtatgcttgctgtattgagttttgttttaaatattggatcatgaaagggtagattctcccccagatccatattgggaatctgtgtgtgtgtgtgtgtgtgtgtgtgtgtgtgtgccactagaatttctacaatgacataatttttttttcaaatttaaatgcatcctcaatcagtataag

SEQ ID NO: 871 - DNA, 259 bp, Homo sapiens
  AL049861.18_130399
  Located on chromosome 1
  Distance between a terminus base of telomere on chromosomal short arm and 5'-terminus of this base sequence : 91484894
  Distance between 3'-terminus of neighbour sequence of sequence listing upward to telomere on chrosomal short arm and 5'-terminus of this base sequence : 57546
gttgctttcttgagactacaatatctaagacatatgtatctaaagactcatacttcagaaaatgggaatgtcagccagaatgttaaagaatcaaatatacgagacaaaccttcacctgagatgatgtgatctggctgtgtgtgtgtgtgtgtgtgtgtgtgtgtgtgtgtgtcttttgctgtgtatatttttaagtagttattttatcctaaacatgtattcagcagaagtcagctggtgttaatattacctgcaccaa

SEQ ID NO: 872 - DNA, 188 bp, Homo sapiens
  AL049861.18_136644
  Located on chromosome 1
  Distance between a terminus base of telomere on chromosomal short arm and 5'-terminus of this base sequence : 91491219
  Distance between 3'-terminus of neighbour sequence of sequence listing upward to telomere on chrosomal short arm and 5'-terminus of this base sequence : 6066
aaggaattgcttagtaggctatagttttctggtgtctggtctcttcaccctacatcacacacacacacacacacacacacacacaaagacacacactcatacacacacacacattgacatctttggggctgatcttaacaagggcctggcctttctctattggcattatctaacagcatagctggtac

SEQ ID NO: 873 - DNA, 274 bp, Homo sapiens
  D1S2627
  Located on chromosome 1
  Distance between a terminus base of telomere on chromosomal short arm and 5'-terminus of this base sequence : 91551923
  Distance between 3'-terminus of neighbour sequence of sequence listing upward to telomere on chrosomal short arm and 5'-terminus of this base sequence : 60516
gacattctgatggacagcactaagaggttgtcaagtttattaattctttctcccttttttcctatgacattttatgtttatttccttctgatttccaaaagtcacctttttgcaagagactacaatttcctccgttaattgtgtgtgtgtgtgtgtgtgtgtgtgtgtgtgtgtgtgtgtgtgtgttttgaggcagagtctcactctgtcaccatgctggagtgcagtggcgcgatcttggctcactgcaacctccgcctcccaggttcaagtg

SEQ ID NO: 874 - DNA, 314 bp, Homo sapiens
  chr1.fa.O7frz.99432325
  Located on chromosome 1
  Distance between a terminus base of telomere on chromosomal short arm and 5'-terminus of this base sequence : 91645502
  Distance between 3'-terminus of neighbour sequence of sequence listing upward to telomere on chrosomal short arm and 5'-terminus of this base sequence : 93305
aagatgtatcactaaggccatctcaaaacttttggggacatgtcaagaacagattaagggagaaagagagatttatgagtaatttgtcaaatttcacaaaatgtaagctgatattttatgtaaatgttataccattctctagagaaagaaacatttcaaattccataaatctgacatgctgatggaatgtgtgtgtgtgtgtgtgtgtgtgtgtgtgtgtgtgtgtgtgtgtgtagggaagggaatacacacatgtgtgcatcacacagttatacagttatactatgtgcttagacctgtcaggtttaatctat

SEQ ID NO: 875 - DNA, 420 bp, Homo sapiens
  AC024554.3_14374
  Located on chromosome 1
  Distance between a terminus base of telomere on chromosomal short arm and 5'-terminus of this base sequence : 91751761
  Distance between 3'-terminus of neighbour sequence of sequence listing upward to telomere on chrosomal short arm and 5'-terminus of this base sequence : 105945
aactttgtggtctagcaaatctacacatttttacctaactccatgttctatttttattttttattcatataccttatctttagtccaattagacttattattctctgagcacatgctttaattttaagctcatgttatactatttaggaaaggaaagaaggaaggagggaaggaaggaaggaaggaaggaaggaaggaaggaaggaaggaaggaaggatggaaagaaggaaggaaggaagggacggacctgggtgcacctttggagaataggatgaggaggctccagttacaggttgaggcagtagcaatgtcatcccatcatgggtgggatagttgtaaagtgaattaggagaaactaaaggactctggggtgggaaggaaaagacaggaccctctattagttgaccatcagttgagtc

SEQ ID NO: 876 - DNA, 219 bp, Homo sapiens
  chr1.fa.O7frz.99742959
  Located on chromosome 1
  Distance between a terminus base of telomere on chromosomal short arm and 5'-terminus of this base sequence : 91979430
  Distance between 3'-terminus of neighbour sequence of sequence listing upward to telomere on chrosomal short arm and 5'-terminus of this base sequence : 227249
gtgaggattacgaatagaagtttatgcttatgaaagatgctggggcctctgtggcctagagatcagctgaatggggctcttgtagtgatgccttacaatcttgagattctgatgaagggtgtgtgtgtgtgtgtgtgtgtgtgtgtgtgtgtgtgtgtatctgggaagggaagaatgaagaggtgttcaggggatcagaagatctttcaatagctccac

SEQ ID NO: 877 - DNA, 381 bp, Homo sapiens
  AL139416.3_94826
  Located on chromosome 1
  Distance between a terminus base of telomere on chromosomal short arm and 5'-terminus of this base sequence : 92170893
  Distance between 3'-terminus of neighbour sequence of sequence listing upward to telomere on chrosomal short arm and 5'-terminus of this base sequence : 191244
cacatgctagaattcttgtactgttctaagtttgttattatgtctcatgtggaagtcagaatgtcctggagactgactcctggtttggctttgatataagcactggaagatgaacaagagatgaggtggtggcaaaaaatagggatgatcttagacaaactgaaacactaaaaacagcctaagtatgtttcttttctttttcttccttccttctccccttcccctttcccttccccttccttcctccctccctcccttcctctttccctttctttctttctctctttctctctttctttctctctttctttctttctttctttctttctttctttctttctttccttctttgtcttgctctgtcacctaggcatagtacag

SEQ ID NO: 878 - DNA, 253 bp, Homo sapiens
  AL161639.6_109299
  Located on chromosome 1
  Distance between a terminus base of telomere on chromosomal short arm and 5'-terminus of this base sequence : 92410116
  Distance between 3'-terminus of neighbour sequence of sequence listing upward to telomere on chrosomal short arm and 5'-terminus of this base sequence : 238842
ggctgtcaagtacataggtcagccctatcagctccaccacttgctggctgtgttgtcttaggcactttattaacctctccatgcattacatttctcaactgcctatgtggacgatagtggtacctaatttacattattccgagaatcaaactgataatccaacaaaatcacttcctctgatataggaagtgaatcatcaagatcatcatcatcatcatcatcatattagtacataccagtacgataaccgtaa

SEQ ID NO: 879 - DNA, 322 bp, Homo sapiens
  chr1.fa.O7frz.92625178
  Located on chromosome 1
  Distance between a terminus base of telomere on chromosomal short arm and 5'-terminus of this base sequence : 92893616
  Distance between 3'-terminus of neighbour sequence of sequence listing upward to telomere on chrosomal short arm and 5'-terminus of this base sequence : 483247
cagtttctagcacgtaatgaacattcagcaggtgttgattgttacatgcattatacattacaaactgtatataaagactgtgtgtgtgtgtgtgtgtgtgtgtctgtgtgcatgcacgtgcgtgcatgtgttagggcttagaactacaaagtgctatatcaggcaaaataatattagcattctgtattccattcatttgtctttacccgttttaataatatagccgataactatgttcagtaatattacgtttagtcgtaggaataatagtgtcaggtataaatggcacaattaaaaacactacagaagctaagttgctcag

SEQ ID NO: 880 - DNA, 157 bp, Homo sapiens
  D1S454
  Located on chromosome 1
  Distance between a terminus base of telomere on chromosomal short arm and 5'-terminus of this base sequence : 93172941
  Distance between 3'-terminus of neighbour sequence of sequence listing upward to telomere on chrosomal short arm and 5'-terminus of this base sequence : 279003
tgttagttcctgttcttggtgaagatatttgttgctcctgtatctcattcacagtactaacacacacacacacacacacacacacacacacaaacacacacacacacagttatatctaccttaggtaagtatacttattatggttgtttccagggaa

SEQ ID NO: 881 - DNA, 253 bp, Homo sapiens
  AL158041.3_63943
  Located on chromosome 1
  Distance between a terminus base of telomere on chromosomal short arm and 5'-terminus of this base sequence : 93292327
  Distance between 3'-terminus of neighbour sequence of sequence listing upward to telomere on chrosomal short arm and 5'-terminus of this base sequence : 119229
gtgacctcaaatgaattacttcacttctataaatctgggataatataatctctgtaatagatttgttgttagaattaaataaaatcatatataaataaaataaaatcatataaaggaatatctgtcatcatcatcatcatcatcatcatcatcattcctgtcaaatttcatgtaggttctcttccatttaagtgtgttcttaatataatgccccttaatatctacctttttgtatgtggatgactttggaaac

SEQ ID NO: 882 - DNA, 253 bp, Homo sapiens; identical to SEQ ID NO: 881
  AL359083.3_58912
  Located on chromosome 1
  Distance between a terminus base of telomere on chromosomal short arm and 5'-terminus of this base sequence : 93292327
  Distance between 3'-terminus of neighbour sequence of sequence listing upward to telomere on chrosomal short arm and 5'-terminus of this base sequence : -253

SEQ ID NO: 883 - DNA, 432 bp, Homo sapiens
  chr1.fa.O7frz.92989384
  Located on chromosome 1
  Distance between a terminus base of telomere on chromosomal short arm and 5'-terminus of this base sequence : 93315311
  Distance between 3'-terminus of neighbour sequence of sequence listing upward to telomere on chrosomal short arm and 5'-terminus of this base sequence : 22731
gacagtctatggtgacagctgttctctacattcagcactttgggaggctgaggcgggcagatcacctgaggtaaggagttcgagaccagcctggccaacatggtgaaacccgtttctaataataccaaaaatttgcctgggcatagtgctgggcgcctgcaatcccagctactgtggagactgagacaggagaattgctttaaccagggaggccgaggttacagtgagccaagattgcgccattgtactccagcctgggtaacaagagtgaaaccctgtctcaacacacacacacacacacacacacacacacacacaagaaagctgtatgagtagttactgcaaaaagatgactagatataatacctaatttgttttaatgtattgaaaaggattaagtaattggcagagtgcttggatttaaactagtga

SEQ ID NO: 884 - DNA, 343 bp, Homo sapiens
  HUMUT1383
  Located on chromosome 1
  Distance between a terminus base of telomere on chromosomal short arm and 5'-terminus of this base sequence : 93320496
  Distance between 3'-terminus of neighbour sequence of sequence listing upward to telomere on chrosomal short arm and 5'-terminus of this base sequence : 4753
cgctaactgcacatcttgcaacttctcagactccataatcacattaaacaatttcttaaaataaatctctctatttcatatctattatctatctatctatcatctatctatctatctatctatctatctatctatctatctatctatgtatctatctatcatctaaatttaccatccatccatccatccatgcatctgttggttctgtgtctctggaaaacctagactaatacagcagttttgaaattgttacagaggaaaagttaaggattcatgggaagcatataacatataatgggaaaccaaacacagtttgagggttacaagagatttcttgggggag

SEQ ID NO: 885 - DNA, 442 bp, Homo sapiens
  AL359083.3_3850
  Located on chromosome 1
  Distance between a terminus base of telomere on chromosomal short arm and 5'-terminus of this base sequence : 93322314
  Distance between 3'-terminus of neighbour sequence of sequence listing upward to telomere on chrosomal short arm and 5'-terminus of this base sequence : 1475
taatgccgtaatctctttattgagtgatagtccagacacacctttagtgttctcttctaaacaagctttcttattgttataatatgaactggctgagaatttttcaaatttctttctttctttctttctttctttctttctttcttttctttcctttgcttaaatattccttcttcaatttatcgttttcctcttccattttactattaacagtcaggaggacccaagctacattctcaactctgcttagaaatctcttcagttaaatatgcagttttatggcttgtagagtttatcttccacaaaacactagcacacagttcagtcagttctttgtcattctataacaaggatcactattcctccagcttcaaataacctgtttttcatttctgtctcagaccttaccacaacaacctttatccattatccagttccaaag

SEQ ID NO: 886 - DNA, 442 bp, Homo sapiens; identical to SEQ ID NO: 885
  AL158041.3_93955
  Located on chromosome 1
  Distance between a terminus base of telomere on chromosomal short arm and 5'-terminus of this base sequence : 93322314
  Distance between 3'-terminus of neighbour sequence of sequence listing upward to telomere on chrosomal short arm and 5'-terminus of this base sequence : -442

SEQ ID NO: 887 - DNA, 136 bp, Homo sapiens
  D1S208
  Located on chromosome 1
  Distance between a terminus base of telomere on chromosomal short arm and 5'-terminus of this base sequence : 93488703
  Distance between 3'-terminus of neighbour sequence of sequence listing upward to telomere on chrosomal short arm and 5'-terminus of this base sequence : 165947
ttgccctttgcatctttgtttcgtgtgtgtgtgtgtgtgtgtgtgtgtgtgtgcgtgtgtatttccaactggccagtaaatacctggacagacagtagtatggcccttaactgtctggcaccaggcccaattatac

SEQ ID NO: 888 - DNA, 192 bp, Homo sapiens
  D1S2807
  Located on chromosome 1
  Distance between a terminus base of telomere on chromosomal short arm and 5'-terminus of this base sequence : 93593721
  Distance between 3'-terminus of neighbour sequence of sequence listing upward to telomere on chrosomal short arm and 5'-terminus of this base sequence : 104882
caaaaacacctcaatgggattttacctctcttcccttccaaaaatgcatacttatcccaaaccactatcaacaagaaaagtacacagagacacttgtgcacacatacttgaaaatcacacacacacacacacacacacacacacacacacacacacaatttactttataccaggcaactgttgtcttgactc

SEQ ID NO: 889 - DNA, 190 bp, Homo sapiens
  D1S488
  Located on chromosome 1
  Distance between a terminus base of telomere on chromosomal short arm and 5'-terminus of this base sequence : 93611356
  Distance between 3'-terminus of neighbour sequence of sequence listing upward to telomere on chrosomal short arm and 5'-terminus of this base sequence : 17443
gcaaaacagagacttcacctaactttacatttaaaaataaaactaacccacatatgtctaaaacacatgcacacacacagtcacacacacacacaataataataataataataataataataataaggtagactttatgagcagcaacaactctttgttctatctccacctccattctagtccctggaag

SEQ ID NO: 890 - DNA, 126 bp, Homo sapiens
  D1S2774
  Located on chromosome 1
  Distance between a terminus base of telomere on chromosomal short arm and 5'-terminus of this base sequence : 93785881
  Distance between 3'-terminus of neighbour sequence of sequence listing upward to telomere on chrosomal short arm and 5'-terminus of this base sequence : 174335
tgcagttcaaacctatgttgctcaagggtctattatgtgtgtgtgtgtgtgtgtgtgtgtgtgtgtgtgtatgtaactctttctgcctcattttgtctctgtttctcatctgtctttggataatgc

SEQ ID NO: 891 - DNA, 384 bp, Homo sapiens
  AC006031.2_27701
  Located on chromosome 1
  Distance between a terminus base of telomere on chromosomal short arm and 5'-terminus of this base sequence : 93858574
  Distance between 3'-terminus of neighbour sequence of sequence listing upward to telomere on chrosomal short arm and 5'-terminus of this base sequence : 72567
tcacagtaaagtgatattggcacccctccatggggatgacctcccttggttctccttggacacctacacaacctcaatgaactcattgagccagagctgcatcctattcagcaaggtctggaccttagccctggtgagaggtgtgtgtgtgtgtgtgtgtgtgtgtgtgtgtgtgtgtgtgtgtgtgtgtgtgatgcaggagcagtggccctctactagaggaccttccatggcactctatctcagccttagagatagttcctcctccttatatcttctattcctatgttctttgtctaaagatagttatgaacattgacttataactgattaaacaaagcaatgatgtaaggaattatgtactagctgaaagtcaatgagtgc

SEQ ID NO: 892 - DNA, 351 bp, Homo sapiens
  AC006031.2_155963
  Located on chromosome 1
  Distance between a terminus base of telomere on chromosomal short arm and 5'-terminus of this base sequence : 93986836
  Distance between 3'-terminus of neighbour sequence of sequence listing upward to telomere on chrosomal short arm and 5'-terminus of this base sequence : 127878
cactgtctatcacgttagcctactttatttctttataaccctaactacttattgaaattatattatttagggtttgtgtgtgtgtgtgtgtgtgtgtgtgtgtgtgtgtgtgtgttttaatttttactgttcatctcctggactaaaatatatgctcaaagagtaacaatatttactctattctctgttttatccccagtgcttagaagaacatatggcccagattccacactcagtatataattcttgaatgaaaaagagaaatgaatcaagggcctctgattccatgaagccctccccaactgcccaccacccatgacatacatcacttaagcagattgatcattcctc

SEQ ID NO: 893 - DNA, 102 bp, Homo sapiens
  D1S226
  Located on chromosome 1
  Distance between a terminus base of telomere on chromosomal short arm and 5'-terminus of this base sequence : 94009156
  Distance between 3'-terminus of neighbour sequence of sequence listing upward to telomere on chrosomal short arm and 5'-terminus of this base sequence : 21969
gctagtcaggcatgagcggggcaggagagggctccccccagtacacacacacacacacacacacacacacacacacacacacaccacgaatgtcaagtgacc

SEQ ID NO: 894 - DNA, 128 bp, Homo sapiens
  DISO7_10000667
  Located on chromosome 1
  Distance between a terminus base of telomere on chromosomal short arm and 5'-terminus of this base sequence : 94200023
  Distance between 3'-terminus of neighbour sequence of sequence listing upward to telomere on chrosomal short arm and 5'-terminus of this base sequence : 190765
aatcccagtgtaacactgttatgattgaaagtttttcattatcatgtcttttgtgacatacacacacacacacacacacacacactcagtatacttgttttttaaaaagtgcttgtgacaataaggct

SEQ ID NO: 895 - DNA, 147 bp, Homo sapiens
  DISO7_10000669
  Located on chromosome 1
  Distance between a terminus base of telomere on chromosomal short arm and 5'-terminus of this base sequence : 94227686
  Distance between 3'-terminus of neighbour sequence of sequence listing upward to telomere on chrosomal short arm and 5'-terminus of this base sequence : 27535
ttgctattactgtcttataaccacctcccaaaacacacacacacacacacacacacacacacaccctctgcattaccaccacccatcctcccactttcttatcttttccttttcttccctgcctttacctaccctattattgccgtc

SEQ ID NO: 896 - DNA, 299 bp, Homo sapiens
  chr1.fa.O7frz.101390243
  Located on chromosome 1
  Distance between a terminus base of telomere on chromosomal short arm and 5'-terminus of this base sequence : 94292429
  Distance between 3'-terminus of neighbour sequence of sequence listing upward to telomere on chrosomal short arm and 5'-terminus of this base sequence : 64596
ttagcgttggtaattaagtcagtttccagttcctctacactcccaaaaggtcaaaggtccaggtggggctgaaaattccaaccctctagtctagacacacacacacacacacacacacacacacacacacacacacacacacacacgtttaagtttccatagcaaccagctcccatcctgcagttatctaggggctttccaaaaattgcttcattaacataaacccaggtgtggttgaagaagacatcttatgagtaataaaagacacttttttcacctttatctggagctatttcagg

SEQ ID NO: 897 - DNA, 241 bp, Homo sapiens
  Z67396
  Located on chromosome 1
  Distance between a terminus base of telomere on chromosomal short arm and 5'-terminus of this base sequence : 94373181
  Distance between 3'-terminus of neighbour sequence of sequence listing upward to telomere on chrosomal short arm and 5'-terminus of this base sequence : 80453
gcattcataaaaggtgtggctggtgtgtgtgtgtgtgagtgtgtgtgtgtgtgtgtgtgtgtagcagattttactaaagatttgagaaagattgaaaggtatttctatctcaaaatagaaataatgagcatatactccagccacctgctgtatggcttgacctaattttcttcttcccttctaacctgtccgtgctctcctgattcacctcctcctacttccaagcctgttcactccaatg

SEQ ID NO: 898 - DNA, 299 bp, Homo sapiens
  AL357516.6_148536
  Located on chromosome 1
  Distance between a terminus base of telomere on chromosomal short arm and 5'-terminus of this base sequence : 94387589
  Distance between 3'-terminus of neighbour sequence of sequence listing upward to telomere on chrosomal short arm and 5'-terminus of this base sequence : 14167
gatcacgaggtcaggagatcgagaccatcccggctaaaatggtgaaaccccgtctctactaaaaaacacaaaaaattagccaggcgtagtggcgggcgcctgtagtcccagctacttgggaggctgaggcggagaatggggtgaacccgggaggcggagcttgcagtgagccgagatcccgccactgcactccagcctgggcgacagagcgagactccgtctcaaaaaaaaaaaaataataataataataataataataataataatcaaatctgaagtactgcaaaccagctaggtaa

SEQ ID NO: 899 - DNA, 127 bp, Homo sapiens
  DISD22_0000549
  Located on chromosome 1
  Distance between a terminus base of telomere on chromosomal short arm and 5'-terminus of this base sequence : 94539948
  Distance between 3'-terminus of neighbour sequence of sequence listing upward to telomere on chrosomal short arm and 5'-terminus of this base sequence : 152060
gacctcgaagtgtgaatctgttttcctttattattccttgagaagtaagaaactatttgtgtgtgtgtgtgtgtgtgtgtgtgtgtgtgtgtgtggtaagtggggcataatatttggattcattatg

SEQ ID NO: 900 - DNA, 198 bp, Homo sapiens
  DISD22_0000557
  Located on chromosome 1
  Distance between a terminus base of telomere on chromosomal short arm and 5'-terminus of this base sequence : 94734402
  Distance between 3'-terminus of neighbour sequence of sequence listing upward to telomere on chrosomal short arm and 5'-terminus of this base sequence : 194327
cctccagcaatttacaatgtcattgtaatagtcatttttactgtttaccagtatccctcccttccttccttcctccctccctccttttccttccttcctccttccttccttccttccttccttccttccttccttccttccttccttcctttctttctctctctctctcactagctaaaaggcagcaaagccatgtat

SEQ ID NO: 901 - DNA, 146 bp, Homo sapiens
  DISD22_0000572
  Located on chromosome 1
  Distance between a terminus base of telomere on chromosomal short arm and 5'-terminus of this base sequence : 95203272
  Distance between 3'-terminus of neighbour sequence of sequence listing upward to telomere on chrosomal short arm and 5'-terminus of this base sequence : 468672
agaatctttcataatgaggaaggaatacacacacacacacacacacacacacacacacacacacacacacacacacacacaattcccttattgcaaagacagatcttttaattaagcttcatttttctcatttagcaggctcaaca

SEQ ID NO: 902 - DNA, 449 bp, Homo sapiens
  chr1.fa.O7frz.99910829
  Located on chromosome 1
  Distance between a terminus base of telomere on chromosomal short arm and 5'-terminus of this base sequence : 95398746
  Distance between 3'-terminus of neighbour sequence of sequence listing upward to telomere on chrosomal short arm and 5'-terminus of this base sequence : 195328
cactaggccaagaggtatctacagatttcgtcagatatcattctgggtgtgttatgtttggattagtagagtacagaaagcagatttccctccatggtgtgagtgtgcccctccaaccagctggaggcctacgtagaaaaacaaaaaaaaagctgaccctctagagtaaatagaaattcctcttgcctgactgccttcaaagtaggacatagtatttttcactatcttagacttgaattgaaacattgactttacctgggtctgaagcttgccaatggaaggtcatggaacttgtcagccctgaatgagccaaaaccatacatatacacatatatgtgtgtgtgtgtgtgtgtgtgtgtctgtgtgtctgtgtatacattctctgggttctgtttgtttggataatcttgggtaatagagtagttgttatctaaacataccttgtcctg

SEQ ID NO: 903 - DNA, 222 bp, Homo sapiens
  chr1.fa.O7frz.100245102
  Located on chromosome 1
  Distance between a terminus base of telomere on chromosomal short arm and 5'-terminus of this base sequence : 95537687
  Distance between 3'-terminus of neighbour sequence of sequence listing upward to telomere on chrosomal short arm and 5'-terminus of this base sequence : 138492
agatacagcgtagctctgtatagttagttcaacttataatgagacaaattgcaaatatagatgttgatatttttctctacttatgacactgaaaattgtcccaagaagagatttgcaggagagactttggacatttcataggtggattagtaactaatgaaatacacgcacacacacacacacacacacacactggcactgatttcaaccaagttatagttg

SEQ ID NO: 904 - DNA, 405 bp, Homo sapiens
  AC022219.3_39694
  Located on chromosome 1
  Distance between a terminus base of telomere on chromosomal short arm and 5'-terminus of this base sequence : 95666748
  Distance between 3'-terminus of neighbour sequence of sequence listing upward to telomere on chrosomal short arm and 5'-terminus of this base sequence : 128839
ccgataatcctctagctaaacttaccaataaaaaagagaaaacacaaactaaaaataccagaaatgaaagaggggaatcaccacagatcctacaaccatcaaaaggacaataaggaaatatatgagcaacccttatgcctttatacagctgacccttgaacaaggatatcttcatcttttttgaacaacacgatttcttcatcttttgtcccccttttcttcctcctcctcctccaccttctttcttcttcttcttctattattattattattattattattattattattattattattattattttggtagagacacggtctccctatgttgccctgactagtctcaaactcttggggtcaactgatcttgcctcagtctctctgagtgctaggattataggc

SEQ ID NO: 905 - DNA, 317 bp, Homo sapiens
  AL355871.5_85394
  Located on chromosome 1
  Distance between a terminus base of telomere on chromosomal short arm and 5'-terminus of this base sequence : 95966785
  Distance between 3'-terminus of neighbour sequence of sequence listing upward to telomere on chrosomal short arm and 5'-terminus of this base sequence : 299632
atgaacgttaagtggactcttaaaagtaatgagtgggaatcggggtgaaagagagagagagtgtgtgtgtgtgtgtgtgtgtgtgtgttgtgcagtgtcctacccattcatttagggcaggagaataactgccactagttttatactgctgggggaaaaatatgcctgtggaataggaccgaacaagtaggcaggagctgaatcacacctgctcttctgcaccattccaagaagtttaaattttaggctaaaagtgatggggagccattgaaggattttatgaaaggtatgctgtgttcagacttatggtttagaag

SEQ ID NO: 906 - DNA, 309 bp, Homo sapiens
  AL355871.5_64611
  Located on chromosome 1
  Distance between a terminus base of telomere on chromosomal short arm and 5'-terminus of this base sequence : 95987524
  Distance between 3'-terminus of neighbour sequence of sequence listing upward to telomere on chrosomal short arm and 5'-terminus of this base sequence : 20422
gatcaaatgtctttggtgaacttcagcatagcaatgggggtggaataatgagaatgggctgagaaaccaaagacttgctcctaaaagaagggtgtgtgtgtgtgtgtgtgtgtgtgtgtgtgtgtgtgtgtgcataaagcaaatatatactaccaaacattaggggaagaactggatcagagtgttgcaaaacaccctttgaaaagttattttatactcagaaattttactttagtatgttagtttgatctttcttttcaagagccattagtgatggctttaaaaaattaagtctgaaaatgctgaact

SEQ ID NO: 907 - DNA, 353 bp, Homo sapiens
  AC027738.3_166886
  Located on chromosome 1
  Distance between a terminus base of telomere on chromosomal short arm and 5'-terminus of this base sequence : 96240215
  Distance between 3'-terminus of neighbour sequence of sequence listing upward to telomere on chrosomal short arm and 5'-terminus of this base sequence : 252382
attatagacatgaactgccatgtccggccagaggatggctggcttgctttctttctttctttctttctttctttctttctttctttctttctttctttctttctttctttctctctctctctctctctctctttctttctttctttctttctttttttcaaactgcttgttgtctattagctgctaggaaggcatgataatatattgtggaatactatcttaactttgccagtcagtccacaactccctcagggagaaggtttccccatcaatgatgattatttatgtgataactttagattttcactttgaaaatccgcatcttgtgctccttgaagtaatggattctattc

SEQ ID NO: 908 - DNA, 430 bp, Homo sapiens
  AL109744.8_54155
  Located on chromosome 1
  Distance between a terminus base of telomere on chromosomal short arm and 5'-terminus of this base sequence : 96334385
  Distance between 3'-terminus of neighbour sequence of sequence listing upward to telomere on chrosomal short arm and 5'-terminus of this base sequence : 93817
gttcgtgatcaactatctgagtttagtactacaggttttcagatgccgcaggagaaaaaacatagcttaaaaagttacctactctaagttggctgggagtggtggcgggtgcctgtagtcccagctactcaggaggctgaggcaggagaattgcttgaacctaggccaagtttgcagtaggccgagatcgtaccactgcactccaacctgggcaacagagcaagactccatctgaaagaaagaaagaaagacagaaagacagagaaagaaaaaaagaaagagaaagaaggaaagcaagcaagcaagcaagcaagcaagcaagcaagctattctgaatgtggctgatttagaaaaagcaaagatagaccttaatgtggaaattggctcttttgttttaccaaaatcacttaatttcactgacttcaccttc

SEQ ID NO: 909 - DNA, 160 bp, Homo sapiens
  Z23649.1_135
  Located on chromosome 1
  Distance between a terminus base of telomere on chromosomal short arm and 5'-terminus of this base sequence : 96346585
  Distance between 3'-terminus of neighbour sequence of sequence listing upward to telomere on chrosomal short arm and 5'-terminus of this base sequence : 11770
ttaatggttattaggcatgataagggaaggaaaggccacatgggaattttctggggactggcaaacacacacacacacacacacacatatatttcttgtcagagacagcgtctcactatgttgcccaggctggagtgcagtgactattcaccagcacaat

SEQ ID NO: 910 - DNA, 165 bp, Homo sapiens
  AL049743.10_43142
  Located on chromosome 1
  Distance between a terminus base of telomere on chromosomal short arm and 5'-terminus of this base sequence : 96346585
  Distance between 3'-terminus of neighbour sequence of sequence listing upward to telomere on chrosomal short arm and 5'-terminus of this base sequence : -160
ttaatggttattaggcatgataagggaaggaaaggccacatgggaattttctggggactggcaaacacacacacacacacacacacatatatttcttgtcagagacagcgtctcactatgttgcccaggctggagtgcagtgactattcaccagcacaatcatac

SEQ ID NO: 911 - DNA, 440 bp, Homo sapiens
  AL049743.10_21335
  Located on chromosome 1
  Distance between a terminus base of telomere on chromosomal short arm and 5'-terminus of this base sequence : 96368548
  Distance between 3'-terminus of neighbour sequence of sequence listing upward to telomere on chrosomal short arm and 5'-terminus of this base sequence : 21798
gtcttaacctggcaattatgtgtttgccctgccccctccaaagcctccccctgtcaaccttcctacctcctgcaaaatgttattgttatctctctaggaagtactgcatgaatgcatgtttgtgtgtgtgtgtgtgtgtgtgtgtgtgtgtgtgtgtgtacaaagtttgtctatttttgccctagattctcctcctctttttgttattgcttctaatatctgatgaaatataatgaaatttgtcaatgtctttgtgattgcaactgtatcctgaacaggcaggatttttgcaaacagagatattgacaacacagttactctctgaaatattttccctgaaaagagtgacaatgctgcctgctgaggtctcttacaccaaacatgcttctgaattacacacagtcatgattataaaagtgaaactgactccataacatatt

SEQ ID NO: 912 - DNA, 259 bp, Homo sapiens
  AL157410.5_47389
  Located on chromosome 1
  Distance between a terminus base of telomere on chromosomal short arm and 5'-terminus of this base sequence : 96466263
  Distance between 3'-terminus of neighbour sequence of sequence listing upward to telomere on chrosomal short arm and 5'-terminus of this base sequence : 97275
  misc_feature (147)...(147): N = A, T, C,  or G
gacactcagcctcatcgaggatgcagagagaaaataactcgatggagagaagcaagcattaggggggttaaatgaccaggttggtggggggaattaaattatagacggtcttaaaaaacaggcaggggaggtttttctgtttttgtnttcgttttgttttgttttgttttgttttgttttaaagacaggatcgcactctgttgcccaggctggagtacagtggcaccaacatagctcactgtaacttcaaactccagga

SEQ ID NO: 913 - DNA, 372 bp, Homo sapiens
  chr1.fa.O7frz.102832862
  Located on chromosome 1
  Distance between a terminus base of telomere on chromosomal short arm and 5'-terminus of this base sequence : 96580819
  Distance between 3'-terminus of neighbour sequence of sequence listing upward to telomere on chrosomal short arm and 5'-terminus of this base sequence : 114297
gctatcgaatggctctttcgtatgtcaccatggagggccactccagcatacacacacacacacacacacacacacacacacacacacacacacaccaagcacacaagggagaggcaagttctatcgaatggctctttggtatggcaccatgaagagccactccaccacacacgtgcatgcgcatacacacacacacacacacacacacacacagatttaacgcaaacagctctgagtgcctaagcgctctaaggacaccacaaacagagctttattaaaaacagaaggttactaagatgataattatattaatagggcatattttgtaattttcctatcagggataaccttagtcagaggtgataaagatga

SEQ ID NO: 914 - DNA, 257 bp, Homo sapiens
  DISO7_10000671
  Located on chromosome 1
  Distance between a terminus base of telomere on chromosomal short arm and 5'-terminus of this base sequence : 96849263
  Distance between 3'-terminus of neighbour sequence of sequence listing upward to telomere on chrosomal short arm and 5'-terminus of this base sequence : 268072
cggttactggatgttaataatcagttaaattctagaaaacgtcaaacaaaatgtaggtggcagtttttgtttgtttgtatgtatgtatgtatgtatgtagagacagggtcttgtgatattgcccaggctggtcttgaactcctggcctcatgtgatcctccaccttggcctctcaaagtgctgagattacaggcatgcgcgaccatgcccagcctaggtggcagtttttaaatgttcctgcaactatttaattcttc

SEQ ID NO: 915 - DNA, 391 bp, Homo sapiens
  AL138838.6_66033
  Located on chromosome 1
  Distance between a terminus base of telomere on chromosomal short arm and 5'-terminus of this base sequence : 97049418
  Distance between 3'-terminus of neighbour sequence of sequence listing upward to telomere on chrosomal short arm and 5'-terminus of this base sequence : 199898
cctgagtagcgaggactacaggcatgtgccaccacacctggctttaattttatttatttatttatttatttatttatttatttatttatttagtaagtaagtaagtagagacgaggccttgctatgctgcctaggctgttcttgaactcctgggctcaagcaatcctcccacctcagactcccaaaatgttgggattactggtgtgagccaccaagctcagcctaaacatttttaaagagggagaaataatgcatcaaaaatgggtttgctttcatgagattagagttcttgaaagaagtttttccttccaaggcaattttacctaaatttacttttctcacattaagatcacagttaaagatgaccctaaaccaaattaggagtttagcc

SEQ ID NO: 916 - DNA, 116 bp, Homo sapiens
  HUMUT851
  Located on chromosome 1
  Distance between a terminus base of telomere on chromosomal short arm and 5'-terminus of this base sequence : 97049428
  Distance between 3'-terminus of neighbour sequence of sequence listing upward to telomere on chrosomal short arm and 5'-terminus of this base sequence : -381
gaggactacaggcatgtgccaccacacctggctttaattttatttatttatttatttatttatttatttatttatttatttagtaagtaagtaagtagagacgaggccttgctatg

SEQ ID NO: 917 - DNA, 322 bp, Homo sapiens
  chr1.fa.O7frz.103475962
  Located on chromosome 1
  Distance between a terminus base of telomere on chromosomal short arm and 5'-terminus of this base sequence : 97120302
  Distance between 3'-terminus of neighbour sequence of sequence listing upward to telomere on chrosomal short arm and 5'-terminus of this base sequence : 70758
acttatggcttaattgaactgagcctgttgttttcaaaataataagttgtttaaatccaaccatttaaaaataagtatttatatacatagtcaggatctaaggatatagtattgtgtccatttcccatatcaaagaaaactggtgaagggctaaatttgaaaacagtcacttctctttcatcagatttcccctacaattcccttactctctttctctctttgtctctctctctgtgtgtgtgtgtgtgtgtgtgtgtgtgtgtgtgtgcgcgtgtgtgtgtgtgtgtttcttttggacaggttacaacgtcaaagtcagaaa

SEQ ID NO: 918 - DNA, 275 bp, Homo sapiens
  chr1.fa.O7frz.103669394
  Located on chromosome 1
  Distance between a terminus base of telomere on chromosomal short arm and 5'-terminus of this base sequence : 97421127
  Distance between 3'-terminus of neighbour sequence of sequence listing upward to telomere on chrosomal short arm and 5'-terminus of this base sequence : 300503
tacaatacattcttggaaagctgagtcaggaggatcacttgaacccagaagttttaagactgcagtgagcaatcatatcatgccactgcactctagcccaagcaactaagcaagaccccatttcaaaaaaaaaaaaaaacataagtgtgatccaacgagtatattagcatgaccccaaaaccgtgtgtgtgtgtgtgtgtgtgtgtgtgtgtgtgtgtgtgtgtgtgtgtgtgtgtgttagggcttgaagaagtcttccatgaataagtagcacc

SEQ ID NO: 919 - DNA, 375 bp, Homo sapiens
  chr1.fa.O7frz.104132801
  Located on chromosome 1
  Distance between a terminus base of telomere on chromosomal short arm and 5'-terminus of this base sequence : 97573350
  Distance between 3'-terminus of neighbour sequence of sequence listing upward to telomere on chrosomal short arm and 5'-terminus of this base sequence : 151948
ttaacttacctgcataagcaacaatccaactataaaagcacttccttgacagtaaccaacctcacgatctactaaagagtaagcctaaaaagtaaaaaaaagttgttcaaaatacatggtaagttataccttccttctccaaaaaacctaaaattggcaagacagacagattaaaaaacatttatttttgagaaaagctcttgcttgcttgttatagatgttatcctatacatatttaaaaagcaaatgttttattacatgaaattttattttgacaatttcccaatccaaacttgctagctctaaagacataaaataaaataaaataaaataaaataaaataaaataaaataaaataaaggaatttgtaacagg

SEQ ID NO: 920 - DNA, 212 bp, Homo sapiens
  D1S2776
  Located on chromosome 1
  Distance between a terminus base of telomere on chromosomal short arm and 5'-terminus of this base sequence : 97615735
  Distance between 3'-terminus of neighbour sequence of sequence listing upward to telomere on chrosomal short arm and 5'-terminus of this base sequence : 42010
aatgcctgtctttatccctgataattctccttcttaagtttgctttgtttgaaattaatataattatgccaaatatctctctctctctcacacacacacacacacacacacacacacacacacacacacacacagaggacggcagacttgaagacaatctggtggtttctagagtggctctgtttttggagaaggggcatttctcttacatt

SEQ ID NO: 921 - DNA, 150 bp, Homo sapiens
  D1S2868
  Located on chromosome 1
  Distance between a terminus base of telomere on chromosomal short arm and 5'-terminus of this base sequence : 97741245
  Distance between 3'-terminus of neighbour sequence of sequence listing upward to telomere on chrosomal short arm and 5'-terminus of this base sequence : 125298
aggtataatctgcaataaaaaacttacatgaattatatatacacacacacacacacacacacacacacacacacacacatatctgttgctctcctccaaacatccaagaatttgcatatttgcataagtggcttcatattgttttacttt

SEQ ID NO: 922 - DNA, 172 bp, Homo sapiens
  D1S2849
  Located on chromosome 1
  Distance between a terminus base of telomere on chromosomal short arm and 5'-terminus of this base sequence : 97962136
  Distance between 3'-terminus of neighbour sequence of sequence listing upward to telomere on chrosomal short arm and 5'-terminus of this base sequence : 220741
tccctaaccctccagactaagtataagttctcatagccctatgaaacttttattcacagcagtgtgtgtgtgtgtgtgtgtgtgtgtgtgtgtatatatatatatttttttctttttgagatggagtctccctctgttgcctaggctggagtgcattggcacgatctcagct

SEQ ID NO: 923 - DNA, 423 bp, Homo sapiens
  AL355822.3_135906
  Located on chromosome 1
  Distance between a terminus base of telomere on chromosomal short arm and 5'-terminus of this base sequence : 98051539
  Distance between 3'-terminus of neighbour sequence of sequence listing upward to telomere on chrosomal short arm and 5'-terminus of this base sequence : 89231
aactaagaatgtcaagcttcaaagaattataattaatttctaagataattgttttaccaaattcaagtaatatttattaaatttgatttgtttcatgatcttgggtaaataactaaatatgtaaaattaagttacctgtactggtttgcttttatatggaaggtagaatttaattggttttagtagggtcactctctatatttttgaaataattttcaaaaatttgaaaatattttaaaactaaggacttaaaaagtacttgagacttaagtgcacttatttatttatttatttatttatttatttatttagagatggtctcgctctgtcacccaggccggagtgcagtggtgcgatttcggtttttacatgtggcaactctttgaataatattaaatattaaccttggacctacttagcagt

SEQ ID NO: 924 - DNA, 376 bp, Homo sapiens
  AL139421.11_15362
  Located on chromosome 1
  Distance between a terminus base of telomere on chromosomal short arm and 5'-terminus of this base sequence : 98131491
  Distance between 3'-terminus of neighbour sequence of sequence listing upward to telomere on chrosomal short arm and 5'-terminus of this base sequence : 79529
gaactggtaacaagaaatcagtaaattaaaccagttgttacctgctgttaaatggaaaattgaaaaggtgcttattagacttacagattttatttcttttgttttgttttcctcttattttctactttagattccccaaaacccccacaaaaaagtcttaaacataaaagaagagtttaccttctttttttgaagatgcatagcctagggccctatctggttgtctccagattgtgcacctgaggagcttctttggttcagcagagtggtgtttgtttttgttttgatttcatttatttatacacacacacacacacacacacacacacacacacacacacatttgcaagtggtttgtatacaatgcaagatgttt

SEQ ID NO: 925 - DNA, 436 bp, Homo sapiens
  chr1.fa.O7frz.104739903
  Located on chromosome 1
  Distance between a terminus base of telomere on chromosomal short arm and 5'-terminus of this base sequence : 98227004
  Distance between 3'-terminus of neighbour sequence of sequence listing upward to telomere on chrosomal short arm and 5'-terminus of this base sequence : 95137
cttggacatgaagacagaatactgctaaatgttggagtatgcagaactctggtcctcggctcctctctttctatccaagtgtagggaatgctatgcatttacaaattcgtaaactttcttaaaacattatgagatattgtgtgtgtgtgtgtgtgtgtgtgtgtgtgtgtgtgtgtgtgtgtgtgtgtgtgttctatcccagagtagggaatgctatacatttataaattcgtaaacgttcttaaaacattatgagatattttgtgtgtgtgtgtgtgtgtgtgtgtgtgtgtgtgtagctcatcagctattgttagtgttagtgtattttacgtgtggcccaagacaattcttcttccaacatggcccagggaagccaaaagattggataccccttctatattgtctccctaggtgatctcgtctagactcattg

SEQ ID NO: 926 - DNA, 327 bp, Homo sapiens
  chr1.fa.O7frz.104874864
  Located on chromosome 1
  Distance between a terminus base of telomere on chromosomal short arm and 5'-terminus of this base sequence : 98362028
  Distance between 3'-terminus of neighbour sequence of sequence listing upward to telomere on chrosomal short arm and 5'-terminus of this base sequence : 134588
ctggattagcctgacattagtagggtctttaataaatgtttgttggactgacctgagtctagtgttgcgtttgacttgaatttgagtgcacaatgtctgaaagtagtgatgaagggtagactggaaccaggcaggcaaagaggttggtctggctgattgcttgattcatgaacctcttgtgtgtgtgtatgggtgtgtctgtgtgtgtgtgtgtgtgtgtagttacacatttgtatataatcaaaccacttttcagaccatttaaaaattcacagaagaaaatcttagtttattggtagaagggattacctcttgcttctgaatact

SEQ ID NO: 927 - DNA, 154 bp, Homo sapiens
  chr1.fa.O7frz.105097297
  Located on chromosome 1
  Distance between a terminus base of telomere on chromosomal short arm and 5'-terminus of this base sequence : 98567821
  Distance between 3'-terminus of neighbour sequence of sequence listing upward to telomere on chrosomal short arm and 5'-terminus of this base sequence : 205466
ttactggactatgagctcactaagaacagggaccacactgtattcacctttgtacctcccgtgcagttgctccatgtatgttggtttgaataaatgaacgtgtgtgtgtgtgtgtgtgtgtgtgtgtgttttctctaatacgcggaagacctag

SEQ ID NO: 928 - DNA, 359 bp, Homo sapiens
  AL049796.28_120358
  Located on chromosome 1
  Distance between a terminus base of telomere on chromosomal short arm and 5'-terminus of this base sequence : 98740688
  Distance between 3'-terminus of neighbour sequence of sequence listing upward to telomere on chrosomal short arm and 5'-terminus of this base sequence : 172713
acaggtgattacagtttaggactaaatatgtgggtaggaatgtgtgtgtgtgtgtgtgtgtgtgtgtgtgtgtgtgtgtgtgtgtgtgtgtgtcaaggagcggggtggagaagaactcagccagagagaaatgcaatgtgatggaaatagttaaagaggctatgatcttctctctgattccccttgaggacagaacaataggcaaaggactcaaattgcaccaccagagaatttgtgtggccactaggagaaaaaaaaaaccctccaacttagaagggagtgtttttgcatttcaatctctgggaggtgttttcctctctttctctctaagtttgaagaattactgttcgagtttaacc

SEQ ID NO: 929 - DNA, 237 bp, Homo sapiens
  AL049796.28_44264
  Located on chromosome 1
  Distance between a terminus base of telomere on chromosomal short arm and 5'-terminus of this base sequence : 98816790
  Distance between 3'-terminus of neighbour sequence of sequence listing upward to telomere on chrosomal short arm and 5'-terminus of this base sequence : 75743
atgcaatgtgaagacatttaattcattaaaggggcataacaattttatatatatatatatatatatatatatatatatatatataaaactttgtttacattagagtataattaaataggcctggcaccaatcagggctctgccacttactgtttggagaagcgattcacaattcgcatccttgcacgttcttcctagatgtgccaagaatgcaagaccctgatcacgctttacttgg

SEQ ID NO: 930 - DNA, 350 bp, Homo sapiens
  AL117351.12_10191
  Located on chromosome 1
  Distance between a terminus base of telomere on chromosomal short arm and 5'-terminus of this base sequence : 98944356
  Distance between 3'-terminus of neighbour sequence of sequence listing upward to telomere on chrosomal short arm and 5'-terminus of this base sequence : 127329
cctcagttttctgcctgtaaaggaggagtaatagtaataatgttaagaatagtaaattaaattaaattaaattaaattaagtgagataatatattgatgttaagagagacaaatctggctgggcatggtggtgcacatctgtagtcctagctactcaggagtctgagacgggaggattgcttgagataaggagttcaaggctgcagtgagctatgctcacaccacttcactccagcctgggcaacatagtgagacaccgtctctgaaaaagagagagagagagagagagagaaagagacaaatctggattcaaatctcagctctgcctctcattacctgtatgagtttgg

SEQ ID NO: 931 - DNA, 341 bp, Homo sapiens
  AL117351.12_973
  Located on chromosome 1
  Distance between a terminus base of telomere on chromosomal short arm and 5'-terminus of this base sequence : 98953564
  Distance between 3'-terminus of neighbour sequence of sequence listing upward to telomere on chrosomal short arm and 5'-terminus of this base sequence : 8858
tggtgagcatagtatccaatagttagtttttcaaccctttcccccttccctccctgccccctctagtagtcctcagtgtctattattattatgccatctttaggtccatgagtacccaatgtttagctcccacttataaatgagaacatgtggttttggttttcttttgctttttaattttcttaagatattggcctccagctgcattcatgttgctgccgaggacataattttgttcttttttatggcttcatagtattccatgatatatatatatatatatatatatatatatatatataatctcacattttcttctttatccagtctactgttgatgg

SEQ ID NO: 932 - DNA, 312 bp, Homo sapiens
  AL390314.6_23296
  Located on chromosome 1
  Distance between a terminus base of telomere on chromosomal short arm and 5'-terminus of this base sequence : 99225559
  Distance between 3'-terminus of neighbour sequence of sequence listing upward to telomere on chrosomal short arm and 5'-terminus of this base sequence : 271654
gtcaggaattcacgaccaccctggccaacgtggtgaaactgtctctactaaaaatacaaaaattagctgggcatggtggctggcacctgtaatcccagctactcgggaggctgaggtaggataattgcttgaacacaggaggtggaggttgcagtgagccgagatcatgccactgcactccagcctgggcaacagagcaagactctgtctcaaaaaacaaaacaaaacaaaacaaaacaggaacaaagaataataaaataggtaggaattatcccgaaatggaaggcagttcagtttcaaacaagttgactt

SEQ ID NO: 933 - DNA, 436 bp, Homo sapiens
  AL390314.6_147041
  Located on chromosome 1
  Distance between a terminus base of telomere on chromosomal short arm and 5'-terminus of this base sequence : 99251958
  Distance between 3'-terminus of neighbour sequence of sequence listing upward to telomere on chrosomal short arm and 5'-terminus of this base sequence : 26087
ttcaagttcacctaggtcagaaaaccactgtgggcagttgcttcaaggcagcttataactgcttccatggaagtcattgtttatttttattttttaattaattaattaattaattaattaatttgagacggagtctcactctgtcgcccaggctggacagcagtggcatcctcttggctcattgcaacctccgcctcccaggttccagcaattctcctgcctcagccttccgagtacctgggactacaggtgtgcaccaccacacctggctaatttttgtattttttggtagagacgggctttcaccatattggccaggctggtctcgaactcctgaccttgtgatccacccgcctcagcctcccaaagtactgggattacaggcatgagctaccacgcttggctgcaattgtttattaagagcagttacttggcc

SEQ ID NO: 934 - DNA, 377 bp, Homo sapiens
  AL390314.6_97992
  Located on chromosome 1
  Distance between a terminus base of telomere on chromosomal short arm and 5'-terminus of this base sequence : 99325958
  Distance between 3'-terminus of neighbour sequence of sequence listing upward to telomere on chrosomal short arm and 5'-terminus of this base sequence : 73564
cggaccaatatggtgaaacaccatctctactgaaaatacaaaaattagctgagcctggtggcaggtgcctgtaatcccagctattcaggaggctgaggcaggagaatcgcttgaacctgggaggcagaggttgcagtgagctgagattgtgccactgcactccagcctgggagacagagcaagactctgtctaaaaaaaaaaaaaagaaagaaagaaagagaaagaaagaaagaaagaaagaaagaaagaaagaaagaaagaaagaaaaatgggctccttctgggtgcttttactaaacactaaattagaaaacatgtctttatcctgcagtcaggagacaatgatgtatcggatgtctgctccatatgaattaaat

SEQ ID NO: 935 - DNA, 301 bp, Homo sapiens
  AC025122.3_134627
  Located on chromosome 1
  Distance between a terminus base of telomere on chromosomal short arm and 5'-terminus of this base sequence : 99367654
  Distance between 3'-terminus of neighbour sequence of sequence listing upward to telomere on chrosomal short arm and 5'-terminus of this base sequence : 41319
tcatcctcatgtaagtcataacagagaataaacatagataggaactctttaacatttactaaattcccaatttctttctttctttctttctttctttctttctttctttctttctttctttctttctttctttctttctttcccttccttccttccttccttccttccttccttccttctttctttctttctttctttctttctttctttctttctttctttctttctttctttctttctttctttctttctttctttctctctttctttctttcttttctttcaacaggatctcactctg

SEQ ID NO: 936 - DNA, 438 bp, Homo sapiens
  AL354940.5_145952
  Located on chromosome 1
  Distance between a terminus base of telomere on chromosomal short arm and 5'-terminus of this base sequence : 99413820
  Distance between 3'-terminus of neighbour sequence of sequence listing upward to telomere on chrosomal short arm and 5'-terminus of this base sequence : 45865
aaggcacagtgcttaccacatggcaaatattccctaagatatctggtgatagatgaatgaagaagtggatggatggatggatagatggatggatggatggatggatggatggatggatggatggatggttgggtaggtgggtaagtgggtgggtgtgtggatggatgggtggatggatggatggatggatggatggatggatggatggatagatggattgattgatgaactacccccaaactacccttcccagtaaatgagtcattcattcacttactccagttatgtctactaagaaccaagcctgcagcaggcaataaaccatgcactagagatattgctgtgaactagacagtgtttagagtctaacaggggagttggtcattaaacaaacaggggccaaatagttatttagtgatagtatggactaggtgtgct

SEQ ID NO: 937 - DNA, 193 bp, Homo sapiens
  D1S2813
  Located on chromosome 1
  Distance between a terminus base of telomere on chromosomal short arm and 5'-terminus of this base sequence : 99434428
  Distance between 3'-terminus of neighbour sequence of sequence listing upward to telomere on chrosomal short arm and 5'-terminus of this base sequence : 20170
ccccaccgtatctggtattttaaaaaatgtttttgaaaagaaaaggaagaggagaaaagagagaaaatttattgcgcctagtcaggaaaatatgaaaatttatttcagttatacttgtgtgtgtgtgtgtgtgtgtgtgtgtgtgtgtaagtgggtcactatacaaaatgtatgtcttccagtgagtcaaaag

SEQ ID NO: 938 - DNA, 164 bp, Homo sapiens
  AL359554.7_49909
  Located on chromosome 1
  Distance between a terminus base of telomere on chromosomal short arm and 5'-terminus of this base sequence : 99525908
  Distance between 3'-terminus of neighbour sequence of sequence listing upward to telomere on chrosomal short arm and 5'-terminus of this base sequence : 91287
atggtcttgaaatgtagtcataaggggaaggtattttggaaaaaataacctgagaaatcgtctcatgtgaacataatcacacacacacacacacacacacacacacacacacaatttgtagtctttgatatagtaatcttgtttctgagaatttatgcttaaga

SEQ ID NO: 939 - DNA, 155 bp, Homo sapiens
  AL359554.7_99406
  Located on chromosome 1
  Distance between a terminus base of telomere on chromosomal short arm and 5'-terminus of this base sequence : 99575446
  Distance between 3'-terminus of neighbour sequence of sequence listing upward to telomere on chrosomal short arm and 5'-terminus of this base sequence : 49374
ctaaatagtttggatcatgatcacaaattaaaataaatatatatatatatatatatatatatatatatatatatatatatatattttagcctcacctaaaagtttttttctttcaaaaatatttttagagaaactgctttgtaaactgatttgag

SEQ ID NO: 940 - DNA, 260 bp, Homo sapiens
  chr1.fa.O7frz.106330244
  Located on chromosome 1
  Distance between a terminus base of telomere on chromosomal short arm and 5'-terminus of this base sequence : 99633055
  Distance between 3'-terminus of neighbour sequence of sequence listing upward to telomere on chrosomal short arm and 5'-terminus of this base sequence : 57454
gattaaggaaacaggatagagaactcagaaatacacccacaaaataagcccaactggtttttgacaaatgtacaaaagcaattcaatggaggaaagatagcctttcaataaatggggctggagcaattggacagacatacataggcaagaaaaacacacacacacacacacacacacacacacacacacacacaccttgtcctatataccacattgtatacaaaaattaactcaaaatggatcattaacttaccatgtat

SEQ ID NO: 941 - DNA, 389 bp, Homo sapiens
  chr1.fa.O7frz.106336328
  Located on chromosome 1
  Distance between a terminus base of telomere on chromosomal short arm and 5'-terminus of this base sequence : 99639113
  Distance between 3'-terminus of neighbour sequence of sequence listing upward to telomere on chrosomal short arm and 5'-terminus of this base sequence : 5798
ttgagattatgaggctcattatactaactcaacaattcattcactcaggaaatgttcaagatacagttctatctatctatacctatctgtctatttacctctatctatctatctgtctatctatccatctgtctatctatctatctatccatccatctgtccatccatctatccattcatctatctatctatctgtctacctatctatctatttatctattttcctacctactgtttgcctacttactaagaaaaatttaacatgaactctaagtactggcattataggcaattttcacatgattataagaacagatgctcaataaatatctgttgaatgaataagtgaatgacatttcttctgtgtgctttatgtttgattctaaact

SEQ ID NO: 942 - DNA, 209 bp, Homo sapiens
  D1S236
  Located on chromosome 1
  Distance between a terminus base of telomere on chromosomal short arm and 5'-terminus of this base sequence : 99651575
  Distance between 3'-terminus of neighbour sequence of sequence listing upward to telomere on chrosomal short arm and 5'-terminus of this base sequence : 12073
ccacctaccaatgtctgtctttggcaacatatacacaacacacacacacacacacacacacacacacacacacacacacacacaccatatctcttcagtctttttacccagccccacctaccaatgtctgtctttggcaacatatacacaacacacacaaacacacacacacacacacacacacacacccaccccataacgacagcttc

SEQ ID NO: 943 - DNA, 291 bp, Homo sapiens
  AL162735.31_148688
  Located on chromosome 1
  Distance between a terminus base of telomere on chromosomal short arm and 5'-terminus of this base sequence : 99714222
  Distance between 3'-terminus of neighbour sequence of sequence listing upward to telomere on chrosomal short arm and 5'-terminus of this base sequence : 62438
catgcgcctttagtcctagctgcctgggagactgaggtgggaggatcacttgagtccaggaggtcaaggctgcagtaagccagattgcaccactgcactctggcctgggtgacagagggagacttcgtctcaaaaataaataaataaataaataaataaataaataaataaagcactatcacttgaaaccagtggtccccaagcctattggattacagaaccaccatggaacttttttttttaaaaaagacaaggttgtgggctccagtccagacttacaagatcagattc

SEQ ID NO: 944 - DNA, 102 bp, Homo sapiens
  DISO7_10004886
  Located on chromosome 1
  Distance between a terminus base of telomere on chromosomal short arm and 5'-terminus of this base sequence : 99813769
  Distance between 3'-terminus of neighbour sequence of sequence listing upward to telomere on chrosomal short arm and 5'-terminus of this base sequence : 99256
aatgcctgtcatgtcttccctgttttgttttgttttgttttgttttgttttgttttgttttattctcctgttttggtcatgcccatacttgagcaaggtaga

SEQ ID NO: 945 - DNA, 463 bp, Homo sapiens
  AL355147.2_96831
  Located on chromosome 1
  Distance between a terminus base of telomere on chromosomal short arm and 5'-terminus of this base sequence : 99839271
  Distance between 3'-terminus of neighbour sequence of sequence listing upward to telomere on chrosomal short arm and 5'-terminus of this base sequence : 25400
agacttgccatacagcaagtaggagaaggtagcacctgaactatatctctttgttgtaagttactttttactttgacattctttcttcttcacttattattattactattattattattattattattattattattattattattttgagacaaagcctcactctgtcacccaggctggagtacagtggtgtgatctcagctcactgcaacctccgcctcctgggttcaagcgattctcatgcctcagcctcccgagtagggttacaggcatgcgccaccatgttcagctgatttttgtatttttagtagagacagggtttcaccatgttggccaggctggtctgaaattcctgacctcaggtgatccacccgcctcggcctcccaaagtgctgggattacaggcgtgagccaccgcgcccagcctctttttcactttataccacagactattccagtccta

SEQ ID NO: 946 - DNA, 379 bp, Homo sapiens
  chr1.fa.O7frz.105538676
  Located on chromosome 1
  Distance between a terminus base of telomere on chromosomal short arm and 5'-terminus of this base sequence : 99917302
  Distance between 3'-terminus of neighbour sequence of sequence listing upward to telomere on chrosomal short arm and 5'-terminus of this base sequence : 77568
cgaaggatactgaagaatgtaagatcccagctgggcttgccttgtgtaccctggacctcccagaagtgtgtgtgtgtgtgtgtgtgtgtgagagagatgtgccttcctggtagcacatctcatgtttgttttttgctaagtggactcttgcgtttcctcccccatccacagtcatcactggaatgctttgcttcagtgcccctgcctgggccctcccctctctactgcagcctacaatgaggttttctttcccattgcttgaattatatccctaatggaagggttcacaattctctgaatcctggctactcagataaagacagggaggaagggaggaagggtattttctcccagggggtccaaatctagctttaacgag

SEQ ID NO: 947 - DNA, 316 bp, Homo sapiens
  AL355496.6_41028
  Located on chromosome 1
  Distance between a terminus base of telomere on chromosomal short arm and 5'-terminus of this base sequence : 99997756
  Distance between 3'-terminus of neighbour sequence of sequence listing upward to telomere on chrosomal short arm and 5'-terminus of this base sequence : 80075
gaggtcaggagtttaagaccagcctggccaacatagtgaaaccctgtctctactaaaaatacaaaaaaaaaaaaaaaaattagccgagtgtggtggcaggtgcctgtagttccagcctctcaggagactgaggcaggagaattgcttgaacccaggaggcggaggttgcagtgagccaagatcatgccactgtactccagcctgggcaacggtgagactgtctcaaataaaataaaataaaataaaataaaataaaataaaataaaataaataaaataaaataaataaaactacctttgacttcagcaagtacgat

SEQ ID NO: 948 - DNA, 377 bp, Homo sapiens
  chr1.fa.O7frz.107856137
  Located on chromosome 1
  Distance between a terminus base of telomere on chromosomal short arm and 5'-terminus of this base sequence : 100054262
  Distance between 3'-terminus of neighbour sequence of sequence listing upward to telomere on chrosomal short arm and 5'-terminus of this base sequence : 56190
actttagctcgtagccaactaccacgtatactatttagttctgacccaaactacacggaaattttgagagttatcagcatcatccttaatctctctccctctctggctaccctttaccatagtactctacctatggattttgaaacacacacacacacacacacacacacacttttcagtaggaattctcagtcctaaaagattttggccaatgaaataatgcaacagctctccacagagcatgagattgtcaaaatgaccctcatgattaaatccttgcccaggcgtatattgagagaggcaggaggcgatagttaagtcaaaatcatcacgtaatttcaattgccatttgtcttgttatctaggtaatgttctgg

SEQ ID NO: 949 - DNA, 184 bp, Homo sapiens
  D1S2819
  Located on chromosome 1
  Distance between a terminus base of telomere on chromosomal short arm and 5'-terminus of this base sequence : 100102143
  Distance between 3'-terminus of neighbour sequence of sequence listing upward to telomere on chrosomal short arm and 5'-terminus of this base sequence : 47504
gaaacccccccaaccttagtaaggcttggcaggaaggtgtctgtctctgcctctttgtctttctgtccttcaccaccctcctatacatacacacacaaacacacacacacacacacacacacacacacacacacacacacacacacgtggtggtacccagtggtggccagcagaaatgttcacg

SEQ ID NO: 950 - DNA, 402 bp, Homo sapiens
  chr1.fa.O7frz.107774387
  Located on chromosome 1
  Distance between a terminus base of telomere on chromosomal short arm and 5'-terminus of this base sequence : 100194138
  Distance between 3'-terminus of neighbour sequence of sequence listing upward to telomere on chrosomal short arm and 5'-terminus of this base sequence : 91811
atccaaggaaatctagactgagaagcacaatcccaccctcaggaggtaacagtcaagatgccaacaggagaattcgttgcctgatcagtcagcacacacacacacacacacacacacacacacacacacacaccacacacgcgcgcgcgcacagcaatcatttaaacttacttgccccagattttaaatttatatatgacataaaaatactgtgacagcgaaggtctacctacagcaaaatccctaaagatgacccacaatagtcatcttcatcatagtcataatcatcacagtcaatcttgtgaaataatctcactactcttaaaagaaacaatgagcttacatttcatgtaatcattggattctgggtacaattttgatatgcagatgctaaatactcct

SEQ ID NO: 951 - DNA, 466 bp, Homo sapiens
  chr1.fa.O7frz.107772396
  Located on chromosome 1
  Distance between a terminus base of telomere on chromosomal short arm and 5'-terminus of this base sequence : 100196022
  Distance between 3'-terminus of neighbour sequence of sequence listing upward to telomere on chrosomal short arm and 5'-terminus of this base sequence : 1482
gacttgtctacagactgaaatcagctctccaattgctctttcaggaggttctccaaggtcaacaaaacctgagattacaaataaaaaattaatttaagaaatcaaataacaagtattgctggggtcaggacagagtcttcctttgacagtcaggtctagatgcagggcaaattccatgcaaagcagcctgtctgtaccattaatcgtgtgtgtgtgtgtgtgtgtgtgtgtgtgtgtgtgtgtgtgtgtgatgtggtatgagagagagggaagcaagagggagcttggatttaaaaagagggaaatttcaatttacttgaaaattgtactatcaatgaggcactttttaaaatatgatgacatttgcaagtttggaagagtagaaagaatggacatgcagtcctggagaatggaaaaccaggagacttcagattcatttccagtttaacaatacaaacgctgtact

SEQ ID NO: 952 - DNA, 241 bp, Homo sapiens
  D1S2664
  Located on chromosome 1
  Distance between a terminus base of telomere on chromosomal short arm and 5'-terminus of this base sequence : 100327692
  Distance between 3'-terminus of neighbour sequence of sequence listing upward to telomere on chrosomal short arm and 5'-terminus of this base sequence : 131204
ttcatgctatgattttccgctggactgtctctaaaaattgatagtggccttggaaagtcagtgtgtgcgtgtgtgtgtgtgtgtgtgtgtgtgtgtgtatgtgtgtccaattttttttaatttttagaaaaataaagaagcatatttacatctcacactgtgggacaacctttggtgaccagaattggtgttcaggtctaccctggatgactctgcagactcagtgttattctgtgggctg

SEQ ID NO: 953 - DNA, 301 bp, Homo sapiens
  AL109756.9_40196
  Located on chromosome 1
  Distance between a terminus base of telomere on chromosomal short arm and 5'-terminus of this base sequence : 100384499
  Distance between 3'-terminus of neighbour sequence of sequence listing upward to telomere on chrosomal short arm and 5'-terminus of this base sequence : 56566
agtaatatccatttccaaacctttggtaaactgtaaaggcccttataaacgtaaggttttactatcataagtactatgaaattcagaataacatcacacacacacacacacacacacacacacacacacaccccagagctacagccaaatgtgcaaaccataggaatgggagggggagattggttcttctcagctttttgacaggaaggcaaatttttttccctaaaataaacttagtttgagataggattgaaaagatttggcaaatgcaaatacccactggtaaccaggagtgaattat

SEQ ID NO: 954 - DNA, 280 bp, Homo sapiens
  AL139014.6_89158
  Located on chromosome 1
  Distance between a terminus base of telomere on chromosomal short arm and 5'-terminus of this base sequence : 100480860
  Distance between 3'-terminus of neighbour sequence of sequence listing upward to telomere on chrosomal short arm and 5'-terminus of this base sequence : 96060
ggagatttcttaaagaactaaacagtagatctgccatttgatccagcaatcccactactgggtatctacccagaggaaaataagtcattctacaaaaaagatacttgcacatgtatgtttatagcagcacagtttgcaattgcaaaaatatggaaccagcccaaatgccatatatatatatatatatatatatatgatggaatactacttagccataaaaagaaatgaattaatgacattcacagtaacctggatggaactggagaccagtattctaagt

SEQ ID NO: 955 - DNA, 289 bp, Homo sapiens
  AL139014.6_42098
  Located on chromosome 1
  Distance between a terminus base of telomere on chromosomal short arm and 5'-terminus of this base sequence : 100527870
  Distance between 3'-terminus of neighbour sequence of sequence listing upward to telomere on chrosomal short arm and 5'-terminus of this base sequence : 46730
gtggaaaatgagcaataacagaaagatttttctggagataattaggcatgcattggaagagaggaaagggggaaggaagaaataatggaaaggaaaagaagggagaaggggattaagaagaaagtgtgtacatgtgagaaaatagtaacttgaggtccattggtgtatggagttttttgtttggcttttatgtttttgtttgggtgtgtgtgtgtgtgtgtgtgtgtgtgtgtgtgctgtgtgtgtaaaacagagaagaaaaggaaggagcaagaatagtatggtttcc

SEQ ID NO: 956 - DNA, 288 bp, Homo sapiens
  AL139014.6_34803
  Located on chromosome 1
  Distance between a terminus base of telomere on chromosomal short arm and 5'-terminus of this base sequence : 100535229
  Distance between 3'-terminus of neighbour sequence of sequence listing upward to telomere on chrosomal short arm and 5'-terminus of this base sequence : 7070
gaataaattccacttgatcatagtgtgttatcttcttgatgtgttgttggatttgctttgctagtattttcttgagaattattgcatctgtattcatcagggatgttattagcctgtagttctctctctgtctctctctctctctctctttctctctctctctctctctctctctctgttatgtccatatatgacttttgcatcagggttatgctggcctcacagaatgagttatcaaaaagaattccctttgctttaatttttttgaatagtttgaaagaattgtta

SEQ ID NO: 957 - DNA, 247 bp, Homo sapiens
  AL139014.6_19054
  Located on chromosome 1
  Distance between a terminus base of telomere on chromosomal short arm and 5'-terminus of this base sequence : 100551025
  Distance between 3'-terminus of neighbour sequence of sequence listing upward to telomere on chrosomal short arm and 5'-terminus of this base sequence : 15508
gcctatcagctcactctgtagattttgaacttgccagcctccacaaatgcatgagccaattctttgaaataaatctctctctctctccctttctgtcacacacacacacacacacacacacacacacacacacacacactggttctgtttctctggagaaccctgactaatacaaaagggatggaaggaataaagcaacataaccaagtgatctgaagaaattgaaacctacgatccaggttactta

SEQ ID NO: 958 - DNA, 354 bp, Homo sapiens
  chr1.fa.O7frz.107217390
  Located on chromosome 1
  Distance between a terminus base of telomere on chromosomal short arm and 5'-terminus of this base sequence : 100666272
  Distance between 3'-terminus of neighbour sequence of sequence listing upward to telomere on chrosomal short arm and 5'-terminus of this base sequence : 115000
tcacctactgaaatcaattcaccagagaaaagccaagtcattgactgcactagcaataaccccacttcattcccttccaaccaggatatcgtaataagaatcaatctcccacagggccccttccatcagaattcatatgtctataatgaattctttcctcattctttgtgtgtgtgtgtgtgtgtgtgtgtgtgtgtgtgtgtgtgtacttggtaaaaatattgatattacaattcttctctatgagactccattaactttactgctcttttacttctttttaattcaacatatgtttattgggtattaaaattttaatttgtggtcttttagcctaggtttaatattaaccaa

SEQ ID NO: 959 - DNA, 259 bp, Homo sapiens
  DISD22_0000586
  Located on chromosome 1
  Distance between a terminus base of telomere on chromosomal short arm and 5'-terminus of this base sequence : 100803978
  Distance between 3'-terminus of neighbour sequence of sequence listing upward to telomere on chrosomal short arm and 5'-terminus of this base sequence : 137352
tgatccagatcaagaaagatagagagtgagaaaaagagagagtcagagagagagagagagagagagagagagggagagagaagaaagaaagaaagaaagaaagaaagaaagaaagaaaaaagaagaaagaaagaaggaaagaaagaaagaaagaagaaagaaagaaagaaagaaagaaagaaagaaagaaagaaagaaagaaagaaagaaagaaagaaagaaagaaaaagaaattcaccccggtgagaatctcatatga

SEQ ID NO: 960 - DNA, 326 bp, Homo sapiens
  chr1.fa.O7frz.108079770
  Located on chromosome 1
  Distance between a terminus base of telomere on chromosomal short arm and 5'-terminus of this base sequence : 100958932
  Distance between 3'-terminus of neighbour sequence of sequence listing upward to telomere on chrosomal short arm and 5'-terminus of this base sequence : 154695
tgtctgtaagaacgcatgtaccacagaaaggggtttcgttgttctctgctttctctccagtgtatacaaacatacttggtatgtttctgttgaatggatgaatccaagatttatgtgtgccaaatgcgatgctaggcaatagggaagagtgagatatctatatatatatctatatctatctatcatccatctatctatctatcatctatctatctatctatctatctatctatctatctatctatccatctatctgtttttctatctatagtttgccatcaaggagctcatattctagtaatgaggatgtataacaaggagcttat

SEQ ID NO: 961 - DNA, 393 bp, Homo sapiens
  chr1.fa.O7frz.108177472
  Located on chromosome 1
  Distance between a terminus base of telomere on chromosomal short arm and 5'-terminus of this base sequence : 101171356
  Distance between 3'-terminus of neighbour sequence of sequence listing upward to telomere on chrosomal short arm and 5'-terminus of this base sequence : 212098
cttaaaacctagatgacaggtttataggtgcagcaaaccaccatggcacatgtatacctgtgttaacaaacctgcatattctgcacatgtatcccagaacttaaagtataatgaaaaaaagaagaagaaagaaagaaagaaagaaagaaagaaagaaagagaaagaaagaaagagagaaggaaggaaggaaggaaaggagagacagagaaagaaagaaagaaagaaagaaagaaagaaagaaagaaagaaagaaagaaagatagaaagaaagaaagaaggaaacaaagaaaaagaaaggaaggaaggaaggaagcaagggaaggaaggaaaggaaggaaaggcctgagactggataacttacaaaggaaagaagtttaattgactcacagttc

SEQ ID NO: 962 - DNA, 330 bp, Homo sapiens
  AL138780.3_26460
  Located on chromosome 1
  Distance between a terminus base of telomere on chromosomal short arm and 5'-terminus of this base sequence : 101304169
  Distance between 3'-terminus of neighbour sequence of sequence listing upward to telomere on chrosomal short arm and 5'-terminus of this base sequence : 132420
cttaattctcagccacagaataatttgcatgtattatacacacacacacacacacacacacacacacacacacaaaactgaaaattatcaatactttatattttaaggaaagctgaaaattatcaagacttatttatatattcaaagtaaaatgagtaataatgggatcaggtgaggtttactgtggcctgtagcacctagtttatttttatgtatttttaaatatctgcaagttttgccccatcatctaaaacaaacattttgccaattcctagtgcttgaaatcaatagccacatagttcatttctatttctatgtgctgatagcact

SEQ ID NO: 963 - DNA, 274 bp, Homo sapiens
  D1S2719
  Located on chromosome 1
  Distance between a terminus base of telomere on chromosomal short arm and 5'-terminus of this base sequence : 101338448
  Distance between 3'-terminus of neighbour sequence of sequence listing upward to telomere on chrosomal short arm and 5'-terminus of this base sequence : 33949
catgcttttgttggcttattactgtgtgtgtgtgtgtgtgtgtgtgtttcttttgttgttgtttaattgtgaatttatgttttgcataatttatttatgagactcttgcaagatttgggttttgaatttatctgggttctcttaaaagagatttgttctttgctttcatcaggcttgccagagtgttatgaacaaaattatgttaattattttaacttgaatttcccaaacaatttgtcatagtgttttatttgaatccagaagtggttaaggg

SEQ ID NO: 964 - DNA, 240 bp, Homo sapiens
  AL138780.3_63013
  Located on chromosome 1
  Distance between a terminus base of telomere on chromosomal short arm and 5'-terminus of this base sequence : 101340634
  Distance between 3'-terminus of neighbour sequence of sequence listing upward to telomere on chrosomal short arm and 5'-terminus of this base sequence : 1912
tcatagcctggaatgtcacttcccacatcttaccttatgtcctgcatggagagacagaaatgtgtgaatttttaaaatgtccccctagctactgctgagtgatgcgtgctcacctcatcccccaccacacacacacacacacacacacaaacacacacatacacacacgtacaccgattattggtccagctgaacattttctcccatggtgagatgctggtcttaccatgcaaacaggtc

SEQ ID NO: 965 - DNA, 431 bp, Homo sapiens
  AL136325.6_41342
  Located on chromosome 1
  Distance between a terminus base of telomere on chromosomal short arm and 5'-terminus of this base sequence : 101449735
  Distance between 3'-terminus of neighbour sequence of sequence listing upward to telomere on chrosomal short arm and 5'-terminus of this base sequence : 108861
atactcactggacctaatccacccaggatttaacagccagaaaagaaatgttggttatggcatgaattccataaacttttatgtaatttacacacaaaaacaaagcagcacatatgtgtatgtctgtatacatatgtaaacatgtctatacataatccacacacacaaatatgtgtatgtttctatgcatttcatgtatatatgcatgtaggtttgtctgtgtgtgtgtgtctgtgtgtgtgtgtgtgtgtgtgtgtgtgtgcatgtgtttaaatattccgaagctttgggccagttggccatgcattcagtttctcttggaaaagatttgcttcatatctaatagaaatatacaatctggttaaatgttgctggtaaaatgtctaacacatgggtggattgagattgtgaacaagtggagaatactaaag

SEQ ID NO: 966 - DNA, 342 bp, Homo sapiens
  AL136325.6_98130
  Located on chromosome 1
  Distance between a terminus base of telomere on chromosomal short arm and 5'-terminus of this base sequence : 101506668
  Distance between 3'-terminus of neighbour sequence of sequence listing upward to telomere on chrosomal short arm and 5'-terminus of this base sequence : 56502
gtcagtccaagataaatcttcagtccttagggaaagccctggggtagatgatgtgggctgccaaccaagttggattttgtgtgtgtatgtgtgtgtgtgtgtgtgtgtgtagcagggggagcagttgtttgttctttttgtttgtttgttaaagtgtggaagcagggactgtaggaacttggggagaaagaatgttagagtagcttcaacaaggcaaagcttctatctaaaattgcacattaatttccatgaaactcttcattcgtgaaaaggcaaagatctaaaactttttctcctttctagcacatgacaggatttttgtcgtgactttcctaaattctc

SEQ ID NO: 967 - DNA, 196 bp, Homo sapiens
  D1S2793
  Located on chromosome 1
  Distance between a terminus base of telomere on chromosomal short arm and 5'-terminus of this base sequence : 101614028
  Distance between 3'-terminus of neighbour sequence of sequence listing upward to telomere on chrosomal short arm and 5'-terminus of this base sequence : 107018
tgtattagtcaagtttcaccagagaaacagaaacaatcggatgataaggtgtgcacgtgtgtgtgtgtgtgtgtgtgtgtgatttataataaagaaatggctcatgagattatggaggctgagcagtcccactatctgtaccctatgagccgggtactcaggaaagccagtggggtacttctgggaactgaagggc

SEQ ID NO: 968 - DNA, 120 bp, Homo sapiens
  DISO7_10000678
  Located on chromosome 1
  Distance between a terminus base of telomere on chromosomal short arm and 5'-terminus of this base sequence : 101811783
  Distance between 3'-terminus of neighbour sequence of sequence listing upward to telomere on chrosomal short arm and 5'-terminus of this base sequence : 197559
accagaatctcgactctgcctaaaaggaatgtatgtgtgttcatatatgtgtgtgtgtgtgtgtgtgtgtgtgtgtgtgtgtgtgtgtatgtataaaatagttacagtctgcttcagcca

SEQ ID NO: 969 - DNA, 136 bp, Homo sapiens
  DISO7_10000676
  Located on chromosome 1
  Distance between a terminus base of telomere on chromosomal short arm and 5'-terminus of this base sequence : 101869722
  Distance between 3'-terminus of neighbour sequence of sequence listing upward to telomere on chrosomal short arm and 5'-terminus of this base sequence : 57819
tcctagttgttccgtgatctcagaatacacacacacacacacacacacacacacacacaggtttttattagttttgtgaaagttaattatattacagatctggatatttaaatattaggattcctggatgttcaag

SEQ ID NO: 970 - DNA, 407 bp, Homo sapiens
  chr1.fa.O7frz.109234525
  Located on chromosome 1
  Distance between a terminus base of telomere on chromosomal short arm and 5'-terminus of this base sequence : 101901107
  Distance between 3'-terminus of neighbour sequence of sequence listing upward to telomere on chrosomal short arm and 5'-terminus of this base sequence : 31249
tgagtctgttaagaactcactatcttttccatttgtatatcatatataagtataatacagtatgatacatgtataatgttcacatatatgtgtgtgtgtgtgtgtgtgtgtgtatatatatatttatatatatatatatagtcatattagacttttaaaaataacactgggcaccacagtagactccttttgtacccagtgtcatatcccctcttacaatctctgatttcagctacagccatgatgcacagttccatgggaactgaaactctcattgtgttggcagctttcctgcaaaacctgtaggttctgaagtcagggagaagttaccagctttggggcaaccctcaacccgtgataggggtggtggggggtggaaatcagtggataaatgctcatatgtattt

SEQ ID NO: 971 - DNA, 445 bp, Homo sapiens
  chr1.fa.O7frz.109354037
  Located on chromosome 1
  Distance between a terminus base of telomere on chromosomal short arm and 5'-terminus of this base sequence : 102001967
  Distance between 3'-terminus of neighbour sequence of sequence listing upward to telomere on chrosomal short arm and 5'-terminus of this base sequence : 100453
catatgatctgccatcaattacccaacagtaatgaaaacttctatgtttttacaaggtagagacacaataaaactaactggaggttggcaaggctgccacttcagcttcttttcatattacctgtccctgcatacccctgactcctttcctgtgcccttctttcaagcttatatatatatatatatatatatatatgtatgtattttttttccttttcatctcttaaagctttttccctcatttattttattgggaaaagcatagtgttgtatatcaaagcaccttggactcagactaaccagaaattgaaatcccatctctatacttgctgcatacacttggaaaagttactcaccatttctctgcctttgtctcctcatttctaaattggtgcaaatatgaaaaataaatgagactgtacttataaagcactgagtctagtgc

SEQ ID NO: 972 - DNA, 243 bp, Homo sapiens
  AL354884.11_83479
  Located on chromosome 1
  Distance between a terminus base of telomere on chromosomal short arm and 5'-terminus of this base sequence : 102201495
  Distance between 3'-terminus of neighbour sequence of sequence listing upward to telomere on chrosomal short arm and 5'-terminus of this base sequence : 199083
ttgatagacacttaaggttgcttccatatcttggctattgtgaataatactgcacagaatatgggagtacagatctatctaactatctgtctgtctgtctatctatctatctatctatctatctatctatctatctatctatctatctatctgtctatcatctatctatatgtagtgctgatttcatttcctttggggatttacccagaagaaggatcgctaggtcacatcgtagttctgttt

SEQ ID NO: 973 - DNA, 402 bp, Homo sapiens
  AL354884.11_55070
  Located on chromosome 1
  Distance between a terminus base of telomere on chromosomal short arm and 5'-terminus of this base sequence : 102271376
  Distance between 3'-terminus of neighbour sequence of sequence listing upward to telomere on chrosomal short arm and 5'-terminus of this base sequence : 69638
gtttctagtggtccactggagacagagatttgtttgtttgtttgtttgtttgtttgtttacttgagatggagtctggctctgtaactcaggctggagtgcagtggtgcgatcttgggtcaccgcaacctccgcctccggagttcgagcgattctcctgcctcagcctccgagtagctgggacaacaggtgtgcatgaccatgcctggctaatttttgtatttttagtagagatggggtttcaccatgttggccaagctggtctcaaactcctcaccttaggtgatccgcccacctcagcctcccaaggtgttaggattacaggcgtgagacagaaatttatttttatagaagtgtactagagatactccagatatcaaaactagtggaaggctgtaattgag

SEQ ID NO: 974 - DNA, 102 bp, Homo sapiens
  DISD22_0000595
  Located on chromosome 1
  Distance between a terminus base of telomere on chromosomal short arm and 5'-terminus of this base sequence : 102429203
  Distance between 3'-terminus of neighbour sequence of sequence listing upward to telomere on chrosomal short arm and 5'-terminus of this base sequence : 157425
tgcagaactcattacctctcagaaaattttaggggtgtgtgtgtgtgtgtgtgtgtgtgtgtgtgtgtgtgtgtctgtgtgtttcctatctaggccatggga

SEQ ID NO: 975 - DNA, 425 bp, Homo sapiens
  chr1.fa.O7frz.110071383
  Located on chromosome 1
  Distance between a terminus base of telomere on chromosomal short arm and 5'-terminus of this base sequence : 102518562
  Distance between 3'-terminus of neighbour sequence of sequence listing upward to telomere on chrosomal short arm and 5'-terminus of this base sequence : 89257
gtgagcctcatctaatcagttaaaggactgaataaaacaaaatgctagctctaccctgaaaaacacataattcttcctgtctgactacctttgaaatgaaacattggctttctcccctactcttggactagaactaaaactaaaacttaactggttctcaggccttccaactgagacttgaactaaaacattggctcttctgtgtctccagctggcagactcaaattgcagatcttggaaatttgcaggttcttaattgtgtaccagtttcctataataaatctcatacacacacacacacacacacacacacacacacacacacacacacacacacacacacacccccccccccccccacatacatcctattctttctgtgtctctggagaacttttgactccttgactaatgcagtgaacatt

SEQ ID NO: 976 - DNA, 278 bp, Homo sapiens
  D1S497
  Located on chromosome 1
  Distance between a terminus base of telomere on chromosomal short arm and 5'-terminus of this base sequence : 102775341
  Distance between 3'-terminus of neighbour sequence of sequence listing upward to telomere on chrosomal short arm and 5'-terminus of this base sequence : 256354
agctcttggagagactggcctaaaacacacacacacacacgcgcgcgcgcacacacacacacacgcacactcttaattacccagggcaattacttactcttcccactagatgctcttggagagactggcctaaaacacacacacactctctctctctctctctctctctctctctctctctctctctctctctctctaattacccagggcaattacttactcttcccactagatggctcttggagagactggcctaaaatcagcaatcttccagagct

SEQ ID NO: 977 - DNA, 260 bp, Homo sapiens
  AL160056.5_94830
  Located on chromosome 1
  Distance between a terminus base of telomere on chromosomal short arm and 5'-terminus of this base sequence : 103010891
  Distance between 3'-terminus of neighbour sequence of sequence listing upward to telomere on chrosomal short arm and 5'-terminus of this base sequence : 235272
aacatggacatcacgtttaaacacctgaacagtctcttcatgggcggaaggtgggaattcagatcagatgaactttgcatatacttagtttctcttttttcatatctcacagtctctgctttcttctgccttcttcttcttctttcctcctcctcctcctcctccttcttcttcttccttctcctcctccttatctctctctgtgtgtgtgtgtgtgtgtgtgtgtgcatgtgcgtgtgcttatttaccaaaaggaaact

SEQ ID NO: 978 - DNA, 268 bp, Homo sapiens
  AL160056.5_27509
  Located on chromosome 1
  Distance between a terminus base of telomere on chromosomal short arm and 5'-terminus of this base sequence : 103029322
  Distance between 3'-terminus of neighbour sequence of sequence listing upward to telomere on chrosomal short arm and 5'-terminus of this base sequence : 18171
tgtgatcataccactgcactacagcctaggcaacagagtaagacctggtggaaagaaagaagaaagagaaagaaggaaagaaagaaagaaagaaagaaggaaagaaagaaagaaagaaagaaagaaagaaagaaagaaagaaagaaagacagacaaagaaagaaagaaagaaagagagagagaaaggaaggaaggaaggaaagaaggaaggaaggaaggaaggaaagaaaagagagagagaagggaaggaaaggtaatttaactttgg

SEQ ID NO: 979 - DNA, 148 bp, Homo sapiens
  D1S2739
  Located on chromosome 1
  Distance between a terminus base of telomere on chromosomal short arm and 5'-terminus of this base sequence : 103111724
  Distance between 3'-terminus of neighbour sequence of sequence listing upward to telomere on chrosomal short arm and 5'-terminus of this base sequence : 82134
aaatcaactgacaggtccaagtttgtggtaagaagttgccaagaagcatttactgtactctcagggaaattgtgtgtgtgtgtgtgtgtgtgtgtgtgtgtgtgtgtatatgtgtgtccatgtgtgtattagtttattttcatgctgc

SEQ ID NO: 980 - DNA, 280 bp, Homo sapiens
  AL137794.5_48745
  Located on chromosome 1
  Distance between a terminus base of telomere on chromosomal short arm and 5'-terminus of this base sequence : 103194653
  Distance between 3'-terminus of neighbour sequence of sequence listing upward to telomere on chrosomal short arm and 5'-terminus of this base sequence : 82781
gaggtcaggagatcgagaccatcctggctaacacggtgaaaccccttctctactaaaaatacaaaaaattagctggcagtggtggctggtgcctgtactctcagctactcaggaggctgaggcaggagaatggcgtgaacctgggaggcagagcttgcagtgagccgagattgcaccactgcattccagcctgggctacagagcaagactccgtctcaaataaataaataaataaataaataaataaataaatatataaataaccattcaaggtctagga

SEQ ID NO: 981 - DNA, 235 bp, Homo sapiens
  AL137794.5_112239
  Located on chromosome 1
  Distance between a terminus base of telomere on chromosomal short arm and 5'-terminus of this base sequence : 103258209
  Distance between 3'-terminus of neighbour sequence of sequence listing upward to telomere on chrosomal short arm and 5'-terminus of this base sequence : 63276
atatccatcagaattaactgacagggattccaccttggaaagggtctattaagcttgatgattttgtttttaatggtatcctcttttattatataatagaaaatagcatttttaaaagttttcataatcttcaatatgcttacacacacacacacagagagagagagagagagagagagagaaagagagacagaatctgctttaaaatgtgattattccacaaataaggagtcag

SEQ ID NO: 982 - DNA, 153 bp, Homo sapiens
  D1S1587
  Located on chromosome 1
  Distance between a terminus base of telomere on chromosomal short arm and 5'-terminus of this base sequence : 103414095
  Distance between 3'-terminus of neighbour sequence of sequence listing upward to telomere on chrosomal short arm and 5'-terminus of this base sequence : 155651
ttgcttgaacccagaggacggaggttgcagtgagccgagatcatgccactgcactccagcctgggcgacagagcaagactctgtctcaaaaataataataataataataataataataataatacttattgagcactaccatggggagacttg

SEQ ID NO: 983 - DNA, 212 bp, Homo sapiens
  D1S2753
  Located on chromosome 1
  Distance between a terminus base of telomere on chromosomal short arm and 5'-terminus of this base sequence : 103424980
  Distance between 3'-terminus of neighbour sequence of sequence listing upward to telomere on chrosomal short arm and 5'-terminus of this base sequence : 10732
acagtacgctccatcacggccaccaccactcccactccatttgcatttgaaaacctctggaaacataagcgctttcaggatgaactctctctctctctctcactctctctctctctcactgtctctctctctctctctctctctctctctctcacacacacacacacacacacagcccgccaagtggaaactgagttgagtcataggatgca

SEQ ID NO: 984 - DNA, 205 bp, Homo sapiens
  D1S420
  Located on chromosome 1
  Distance between a terminus base of telomere on chromosomal short arm and 5'-terminus of this base sequence : 103446418
  Distance between 3'-terminus of neighbour sequence of sequence listing upward to telomere on chrosomal short arm and 5'-terminus of this base sequence : 21226
agcttaattttataaaaggcatacaatattgaataagacctttagatcatttgtgtgtgtgtgtgtgtgtgtgtgtgtgtgtgtgtgtgtgtatgtgttattgtctcatggattattattaaagttttctcattcatctatgacacaaataatttttaaattcccgtggaagggaattgccctgacaaaactatttgagcactta

SEQ ID NO: 985 - DNA, 325 bp, Homo sapiens
  Z23492.1_259
  Located on chromosome 1
  Distance between a terminus base of telomere on chromosomal short arm and 5'-terminus of this base sequence : 103446434
  Distance between 3'-terminus of neighbour sequence of sequence listing upward to telomere on chrosomal short arm and 5'-terminus of this base sequence : -189
aggcatacaatattgaataagacctttagatcatttgtgtgtgtgtgtgtgtgtgtgtgtgtgtgtgtgtgtgtgtatgtgttattgtctcatggattattattaaagttttctcattcatctatgacacaaataatttttaaattcccgtggaagggaattgccctgacaaaactatttgagcacttatacaatgttctagtattacagtagcataaaataagtttcctaatatctgtattggaactgtatttaataaaaatgtacttagaacataggtgattatataatagtaaaaatgaatgttactggttaagcaattaga

SEQ ID NO: 986 - DNA, 313 bp, Homo sapiens
  G09907
  Located on chromosome 1
  Distance between a terminus base of telomere on chromosomal short arm and 5'-terminus of this base sequence : 103518036
  Distance between 3'-terminus of neighbour sequence of sequence listing upward to telomere on chrosomal short arm and 5'-terminus of this base sequence : 71277
aggtatctcatgaatgcaccagaaaccgagttaagcataagcaaaatcttattcaggaggctgaagtaggaagattgcttgaggctaggagttcaagaccaacctgggcaacgtagcaaaaccctgtttctctttctctctctctctgtagatagatagatagatagatagatagatagatagatagatagatagatagatacagatagatagatagataggtatagatagatagattgatagatagatagatagatagatagataaagataatttttttaaaattttaagttgtaagccaaaatttgaaact

SEQ ID NO: 987 - DNA, 278 bp, Homo sapiens
  chr1.fa.O7frz.110775247
  Located on chromosome 1
  Distance between a terminus base of telomere on chromosomal short arm and 5'-terminus of this base sequence : 103587356
  Distance between 3'-terminus of neighbour sequence of sequence listing upward to telomere on chrosomal short arm and 5'-terminus of this base sequence : 69007
tacctatgtaacaaacctgcacgttctccacatgtaccctagaacttaaagtgtaatgaagaaagaaagaaggagaggaaggaaggaaggaaggaaggaaggaaggaaggaaggaaaagaaagaaaggaaggaaggaaggaaatagtgtttctgtggtataggtaactctcccttagatgttctaatttagctttagtttagtttaagtggttccgtgctattttctacattgatcaaaattttccaatgtctgctgactatgcatgtatttaacgta

SEQ ID NO: 988 - DNA, 389 bp, Homo sapiens
  AC022907.3_95485
  Located on chromosome 1
  Distance between a terminus base of telomere on chromosomal short arm and 5'-terminus of this base sequence : 103775200
  Distance between 3'-terminus of neighbour sequence of sequence listing upward to telomere on chrosomal short arm and 5'-terminus of this base sequence : 187566
gactggtgaacaaatttatcaccaattattaattgttgaccacctaatgtgccgagcataatcaaaaccacagaagtacttgacattagttatgcagataaggcaaccgggtgctctcttaactaatggtcaagaatgagggctctgaggttacgaattaatcatttattatctgtgttactttaggcaaatttatcagtttttctgagtctcagggtttttatctatctgtgtatctatctatgtatctatgcatctatgtatctgtctatctatctatctatctatctatctatctatctatctatctatcaaaatagtgcattggtttgctagggctgctataacaatagaccataattctggagactagaagtccaagatcaagg

SEQ ID NO: 989 - DNA, 226 bp, Homo sapiens
  D1S2808
  Located on chromosome 1
  Distance between a terminus base of telomere on chromosomal short arm and 5'-terminus of this base sequence : 103793657
  Distance between 3'-terminus of neighbour sequence of sequence listing upward to telomere on chrosomal short arm and 5'-terminus of this base sequence : 18068
agttcctgcccacaaaggggtcacggagatttcctgcttcagttaagagttttaccttcacccatatttgacattttccagtcactgtgaatttggctgttatatagtctgtgtgttttcatccaattcgatggtgctgtttatttaaacacacacacacacacacacacacataagatattctctaaattgtgtaataatgtgcctgcattttactggagatggc

SEQ ID NO: 990 - DNA, 293 bp, Homo sapiens
  chr1.fa.O7frz.111199844
  Located on chromosome 1
  Distance between a terminus base of telomere on chromosomal short arm and 5'-terminus of this base sequence : 103844075
  Distance between 3'-terminus of neighbour sequence of sequence listing upward to telomere on chrosomal short arm and 5'-terminus of this base sequence : 50192
tcctatctccaaataaggtcacattctgaggtacctgagattggggcttcatcatatgatttgtgtgtgtgtgtgtgtctgtgcatgtgtgtgtgtgtgtgtggaggagacacaattcaaacataacagatagttactcatttacttattaaacacataaccacgaaatacctgctggatgcaaggcactgttttagatgctgggaaagtcagcagtgaacaaaacggataaggttcctgccctaaggacatgttgtgtcattagtgcctgtctagtctaaggtgctgtccac

SEQ ID NO: 991 - DNA, 420 bp, Homo sapiens
  chr1.fa.O7frz.111305362
  Located on chromosome 1
  Distance between a terminus base of telomere on chromosomal short arm and 5'-terminus of this base sequence : 104089658
  Distance between 3'-terminus of neighbour sequence of sequence listing upward to telomere on chrosomal short arm and 5'-terminus of this base sequence : 245290
ctttatagctgtgcaagaacagactagtataccaggcatggtggctcatacctgtaatcctggcactttgagaggccaaggtaggaggattccttgagcccaggacatcaagaccagcctgggcaacataagtgagacttggaaaatgcaagaaagcaagaaaggaaggaaggaaggaaagaaggaaggaaggaaagaaggaaggaaggaagggaggaaggaaggaaggaaggaaggaaagaaggaaggaaggaaggaaggaaggaaaggaaggaaggagaaaagaaaagaaaagagaagaaaagaagagaaaaggaaaaaaaaagtcagaaaggtaagcaagagcaaaataatggagtcttgtaaaccatagtaaagattctggatttattttttctaagttacctggaaatacgatta

SEQ ID NO: 992 - DNA, 464 bp, Homo sapiens
  AC020645.3_48529
  Located on chromosome 1
  Distance between a terminus base of telomere on chromosomal short arm and 5'-terminus of this base sequence : 104154903
  Distance between 3'-terminus of neighbour sequence of sequence listing upward to telomere on chrosomal short arm and 5'-terminus of this base sequence : 64825
gactgccagacaatacatagactcagacaataaaacgccaacactcctgattaaccagtagcttcttgttggtacagagcatgatatagaaacattttctagcatatgagcctcagtttctccacctaagaaatgagatagattctgaatttaaacttactactgacaattcaaactgactactcaaaataaatttagtaaaatttattccctgaatgtaagaaccatgtattatacttctttttgtatgtatgtatgtatgtatgtatgtatgtatgtatgtatgtatgggagagagacagagtcttgctctattacccaggcacaagcaatcctcctgcctcaacctcctgagtaactgggaccacaggcatgcgccaccatgcccaactgtctttgcattttttgtagagatgtagtgttgctctgttgcccaggttggtctcaaacttctgaccttgatc

SEQ ID NO: 993 - DNA, 250 bp, Homo sapiens
  AC020645.3_84089
  Located on chromosome 1
  Distance between a terminus base of telomere on chromosomal short arm and 5'-terminus of this base sequence : 104253093
  Distance between 3'-terminus of neighbour sequence of sequence listing upward to telomere on chrosomal short arm and 5'-terminus of this base sequence : 97726
gtccagaagcaatgatctagtaaatttcagttccttgatactacttgggactcctgatagtcgatttcctgagaaaggaatgcaggaaattatcatctccattgctatcatctttatctatctatctatatttctatctatctatctatctatctatctatctatccagataagacaaatatgtttctcaacctttaagactgaatgggtcacaatgagataccatctcatatcagtcatagtggctatt

SEQ ID NO: 994 - DNA, 151 bp, Homo sapiens
  G07830
  Located on chromosome 1
  Distance between a terminus base of telomere on chromosomal short arm and 5'-terminus of this base sequence : 104253155
  Distance between 3'-terminus of neighbour sequence of sequence listing upward to telomere on chrosomal short arm and 5'-terminus of this base sequence : -188
gatttcctgagaaaggaatgcaggaaattatcatctccattgctatcatctttatctatctatctatatttctatctatctatctatctatctatctatctatccagataagacaaatatgtttctcaacctttaagactgaatgggtcac

SEQ ID NO: 995 - DNA, 367 bp, Homo sapiens
  AL139425.4_57254
  Located on chromosome 1
  Distance between a terminus base of telomere on chromosomal short arm and 5'-terminus of this base sequence : 104304149
  Distance between 3'-terminus of neighbour sequence of sequence listing upward to telomere on chrosomal short arm and 5'-terminus of this base sequence : 50843
acaaatttagcacctgaatgtaactgtgatccaactaatactgacttctttaacactactcttttttcaagcctggtccccctctaagggaaatatcctcagcataaggaaactgagattgtccatttcattttgtcatgcatgcatgcattcatgcattttacatttattcaatatctattccgtgccagggattatactgaacattgtaacactgagaaatgagatgtattcttttttttattattattattattattatactttaagttttagggtacatgtgcacaatgtgcaagttagttacatatgtatacatgtgtcatgctggtgtgctgcacccattaactcgtcatttagcattagg

SEQ ID NO: 996 - DNA, 309 bp, Homo sapiens
  AL139425.4_74415
  Located on chromosome 1
  Distance between a terminus base of telomere on chromosomal short arm and 5'-terminus of this base sequence : 104321397
  Distance between 3'-terminus of neighbour sequence of sequence listing upward to telomere on chrosomal short arm and 5'-terminus of this base sequence : 16881
taggatgcatgaaaataagctaacctgagaataagaattcttgaaattaaaaatatgataaaaatatgataaaatttttaatcaaagatttaaaaggcaaaagcaagcaaatctggaaattagaggaaaaggacaaatgagcaatagagctgaaaggaaggaaggaaggaaggaaggaaggaaggaaggaagggaggaaaagaagaaatgaggaaaaagaaaatgagaatagtaatcctagaagtccaatagaaagggaaaagtattgaataatacaagaatttttttttcagactgaaggacctaaca

SEQ ID NO: 997 - DNA, 270 bp, Homo sapiens
  D1S1658
  Located on chromosome 1
  Distance between a terminus base of telomere on chromosomal short arm and 5'-terminus of this base sequence : 104377566
  Distance between 3'-terminus of neighbour sequence of sequence listing upward to telomere on chrosomal short arm and 5'-terminus of this base sequence : 55860
tgcgtcgagactgcaatataaagacctacctgctaacttgccccacagatttcagtcttgccagctcccacaattaaacaatcacatgagccaattccttaaaatagatggtagatagatagatagatgatagatagatagatagatagatagatagatagatagatagataatagatagatagatagatagatagatagatagatagatagatagatgatagatagataattgtgtttttctggagcactctaattaaatagacatggc

SEQ ID NO: 998 - DNA, 225 bp, Homo sapiens
  AL139425.4_130845
  Located on chromosome 1
  Distance between a terminus base of telomere on chromosomal short arm and 5'-terminus of this base sequence : 104377865
  Distance between 3'-terminus of neighbour sequence of sequence listing upward to telomere on chrosomal short arm and 5'-terminus of this base sequence : 29
agtgatccaaacagatcaaagtaggtgtggtgtttctgctaggatagcagatagatagatagatagatagatagatagatagatagatagatagatagacagtatttttctggagaactctgactaattacatagatgtggtagagcttttggtgtccattccagaacatcagtgatccaagcaggttcaaagtaggtgtggtgttcctgctagaatagttcaag

SEQ ID NO: 999 - DNA, 218 bp, Homo sapiens
  D1S2767
  Located on chromosome 1
  Distance between a terminus base of telomere on chromosomal short arm and 5'-terminus of this base sequence : 104505123
  Distance between 3'-terminus of neighbour sequence of sequence listing upward to telomere on chrosomal short arm and 5'-terminus of this base sequence : 127033
agcaccatttaatgcacaggacattgacagctatgtgagttcttgtggaaatggaggccaatagtatcttggcaaaagttcctagaataaaacttggtaccagaggagaggtgctacacacacacacacacacacacacacacacacacacaaaattagaccttttttttcccactcctaaggagacatttgaacattctgttgttgttgagggccaa

SEQ ID NO: 1000 - DNA, 434 bp, Homo sapiens
  chr1.fa.O7frz.112038111
  Located on chromosome 1
  Distance between a terminus base of telomere on chromosomal short arm and 5'-terminus of this base sequence : 104580059
  Distance between 3'-terminus of neighbour sequence of sequence listing upward to telomere on chrosomal short arm and 5'-terminus of this base sequence : 74718
ggaaattggagtaaggaagtagtgaaagggaaaagggaggagggaggctaaggccaaatctgagaatttcttagggagtaggaaggcaggtagccctttctcaccactttctgaaagctgcctcctcctcaactctctctctctctctctctctctctctcacacacacacacacacacacacacacacgcatgcaaaagcttatgcacacacagacatacatattctaaaaggtattagattacaaaagagttgattataataatcctcactgagatgcttggctaatcaaaggagaatgtcaggaaaacaatccttgccctgcccagtaaggcaggagggttgatgaagatgggagaggaggacaaaggagttgaacattgaaggggagcttggaacagcaccagaacgcctgtcagcatattcatatctgg

SEQ ID NO: 1001 - DNA, 399 bp, Homo sapiens
  chr1.fa.O7frz.112236886
  Located on chromosome 1
  Distance between a terminus base of telomere on chromosomal short arm and 5'-terminus of this base sequence : 104710049
  Distance between 3'-terminus of neighbour sequence of sequence listing upward to telomere on chrosomal short arm and 5'-terminus of this base sequence : 129556
ctggtcaacatggtgaaagcccatctctactaaaaatacaaaaattagccaggcgtcgtggtgcactcctgtagtcccagctactcaggaggctgagtcaggagaatcgctcgaacctgggaggcagaggttacagtgagccgagattgcaccactacacttcagcctgggtgacagagcaagactctgtctccaaaaagaaagaaggaaagaaagaaagaaagaaagaaagaaagaaagaaagagagagagagagagagagagagagagagagagagaaagaaagaaagaaagaaagaaagaaagaaagaaagaaagaaagaaagaaagaaagaaagaaagaaagaaagaaagaaacgaacaccctatgaagttgttaacattgaccagatctctaaa

SEQ ID NO: 1002 - DNA, 317 bp, Homo sapiens
  HUMUT1606
  Located on chromosome 1
  Distance between a terminus base of telomere on chromosomal short arm and 5'-terminus of this base sequence : 104875093
  Distance between 3'-terminus of neighbour sequence of sequence listing upward to telomere on chrosomal short arm and 5'-terminus of this base sequence : 164645
attagccaagcatggtggcacacacctgtagtctcagctacttacatggctaaggcaggaggatggcttgggcccagaaagttgaggctgcagtgagcggtgattacgccatcgcactccagcctcagtgacagagtgagactgtgaaagaaagaaagaaggaaagaaagaaagaaagaaagaaggaaagaaagaaagaaagagaaaagaaaagaaaagaaaagaaaagaaaagaaaagaaaagaaaagaaaagaaaaacagataacaagaaagagcaacagagaaaaggtatcaggaccagggatggatttgggtt

SEQ ID NO: 1003 - DNA, 345 bp, Homo sapiens
  AL355993.4_63565
  Located on chromosome 1
  Distance between a terminus base of telomere on chromosomal short arm and 5'-terminus of this base sequence : 105015243
  Distance between 3'-terminus of neighbour sequence of sequence listing upward to telomere on chrosomal short arm and 5'-terminus of this base sequence : 139833
agctgttcagatagcttcatagaccactacaaactgtgtgtggtgggggggtgggtctgagatggagtcttgctctgtcccccagctggagtgcagtggcgcaatctcagctcactgcaatctctgcctcctgggttcaaacgattcttgtacctcagcctcccaagtagctggactacaggtgcatgccaccacaactagctaattttttgtatttgttgttgttgttgttgttgttgttgttgttgttgttttagtagagatgaggcttcgccatgttttggccaggctggacattgtggttttaatttgcatttccctaatggctaatggtatggaatatct

SEQ ID NO: 1004 - DNA, 457 bp, Homo sapiens
  AL356262.4_33212
  Located on chromosome 1
  Distance between a terminus base of telomere on chromosomal short arm and 5'-terminus of this base sequence : 105133922
  Distance between 3'-terminus of neighbour sequence of sequence listing upward to telomere on chrosomal short arm and 5'-terminus of this base sequence : 118334
aaacaatcagtgtggataagaaatattcagcttggtaagttttaaatgttttctaatattattttaaaaatgattatattgttatatttaaagatttctatatatctttaaataaatgagccttgcataaaatctgctattgatccaaatatctggcaatgctcttgtcttttaaaacattttattatttatttatttatttatttatttatttatttatttatttatttatttatttttgacagattctcgctctctcgcccaggctggagtgcagtgtgcaatctcggctcactgcaagctccgcctcccaggttcacgccattctccagtctcagcctcctgagtagctgagactataggcgcccgccaccacgcccggctaattttttgtatttttagtagagatagggtttcactgtgttagacaggatggtctcaatttcttgaccttgtg

SEQ ID NO: 1005 - DNA, 273 bp, Homo sapiens
  chr1.fa.O7frz.112665799
  Located on chromosome 1
  Distance between a terminus base of telomere on chromosomal short arm and 5'-terminus of this base sequence : 105260237
  Distance between 3'-terminus of neighbour sequence of sequence listing upward to telomere on chrosomal short arm and 5'-terminus of this base sequence : 125858
tccttagttctgttaatgactcacacttttgaaggttatatgagactgatactctaaatgcctctcttcaaaacgtaaagtaaaagattcacaaatatctccctgcagtacttcggtttattgtttttacatttataccatgaaatgccaattctacaaggcagcagtgtgtgtgtgtgtgtgtgtgtgtgtgtgtgtatgaccaacagcaataaaatatatttttatatatatgttattatatatatataatatgcaacttctaagtgcact

SEQ ID NO: 1006 - DNA, 247 bp, Homo sapiens
  DISD22_0000601
  Located on chromosome 1
  Distance between a terminus base of telomere on chromosomal short arm and 5'-terminus of this base sequence : 105367451
  Distance between 3'-terminus of neighbour sequence of sequence listing upward to telomere on chrosomal short arm and 5'-terminus of this base sequence : 106941
tcataagtcaaggagcatctgggttgttgttgttgttgttgttgttgttggtagagacagggtcttgctatgttgcccaggctagtctggaactcctggcctcaagcagtcctcccatcttggcctcccaaagtgttgggataacaggcatgagccaccacacctggccacatctgtattttgttttatttgtaactttttgtttgtaactttaaaaaaaaatcctatctgatttacaagacaacca

SEQ ID NO: 1007 - DNA, 124 bp, Homo sapiens
  DISO7_10000679
  Located on chromosome 1
  Distance between a terminus base of telomere on chromosomal short arm and 5'-terminus of this base sequence : 105484934
  Distance between 3'-terminus of neighbour sequence of sequence listing upward to telomere on chrosomal short arm and 5'-terminus of this base sequence : 117236
tagtcctcggctagctgcaaagtgataaagccttaaattattaaccctccaaagggattctgtgtatgtgtgtgtgtgtgtgtgtgtgtctctgtgagagagtgtgagtatatgtttaagaggc

SEQ ID NO: 1008 - DNA, 112 bp, Homo sapiens
  DISO7_10000680
  Located on chromosome 1
  Distance between a terminus base of telomere on chromosomal short arm and 5'-terminus of this base sequence : 105515151
  Distance between 3'-terminus of neighbour sequence of sequence listing upward to telomere on chrosomal short arm and 5'-terminus of this base sequence : 30093
tagctagaggcgaggcagggcacggagatctgaggtttttacgagtgtgtgtgtgtgtgtgtgtgtgtgtgtgtgcgcgcgcgcgcgccctacaagagtttagaagagcatg

SEQ ID NO: 1009 - DNA, 269 bp, Homo sapiens
  chr1.fa.O7frz.112956059
  Located on chromosome 1
  Distance between a terminus base of telomere on chromosomal short arm and 5'-terminus of this base sequence : 105575831
  Distance between 3'-terminus of neighbour sequence of sequence listing upward to telomere on chrosomal short arm and 5'-terminus of this base sequence : 60568
tagtgaggtctgcctacagtagtgagccagaataggagggaagttcccagttactgcagggaaggtgggtgaacttcctgtatgttttatatatatatatatatatatatatattttatatatatatattttatatatatatattttatatatatatattatatatatatatatagtatgtatgcaatggatctgttgattgggtttaagttacttttatttaagctgtaattgtttcagttctgctgtttgtggaagttagtaagcta

SEQ ID NO: 1010 - DNA, 124 bp, Homo sapiens
  DISD22_0000603
  Located on chromosome 1
  Distance between a terminus base of telomere on chromosomal short arm and 5'-terminus of this base sequence : 105656075
  Distance between 3'-terminus of neighbour sequence of sequence listing upward to telomere on chrosomal short arm and 5'-terminus of this base sequence : 79975
ggttgttcttagccctgctgtgtgtgtgtgtgtgtgtgtgtatgtgtgtgtgtgtgtgggtatgtgtgtgtgtgtgaagtcctaggatcagaactatatagcctgattctataactcttcttca

SEQ ID NO: 1011 - DNA, 209 bp, Homo sapiens
  Z67316
  Located on chromosome 1
  Distance between a terminus base of telomere on chromosomal short arm and 5'-terminus of this base sequence : 105795996
  Distance between 3'-terminus of neighbour sequence of sequence listing upward to telomere on chrosomal short arm and 5'-terminus of this base sequence : 139797
gttgtgattttgtcaatgctgcttaactctaatgcaggatgataattgtggctaattgcctaaaagcatatgaactttttttcccatcagtgttatatgtgagagaacacacacacacacacacacacacacccctctttaatatgaatttgatgtcctcacttaaattacatgaaataattcctaaatgcttgaaaatacaaaaccct

SEQ ID NO: 1012 - DNA, 409 bp, Homo sapiens
  AC026040.3_124664
  Located on chromosome 1
  Distance between a terminus base of telomere on chromosomal short arm and 5'-terminus of this base sequence : 105817824
  Distance between 3'-terminus of neighbour sequence of sequence listing upward to telomere on chrosomal short arm and 5'-terminus of this base sequence : 21619
aacatgagatatctttccactgatgtgtcctcttcagtcttctctttttctttttctttctttcttttctttctttctttctttctttctttctttctttctttctttctttctttctttctttctttctttgtttttctttctttctttccttccttctttctttctctctctctctctccttccttccttcctttcttccttccttcttcttttcttttcttttctttcttcctttcttcttttctctctttttcttagatagggtctcactctgtcacccaggctggagtgcaatggcaggatcatggctcactgcagcctagacctcctgggctcaagcaatcccccaacttcaacatgctgagtagctgggactaaaggtgcatgccactacacttgcttaatc

SEQ ID NO: 1013 - DNA, 341 bp, Homo sapiens
  AL157715.5_30447
  Located on chromosome 1
  Distance between a terminus base of telomere on chromosomal short arm and 5'-terminus of this base sequence : 106128484
  Distance between 3'-terminus of neighbour sequence of sequence listing upward to telomere on chrosomal short arm and 5'-terminus of this base sequence : 310251
gagtgatggctcatacctgtactcgcagctacccaagaggctgaggtgggagaaccacatgagcccaggaagtcgaggctgtggtaagctgtgatcacaccactgcacttcagcctgggtgacagagtgagaccctgtctagaaagaaagaaaaaggaaagaaaagaaggaaagaaagagaaagaaagaaagaaagaaagaaagaaggaaagaaagagaaagaaagagggagggaggaaggaaggaagggagggaaagaaagaaagcgagcctttaaagggacgtcacagaaatgagatgggtaaaggaaggcaggcaagtcttagacctggatggtagct

SEQ ID NO: 1014 - DNA, 182 bp, Homo sapiens
  D1S2671
  Located on chromosome 1
  Distance between a terminus base of telomere on chromosomal short arm and 5'-terminus of this base sequence : 106183024
  Distance between 3'-terminus of neighbour sequence of sequence listing upward to telomere on chrosomal short arm and 5'-terminus of this base sequence : 54199
agaagatcaactacccaaagaaatgatccatgaaaaggaggaggttcagaaaggcagaactggcaggataatccaagttacacacacacacacacacacacacacacacacacacacacacacacagagttacgggaagtcagggaccccaaacggagggactgactggagtcgcagcagag

SEQ ID NO: 1015 - DNA, 215 bp, Homo sapiens
  chr1.fa.O7frz.113393165
  Located on chromosome 1
  Distance between a terminus base of telomere on chromosomal short arm and 5'-terminus of this base sequence : 106257221
  Distance between 3'-terminus of neighbour sequence of sequence listing upward to telomere on chrosomal short arm and 5'-terminus of this base sequence : 74015
gatagatggtagatgagcatgactaaaaataaaacaacaatcagcaaacaaaagaaaaacactgaagcatgggaaagaggtaagaatttatagggttgaaagtttcattcactcataaataatttgagtttcattcatttattgaacagatgcagaactagggacacacacacacacacacacacacacacacgaggctgagttaaatgctattt

SEQ ID NO: 1016 - DNA, 457 bp, Homo sapiens
  AL139019.4_59052
  Located on chromosome 1
  Distance between a terminus base of telomere on chromosomal short arm and 5'-terminus of this base sequence : 106297209
  Distance between 3'-terminus of neighbour sequence of sequence listing upward to telomere on chrosomal short arm and 5'-terminus of this base sequence : 39773
gatgagtttgaggtaagtatgcacccatgaaaccatcactatgatttctccaataaacatatccgttcccactgaaagtttcctcctactctcaattctttcttttcttttttcttttcttttcttctttctttccctccctcccttcctcacttcttttcttttttcttttcttttctttcttttctttctttctttctttctttctttctttctttctttctttctttctttctttctttcttcctttctttctttctttctacttttgcagtaagagcacttaacataagatctacactcttggcagatttttaagtatacaatacagtattagctatgggcactatgccatacaaatccctaggacctatttattttgcacaactgaaactttgtaccctttgactaatatttccccttttccaacttcctccaaccactggcaaccactatt

SEQ ID NO: 1017 - DNA, 169 bp, Homo sapiens
  DISO7_10007904
  Located on chromosome 1
  Distance between a terminus base of telomere on chromosomal short arm and 5'-terminus of this base sequence : 106458619
  Distance between 3'-terminus of neighbour sequence of sequence listing upward to telomere on chrosomal short arm and 5'-terminus of this base sequence : 160953
ttccatatactaggaaccacactagatgttttaagttttcacaattggggtgtgtgtgtgtgtgtgtgtgtgtgtgtgtgtgtgtgtgtgatattgcctatcttattaatgaggaaactaaaattcagagtgttaattctgggatttgaccctgactctatctggttcc

SEQ ID NO: 1018 - DNA, 259 bp, Homo sapiens
  D1S223
  Located on chromosome 1
  Distance between a terminus base of telomere on chromosomal short arm and 5'-terminus of this base sequence : 106540017
  Distance between 3'-terminus of neighbour sequence of sequence listing upward to telomere on chrosomal short arm and 5'-terminus of this base sequence : 81229
taacatgagcgaatggacaaatgaaaatccagttatgtatatatagaactggatgtttaaaattatatattcatatatatacacatatgtgtatatatatgaagtatatatgtatttttatataagcgtatatatgtatttatatatataagcatatatatgaactatatatatgaaatacacacacacacacacacacacacacacacacacatatatatatatatatgaagtaatgagaactgtggtgaaaaccttg

SEQ ID NO: 1019 - DNA, 293 bp, Homo sapiens
  AL109741.18_89683
  Located on chromosome 1
  Distance between a terminus base of telomere on chromosomal short arm and 5'-terminus of this base sequence : 106625961
  Distance between 3'-terminus of neighbour sequence of sequence listing upward to telomere on chrosomal short arm and 5'-terminus of this base sequence : 85685
attcgtttacagctgtggatacatccagcactgtgcctgagcagtttctttcttatttatttatttatttatttatttatttatttatttatttattttaaaataaagatgaggtcttgctatgttgcccaggctggcctcaaactcctaggccaagcgaacctcttgcctcagtcttccaagtactggaattacaggtgtgagccattgttctcagcctatggagcagcttctgtgctgttgtgctcccccatgctttgcttactgtggatcatgattacggattatggtta

SEQ ID NO: 1020 - DNA, 204 bp, Homo sapiens
  D1S206
  Located on chromosome 1
  Distance between a terminus base of telomere on chromosomal short arm and 5'-terminus of this base sequence : 106696367
  Distance between 3'-terminus of neighbour sequence of sequence listing upward to telomere on chrosomal short arm and 5'-terminus of this base sequence : 70113
ggaagtaatctctgcccaattgtggaattacgtttacatgtctgtaaactaacatgttggcgaaacctaagtattcatgatcgaacttttaaaaatagaggatgagggaaaacaacaaaaattactccgtctacacacacacacacacacacacacacacacacacacaaattcagtgaatacaaataccagaagaaactttgg

SEQ ID NO: 1021 - DNA, 403 bp, Homo sapiens
  chr1.fa.O7frz.114038069
  Located on chromosome 1
  Distance between a terminus base of telomere on chromosomal short arm and 5'-terminus of this base sequence : 106868047
  Distance between 3'-terminus of neighbour sequence of sequence listing upward to telomere on chrosomal short arm and 5'-terminus of this base sequence : 171476
tagtgcattgtctgacctttatctcttgaattgcaccacttaattgtaacttctattttgccacgagatatatatatatatatatatgatcaaaggctatgaatagcacttgtgagtttttcccaaaggatcacaacaaaagtctaacgtgcagaaatcagaattgtccatgcatttggatctgggcagatgcagactggtagtctgtgccctctgatgctacgtaactctccccacgtcctttttttttccaacgttaaatcattttaaatatggtattcaggattctggctcacccctgggtgcaatccaagttttggacatgctaggccatcagatctgaggaaaatcattcgattgaatggcatgccctgttttcctactgaaagctatgctgataatc

SEQ ID NO: 1022 - DNA, 428 bp, Homo sapiens
  AL390200.6_59989
  Located on chromosome 1
  Distance between a terminus base of telomere on chromosomal short arm and 5'-terminus of this base sequence : 106884554
  Distance between 3'-terminus of neighbour sequence of sequence listing upward to telomere on chrosomal short arm and 5'-terminus of this base sequence : 16104
ctggaataggagttggtctttcctggttaataaaactcttgggggaggggattgatgaccaagttccttggagtattatctctaggctaaggagggtcagaaaaagcctaaccctgcatttgctgcttttcaactgtcttcagcttaaactaatgtaccaaagtagcatattttggggtgacacttcccagactcgtcaatagctagctagctttatttatttatttatttatttatttatttattacagagtcttgctctgttgcccaggatggagtgcagtggtacgatcttggctcactgcagcctccacatcccaggttcaagtgattcttgtgcctcagcttcccaggtagctgggattacaggcacacaccaccacgtctggctaatttttgtatttttagtagagatgaggtttctgcatg

SEQ ID NO: 1023 - DNA, 220 bp, Homo sapiens
  D1S486
  Located on chromosome 1
  Distance between a terminus base of telomere on chromosomal short arm and 5'-terminus of this base sequence : 107098508
  Distance between 3'-terminus of neighbour sequence of sequence listing upward to telomere on chrosomal short arm and 5'-terminus of this base sequence : 213526
aactgaacaattatactgaggaaagaaagtgaggtgtgtgtgtgtgtgtgtgtgtgtgtgtgtgtgtgtatacatagtttttaaaaattaattggttttagtttttcttaggaaaattaacatttaatttgttgaactagttgtaagacaagagcctaagtgttcacacggcagaaaagttgaatttagcaaagcatggctaagtctgcaaatgtcgcag

SEQ ID NO: 1024 - DNA, 371 bp, Homo sapiens
  AL356779.2_78542
  Located on chromosome 1
  Distance between a terminus base of telomere on chromosomal short arm and 5'-terminus of this base sequence : 107102067
  Distance between 3'-terminus of neighbour sequence of sequence listing upward to telomere on chrosomal short arm and 5'-terminus of this base sequence : 3339
agtgttcagattaagatggactttataaaagtccttgagaacatttatatttcccttccttccttcctttcttccttcctttttctctctttttcttttcttttttttcttctttctttctttctttctttctttctttctttctttctttctttccttctttcattctttcctctttctctttctctttctctttctctctttctttcattctttcttgtcttgctctgtctcccaggctgcaatgtagtgacacgacctctgctcgcccaggctgcaatgtagtgacatgacctctgctcactgcaacctccacctcctgggtttaagcaattctcctgactcagtctcctgagtatcttacagacatg

SEQ ID NO: 1025 - DNA, 305 bp, Homo sapiens
  AL356779.2_114877
  Located on chromosome 1
  Distance between a terminus base of telomere on chromosomal short arm and 5'-terminus of this base sequence : 107126823
  Distance between 3'-terminus of neighbour sequence of sequence listing upward to telomere on chrosomal short arm and 5'-terminus of this base sequence : 24385
catctttgaacactcagtgctaacttctgttacattatctctatctatctatctatctatctatctatctatctatctatccatccatctaatctatctatctatctgtctgtctatctatctggtaatatcatccaaactctgactttctttaccagtaaaacacaaataacattaatttataattctgtccaagatctttcctttgaactctagatctatatatcctgtttatataatatgttcatgcattttctcacagtccttccccaaaaaagcatgatgttacagactgaattgattcc

SEQ ID NO: 1026 - DNA, 206 bp, Homo sapiens
  chr1.fa.O7frz.114509372
  Located on chromosome 1
  Distance between a terminus base of telomere on chromosomal short arm and 5'-terminus of this base sequence : 107243923
  Distance between 3'-terminus of neighbour sequence of sequence listing upward to telomere on chrosomal short arm and 5'-terminus of this base sequence : 116795
atgtaatagatgagccagttacacagagttgtttgaaactgaagcattgactttcgtcaaacacacacacacacacacacacacacacacacacacacacacacacagtgtatgttgtcaagcagtatccctcacccctagccgtaacaggactgaagcacgcctacagtttcaccttgggtttctagacatgtcaccgttacttc

SEQ ID NO: 1027 - DNA, 337 bp, Homo sapiens
  chr1.fa.O7frz.114578656
  Located on chromosome 1
  Distance between a terminus base of telomere on chromosomal short arm and 5'-terminus of this base sequence : 107313213
  Distance between 3'-terminus of neighbour sequence of sequence listing upward to telomere on chrosomal short arm and 5'-terminus of this base sequence : 69084
gataagttatgcgtatcagcacactctgacaaaattactcttaagctaggattttgaccttagacttatgtgctattctaccttggtaaagctcaagaatacacacacacacacacacacacacacacacacacactcactcacatttgattacattaaaatacacctaaattccatgcttcattaatcattttccatgaattttatattaatcctgtacattaatgagagcttttaacaatttccttttctactgttgaaacttcagtcttctatttaacccatttttggacctttgatccatgtcaagatagcctgtgaagactgttgaactgtt

SEQ ID NO: 1028 - DNA, 408 bp, Homo sapiens
  chr1.fa.O7frz.114631696
  Located on chromosome 1
  Distance between a terminus base of telomere on chromosomal short arm and 5'-terminus of this base sequence : 107366267
  Distance between 3'-terminus of neighbour sequence of sequence listing upward to telomere on chrosomal short arm and 5'-terminus of this base sequence : 52717
ttcttaccaaatcaattatcagagaagatttaaggaagtagatgacactgtctttttatcctgaatatttgtgttaagacttgtatgagagagagagagagagagagttttcgcttaagacttgagtcagatttgtttaggtaattttttttgccaattattttttagtttagtgctaaataaatgttatttggttccttacattattggtgatttctctaaacattcaatgttcacatttcacttttgttttctaaatttttgtctaaataagtctcactgaaacacatttgtgaaaacatacctccattccctgttgcatcaaattgggtactaaaagaactggatgtcaaaacactcagggttttctctttttattctcctctgcgtaaatactgatttcatatc

SEQ ID NO: 1029 - DNA, 153 bp, Homo sapiens
  D1S495
  Located on chromosome 1
  Distance between a terminus base of telomere on chromosomal short arm and 5'-terminus of this base sequence : 107513704
  Distance between 3'-terminus of neighbour sequence of sequence listing upward to telomere on chrosomal short arm and 5'-terminus of this base sequence : 147029
aaacctggtatgccatcaaaaagcataaacatttcttaccagccaggtctctggcctctgtgtgtgtgtgtgtgtgtgtgtgtgtgtgtgtgtgtgtgtgtgtgtgtgtgtcatggtaaacatcacagtttgcctcctctgcaaaggtttggt

SEQ ID NO: 1030 - DNA, 426 bp, Homo sapiens
  chr1.fa.O7frz.114761424
  Located on chromosome 1
  Distance between a terminus base of telomere on chromosomal short arm and 5'-terminus of this base sequence : 107663423
  Distance between 3'-terminus of neighbour sequence of sequence listing upward to telomere on chrosomal short arm and 5'-terminus of this base sequence : 149566
gacataagcactgattgtatcataaattgggagagatttagacactccacttctacccccttcacacacacttctctaaaattattgattcttgggttcaaaaaaacaagcaaactttaccaaatgcaaattaagaaaacatgatactttttttttctcaaagatatttattaaaatgctgaaaagggaagattcattacaaacttcccttacccacacatcacatattttggttatgttttacagtcaaatacaagtatattgaacaactctcaattcaggtaatcatttcctgctatgaccaaaacacacatacacacacacacacacacacaaagtgacacctcatgaatggtgcattctttcttcagtgttaaaagttttaatagcaagcctggatatatttatctcatgccatagtttaga

SEQ ID NO: 1031 - DNA, 373 bp, Homo sapiens
  chr1.fa.O7frz.114982091
  Located on chromosome 1
  Distance between a terminus base of telomere on chromosomal short arm and 5'-terminus of this base sequence : 107815625
  Distance between 3'-terminus of neighbour sequence of sequence listing upward to telomere on chrosomal short arm and 5'-terminus of this base sequence : 151776
ttaatgttatccatgccttaatactatccagaccattataccctttgtattgtatccagaatcagagaggcagctacaatatctgtgtgtgtgtgtgtgtgtgtgtgtgtgtgtgtgtgtgtgtgtttcatgcccatagggaagataagggtaaaatggaaaaatatagggtgtgtcagccagtggttgtaacaatttatatatatattcaggctctattatttttaatcaacaatattcttaatgtccactttgaagagcatagtatttgcttgataagtttaactgaatgaatagattaagtttactcaggtaggccccaagctttgattataattacttgagcaaacttgtacaagttacaaaccatagc

SEQ ID NO: 1032 - DNA, 292 bp, Homo sapiens
  D1S2626
  Located on chromosome 1
  Distance between a terminus base of telomere on chromosomal short arm and 5'-terminus of this base sequence : 107997396
  Distance between 3'-terminus of neighbour sequence of sequence listing upward to telomere on chrosomal short arm and 5'-terminus of this base sequence : 181398
cgttcaagcacaaactgaatctcttccctgggcctccatcctgctgccctccctgacagattttgaacttgccagtgttcacaatcatgaaccagtttcttactaataaatctctcctttcgtaaaaaaatatatatgtatagatgtgtgtgcacacatatataaatatatacagatgtatatgtatacccgtgtgtgtgtgtgtgtgtgtgtgtgtgtgtgtgtgtgtatcctattggttctgtttctttggagtactctgaacagtacaccagggataagagataataca

SEQ ID NO: 1033 - DNA, 232 bp, Homo sapiens
  chr1.fa.O7frz.115269354
  Located on chromosome 1
  Distance between a terminus base of telomere on chromosomal short arm and 5'-terminus of this base sequence : 108034230
  Distance between 3'-terminus of neighbour sequence of sequence listing upward to telomere on chrosomal short arm and 5'-terminus of this base sequence : 36542
aaatgagtatgttgcatctatgtaaaagaatgggataccttggggaaaaataaagtataataaagaactttcatatatatatatatacacacacataaatatacatatatatatacatatatatacacacacatatatatgtgtgtgtgtgtgtgtgtgtgtatatatatatcccaaagcagatagtatacaggttagaaaaaagttaaagttgtcattcagaaagttgaac

SEQ ID NO: 1034 - DNA, 420 bp, Homo sapiens
  chr1.fa.O7frz.115357540
  Located on chromosome 1
  Distance between a terminus base of telomere on chromosomal short arm and 5'-terminus of this base sequence : 108188674
  Distance between 3'-terminus of neighbour sequence of sequence listing upward to telomere on chrosomal short arm and 5'-terminus of this base sequence : 154212
gtgaagtaatatgatccactagctctttctcataatataattctggagatgtcatagaaagtttggcgatatttggggaagaattttatactggtgatgcatttatctttcttgcactgccattggcaaatcattacctaaccacctaccaataaaaggtggtggggggaagtgggggggagagagagagagagagagagagagagagagagagagagagagagagagactgttctgggcaagcaggacagcagcactaatcagctggaaccagagatcagacaacaagtagattccgtaacaagtctgtcccttagctctccattcacagtttgtctgcttggtgattacaagcacacattatcattcttacataaaagcaatatccaatgaggagtatgaagatttctaaactcgatg

SEQ ID NO: 1035 - DNA, 376 bp, Homo sapiens
  chr1.fa.O7frz.115542477
  Located on chromosome 1
  Distance between a terminus base of telomere on chromosomal short arm and 5'-terminus of this base sequence : 108372667
  Distance between 3'-terminus of neighbour sequence of sequence listing upward to telomere on chrosomal short arm and 5'-terminus of this base sequence : 183573
gttgctacaatatcaatgaggtttttgttttcaatctatatgtgttaatgtgtatattcctttatccctcagaatatgatttacaggtgatgggaatttagtacatgtttgtttaaataatactcaactgtaatttttatggtttctaacttaaatattttaaaatttatttactctagggctgaataaaaatatctttttaagaacattactgacttaaattagaattaagacactctaaattctttctttgatcatacttaaaggactgtgtgtgtgtgtgtgtgtgtgtgtgtattattggaaatgagtagaaaaaataacctatatttttactcaccccatccccttttgctcctggagatccttgagttcc

SEQ ID NO: 1036 - DNA, 441 bp, Homo sapiens
  chr1.fa.O7frz.115617540
  Located on chromosome 1
  Distance between a terminus base of telomere on chromosomal short arm and 5'-terminus of this base sequence : 108447768
  Distance between 3'-terminus of neighbour sequence of sequence listing upward to telomere on chrosomal short arm and 5'-terminus of this base sequence : 74725
ttggaggaagctttctaattactgagaaagtatatataatgttttaactaaaactgataagcagttaaaaagaagccttcagcacaagtaagtagtcatgtttacacactctataaaataacatcgtatttcccttgcctcagggttaacctctgaaataaaataatcaataaatccaatgattcttcatttttgcttctgttatacatattcctaaaaacaagatgcagttttgttgtttctctaggggtgtgtgtgtgtgtgtgtgtgtgtatgtgtttggatgtgcatgtgtgtgtccgtgtgcgcatgtgtgtgtgtatgtgtgtgagttacagtgttgagaactatttagagacagagaaaagactaaaccaattaaataattaaaatacgtattcacctgcttttgctcctttgttataatttggtattagcagg

SEQ ID NO: 1037 - DNA, 101 bp, Homo sapiens
  DISD22_0000613
  Located on chromosome 1
  Distance between a terminus base of telomere on chromosomal short arm and 5'-terminus of this base sequence : 108566721
  Distance between 3'-terminus of neighbour sequence of sequence listing upward to telomere on chrosomal short arm and 5'-terminus of this base sequence : 118512
ggttaagcaacacagaaggggtgtctgtgtgtgtgtgtgtgtctgtgtctgtgtgtgtgtgtgtgtgcgtgtgtgtgtacataggcatatgtgcatctgga

SEQ ID NO: 1038 - DNA, 165 bp, Homo sapiens
  DISD22_0000616
  Located on chromosome 1
  Distance between a terminus base of telomere on chromosomal short arm and 5'-terminus of this base sequence : 108661471
  Distance between 3'-terminus of neighbour sequence of sequence listing upward to telomere on chrosomal short arm and 5'-terminus of this base sequence : 94649
tgccatgagatttattggtgctatatatatatatatatatatatatatatatatatatatacacacacatatatacatatatacacagagttttataaaatacctaccacaaaataattaactactcagtaaatcttagctattttgaatcctgcatacttccca

SEQ ID NO: 1039 - DNA, 229 bp, Homo sapiens
  chr1.fa.O7frz.115971369
  Located on chromosome 1
  Distance between a terminus base of telomere on chromosomal short arm and 5'-terminus of this base sequence : 108837814
  Distance between 3'-terminus of neighbour sequence of sequence listing upward to telomere on chrosomal short arm and 5'-terminus of this base sequence : 176178
tcattacctacttaatgttcgaagtggggcctggtgggaggtgactggattatggggacagttttttcatggtttagcaccatctccttggtgctgttcttatgatagtgagtgagttcttatgaaatctggtcgtttagaagtatgtggcacctccctgctctctctctctctctctctctctctctctctctctctctcgctcctactttagccatgtaatacgatc

SEQ ID NO: 1040 - DNA, 138 bp, Homo sapiens
  DISD22_0000623
  Located on chromosome 1
  Distance between a terminus base of telomere on chromosomal short arm and 5'-terminus of this base sequence : 108931189
  Distance between 3'-terminus of neighbour sequence of sequence listing upward to telomere on chrosomal short arm and 5'-terminus of this base sequence : 93146
agcaccaagaaacttattgataactcgtgtgtgtgtgtgtgtgtgtgtgtgtgtgagagagagagagagagagagagagagagagagagagagagagagagagagagagagagtttccagaatggaacttattgagtg

SEQ ID NO: 1041 - DNA, 378 bp, Homo sapiens
  chr1.fa.O7frz.116297348
  Located on chromosome 1
  Distance between a terminus base of telomere on chromosomal short arm and 5'-terminus of this base sequence : 109165284
  Distance between 3'-terminus of neighbour sequence of sequence listing upward to telomere on chrosomal short arm and 5'-terminus of this base sequence : 233957
acaatagtttgcgagtaacttaactgtgcatctctttctgcatggcatggcatctgaagattaaattctttctctaattaaatggttattctgtaacatatatatatatatatatatatatacatacacacacacaaacacacactcaaatatatatacacacacacaccatatacacacacgtgtgtaatctacatatgtagtctatattcgtatatacaagtatggaatacttatattcatattacaaatataagatttttgttattaaaaaaggtcctttcagaggtttcagcacattatcatttagaggcactccagaaggatcaatatccatatcacattttacggaatgtcaaactaggttaaaataaggct

SEQ ID NO: 1042 - DNA, 159 bp, Homo sapiens
  DISD22_0000635
  Located on chromosome 1
  Distance between a terminus base of telomere on chromosomal short arm and 5'-terminus of this base sequence : 109270385
  Distance between 3'-terminus of neighbour sequence of sequence listing upward to telomere on chrosomal short arm and 5'-terminus of this base sequence : 104723
ggctctatgatggtgtcttgctctctctctctctctctctctctctctctctctctctctatatatatatatatatatatatatacacatatatatatatatatatatatatatacacacacatatatatatatatcccaagtggtggcccacatactt

SEQ ID NO: 1043 - DNA, 404 bp, Homo sapiens
  chr1.fa.O7frz.116761275
  Located on chromosome 1
  Distance between a terminus base of telomere on chromosomal short arm and 5'-terminus of this base sequence : 109651587
  Distance between 3'-terminus of neighbour sequence of sequence listing upward to telomere on chrosomal short arm and 5'-terminus of this base sequence : 381043
tcagaagcatcaggtaatattaacattatacaaaattaccaggctgggtgcggtggctcactcctgtaattctaccactttgagaggctgaggtgagtggatcacctgaggtcaggagttggagaccagcctggccaagatggcaaaaccctgtctctcctaaaagtacaaaaattagctgggcagggtgatgtgtgactgtaatcacagctacttgggaggctgaggtaggagaatcgcttgaaccctggaggtggaggttgcagtgagccgtgatcatgccacttcactccagcctggatgacagagtgacactctgtctcaaaaaataaataaataaataaataaataaataaataaataaataaataatcagagtcagcttcatgaagaaattgacttga

SEQ ID NO: 1044 - DNA, 288 bp, Homo sapiens
  D1S2699
  Located on chromosome 1
  Distance between a terminus base of telomere on chromosomal short arm and 5'-terminus of this base sequence : 109828724
  Distance between 3'-terminus of neighbour sequence of sequence listing upward to telomere on chrosomal short arm and 5'-terminus of this base sequence : 176733
tgtgactatttttaagaagatccaaacacacacacacacacacacacacacacacatacatatacataactggcaatattttgacttacctgtaaatataataacattgtctcctttttgataacctttaaaaatacacaaagacatatttttctggttactagtatagcaattcatattttatggtataaatacttatgtatatagtttaaggagtttatatagaatgaaattaatttattttagttttctattgttgcataactaattattcccaaacttattggc

SEQ ID NO: 1045 - DNA, 403 bp, Homo sapiens
  chr1.fa.O7frz.117085679
  Located on chromosome 1
  Distance between a terminus base of telomere on chromosomal short arm and 5'-terminus of this base sequence : 109941746
  Distance between 3'-terminus of neighbour sequence of sequence listing upward to telomere on chrosomal short arm and 5'-terminus of this base sequence : 112734
ctatctcagctcactgaaatctctgcctcctgggttcaagtgtttcccctgccttagctcccctgccttagctcccctgcttcccccaccaccctggccttgagtaactgggattacaggtgcccgccaccatgcctgaatatttaattgcatttttcttttttattctttcattactattttcatttaagtgattatgtgtgtgtgtgtatgtgtgtgtgtgcaccttttatacaaatttggcttgtactgtttgaagaatattttatcttgatatcagtggttttgatgctcatattttctgatcattttgacttagtaaagtgtcatttattttcattctgtaaatttcagaaaaatgaacttcaccttccttgatggaacaaagcattatgacttatcc

SEQ ID NO: 1046 - DNA, 299 bp, Homo sapiens
  chr1.fa.O7frz.117176742
  Located on chromosome 1
  Distance between a terminus base of telomere on chromosomal short arm and 5'-terminus of this base sequence : 110037660
  Distance between 3'-terminus of neighbour sequence of sequence listing upward to telomere on chrosomal short arm and 5'-terminus of this base sequence : 95511
gctatacatttatgatttgttcacttttgtgtgaatatgttaaacttcaataaaatttatggttaaataaatacttattgggggcagaatgtgtgttctgttttcagagctctgggaatcagatttgtaacttttccataagagtttgcctggtatttcacacacacacacacacacacacacacacacacacaaaatcttcagcaattattaatttctctagcaatattggatcttctagatcatatagcctgataagaaacagccatgaaacttatattgtgatcaaagcatctgta

SEQ ID NO: 1047 - DNA, 136 bp, Homo sapiens
  D1S2888
  Located on chromosome 1
  Distance between a terminus base of telomere on chromosomal short arm and 5'-terminus of this base sequence : 110043561
  Distance between 3'-terminus of neighbour sequence of sequence listing upward to telomere on chrosomal short arm and 5'-terminus of this base sequence : 5602
caaaatatgcaatacaaaattcaagttatagacttaaatttattgtcaaggtgaaatacacacacacacacacacaaacacacacacacacacacacacatatgagagactttggtcatctatgtgttaattgttg

SEQ ID NO: 1048 - DNA, 360 bp, Homo sapiens
  chr1.fa.O7frz.117375148
  Located on chromosome 1
  Distance between a terminus base of telomere on chromosomal short arm and 5'-terminus of this base sequence : 110117926
  Distance between 3'-terminus of neighbour sequence of sequence listing upward to telomere on chrosomal short arm and 5'-terminus of this base sequence : 74229
ctcatgaaagaccattaatcagaatggctttggaaatcttagcagcttaagttatactataatacagattttttttctctctctctcccccagatgcatacacacacacacacacacacacacacacacacacacacaactttctgagtattcaatttggttccattgtaaaatcaacttttgccataaaaatgaaagcagagaagcccctcatatatttgaatcatgtagatgaaccagaataagagagagcaaggaggcggggggcaggcacagaaactaggtcataactaggtctcagtaacattatttgtcttggtaacattatttgtacctctgaatcaattagaagtcagaatc

SEQ ID NO: 1049 - DNA, 264 bp, Homo sapiens
  chr1.fa.O7frz.117181071
  Located on chromosome 1
  Distance between a terminus base of telomere on chromosomal short arm and 5'-terminus of this base sequence : 110181978
  Distance between 3'-terminus of neighbour sequence of sequence listing upward to telomere on chrosomal short arm and 5'-terminus of this base sequence : 63692
tatagccttcaggttcagactaaaacattgggtttttgaaagtcccaagcttgctattttttgtttttgttttggctctactcattctcaggacttggaattataatgaaaatacctatcagttctcctgggtctccagctttctaattcaccctgcaaatcttggatattgtcagcttctaaaacatgagccaattccttataataagtctctctctctttctctctctctctctctctctctcaagccaattccttataatc

SEQ ID NO: 1050 - DNA, 157 bp, Homo sapiens
  D1S485
  Located on chromosome 1
  Distance between a terminus base of telomere on chromosomal short arm and 5'-terminus of this base sequence : 110333090
  Distance between 3'-terminus of neighbour sequence of sequence listing upward to telomere on chrosomal short arm and 5'-terminus of this base sequence : 150848
aggctgaggcagggaatcgcttgaatctgggtggtggaggttgcagtgagccaaaatcacatcactgcactccaggctgagcaacagagagagactttgccttaaaaatacacacacacacacacacacacacgtagtaacctctatcaaaattcca

SEQ ID NO: 1051 - DNA, 407 bp, Homo sapiens
  chr1.fa.O7frz.117990803
  Located on chromosome 1
  Distance between a terminus base of telomere on chromosomal short arm and 5'-terminus of this base sequence : 110572831
  Distance between 3'-terminus of neighbour sequence of sequence listing upward to telomere on chrosomal short arm and 5'-terminus of this base sequence : 239584
gatagccaacattcagagaataagtcccttaccactttttgtgtgttcgttttctagttttctaaactgttcctgtagatattaagccatataagttatgtgaattttgtttagccttgtcagaaaggcacatagcggtttcttaaatattgcctaaagaggctaatttggggtaacagggagtaaattggtggggctcttttgcaatcagatatccttgcatttacacatacacacacacacacacacacacacacacacactattcaaatatgtatatatatagataaattttctggaatagaaaagttttcactgctttaaaataatgtaaaaactgttgacttcttaagatctaaaatgttctctgttttcagtttatatgatatgaagagcatagatgtaga

SEQ ID NO: 1052 - DNA, 178 bp, Homo sapiens
  DISD22_0000661
  Located on chromosome 1
  Distance between a terminus base of telomere on chromosomal short arm and 5'-terminus of this base sequence : 110692250
  Distance between 3'-terminus of neighbour sequence of sequence listing upward to telomere on chrosomal short arm and 5'-terminus of this base sequence : 119012
gcttgctagtagatttgtcagttgaaatgggctatatatatatatatatatatatatatatatatatatgctacatatatatatatatgctacatatatatatttcatacatatatgaaatatgtgaaatataggctacatacatatatatttcatcagtctattctaggtaccttga

SEQ ID NO: 1053 - DNA, 229 bp, Homo sapiens
  D1S429
  Located on chromosome 1
  Distance between a terminus base of telomere on chromosomal short arm and 5'-terminus of this base sequence : 110804189
  Distance between 3'-terminus of neighbour sequence of sequence listing upward to telomere on chrosomal short arm and 5'-terminus of this base sequence : 111761
tggtctagtaccaaacctgcagtatctctaaggatgcctctgtgtgtgtgtgtgtgtgtgtgtgtgtgtgtgtgtgtgtgtgtgtgtgtgtgtgtgtgttttctggcaatcatgagttttgaaacagaatgagttaggtttttaattaggctcaattgctctctgtttgaccttggtcatgttacttaaactcaggaaaatgacaaaactacctaaatcgccgggaagt

SEQ ID NO: 1054 - DNA, 235 bp, Homo sapiens
  D1S2759
  Located on chromosome 1
  Distance between a terminus base of telomere on chromosomal short arm and 5'-terminus of this base sequence : 111011452
  Distance between 3'-terminus of neighbour sequence of sequence listing upward to telomere on chrosomal short arm and 5'-terminus of this base sequence : 207034
tgcgttacatggctactcctaggcatggaggaagaaaaaatggcctctgcaattcaggactattttttctatctcttatttcccctttcagtgatataaaattaaaaccagctattgtgagtactcacctgatttttggttcttatgaaattgtgtgtgtgtgtgtgtgtgtgtgtgtgtgtgtagataattgctaacttagtgttcatatggaggttgtgaaggtgagatgatc

SEQ ID NO: 1055 - DNA, 350 bp, Homo sapiens
  chr1.fa.O7frz.118358138
  Located on chromosome 1
  Distance between a terminus base of telomere on chromosomal short arm and 5'-terminus of this base sequence : 111170513
  Distance between 3'-terminus of neighbour sequence of sequence listing upward to telomere on chrosomal short arm and 5'-terminus of this base sequence : 158826
ggtaaagatactgcattctcatattcattgcagcattattcacaacagccaagaaataaaaacaacctaagtatctatagatgaatgactggaataagaaattgtgttgaaatatatatatatatatatatatatatatatatataataaatatacaaaatatatgtatatataatatataaaaaaatatgtgtatatatgttacatgcaatggaatatttttcagccttcaaataaaaggaactcctgccacgtgtgacaagctgaataaacctagaagacattatactaagtgaaataagccagacacagaaaatagaatagctgtgatttcacttataacatgcaat

SEQ ID NO: 1056 - DNA, 256 bp, Homo sapiens
  chr1.fa.O7frz.118660425
  Located on chromosome 1
  Distance between a terminus base of telomere on chromosomal short arm and 5'-terminus of this base sequence : 111373835
  Distance between 3'-terminus of neighbour sequence of sequence listing upward to telomere on chrosomal short arm and 5'-terminus of this base sequence : 202972
aagtaagctaaccaggtatcctagaaaaacctaaagaaatacaaatccaacaaaatgatttagactgtggggaaggaatcaggatatttcagctaacctaagagttttctataccataatgtctgcgtgtgtgtgtgtgtgtgtgtgtgtgtgtgtgtgtgcgcgcgcatgtgtgtgtgtatctgaaaatagaaaaatgaagcagagaactcatagaacacagtattcttaatactgtacagttgctcctattcac

SEQ ID NO: 1057 - DNA, 174 bp, Homo sapiens
  chr1.fa.O7frz.118780862
  Located on chromosome 1
  Distance between a terminus base of telomere on chromosomal short arm and 5'-terminus of this base sequence : 111494345
  Distance between 3'-terminus of neighbour sequence of sequence listing upward to telomere on chrosomal short arm and 5'-terminus of this base sequence : 120254
tgtagaagcagttggaataaaggagaaaagaagagatttaattaagtgaggagaaaatagtacaaattaatattatttgggatgtgtgccttacattgtgtgtgtatatatatatatatatatatatatatatatatatatatatatgaatatgtgattctatgaagcaaatag

SEQ ID NO: 1058 - DNA, 354 bp, Homo sapiens
  chr1.fa.O7frz.118894753
  Located on chromosome 1
  Distance between a terminus base of telomere on chromosomal short arm and 5'-terminus of this base sequence : 111607093
  Distance between 3'-terminus of neighbour sequence of sequence listing upward to telomere on chrosomal short arm and 5'-terminus of this base sequence : 112574
gcagacgaatcacttcaacccaggagacagaggttgcagtcacccaagatcgggctattgtattccagccttggtgacagagtgagattctgtttcaaaaattaaataaataaataaataaataaataaataaataaagcaaatgatgacttgctagaaatccacaggaaacaaaataactattcacagaaccaaataaaattattccactagaaaataaaaatcatcaatggttttatatttttgcatacacaagccataaacccaaagaagaaaaaaacagcaaccaaatgaaaatcagaagcaaaaaaaaaaaacaggaaactaaccctaaatgtttccaactcagtctac

SEQ ID NO: 1059 - DNA, 313 bp, Homo sapiens
  chr1.fa.O7frz.118987781
  Located on chromosome 1
  Distance between a terminus base of telomere on chromosomal short arm and 5'-terminus of this base sequence : 111699738
  Distance between 3'-terminus of neighbour sequence of sequence listing upward to telomere on chrosomal short arm and 5'-terminus of this base sequence : 92291
actacgaatcatgctactatcaactgtgagatgtgtctacatctacatctatctatctttgtgtgtgtgtgtgtgtgtgtgtattactatgcagtattagagacaaaaaaatatgactttctcttctgatcttgcttgctcaacctaacatttactttattataatatataattttaactttgactttttctaagactaccttggcctaacctaccagtttgttcttttactaaacaatgttcttctcatctttggagcacctttatcaatgagatgacaaacttcaaggaaattaaactcaggtattgcttt

SEQ ID NO: 1060 - DNA, 256 bp, Homo sapiens
  D1S239
  Located on chromosome 1
  Distance between a terminus base of telomere on chromosomal short arm and 5'-terminus of this base sequence : 112020293
  Distance between 3'-terminus of neighbour sequence of sequence listing upward to telomere on chrosomal short arm and 5'-terminus of this base sequence : 320242
tggatgcctgatgtagagatgggtacatagtagttacacaaaacacacacacacacacacacacacacacacacacacacacaccacctctaaataaattggagaattactactgacgaaaaaatagaaagtaaatgtttgttgtttatttgtttcaaagtacacagatgcattaccaagggaaagatatttcattatgactcttctttttctaaatttttggacaaaattcttccctatcatcttatttctggag

SEQ ID NO: 1061 - DNA, 261 bp, Homo sapiens
  D1S1623
  Located on chromosome 1
  Distance between a terminus base of telomere on chromosomal short arm and 5'-terminus of this base sequence : 112255627
  Distance between 3'-terminus of neighbour sequence of sequence listing upward to telomere on chrosomal short arm and 5'-terminus of this base sequence : 235078
gacagtctttgtctcctgtgctattctgtttaagacaggtcctggggatatgatgtcctttattattattattattattattattattattattattatactttaagtcttagggtacatgtgaacaacatgcaggtttgttacatatgtatacttgtgccatgttggtgtgctgcacccattaactcgtcatttagcattaggtatatctcctaatgctatccctccccactcctgccaccccacaacatctatgaggga

SEQ ID NO: 1062 - DNA, 201 bp, Homo sapiens
  D1S248
  Located on chromosome 1
  Distance between a terminus base of telomere on chromosomal short arm and 5'-terminus of this base sequence : 112334847
  Distance between 3'-terminus of neighbour sequence of sequence listing upward to telomere on chrosomal short arm and 5'-terminus of this base sequence : 78959
gctttataggaggtatctgtgtgtgtgtgtgtgtgtgtgtgtgtgtgtgtgtgtgtgtgcgcgctccaattatggtcagtactttataacaatattgttttatgaaaataaacatgtttataaaaaattttatgtggattttgaacataaacataatacttcaaagaaatttatgctcaagcagacaatactaatcagatc

SEQ ID NO: 1063 - DNA, 478 bp, Homo sapiens
  chr1.fa.O7frz.119368251
  Located on chromosome 1
  Distance between a terminus base of telomere on chromosomal short arm and 5'-terminus of this base sequence : 112703818
  Distance between 3'-terminus of neighbour sequence of sequence listing upward to telomere on chrosomal short arm and 5'-terminus of this base sequence : 368770
tagctggtaaagcactatttctaggtgtgtctataagggtgtttccagaggtgactggcaaatgaattggtggactgagtgaggaagatctttgctcattgtgggcatgcaccatccagcgggctggggactcggatagatagaacaaaagagcagagaaaaaaaattagctctggctctctctctctctctctctctgtgtgtgtgtgtgtgtgtgtgtgtgtgtgtgtgtgtgtctcagagctgggacactccttctcttgacctcagatatcagatctctaggtcctccagtcattggactcccagaattgcaccagcagctcttcaggttctcaggctttctccctcagactgagaacctcaccaggggcttccctggttctgagactttcagacttggactgagccatcaccgcataccagcatccctgggtgtccaccaggcagatgacctatcatgagacttctcagcttc

SEQ ID NO: 1064 - DNA, 426 bp, Homo sapiens
  chr1.fa.O7frz.119281836
  Located on chromosome 1
  Distance between a terminus base of telomere on chromosomal short arm and 5'-terminus of this base sequence : 112815982
  Distance between 3'-terminus of neighbour sequence of sequence listing upward to telomere on chrosomal short arm and 5'-terminus of this base sequence : 111686
tagagttcgtttcacattcaactaatgtaccctgttagtcaaatatacacataaggccgggtgcagtggctcatgcctgtaatcccagtactttgggagcccgaggcaggcggatcacgaggtcatgagatcgagaccatcctggctaacacagtgaaactccgtctctactaaaactacaaaaaaattagctgggcgtggtggcgggcgcctgtagtcccaactactcgggagggtgaggcaggagaatggcgtgaacccaggaggggaagcttgcagtgagctgagattgcgccactgcactccagcctgggcaacagagcgagactccgtctaaaaaaaaaaaaaaaatatatatatatatatatatatacacacacacacacacacacaaacacacacacacactttgtagaaattctggaa

SEQ ID NO: 1065 - DNA, 105 bp, Homo sapiens
  DISO7_10007914
  Located on chromosome 1
  Distance between a terminus base of telomere on chromosomal short arm and 5'-terminus of this base sequence : 113185724
  Distance between 3'-terminus of neighbour sequence of sequence listing upward to telomere on chrosomal short arm and 5'-terminus of this base sequence : 369316
ccaggataggaatcttgggtaaacgtgattgagctaacacactgtgttccagaacttgcgtgtgtgtgtgtgtgtgtgtgtgtgtgtgagcatgcacatgtgttg

SEQ ID NO: 1066 - DNA, 160 bp, Homo sapiens
  DISO7_10007915
  Located on chromosome 1
  Distance between a terminus base of telomere on chromosomal short arm and 5'-terminus of this base sequence : 113263771
  Distance between 3'-terminus of neighbour sequence of sequence listing upward to telomere on chrosomal short arm and 5'-terminus of this base sequence : 77942
gattatggaactttctgctcttctattaattgacataaaggtagtatttaaaaaatttaagctctgagcatatatgtcaccgccgtactattttttataataatacacacacacacacacacacacacacacacacacatgcacagccctattagtcctc

SEQ ID NO: 1067 - DNA, 398 bp, Homo sapiens
  chr1.fa.O7frz.119686118
  Located on chromosome 1
  Distance between a terminus base of telomere on chromosomal short arm and 5'-terminus of this base sequence : 113344842
  Distance between 3'-terminus of neighbour sequence of sequence listing upward to telomere on chrosomal short arm and 5'-terminus of this base sequence : 80911
agaaatttgtaatcagaccgacctttaaaagcaaagagaaaaagaaacaaaagaccatgtagaagtttgtatctccaaaatggtttcaatgatcagaatatgcatttgtattttggtgaattttaacatgttttgcgcagacaaggtatagaattaaattctacttagtgaccaatattgctattcatttttttaaaatataaagcaaaattttgtgaggtctctggaatacacacacacacacacacacacgtatacataatgtcactgatacaaacgataccgaagtttctcctagtcttattacttaaattgagtaaaatgtgttattttctttagcaaatgtgaaaacaaacttgaaaggaattataagccatagctttgaacttcaacgtaat

SEQ ID NO: 1068 - DNA, 210 bp, Homo sapiens
  DISD22_0000664
  Located on chromosome 1
  Distance between a terminus base of telomere on chromosomal short arm and 5'-terminus of this base sequence : 113415709
  Distance between 3'-terminus of neighbour sequence of sequence listing upward to telomere on chrosomal short arm and 5'-terminus of this base sequence : 70469
ccataggttgtgctctttatctcaattatttatttattttttttcaaaaaggaaggaagaaacaaagtaaggaagggagggagggagggagggagggaccctttctctcccaaaggccacccttccaaatatgcatgtgcacacacatgcacatatacttgattatatctctaaaatttctctctaatcaaaccatttcttgccaccttc

SEQ ID NO: 1069 - DNA, 284 bp, Homo sapiens
  DISD22_0000671
  Located on chromosome 1
  Distance between a terminus base of telomere on chromosomal short arm and 5'-terminus of this base sequence : 113657035
  Distance between 3'-terminus of neighbour sequence of sequence listing upward to telomere on chrosomal short arm and 5'-terminus of this base sequence : 241116
ttggtgagaactaaattatgcatacttttcttgcacaattttaaaaaccttcattacttgttttccatgttaaaaggaaaggactactgaagaaaatgtaacaacaggggtaagatgtgacagctgatagaaaaggagtaagaaaaagcagttgttttttaaaatttacatcaccatcacccaacacccccgccccactcaaacacacacacacacacacacacacacacacacacacacacacacacacaatataaaacatattctggaagcattcagtatag

SEQ ID NO: 1070 - DNA, 227 bp, Homo sapiens
  chr1.fa.O7frz.120185847
  Located on chromosome 1
  Distance between a terminus base of telomere on chromosomal short arm and 5'-terminus of this base sequence : 113764086
  Distance between 3'-terminus of neighbour sequence of sequence listing upward to telomere on chrosomal short arm and 5'-terminus of this base sequence : 106767
tacatctgcaaggataatagctacaatgtatacatatacacacatacatacacacacacacacacacacacacacacacacacacaaatatttataatccaatggtgagaatggttggtcagctttaggtatccatcgccaagagaggggactgagaagatttaagggaaaattcaaaacggtgacacatgagagaccagaacaactctatcaagtcactggtttca

SEQ ID NO: 1071 - DNA, 420 bp, Homo sapiens
  AL359258.4_22162
  Located on chromosome 1
  Distance between a terminus base of telomere on chromosomal short arm and 5'-terminus of this base sequence : 113926353
  Distance between 3'-terminus of neighbour sequence of sequence listing upward to telomere on chrosomal short arm and 5'-terminus of this base sequence : 162040
atcatgaagtcaagagatcaagaccatcctggccaacatggtgaaaccccgtctttactaaaaatacaaaaattagctgggcgtggtggcatgcgcctgtagtcccagcgactcgggaggctgaggcaggagaatcgcttgaaccgtgagacgggggctgcagtgagccgagaccctgccactgcactccagcctggtgacagagtgagactccgtctcaaaaacaacaacaacaacaacaacaacaaataaaataaaataaaaaccattaatacgtctgaaaggagagagagactgcaatacagcaatagtaggggacttcaacaccctaccttcagcaatagacaaatcatctcaacagaaaatcagtaagaaacatcagacttaaactatactctagaacaaatggacagatcagac

SEQ ID NO: 1072 - DNA, 397 bp, Homo sapiens
  AL359258.4_137821
  Located on chromosome 1
  Distance between a terminus base of telomere on chromosomal short arm and 5'-terminus of this base sequence : 114041207
  Distance between 3'-terminus of neighbour sequence of sequence listing upward to telomere on chrosomal short arm and 5'-terminus of this base sequence : 114434
ataacattgacaatgattgtctgtgtaacttgggcaagttattgaatctctctgtgcttcaatttcttcagtaaaatgagaataatgatagctatctattagttgaactataggaaatttctgatatccaactatttttgacctacaagaatggtaatttgcagaaagtccccatcagcgagcaggctctcacagatgtgtcccctcaaccttggacttctcagcctccataattgcatgagcccaatgaatgaattcctgtaataaactctatctatctatctatctatctatctatctatctatctatctatctatcttatatctatccatccatccatcctattggttttgtctttctggagagccctaactaatacagagtgcttccatgttt

SEQ ID NO: 1073 - DNA, 471 bp, Homo sapiens
  chr1.fa.O7frz.120328954
  Located on chromosome 1
  Distance between a terminus base of telomere on chromosomal short arm and 5'-terminus of this base sequence : 114174026
  Distance between 3'-terminus of neighbour sequence of sequence listing upward to telomere on chrosomal short arm and 5'-terminus of this base sequence : 132422
ggccagttcctgacttaactgatgacattctaccacaaaagaagtgaaaatggcctgttcctgccttaactgatgacattgtcttgtgaaattccttctcctggctcatcctggctcaaaagctcccctactgagcaccttgtgacccccactctgcctgccagagaacaacctccctttgactgtaattttcctttacctacacaaatcctataaaacggccccacccctatctcccttcgctgactttctttggactcagcctgcctgcacccaggtgaaataaacagccatgttgctaaaaaataaataaataaataaataaataaataaataaataaataagaaacatgaagaaaactacaccaaggaacaccatactccaattgatcaaaaccagtgatgaagagaaactcctcagaggaataaaaggtgaaaagacatgttacatacagaggactaactgtaagg

SEQ ID NO: 1074 - DNA, 169 bp, Homo sapiens
  D1S2778
  Located on chromosome 1
  Distance between a terminus base of telomere on chromosomal short arm and 5'-terminus of this base sequence : 114201024
  Distance between 3'-terminus of neighbour sequence of sequence listing upward to telomere on chrosomal short arm and 5'-terminus of this base sequence : 26527
cacagttaaattgcatttccccaacacacacacacacacacacacacacacacacacacacacacgagtctccctcctctgcttcatttccccttagcacttttcattatctaacatagcttaattatttatctagtttattgtttttctcctcttgtttatggtgagc

SEQ ID NO: 1075 - DNA, 271 bp, Homo sapiens
  Z67512
  Located on chromosome 1
  Distance between a terminus base of telomere on chromosomal short arm and 5'-terminus of this base sequence : 114281951
  Distance between 3'-terminus of neighbour sequence of sequence listing upward to telomere on chrosomal short arm and 5'-terminus of this base sequence : 80758
tttacccaaggactcaggaaatgcatcataggaaaagcttttgagcaatgtcttgaattatataacacttggtggtttacgcagaggggtgtgtgtgtgtgtgtgtgtgtgtgtgtaatgccatttaatttagtaagtttttataagcattttagatccagacaacatatgtttaccaatttgtacctaactataaaacatttcataagaggaaatttatacagaggagaataattacaaattactttcaacatcccttcagtgttgaaat

SEQ ID NO: 1076 - DNA, 345 bp, Homo sapiens
  AL354724.3_44798
  Located on chromosome 1
  Distance between a terminus base of telomere on chromosomal short arm and 5'-terminus of this base sequence : 114523580
  Distance between 3'-terminus of neighbour sequence of sequence listing upward to telomere on chrosomal short arm and 5'-terminus of this base sequence : 241358
gttctgccgaggttaatatctaatcatcacatacacattcacaaaacacatttgaagtatggaattataaaatttggagttttcctcatgcatcaaaatccattccaggctgggtatggtggctcatgcctgtaatcccagcactttgggaggccaaggagggtggatggcttgagactaggagttcaaggtcagccagggcaacatggcaaaacctcatctcaaaaacaaacaaacaaacaaacaaacaaacaaacagttcctaccaggggaagaaactatgctatacgtcagtaatgggtcacgtagctttggtcctggaagtacaagctgattacatccaac

SEQ ID NO: 1077 - DNA, 404 bp, Homo sapiens
  AL358592.6_41483
  Located on chromosome 1
  Distance between a terminus base of telomere on chromosomal short arm and 5'-terminus of this base sequence : 114646112
  Distance between 3'-terminus of neighbour sequence of sequence listing upward to telomere on chrosomal short arm and 5'-terminus of this base sequence : 122187
ctaccagcaacagacattcacaaaggagcaaagaacacagcatcctgtataaggctaaaacaatttttaatatatataatgaaatagaattatttttttaaataaattgggttttgggttattattattattattattatttttagagacagggtcttgctctattgcccaggctggagtacagtgatacaatcacagctcagtgcatcctccaactcctgggctcaagaggtcctcctggctagctgggactacaggtgtgtgccaccacacctggataattttttttttttaatttttagtagagacagggtctcactatgttatccaggctggtctcaaactcctggcctcaactgatcctcccaccctggcctcccaaagtgctaggattataggcatga

SEQ ID NO: 1078 - DNA, 265 bp, Homo sapiens
  AL138933.4_19082
  Located on chromosome 1
  Distance between a terminus base of telomere on chromosomal short arm and 5'-terminus of this base sequence : 114931171
  Distance between 3'-terminus of neighbour sequence of sequence listing upward to telomere on chrosomal short arm and 5'-terminus of this base sequence : 284655
gcgtgacagagcaagactctgtcttaaaataaaataaaataaaataaaataaaataaatacaagaggcctgtatttttgccccctccactatatgaggacacgtagacagcaccatctctgaggaatgggccctcaccggacgcctaatctgctggtgccttgatcttggacttcccagcctccagagctgtgagcaatcaatatccattgtttataaattacctagtctatggtattttgttatagcagaccaaacagactagg

SEQ ID NO: 1079 - DNA, 228 bp, Homo sapiens
  G09558
  Located on chromosome 1
  Distance between a terminus base of telomere on chromosomal short arm and 5'-terminus of this base sequence : 114949346
  Distance between 3'-terminus of neighbour sequence of sequence listing upward to telomere on chrosomal short arm and 5'-terminus of this base sequence : 17910
ttctatcacctcctccctccccaccagcagcagcagcagcagcagcaggctaaaacttcctgatttcctaatgttctcatgaaggaacactttctcccctgggtcagagtcaaatgagaaacccaatgacggtgtcaggtcctgcccagggtggtgaaatgctgcttcagccttctccccatagtcccagctctgagtgtcctgctaaaggatcttctccttggttgc

SEQ ID NO: 1080 - DNA, 150 bp, Homo sapiens
  D1S2792
  Located on chromosome 1
  Distance between a terminus base of telomere on chromosomal short arm and 5'-terminus of this base sequence : 115008442
  Distance between 3'-terminus of neighbour sequence of sequence listing upward to telomere on chrosomal short arm and 5'-terminus of this base sequence : 58868
gatcgacttattggtgagtaactccgctgcctcagccttgtttgagagtgtgtgtgtgtgtgtgtgtgtgtgtatgtgtaagagagtgtgaggttaccagtctgggaggtaaaaggccccacatgaggggcccaacctcttgacctgtgt

SEQ ID NO: 1081 - DNA, 147 bp, Homo sapiens
  DISO7_10000683
  Located on chromosome 1
  Distance between a terminus base of telomere on chromosomal short arm and 5'-terminus of this base sequence : 115201530
  Distance between 3'-terminus of neighbour sequence of sequence listing upward to telomere on chrosomal short arm and 5'-terminus of this base sequence : 192938
caaactggcttcagtacaatattagaaagtgtgtgtgtgtgtgtgtatgtgtgtgtgtgtgtgtgtgtgtgtgtgcgcgcgcgcgttttaggacatacaggaagactaaaatgcttatccaaagcaaacataagacggatagtattc

SEQ ID NO: 1082 - DNA, 223 bp, Homo sapiens
  D1S221
  Located on chromosome 1
  Distance between a terminus base of telomere on chromosomal short arm and 5'-terminus of this base sequence : 115494082
  Distance between 3'-terminus of neighbour sequence of sequence listing upward to telomere on chrosomal short arm and 5'-terminus of this base sequence : 292405
cctacaactccatcctgtccatcaccgtgcaggagccgggcctgccaggcactagcactctgctcttccagtgccaggaagtgggggtgagtggtcgggggtgattggtcaggggtggggttcatcgaccatcaccccaccacacacacacacacacacacacacacacacacacacacttagcctgcctgactgctgcttcccaggcagagcgactgaagac

SEQ ID NO: 1083 - DNA, 271 bp, Homo sapiens
  D1S2651
  Located on chromosome 1
  Distance between a terminus base of telomere on chromosomal short arm and 5'-terminus of this base sequence : 115596746
  Distance between 3'-terminus of neighbour sequence of sequence listing upward to telomere on chrosomal short arm and 5'-terminus of this base sequence : 102441
accaggtgagcccctagtctacactgcactgcaccccccccccaccccggcgcacgcacacacacacacacacacacacacacacacaggcatgcacaggccctcctgtgagagatagccctaaggagggaaccgtccctagagccggtccccagccgctcggcacttcccgcccacgcgcccggtcccacagtgcagcggaccctcactcaccccgcggatgtcccagtaccccagtgtcatggacatgatgctggttggtgtcgattct

SEQ ID NO: 1084 - DNA, 400 bp, Homo sapiens
  AL355310.9_90354
  Located on chromosome 1
  Distance between a terminus base of telomere on chromosomal short arm and 5'-terminus of this base sequence : 115598822
  Distance between 3'-terminus of neighbour sequence of sequence listing upward to telomere on chrosomal short arm and 5'-terminus of this base sequence : 1805
ttcacattctgcatttccttacttaccttccgtctcagcctttccgtaattgaaagaggggttttagagcctcccattgttaatgtagaactgtctatttctcccttcaattctgtcaaattttgctgcatatatcttgttttattcctactatgggaattgcatcttgtatgagagaaatcaattatccttcctggatggtccaccagattatctgtgctttcctcattttagaagcttctgggtatccttccttccttccttccttccttcccttccttccttccttccttccttccttccttccttccttccttccttccttccttctttctttctttcttttctttctttctttcttttctttctttctttctttctttcgatggagtttcaatct

SEQ ID NO: 1085 - DNA, 245 bp, Homo sapiens
  AL353702.8_64443
  Located on chromosome 1
  Distance between a terminus base of telomere on chromosomal short arm and 5'-terminus of this base sequence : 115598977
  Distance between 3'-terminus of neighbour sequence of sequence listing upward to telomere on chrosomal short arm and 5'-terminus of this base sequence : -245
ggaattgcatcttgtatgagagaaatcaattatccttcctggatggtccaccagattatctgtgctttcctcattttagaagcttctgggtatccttccttccttccttccttccttcccttccttccttccttccttccttccttccttccttccttccttccttccttccttctttctttctttcttttctttctttctttcttttctttctttctttctttctttcgatggagtttcaatct

SEQ ID NO: 1086 - DNA, 418 bp, Homo sapiens
  AL355310.9_59233
  Located on chromosome 1
  Distance between a terminus base of telomere on chromosomal short arm and 5'-terminus of this base sequence : 115671283
  Distance between 3'-terminus of neighbour sequence of sequence listing upward to telomere on chrosomal short arm and 5'-terminus of this base sequence : 72061
gaatccaacataggacaattaaagtatagagtctatatatattaacaaaagtaggtttttttgttttgttttgttttgttttgtttttttgagacagagtcttactctgtcacccaggctgcagtgcagtggtgcgaactcggctcactgcaacttccgcctcctgggttcaaatgattctcctgcctcagcctcctgaacagctgggattacaggtgcccgccactacgcccagctaattttttgtatttttagtagagatggggtttcaccatgttggccaggctggtctcaaactcctgacctcaggtgattcgtctgtctcggcctcccaaagtgctgggattacaggcgtgagcaaccgcgcccggacacaaaagtaggtttaattctacagaattaaattgtgaaggccaat

SEQ ID NO: 1087 - DNA, 186 bp, Homo sapiens
  D1S418
  Located on chromosome 1
  Distance between a terminus base of telomere on chromosomal short arm and 5'-terminus of this base sequence : 116011128
  Distance between 3'-terminus of neighbour sequence of sequence listing upward to telomere on chrosomal short arm and 5'-terminus of this base sequence : 339427
tacttctttctaatctggatgccgtgtgtgtgtgtgtgtgtgtgtgtgtgtgtgtgtgtgtgtgtgtgtgtctgtctgtcttactacattggctagaacttcagtacaatgtcaagtagaaatgatggggatatctgtgtcttcttcccagaaagccttcagtctgtcaagttgttggccgtaggt

SEQ ID NO: 1088 - DNA, 152 bp, Homo sapiens
  D1S2746
  Located on chromosome 1
  Distance between a terminus base of telomere on chromosomal short arm and 5'-terminus of this base sequence : 116068357
  Distance between 3'-terminus of neighbour sequence of sequence listing upward to telomere on chrosomal short arm and 5'-terminus of this base sequence : 57043
tagcctgggcaacatagatacacacacacacacacacacacacacacacacacacacacatatacacacacacacacattatagtaatgaaaacagtatggtacttgcataaaaacaatatatagagcaaagggacagaatagagctcccag

SEQ ID NO: 1089 - DNA, 194 bp, Homo sapiens
  chr1.fa.O7frz.125199223
  Located on chromosome 1
  Distance between a terminus base of telomere on chromosomal short arm and 5'-terminus of this base sequence : 116134069
  Distance between 3'-terminus of neighbour sequence of sequence listing upward to telomere on chrosomal short arm and 5'-terminus of this base sequence : 65560
taatcctacatatttccggttctccttctagttctttgactgctctttttcaattcgttcttcttcataaagattgtttgggtcctttgcctttccatatacattttagaataagcttgttactttgtgtgtgtgtgtgtgtgtgtgtgtgtgaaaaatccctcctgggattttgatagcgattgtattgaatc

SEQ ID NO: 1090 - DNA, 320 bp, Homo sapiens
  chr1.fa.O7frz.125203457
  Located on chromosome 1
  Distance between a terminus base of telomere on chromosomal short arm and 5'-terminus of this base sequence : 116138369
  Distance between 3'-terminus of neighbour sequence of sequence listing upward to telomere on chrosomal short arm and 5'-terminus of this base sequence : 4106
actcaaagacatttggtttctcaagcacataatcccagttttatcaatcttttctttaaacacacacacacacacacacacacacatattagagagaatcttgctatgttgcccagggtggtctcaaatttctggcctcaagtgatcctcctgcctcagcctccctagtggctggaactacaggtgtgagtcacaacacttggctcatcaattttatttacattgtcattgtcaagccacagtgtctggcttttagcaaatggttaatgcagaggttccaaaattggttcaagataatttcacttgttaatagtgagtcc

SEQ ID NO: 1091 - DNA, 254 bp, Homo sapiens
  D1S487
  Located on chromosome 1
  Distance between a terminus base of telomere on chromosomal short arm and 5'-terminus of this base sequence : 116213132
  Distance between 3'-terminus of neighbour sequence of sequence listing upward to telomere on chrosomal short arm and 5'-terminus of this base sequence : 74443
caaggctgcagtgatcttgccactacacttcagcctgggtgacaaagggagactctgtctgtctttctctctcacacacacacacacacacacacacacacacacgaaacgtaaaaaagaaaaatctatagtaatcaactattctcatctaaatgttgcatatggttaacgtagaaaaataaatgacaagtcaatcagtaacactgtgcatagaaaccaccgttaagcacttcattcacctgttacagagatgc

SEQ ID NO: 1092 - DNA, 167 bp, Homo sapiens
  Z24192.1_123
  Located on chromosome 1
  Distance between a terminus base of telomere on chromosomal short arm and 5'-terminus of this base sequence : 116213141
  Distance between 3'-terminus of neighbour sequence of sequence listing upward to telomere on chrosomal short arm and 5'-terminus of this base sequence : -245
agtgatcttgccactacacttcagcctgggtgacaaagggagactctgtctgtctttctctctcacacacacacacacacacacacacacacacacgaaacgtaaaaaagaaaaatctatagtaatcaactattctcatctaaatgttgcatatggttaacgtagaa

SEQ ID NO: 1093 - DNA, 193 bp, Homo sapiens
  D1S2756
  Located on chromosome 1
  Distance between a terminus base of telomere on chromosomal short arm and 5'-terminus of this base sequence : 116304204
  Distance between 3'-terminus of neighbour sequence of sequence listing upward to telomere on chrosomal short arm and 5'-terminus of this base sequence : 90896
gtagaagcagagtccctggtggaggaaaagttggaggtgagttttgtttgtgtgtgtgtgtgtgtgtgtgtgtgtgtgtgttatgcaaggtgaataacaagactctgggcatccatacaaacatctgagaggtcagtgtttgctactgaaggcaaattaggtttattcacataaggcttcgtatgtgtcaaga

SEQ ID NO: 1094 - DNA, 464 bp, Homo sapiens
  chr1.fa.O7frz.122198820
  Located on chromosome 1
  Distance between a terminus base of telomere on chromosomal short arm and 5'-terminus of this base sequence : 116684484
  Distance between 3'-terminus of neighbour sequence of sequence listing upward to telomere on chrosomal short arm and 5'-terminus of this base sequence : 380087
ttctgtttcacttcaagtgtataacttaggcaagattcaggggaaaaggagaccttcagaattttgctattttgtgttgtttgtttgtttgtttgagatggatttttgctcttgtcgcccaggctggagtgtgatggcacgatctcggctcactgcaatctccacctcccgggttcaaacagttctcctgcctcagcctcccaagtagctgggattacaggcatgtgccaccacacctggctaaattttttttggtgttttttttgtttttgtttttgtttttagtagagatgggatttcatcatgttggttagggtggtctcgaactcctgacctcaggtgatccacccgccatggcctcccaaagtgttgggattacaggcatgagccactgcacccggcaaattttgctattttggaagttgaaataggtgcttcctagagatagcagatgtatccagttg

SEQ ID NO: 1095 - DNA, 277 bp, Homo sapiens
  chr1.fa.O7frz.122314469
  Located on chromosome 1
  Distance between a terminus base of telomere on chromosomal short arm and 5'-terminus of this base sequence : 116728215
  Distance between 3'-terminus of neighbour sequence of sequence listing upward to telomere on chrosomal short arm and 5'-terminus of this base sequence : 43267
gtttgagtatgctgacacagacaagtgggctgcagagctctcgggtaacgcacagacctttgtgttatttgggggtggttttttccttattggtctttaataaaattaataatgaatatcatttagggcttcattgctttccctagttctatcaaatatatatatatatatatatatatatatatatatatatatatgtataaaacatgttatttgattcaagccttgtgtatcttataactttgtgttgtcctttacttttatgaagctggctaga

SEQ ID NO: 1096 - DNA, 105 bp, Homo sapiens
  D1S2695
  Located on chromosome 1
  Distance between a terminus base of telomere on chromosomal short arm and 5'-terminus of this base sequence : 116843783
  Distance between 3'-terminus of neighbour sequence of sequence listing upward to telomere on chrosomal short arm and 5'-terminus of this base sequence : 115291
tgctggctcaggggactccaatctgctactggaaatgtgtgtgtgtgtgtgtgtgtgtgtgtgtgtgcattgcattcaccattcattctgtagccaatgccctcc

SEQ ID NO: 1097 - DNA, 276 bp, Homo sapiens
  AC019225.3_61090
  Located on chromosome 1
  Distance between a terminus base of telomere on chromosomal short arm and 5'-terminus of this base sequence : 116910582
  Distance between 3'-terminus of neighbour sequence of sequence listing upward to telomere on chrosomal short arm and 5'-terminus of this base sequence : 66694
agcaaaggtgaatggacagacaggaatccagggggttgttccctaatccaggatgtggctggtgcccacggggcctgaaggactctcttgcctgctgcagaatgagcccatggtggtggcagttgaggagggtagcaaggcaggctccctggccctgctatgagaggatggccggggccatgccgccctccctccctccctccctctgctcaccctcttggcagctcttcctgaacttgtttttccaagtcactaattaacttcacgctcagtttc

SEQ ID NO: 1098 - DNA, 207 bp, Homo sapiens
  D1S457
  Located on chromosome 1
  Distance between a terminus base of telomere on chromosomal short arm and 5'-terminus of this base sequence : 117026614
  Distance between 3'-terminus of neighbour sequence of sequence listing upward to telomere on chrosomal short arm and 5'-terminus of this base sequence : 115756
gggggcaataacacaaaggaaatgaaaacaatcacttattttaactacagcatggatccaacttattcatttgttgtggaaacacacacacacacacacacacacacacacatacacatcacaggcaatattttggctgttactcttaatggaatctaggccttttccatctaaccataaaacttactagcactcttggctccaggc

SEQ ID NO: 1099 - DNA, 471 bp, Homo sapiens
  chr1.fa.O7frz.122788158
  Located on chromosome 1
  Distance between a terminus base of telomere on chromosomal short arm and 5'-terminus of this base sequence : 117147910
  Distance between 3'-terminus of neighbour sequence of sequence listing upward to telomere on chrosomal short arm and 5'-terminus of this base sequence : 121089
cggaatcatacagtatttgtctttttgtgactggcttatctcacttaacatagcatcttcaagattcatcaattttgtagcacgtgttagaatgtcctttctttttaagactgaataatattcatatatatatatacacacacacacacacacacacacacagacatacacacatatgccacattttgtttatccattcctctgtggatggacacttgatcctaccttttggctattgtgcataatgctgctacaaacatgggtatacaaatatctttttggaacccagctttcaattcatctgagtgaactgaagaatcccacaagtggaattattgaatcatacagtgttctacttttaattttttgaggaattgccatactgttttccatagtggctgcacgatttcacatgcataccagcaatatacaaggtttccagcttctctaagtatttgctaacactcgttt

SEQ ID NO: 1100 - DNA, 354 bp, Homo sapiens
  AC068519.1_166905
  Located on chromosome 1
  Distance between a terminus base of telomere on chromosomal short arm and 5'-terminus of this base sequence : 117179122
  Distance between 3'-terminus of neighbour sequence of sequence listing upward to telomere on chrosomal short arm and 5'-terminus of this base sequence : 30741
actcttgtctggatgtagtggtagtctggatatggaaataagtttctaaaaatttagataggctgggcacagtggctcacacctgtaatcccagcactttgggaggccaaggcaggtggatcacctgaggtcaggagtttgaggccagcctggccaacatggcgaaaccctgtcttaactaaaaataaaaaaaattagctgggtgtggtggtgggtgcctgtagttccaactacttgggaggctgaggcaggactctcttgaaccactccagcctaggcgacagagtgagactctgtctctaaataaataaataaataaataaaagtttagataaatttcaggatgtcagactg

SEQ ID NO: 1101 - DNA, 277 bp, Homo sapiens
  AL390797.5_14156
  Located on chromosome 1
  Distance between a terminus base of telomere on chromosomal short arm and 5'-terminus of this base sequence : 117183279
  Distance between 3'-terminus of neighbour sequence of sequence listing upward to telomere on chrosomal short arm and 5'-terminus of this base sequence : 3803
gtgaaccagtgaactgaggtcgcgccactgcattccagcctgagtgacagagcaagactctgtctcaaaaaagaaagaaagaaagaaagaaagaaagaaagaaagaaagaaagaaagaaagaaagaaagaaagagaaagaaagaaagaaatttggacagagaaacagacacatatagagggaaaatggtgtgaagagatacagggagaagatggccatctacaaaacaaggagccaaccctgctggcaccttgctcttgaactttcagtttccagaa

SEQ ID NO: 1102 - DNA, 175 bp, Homo sapiens
  D1S2708
  Located on chromosome 1
  Distance between a terminus base of telomere on chromosomal short arm and 5'-terminus of this base sequence : 117197922
  Distance between 3'-terminus of neighbour sequence of sequence listing upward to telomere on chrosomal short arm and 5'-terminus of this base sequence : 14366
agtccaaggtgtccataggaagtaatttcattttgagaaatcattttaggtgggaaggaagtaaataattgtgtgtgtctgtgtgtgtgtgtgtatatgtgtgtgtgtgtgtgtgtgtgtgcgcgcgcacgctggaggtggggttaggaaatcatgcccagtgggcttggacatc

SEQ ID NO: 1103 - DNA, 261 bp, Homo sapiens
  AL365361.8_57889
  Located on chromosome 1
  Distance between a terminus base of telomere on chromosomal short arm and 5'-terminus of this base sequence : 117289230
  Distance between 3'-terminus of neighbour sequence of sequence listing upward to telomere on chrosomal short arm and 5'-terminus of this base sequence : 91133
tgacctttctgagtagcagtttacttataaaataggtaggacactagccccgcccacccccttgcttcatagggcttaaagacagaatgaggaaggaaggaaggaaggaaggaaggaaggaaggaaggaaggaaggaaggaaagggaccttcattgttagtgtgtgttaacatctcattggttaggactacagaggataatacccatggaggtgcatggagaagcaaagcctggtcagtgtggaacaggactctgttaatg

SEQ ID NO: 1104 - DNA, 278 bp, Homo sapiens
  D1S2726
  Located on chromosome 1
  Distance between a terminus base of telomere on chromosomal short arm and 5'-terminus of this base sequence : 117319943
  Distance between 3'-terminus of neighbour sequence of sequence listing upward to telomere on chrosomal short arm and 5'-terminus of this base sequence : 30452
ctggatggatgctcaaatacttgcattgagtggataaatgcaactgaagtagaagtgaaagatcgtgtgtgactaaacaaaagagaaaagggaagagaaaggagaggtttagtgcatttgtgagtgtgtgtgtgtgtgtgtgtgtgtgtgtgtgtgtgtgtagggagggaagatggtaataatgctaggagaaaggcagcatttcatgactggcagaaatgggttccatggtaccactgcatggtcgacttaaatacaggaaaccctgcaacttgtgg

SEQ ID NO: 1105 - DNA, 338 bp, Homo sapiens
  AL136374.4_35981
  Located on chromosome 1
  Distance between a terminus base of telomere on chromosomal short arm and 5'-terminus of this base sequence : 117422519
  Distance between 3'-terminus of neighbour sequence of sequence listing upward to telomere on chrosomal short arm and 5'-terminus of this base sequence : 102298
ttcttgtaaatctgaaatcgagaatgtgacttttgcctcaaatgagcctccaatatcttcttaaactgtgaatctaaaccttaggatagctctaccctctggccagctctttaaagaaagaaatgtcagaaggtggagagagagagagagagagagagagaaagaaagagagaggacatctgacctgcctaaggtgccagatctggctgcaacatgtctcctaggtgcatgaaggaaaggcaagcaaaaggggagcagaacatggggtttggcctttaaacacacagtgtctctgcccatgggaaaaagcattctacttgatggattaggataatagc

SEQ ID NO: 1106 - DNA, 300 bp, Homo sapiens
  AL136374.4_60851
  Located on chromosome 1
  Distance between a terminus base of telomere on chromosomal short arm and 5'-terminus of this base sequence : 117447296
  Distance between 3'-terminus of neighbour sequence of sequence listing upward to telomere on chrosomal short arm and 5'-terminus of this base sequence : 24439
tacttcacttagcatgccttcaacgttcatccatgttgtagcatatgtcaggattttcttcctttttaaagctgaataatattccattgtagctgtatactacattttgtttattcattcatccatcaatggacacttggattgcttccaccttttgacaactgtgtataacattgctgtgaacctgaatgtacgcatttctgtttgggtctctgattttgattcttctatatatatatatatatatatatatatatatatatatatacacagaagtggaattgctggatcataggtatt

SEQ ID NO: 1107 - DNA, 364 bp, Homo sapiens
  AJ243474.1_1202
  Located on chromosome 1
  Distance between a terminus base of telomere on chromosomal short arm and 5'-terminus of this base sequence : 117549791
  Distance between 3'-terminus of neighbour sequence of sequence listing upward to telomere on chrosomal short arm and 5'-terminus of this base sequence : 102195
tatagatttgtgaatctttggaacagacagatagtaattagagccatcagaatgggtgagataattaggaaaatatgagttcagccagaagcctctcctcagccccaccacttcagggacctgtaagcatggcagcagctctgagtgagggtcagtgattccagccgaggtgcagagactttttaatagcattccctaaagtgtagttacactgaaaaattgttccccaagagaaactacacacacacacacacacacacacacacacacaccacacagttccatgctcagataagtttggagaaatctatatattatttcccctgcttagagaatattaaggactgacaagttctgcagtaaa

SEQ ID NO: 1108 - DNA, 137 bp, Homo sapiens
  D1S2809
  Located on chromosome 1
  Distance between a terminus base of telomere on chromosomal short arm and 5'-terminus of this base sequence : 117549952
  Distance between 3'-terminus of neighbour sequence of sequence listing upward to telomere on chrosomal short arm and 5'-terminus of this base sequence : -203
cagccgaggtgcagagactttttaatagcattccctaaagtgtagttacactgaaaaattgttccccaagagaaactacacacacacacacacacacacacacacacacaccacacagttccatgctcagataagtt

SEQ ID NO: 1109 - DNA, 408 bp, Homo sapiens
  AL391064.11_71795
  Located on chromosome 1
  Distance between a terminus base of telomere on chromosomal short arm and 5'-terminus of this base sequence : 117567547
  Distance between 3'-terminus of neighbour sequence of sequence listing upward to telomere on chrosomal short arm and 5'-terminus of this base sequence : 17458
gatcaccaggtcaggagttcgagatcagcctggccaacatggtgaaaccccgtctctactaaaaaaaaatacaaaaattagccgggcgtggtgacgggcgcctgtaacccagctactcgggaggctgaggcaggagaatggcttgaatctggaaggtggaggttgcagtgagctgagatcatgccactgcatgccagcctcggcgaaagagcaaaactccgtcaaataaataaataaataaataaataaataaataaagactaaataatcatgggttcaatttattgagtaccggtcttgctgtatgccagtctgtgtgataagatcatttaatattcacaaccaccctataagggataagtgttggcccgttttacataggaagaaattgtgactggaactgttaag

SEQ ID NO: 1110 - DNA, 428 bp, Homo sapiens
  AL391064.11_99830
  Located on chromosome 1
  Distance between a terminus base of telomere on chromosomal short arm and 5'-terminus of this base sequence : 117593505
  Distance between 3'-terminus of neighbour sequence of sequence listing upward to telomere on chrosomal short arm and 5'-terminus of this base sequence : 25550
ctggctaacacggtgaaaccccatctctactaaatatagaaaaaaacattagccgggcgcggtggcaggcgcctgtagtcccagctattcgggaggctgaggcaggagaatggggtgaacccgggaggcggagtttgcagtgagccgagatagcgccaatgcactccagcctgggcgacagagcgagactccgtctcaaaaaataaataaataaataaataaataaatttacttactatgttcaaaaatgtacaaaaccgtattatttagggataccctcaccaacagcaaaagcacaaagtaaaggaagaaagtcactatcataaagtcagaacagtgactatccatggaggaggagaacaagtggtgattgtgaaggaatatgcaggaaactcttgggatgccagtaatgtttcattcttgatccg

SEQ ID NO: 1111 - DNA, 291 bp, Homo sapiens
  Z67516
  Located on chromosome 1
  Distance between a terminus base of telomere on chromosomal short arm and 5'-terminus of this base sequence : 117640076
  Distance between 3'-terminus of neighbour sequence of sequence listing upward to telomere on chrosomal short arm and 5'-terminus of this base sequence : 46143
agcttcagaaagtcatctggtaaatgtcccaaatatatgatgtaaaacctcaatgatttaaataaatacattcaaaaataataaaaacaatgcataaatcaatgagttaatgaactcaaaatgacttatgaatgtaatttgtaatttaaaaatctccaaatccccaaaaggattagaaactggataacagagttaagggtacacacacacacacacacacacacacacacacacaaagtaaagttgtttatcttactttttgtatttaaaaatgcaatcctaaaacaaatt

SEQ ID NO: 1112 - DNA, 409 bp, Homo sapiens
  AL139154.5_94222
  Located on chromosome 1
  Distance between a terminus base of telomere on chromosomal short arm and 5'-terminus of this base sequence : 117832121
  Distance between 3'-terminus of neighbour sequence of sequence listing upward to telomere on chrosomal short arm and 5'-terminus of this base sequence : 191754
ctagagtgctttggttattctgaggtttttgtgattccatacacattttaggattttttttctatttctgtgaagaatgtcattggtattttgatagggattgcattgaatctgtagattgctttgggtagtatggccattttgacaatattaattcatggacatgggatgacttttcattttgtgtgtatgtcctcctcagtttcttttattagtgctttgtagttttcattgtggagatctttcaactccttggttaaatttattcccaagtattttattttattttattttattttattttattttattttattttattttattttattttatttagctgttgttaatggggttgccttcttgatttttttccagctagtttgttattggtgtatggaaatgctac

SEQ ID NO: 1113 - DNA, 343 bp, Homo sapiens
  chr1.fa.O7frz.123778194
  Located on chromosome 1
  Distance between a terminus base of telomere on chromosomal short arm and 5'-terminus of this base sequence : 117910287
  Distance between 3'-terminus of neighbour sequence of sequence listing upward to telomere on chrosomal short arm and 5'-terminus of this base sequence : 77757
caacctgtcagaagtcagttacagccagagtaggcagagagaagaagtagtgttagaagacctatgtagatttctgcacacagaaagaaggaagaaagatcaggctacctaacttttttggttctgtgttaactcctccgtgaacacccttcaatatgaatgggcttccatggcacccatccttctaattatcaaattttctccccttcctaatacttgcttaggtgttgatgcaaataaaaatgtcttcatttattcattcattcttgcattcattcattcattcattcattcagtaaattcattcagtaagtaattgtttaccagtttagtggttgaaagt

SEQ ID NO: 1114 - DNA, 192 bp, Homo sapiens
  D1S2789
  Located on chromosome 1
  Distance between a terminus base of telomere on chromosomal short arm and 5'-terminus of this base sequence : 118135492
  Distance between 3'-terminus of neighbour sequence of sequence listing upward to telomere on chrosomal short arm and 5'-terminus of this base sequence : 224862
ctaggcaacagagcaagactctctcaaacacacacacacacacacacacacacacaaacaacaaattcagatagcagtagagctttttatcatggtcagaacatgattagattctaaaatatgcagcttccaaaacaatctttaggaatatgttcaagtattttgttattactgtttttattttgagccttg

SEQ ID NO: 1115 - DNA, 474 bp, Homo sapiens
  AL357633.6_51293
  Located on chromosome 1
  Distance between a terminus base of telomere on chromosomal short arm and 5'-terminus of this base sequence : 118285092
  Distance between 3'-terminus of neighbour sequence of sequence listing upward to telomere on chrosomal short arm and 5'-terminus of this base sequence : 149408
gtattgtacaagaactggctcatcaggacatccagcacctaatgtttttctatttaatgatattagagaacagtgaggccttacaatggccacaagagttcatttgaattcattttcttttatttatttatttatttatttatttatttatttttattgattattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcactgcccttaatccatttaaccctgagtggacacagcacatgattcagagagcacagggttgggggtaaggtcacagatcaacagga

SEQ ID NO: 1116 - DNA, 330 bp, Homo sapiens
  AL049557.19_79480
  Located on chromosome 1
  Distance between a terminus base of telomere on chromosomal short arm and 5'-terminus of this base sequence : 118406190
  Distance between 3'-terminus of neighbour sequence of sequence listing upward to telomere on chrosomal short arm and 5'-terminus of this base sequence : 120624
ggtagctaactagctaaggcaggcactgtcctgagaaggctcccccaccccatacacacacacacacacacacacacacacacacacagacatttcatctccccaactaccctatgaggtagtgactattactgttcccatttcacaggtaatttgcccaagataagatagtaagaggtggggctgagatcagcttgaagtgcacaaagctgtagtgcccatcctcatccttttttgagtctgagcgctcttcctccctgggcctccctgaaatgatgacagtgatgatggcggaaaaaacaatatgagaatctgctttgtaacaggaat

SEQ ID NO: 1117 - DNA, 456 bp, Homo sapiens
  HUMUT421B
  Located on chromosome 1
  Distance between a terminus base of telomere on chromosomal short arm and 5'-terminus of this base sequence : 118410498
  Distance between 3'-terminus of neighbour sequence of sequence listing upward to telomere on chrosomal short arm and 5'-terminus of this base sequence : 3978
gaaaagggggcagtaagggaggtagaggaaaggagaggggccagctcagatagacaaaatcccgagcagacatgagtagctctaaacccatctccaggctgcagggtgcggagttcctccggagcctcttactgtcttggagcctcaggttcttcctcagaacaagcttgctctcaggggtcagctgagagaattcacaagaaggtcgacctggtcctgattagtttgagcaagagccacctctttctaacccactcctagtctctctctctgttacacacacacacacacacacacacacacacacagaactaacctgctccaccatcaaaggtaaaacccttaataaccatattccaatgaagattgtgggaatccctcctgtgaaaagccaggaaaggtcttctcacctgcttgttgcctccataccaccccacagtccctctcccaccctca

SEQ ID NO: 1118 - DNA, 246 bp, Homo sapiens
  D1S2837
  Located on chromosome 1
  Distance between a terminus base of telomere on chromosomal short arm and 5'-terminus of this base sequence : 118410721
  Distance between 3'-terminus of neighbour sequence of sequence listing upward to telomere on chrosomal short arm and 5'-terminus of this base sequence : -233
gtttgagcaagagccacctctttctaacccactcctagtctctctctctgttacacacacacacacacacacacacacacacacagaactaacctgctccaccatcaaaggtaaaacccttaataaccatattccaatgaagattgtgggaatccctcctgtgaaaagccaggaaaggtcttctcacctgcttgttgcctccataccaccccacagtccctctcccaccctcagcgtctctggaag

SEQ ID NO: 1119 - DNA, 395 bp, Homo sapiens
  AL357144.11_30919
  Located on chromosome 1
  Distance between a terminus base of telomere on chromosomal short arm and 5'-terminus of this base sequence : 118516667
  Distance between 3'-terminus of neighbour sequence of sequence listing upward to telomere on chrosomal short arm and 5'-terminus of this base sequence : 105700
ctggccgacatagtgaaaccccgtctctactaaaaatacaaaaaattagccgggcatggtggcaggcgcctgtaatcccagctactcgggaggctgaggcaggagaatggcttgaacctgggaggcggaggttgcagtgagccgagatcgcaccactgcactccagcctgggcgacagagcgagagtccgtctcaaaaaaacaaaaacaaaagcaaaaacaacaacaacaacaacaacaacatcaacaaaagcacacacaacagatgaggccaaagacagagacctcttcacaaatcaccttttaagatgttctgttgacacttgggaaaaagggctggcacttttggaggacagttttgaagtcaaatggttgtactattgtccagatcacatc

SEQ ID NO: 1120 - DNA, 357 bp, Homo sapiens
  AL357144.11_129577
  Located on chromosome 1
  Distance between a terminus base of telomere on chromosomal short arm and 5'-terminus of this base sequence : 118524380
  Distance between 3'-terminus of neighbour sequence of sequence listing upward to telomere on chrosomal short arm and 5'-terminus of this base sequence : 7318
caataagtgtaaaccaggacagtcccacacaaactaggatatatggccaccctaactatcatccacttatactgaaatatttgctgttctccaaacactccgtgttctttcacttctgggccactgaacacacagttccctctgccagaaaaagcccatttatcctctttcgggagctcttccctgatgttactttccccgggttatgtaagatacctttcctctgtacacccatgacactctctgctgctgctgctgctgctgctgctgctgctgctgataaaagaatggcagccaatgttacctgggggtggggtgcaggacagaacagcacagtagttgagcctatggacaatg

SEQ ID NO: 1121 - DNA, 425 bp, Homo sapiens
  chr1.fa.O7frz.124610085
  Located on chromosome 1
  Distance between a terminus base of telomere on chromosomal short arm and 5'-terminus of this base sequence : 118643430
  Distance between 3'-terminus of neighbour sequence of sequence listing upward to telomere on chrosomal short arm and 5'-terminus of this base sequence : 118693
aggctcatctaaggaccagaagatccagctctggatcagaatgctgcctctggtgtgagagaagggtcacctctgaagaggtaatcttccaagaatggagggactctagatggcaggaagagggcaggatcctaaagttccctaagtcaacaatggcccaggttaccctgagaactccctcctccctccccgaccccttatggccagcaaaaccacacacacacacacacacacacacacacacacacacacacacacacacacgccaggagcatggtgtcaggttctgagtctctcctccaacttccactttttgcccagagtacttgccctttccagctctccaaaccagctttctcatgtgatttacaccctcctataagttctagctcttctgtgatttctctaagtggaacagattgatg

SEQ ID NO: 1122 - DNA, 258 bp, Homo sapiens
  D1S502
  Located on chromosome 1
  Distance between a terminus base of telomere on chromosomal short arm and 5'-terminus of this base sequence : 118643493
  Distance between 3'-terminus of neighbour sequence of sequence listing upward to telomere on chrosomal short arm and 5'-terminus of this base sequence : -362
gggtcacctctgaagaggtaatcttccaagaatggagggactctagatggcaggaagagggcaggatcctaaagttccctaagtcaacaatggcccaggttaccctgagaactccctcctccctccccgaccccttatggccagcaaaaccacacacacacacacacacacacacacacacacacacacacacacacacacgccaggagcatggtgtcaggttctgagtctctcctccaacttccactttttgcccag

SEQ ID NO: 1123 - DNA, 317 bp, Homo sapiens
  chr1.fa.O7frz.124666375
  Located on chromosome 1
  Distance between a terminus base of telomere on chromosomal short arm and 5'-terminus of this base sequence : 118699679
  Distance between 3'-terminus of neighbour sequence of sequence listing upward to telomere on chrosomal short arm and 5'-terminus of this base sequence : 55928
ttaacagatagtccgtgctaagctgtgactgttaatcctttctaagccgtgaaatgctactttctggttttgcaagtgattctcaaccaggtgaaactttatagttctccagactttctgaatcctggcccagcacaagcccctgcaacacatagactaaagggttttttgttttgttttgtttttgcttttgttctttgaaatacaaaatgactttgacacatcgatcaacctaaggaagctataaggaggagtgtgtgtgtgtgtgtgtatgtgtgtgtgtgtgtttgtgtgtgtgctttaagcatcactgaata

SEQ ID NO: 1124 - DNA, 430 bp, Homo sapiens
  chr1.fa.O7frz.124832112
  Located on chromosome 1
  Distance between a terminus base of telomere on chromosomal short arm and 5'-terminus of this base sequence : 118848897
  Distance between 3'-terminus of neighbour sequence of sequence listing upward to telomere on chrosomal short arm and 5'-terminus of this base sequence : 148901
ctgatagcgagtatctcaacatgcttccaacatgatggcatgatgggtgacagagcgagactatgtctgaaagaaggaaagagagaaggaaagcaagaaagcaagaaagcaagcaagcaagcaagaaagaaagaaagaaagaaagaaagaaagaaagaaagaaagaaagaaaagaaacacagagagagagggagggagggaggaaggaaggaaggaaggaaggaaggaaggaaggaaggaaggaaggaaggaaggaaagaaaacccagagaagcgactgggagatgaaactgtggctggtcttaaatattcaactttcaacagagtccacagctcctaagaactctaatatattagaaatgctgctaagacccttcattcgatgtgcatctttcagattattctagaatcagatcaggcttctaactaca

SEQ ID NO: 1125 - DNA, 271 bp, Homo sapiens
  AL158844.8_107945
  Located on chromosome 1
  Distance between a terminus base of telomere on chromosomal short arm and 5'-terminus of this base sequence : 119115947
  Distance between 3'-terminus of neighbour sequence of sequence listing upward to telomere on chrosomal short arm and 5'-terminus of this base sequence : 266620
caatggtcgcctcttgtagaaatacttgccaatcatggtcagagctggattcaagttgaaggcaagcccaagacctgtgaagacaataaataaataaataaataaataaataaataaataaataaataaataataagaggtataaataatggaaggaataggatataaatcctcattattagaggacatgttatgtagtggtttaaagtatgacttctaaaacagacatgggttcaaatctcagtatcagtgcttactggttgcataatct

SEQ ID NO: 1126 - DNA, 442 bp, Homo sapiens
  AC073965.1_67586
  Located on chromosome 1
  Distance between a terminus base of telomere on chromosomal short arm and 5'-terminus of this base sequence : 119406046
  Distance between 3'-terminus of neighbour sequence of sequence listing upward to telomere on chrosomal short arm and 5'-terminus of this base sequence : 289828
taccttagactgttgcttggagagcttttacaaaataccattgttgagaacacttggacacagggtggggaacatcacatgccagggcctgttgtggggtggggggaggggggagggatggcattaggagatatacctaatgtaaatgatgagttaatggatgcagcacaccaatgtggcacatctatacatatgtaacaaacctgcacgttgtgcacatgtaccctagaacttaaagtataataataataataataataataataataataataataataatattggccttatcccagtgattctctgatttgtttggtctggggtgggacttaactatcaatattaatcttccctagtgaggctaatgtgcagccgtgatggagaaccactgaaccataagcaatttttgcttattgaatgttagttgaggaaatctgtg

SEQ ID NO: 1127 - DNA, 318 bp, Homo sapiens
  AL365225.6_170281
  Located on chromosome 1
  Distance between a terminus base of telomere on chromosomal short arm and 5'-terminus of this base sequence : 119615263
  Distance between 3'-terminus of neighbour sequence of sequence listing upward to telomere on chrosomal short arm and 5'-terminus of this base sequence : 208775
gtgacagagtgagactccatctcaataataataataataataataataataataatacatgtaccattgtgccctttcactctgtgttcacctcatcaaagcaaaagcaaagaccctgcctctgaactatcccacaaagctggcaatcttcaatcactgactagactatgggttcatctcatcatatttacctttttgtttttttagagattcttccctggtttttttttttaggggttaaatatttttcttatgtaccagggatttgggtttatttgtttttaataaaagtggttcttggcatctacagattgctat

SEQ ID NO: 1128 - DNA, 361 bp, Homo sapiens
  AL365225.6_47608
  Located on chromosome 1
  Distance between a terminus base of telomere on chromosomal short arm and 5'-terminus of this base sequence : 119722573
  Distance between 3'-terminus of neighbour sequence of sequence listing upward to telomere on chrosomal short arm and 5'-terminus of this base sequence : 106992
gtgagaaacaagctgtcttcacattagattttataagaagtgagactttaaaaacgcaactggtgacacgaatcttttgattatatgtaaggaaataaatagtttattattttagtgaacaaaaaatttcttaagtatagagcatatagtttgtacactaataggaactgtaaaaatgaggttcagatgccattgtgactacagcattctgagaaagggggtctgggaaaggattttgtcagtttcttccatacaaataacccagtgtattagtggataatggatggatggatggatggatggatggatggatggatggatggatggatatatattaactcagtgcaataaccatgtaata

SEQ ID NO: 1129 - DNA, 395 bp, Homo sapiens
  chr1.fa.O7frz.127537315
  Located on chromosome 1
  Distance between a terminus base of telomere on chromosomal short arm and 5'-terminus of this base sequence : 119986191
  Distance between 3'-terminus of neighbour sequence of sequence listing upward to telomere on chrosomal short arm and 5'-terminus of this base sequence : 263257
aataccaagcattcttaatacctcaatgccctttaatctatctggaatcatctccctctccctaatcccaacttatttatttatttatttatttatttatttatttgactcggtctatcaccaggctggaatgcagtggcacgatcttggctcattgcaacctccacctcctgggttcaagtgattctcctgcctcagcctcctgagtagctgggactacaggcgtgcaccaccacacccagataatttttgtatttttagtagagacggggtttcacaatgttggccaggatggtctcgatctcttgacctcatgatccgcccgccttggcctcccaaagtgctggaattacaggcgtgagccaacttatctttaaagactgcttaaacatcag

SEQ ID NO: 1130 - DNA, 317 bp, Homo sapiens
  AL133517.11_57833
  Located on chromosome 1
  Distance between a terminus base of telomere on chromosomal short arm and 5'-terminus of this base sequence : 120072461
  Distance between 3'-terminus of neighbour sequence of sequence listing upward to telomere on chrosomal short arm and 5'-terminus of this base sequence : 85875
gttatttgcatgctagaaacacacacacacacacacacacacacacacacacacgtgtgaagaacacagatttctgtacatagtaatttttaagactaggatgctacagagtggtggtgatacttactcttatattaaatcctagaagatcacttataacacctgagacagcagaaaggataactactcttgtgatattgtagattaagggattcattgtcagtccatagagtctaaatggtgtgtccagctcctacaaaaaacatcaaagaattgaaatgagatacatgttttctcatagctactcagtgacttct

SEQ ID NO: 1131 - DNA, 421 bp, Homo sapiens
  AL133517.11_57362
  Located on chromosome 1
  Distance between a terminus base of telomere on chromosomal short arm and 5'-terminus of this base sequence : 120072809
  Distance between 3'-terminus of neighbour sequence of sequence listing upward to telomere on chrosomal short arm and 5'-terminus of this base sequence : 31
cttaaggctgtctttccttaatattcaaagagctaccttcaaaaaatccataacgtgttctcacctacttttctactaactaagatttttttaggtggatttgagcaatatgtcatttgtagttttatatatatatatacacacacacacacacacacacacacacacacacacacatacacacatatataaaatatgacagacatcagcaatcatcagaacctgggtaacaaaattggaaattttttcacagtagttattaacccaaaaccatcaggtcagcattttgaatctacacagcctagcatctatctcttactgggttctgagaagtaaaacattaattaatgtatttaaaacaggttaactcactttatttttctggtataaaaccaccacatggtggccatagctagagctt

SEQ ID NO: 1132 - DNA, 290 bp, Homo sapiens
  AL137856.4_81146
  Located on chromosome 1
  Distance between a terminus base of telomere on chromosomal short arm and 5'-terminus of this base sequence : 120233484
  Distance between 3'-terminus of neighbour sequence of sequence listing upward to telomere on chrosomal short arm and 5'-terminus of this base sequence : 160254
tgtatgctcatgagtgaacaagtgagtgaatgaatgaatgaatgaatgaatattcttttgcagtcataaatagtacaaactaagttgtcaatgccatgttccaagatcaggatcagtaagcaatgggtacaaagagatagtaatgattgaatttgggagaaagtatgagtttatagagagaaatggaacttacagggcaaaatatccttatatctgtttttcttgatattcttgggcttctcagccacagttgtaggataggttttgtctgccttgtacttggtagattg

SEQ ID NO: 1133 - DNA, 440 bp, Homo sapiens
  AC027074.3_104546
  Located on chromosome 1
  Distance between a terminus base of telomere on chromosomal short arm and 5'-terminus of this base sequence : 120298786
  Distance between 3'-terminus of neighbour sequence of sequence listing upward to telomere on chrosomal short arm and 5'-terminus of this base sequence : 65012
gattctaccattcagctggaccaggccattcttcccagattgtcagtcaccactcatactatgagtaatcctatataggaaccacacagcttctgcccaaactatgccactaaaaccgctctctcgaagatcaaatactatctctctctctctctctctctctctctctccctctctcagagatgggagtagtggctctcaccaatatcagtaatatctatctatctatctatctatctatctatctatctatctatctatccatccatccatccatccatgtatctaatctatctaccttagagatgggggtctcaatatgttgcccaggctggatttgaactcctgggctcaagcaatcctcctgcctcagcctcctgagaagctgggactataagcacatgccatcatggaccagctagcagtgacctttccataag

SEQ ID NO: 1134 - DNA, 368 bp, Homo sapiens
  AC027074.3_150221
  Located on chromosome 1
  Distance between a terminus base of telomere on chromosomal short arm and 5'-terminus of this base sequence : 120385117
  Distance between 3'-terminus of neighbour sequence of sequence listing upward to telomere on chrosomal short arm and 5'-terminus of this base sequence : 85891
aatcaaagagtgactagactgcagaagaaagtgttgtcaattcccttacttaacaaagctgatgcttaataataacaaacatttttcttggatctcaggtacacaggattattccgcccttcatctcatctcacagtgtcatcaatggtccatgcaagaactctgccattcattcattcattcattcattcacttattcattcattctttttatccccatcccctatatcccatcactgttttaatttgtttaatgttgaatcttgaaaagcacacatcattgttttgtggctgcggatttttaatttatgtgaatagggttgtgatatagctcattatgtttcttgtcttctattcaggaccatggt

SEQ ID NO: 1135 - DNA, 490 bp, Homo sapiens
  AC027074.3_36967
  Located on chromosome 1
  Distance between a terminus base of telomere on chromosomal short arm and 5'-terminus of this base sequence : 120433938
  Distance between 3'-terminus of neighbour sequence of sequence listing upward to telomere on chrosomal short arm and 5'-terminus of this base sequence : 48453
atagagccaacagcacttgtagattggatgtgagagatataatagtggcccagctaagactaaaatgaaagtgactttgagcacaatgtgaggcccatttttccatactagggcttgcattctcaaattaatccccaccagattaaaggatgatgggaaaacggggaactaatacatatatatctatctaaatctatctatctatctatgtatctatgtatctatctatctatctatctatctatctatctatctatctatctatctatattttgagatagagtcttgctctgttgcctaggctggagtgcagtggtgcaatctcagctcactgcaacctccacttccagggttcaggttgatcctcccaccttagactccagagtagctgggactacaggtgcatgccaccacacccacctaattaattttttgtaaagccagggtttcaccatgttgcccaggttggtctcaaacttctgagctcaag

SEQ ID NO: 1136 - DNA, 213 bp, Homo sapiens
  D1S2881
  Located on chromosome 1
  Distance between a terminus base of telomere on chromosomal short arm and 5'-terminus of this base sequence : 120544570
  Distance between 3'-terminus of neighbour sequence of sequence listing upward to telomere on chrosomal short arm and 5'-terminus of this base sequence : 110142
atctgccagcccatgatcttggacttcccagcctctagaactatgagaaacaaattattgttgtttataagtgatctagttaatgatgttctgttatagtagcccaaaaggactaagacacacacacacacacacacacacacacacacacacacacacacacacagagagagagagaagagagaagaaaaggtctacaaacagagcctggca

SEQ ID NO: 1137 - DNA, 123 bp, Homo sapiens
  HUMUT7380
  Located on chromosome 1
  Distance between a terminus base of telomere on chromosomal short arm and 5'-terminus of this base sequence : 120594865
  Distance between 3'-terminus of neighbour sequence of sequence listing upward to telomere on chrosomal short arm and 5'-terminus of this base sequence : 50082
ctttgttcactgttatacccctaaaacctggatcagtgcctggcctaaaataggaactcagtgaacatttgctgaatgaatgaatgaatgaatgaatgaatgaactagcagtgattgaaaaag

SEQ ID NO: 1138 - DNA, 277 bp, Homo sapiens
  AL035410.7_113035
  Located on chromosome 1
  Distance between a terminus base of telomere on chromosomal short arm and 5'-terminus of this base sequence : 120718948
  Distance between 3'-terminus of neighbour sequence of sequence listing upward to telomere on chrosomal short arm and 5'-terminus of this base sequence : 123960
taattccagtgtcttgtaattgtctagcttttgaagattctcagaaccatctcattaagatctcacagaaattgagctctccaactccaatcccacagctttttgcctcccgaaatttgctgtgtgtgtgtgtgtgtgtgtgtgtgtgtgtgtgtgtgtgtcagagagagagagagcacgcacctcccaagttctttgcttactggctcgctgatacctcgcagaccaatattcacactgcctttctttgacactttccttactaaactgtaccagc

SEQ ID NO: 1139 - DNA, 290 bp, Homo sapiens
  chr1.fa.O7frz.126598238
  Located on chromosome 1
  Distance between a terminus base of telomere on chromosomal short arm and 5'-terminus of this base sequence : 120919386
  Distance between 3'-terminus of neighbour sequence of sequence listing upward to telomere on chrosomal short arm and 5'-terminus of this base sequence : 200161
agttaaattcgaagagccataaagacatctgggggacattgagactgtacatttaaataatattattatatctgtgtttattttatttatttatttatttatttatttatttatttatttatttattttgagacagagtctcactctgtcactcaggctggaatgcagtggcacgatctcggctcactgcagcctccgcctttgctacttgggagttgaggcaggagaattgcttgaattctcctgcctcaacctccagagtagctgggactacagaagcacgctaattt

SEQ ID NO: 1140 - DNA, 254 bp, Homo sapiens
  AL096773.6_136555
  Located on chromosome 1
  Distance between a terminus base of telomere on chromosomal short arm and 5'-terminus of this base sequence : 121040243
  Distance between 3'-terminus of neighbour sequence of sequence listing upward to telomere on chrosomal short arm and 5'-terminus of this base sequence : 120567
tcttgcctataacttaagactcactacagaccatttaaaagtaatataatttccagctttagaaaactgcttattgtcattaagaaaaataaatattcttcctttattgctgcatttaaaaaacgtactgccacattcaacacacacacacacacacacacacacacacacaccccaactaatgaaagaccaagacacataattactacatttcctggtttctgcctggcaaactcagaacaggcctacaagta

SEQ ID NO: 1141 - DNA, 248 bp, Homo sapiens
  G12424
  Located on chromosome 1
  Distance between a terminus base of telomere on chromosomal short arm and 5'-terminus of this base sequence : 121049499
  Distance between 3'-terminus of neighbour sequence of sequence listing upward to telomere on chrosomal short arm and 5'-terminus of this base sequence : 9002
tctcaaaaccacacccttaatttctctaccttagcaatagaggtcttcaaaaatcattagagtggatgtgtcagaggaaatccttatattcatttgtgtagtgtttggccccagggatcgctccctccctccctcccttccttccttctttccctctctccctccttccttccttccttccttccttccttccttccttccttccttccttccttcttccctttcctcaagaaccatgccagatacca

SEQ ID NO: 1142 - DNA, 278 bp, Homo sapiens
  D1S2852
  Located on chromosome 1
  Distance between a terminus base of telomere on chromosomal short arm and 5'-terminus of this base sequence : 121183405
  Distance between 3'-terminus of neighbour sequence of sequence listing upward to telomere on chrosomal short arm and 5'-terminus of this base sequence : 133658
aactactgtcactgttcacactcagtgatgagcatgaccgcttccttacacatttgtatttgtgtactctctacaagaatcttgaaaaaatacatatctacatatatatgtgtatatatgtgtatatatatgtatatatgtgtatatatgtatatatatgtgtatatatgtatatatatgtgtatatatatgtatatatacgtgtgtgtgtgtgtgtgtgtgtgtgtgtgtgtgtatgtgtatatagtttttttagaaagggcctcgctgtgttgccc

SEQ ID NO: 1143 - DNA, 492 bp, Homo sapiens
  chr1.fa.O7frz.261792668
  Located on chromosome 1
  Distance between a terminus base of telomere on chromosomal short arm and 5'-terminus of this base sequence : 121246614
  Distance between 3'-terminus of neighbour sequence of sequence listing upward to telomere on chrosomal short arm and 5'-terminus of this base sequence : 62931
tgatttacatgttagtgacatcacttaatttatcaaatatttactgccttttgtcagaaatcagcacattgtgacacataaccattaatttgaaaacatataaagtattattcatctgtgtctggcttctgtttacctttgttttctcatctcctgtcattgtccactttgcttttctgctgtagtcactcttttatgtttctcaaatttgccaagctctttctgatggtggttctttgaatttgtaccctttgcagaacttttatgtctaagatcttatgcacatttctaaacttcattctgcttttttgttattctccccttaatactttatctaaaatttctatttgattattccatatatatccatctcatttaacttttctcaagagcacataaagctgcatggcatgtatttgatatgtgtgtgtgtgtgtgtgtgtgtgtgtgtatttgtattcttttttacactttattgtaaggtccagtagg

SEQ ID NO: 1144 - DNA, 235 bp, Homo sapiens
  DISO7_10000691
  Located on chromosome 1
  Distance between a terminus base of telomere on chromosomal short arm and 5'-terminus of this base sequence : 121281226
  Distance between 3'-terminus of neighbour sequence of sequence listing upward to telomere on chrosomal short arm and 5'-terminus of this base sequence : 34120
cactcctcttccagccacttgtgttaattttttttttacttgttaaaatccttaggttatatattgtctctctctctctctcccccgccctccctccctccttccttctttccctctctctcccttgctgtacacacacacacacacacacacacacacacacacacacacgtttatatgtatttatgtattttgtccagagtttatagaagttttcagtgggagagttggtctc

SEQ ID NO: 1145 - DNA, 231 bp, Homo sapiens
  DISO7_10000690
  Located on chromosome 1
  Distance between a terminus base of telomere on chromosomal short arm and 5'-terminus of this base sequence : 121508815
  Distance between 3'-terminus of neighbour sequence of sequence listing upward to telomere on chrosomal short arm and 5'-terminus of this base sequence : 227354
cactccctagaaggaagtggggaagcacaggactattctgtctcattttccaaatagagaaactgaggcactgagcaatgagagaagcttagtaaggatgagataatgagctagctgcagggctgagaacaaactgggctttggctcagagtggctaccattcagtacaatgtgtgtgtgtgtgtgtgtgtgtgtgtgtgtctgtgtgtgtgcctgcgagcacacctgtac

SEQ ID NO: 1146 - DNA, 101 bp, Homo sapiens
  DISO7_10000688
  Located on chromosome 1
  Distance between a terminus base of telomere on chromosomal short arm and 5'-terminus of this base sequence : 121548580
  Distance between 3'-terminus of neighbour sequence of sequence listing upward to telomere on chrosomal short arm and 5'-terminus of this base sequence : 39534
ttctaggattctacatctaggaaccaaaaattagagggagagaaagagagagagagagagagagagagagagacaccatgacaccacagattcttccaggg

SEQ ID NO: 1147 - DNA, 331 bp, Homo sapiens
  AL049825.17_60927
  Located on chromosome 1
  Distance between a terminus base of telomere on chromosomal short arm and 5'-terminus of this base sequence : 121608221
  Distance between 3'-terminus of neighbour sequence of sequence listing upward to telomere on chrosomal short arm and 5'-terminus of this base sequence : 59540
cagaaggaaatgtgtcttgagagggagatggggatttaagtgggtgcccaggattgattgcatgaataaaagaaagacttcagcccagggaggaagacagaagatagagtggtgctgttggatatatatgtctttggagattatacacacattcacacacaatatgatacggatatatttataatctccataacatattttatatgttttatataaataatctccaaagacatgtatttgtgtgtgtgtgtgtgtgtgtgtgtgtgtgtgtgtgtatggccagtgtgaagggtatgccctaaaaggtggagctgaaacatctgaagtagaa

SEQ ID NO: 1148 - DNA, 159 bp, Homo sapiens
  Z66906
  Located on chromosome 1
  Distance between a terminus base of telomere on chromosomal short arm and 5'-terminus of this base sequence : 121608358
  Distance between 3'-terminus of neighbour sequence of sequence listing upward to telomere on chrosomal short arm and 5'-terminus of this base sequence : -194
agattatacacacattcacacacaatatgatacggatatatttataatctccataacatattttatatgttttatataaataatctccaaagacatgtatttgtgtgtgtgtgtgtgtgtgtgtgtgtgtgtgtgtgtatggccagtgtgaagggtatg

SEQ ID NO: 1149 - DNA, 351 bp, Homo sapiens
  AL049825.17_53456
  Located on chromosome 1
  Distance between a terminus base of telomere on chromosomal short arm and 5'-terminus of this base sequence : 121615816
  Distance between 3'-terminus of neighbour sequence of sequence listing upward to telomere on chrosomal short arm and 5'-terminus of this base sequence : 7299
aacctccaagctgaatatttactttaaagcggtgtcaggattggtagtctacccaaatccatggaaaaatcaaatgaaaatcctctgtaggaatattttcaacacacatacacacacacacacacacacacacacacacacacacacacacggccatcatgtgctagaatcagaacacacaaactgcagaatcagatgcacaatgcattagaattgttaaaaatggaagtaaatagggcatttagaaatataaaagaggagattataagagtgactaaaatatttgaaaaggaatcaaatagaaattcaacatatggattaaagaggttaaataactgtttagaatcacca

SEQ ID NO: 1150 - DNA, 167 bp, Homo sapiens
  D1S467
  Located on chromosome 1
  Distance between a terminus base of telomere on chromosomal short arm and 5'-terminus of this base sequence : 121826553
  Distance between 3'-terminus of neighbour sequence of sequence listing upward to telomere on chrosomal short arm and 5'-terminus of this base sequence : 210386
acattatgatcaggcacaaactttgttattctgttattttgaaattagaaaattaagttgcagacacacacacacacacacatacacacacacacacattgatttcaaaggccttgtttatttcctgagtctcacaaagtaaaataacctgaaaaatcacctatggc

SEQ ID NO: 1151 - DNA, 353 bp, Homo sapiens
  AL157950.7_130979
  Located on chromosome 1
  Distance between a terminus base of telomere on chromosomal short arm and 5'-terminus of this base sequence : 121898384
  Distance between 3'-terminus of neighbour sequence of sequence listing upward to telomere on chrosomal short arm and 5'-terminus of this base sequence : 71664
tgcattcaaactgaattacactaccagcttttcttattcaccagcttgcagacagcatattctcatctctctctctctctctctctctctctctctctctctatctatctatcatctatctatctatctatctatctatctatctatctatctatcatctatctatctatctattatctagatatcctgttggttctgtttctctggagaatgctgattcacacaaaaggaaaaagaatcatttaaaaaaatattacagcagccaccaacccaacacttactatatcaatcagggctcaataaaagaaacaggataagcagaaggtatgtagtaacagacttatggcaaggaa

SEQ ID NO: 1152 - DNA, 163 bp, Homo sapiens
  D1S2687
  Located on chromosome 1
  Distance between a terminus base of telomere on chromosomal short arm and 5'-terminus of this base sequence : 122031338
  Distance between 3'-terminus of neighbour sequence of sequence listing upward to telomere on chrosomal short arm and 5'-terminus of this base sequence : 132601
tcagtgtaccccttgaagtgtggtgaagatgggtgggttttgatgctctgtgtgtgtgtgtgtgtgtgtgtgtgtgtgtgtgtatgtagaatttccctaaattcaaaatgatacttacattttgataaacccagagagttaattaacatggcataaatgtgct

SEQ ID NO: 1153 - DNA, 381 bp, Homo sapiens
  chr1.fa.O7frz.128631688
  Located on chromosome 1
  Distance between a terminus base of telomere on chromosomal short arm and 5'-terminus of this base sequence : 122215663
  Distance between 3'-terminus of neighbour sequence of sequence listing upward to telomere on chrosomal short arm and 5'-terminus of this base sequence : 184162
taaagtgcttaaactaatgcctagaactcatgttcagtaagtgttggctatcattattattattattcagtataaatacatattgaggaacagatatatattgacatagaaaaataaacatatccagatatactcacccgtgtgtgtgtgtgtgtgtgtgtgtgtgtgtgtgtgtgtgtgtgtgtgtctgtccatagctctggtggccaaactacaatgagcattttccatgtgtcagacctaggtatagtgactttgctcatattaacttatttaaccttcaccacaaacctgtgaggtaggtaggtactgttgtcccgattttgtgtataagaaaactaggacatggaaaagatggtaatctactcaaggtcacatagc

SEQ ID NO: 1154 - DNA, 474 bp, Homo sapiens
  chr1.fa.O7frz.128787849
  Located on chromosome 1
  Distance between a terminus base of telomere on chromosomal short arm and 5'-terminus of this base sequence : 122360716
  Distance between 3'-terminus of neighbour sequence of sequence listing upward to telomere on chrosomal short arm and 5'-terminus of this base sequence : 144672
gacctagtattaatctgaatgcagtgtttaagcattgcctctctgagctaatttctcatagtacccctttcatagcatttatgaaacagtatcattactgcttgcctcttctggctcccttatggttagcaaaagtaagcatgactatgggtattggaggagacaaaaaggctaacaccgttttattgaggctggcactgcatagaagagttgcaagtttctgactcttctggtggcataaagctgtggacctgtgtgttctgtgagggccttggatgtgtgtgtgtgtgtgtgtttgtgtgggtgtgtgtgcatgtgcaggaggtgggtgaggaagacattgtgaagagtgggaggagaacagagaagatgagaaaagtggaaagtgcttattctgcctgcaggttgctagaaagaaaactggttaatactgattaatacagataatactgattaggtagatttcactattcc

SEQ ID NO: 1155 - DNA, 278 bp, Homo sapiens
  AL158842.4_101584
  Located on chromosome 1
  Distance between a terminus base of telomere on chromosomal short arm and 5'-terminus of this base sequence : 122429861
  Distance between 3'-terminus of neighbour sequence of sequence listing upward to telomere on chrosomal short arm and 5'-terminus of this base sequence : 68671
cctaatgctaaatgacgagttaatgggtgcagcacaccaacatggcacatgtatacatatgtaactaacctgcacattgtgcacatgtaccctaaaacttaaagtataataataataataataatactgaaaaaaaaagaaaacagactaatacataaaaaaaatagttgggacttaattaaactaaagagcttctacatagcaaaaggcacagtcagcagagtaaacagacaacccacagagtgggagaaaatcttcacaatctgtacatctgacaa

SEQ ID NO: 1156 - DNA, 237 bp, Homo sapiens
  AL158842.4_18971
  Located on chromosome 1
  Distance between a terminus base of telomere on chromosomal short arm and 5'-terminus of this base sequence : 122570393
  Distance between 3'-terminus of neighbour sequence of sequence listing upward to telomere on chrosomal short arm and 5'-terminus of this base sequence : 140254
tggtagtgcacatctgcagtcccagctactcggggaggctgaggtggaagaatagcttgaatctgggaagcagaggttgcagtgagccgagattgtgccacggcactccagcctgggcaacagagtgagactctgcctcaaaataataataataataataataataataataataataataataatacaccaatatactgtaccttggtgaaaaatagcacattgtcagtatacgga

SEQ ID NO: 1157 - DNA, 312 bp, Homo sapiens
  AL121982.19_57293
  Located on chromosome 1
  Distance between a terminus base of telomere on chromosomal short arm and 5'-terminus of this base sequence : 122580785
  Distance between 3'-terminus of neighbour sequence of sequence listing upward to telomere on chrosomal short arm and 5'-terminus of this base sequence : 10155
tggacatgcctagcttaactgggttccaacgtgcaacatgtagactgaacaacacacacacacacacacacacacacacacacacacacacacacacacacactgcatttaaacaaagcacatcagaaaagagttcaggctttcaccctcccttcctgccaagcacggagacaaacagtactggtcttggttctctttgtctctgagtctagaccattcatttcctctcattcaaccagctttatttttggcgatgtaactttctttcgtgagcatatatattatgttctcagactttgtaacctatgaatc

SEQ ID NO: 1158 - DNA, 137 bp, Homo sapiens
  D1S189
  Located on chromosome 1
  Distance between a terminus base of telomere on chromosomal short arm and 5'-terminus of this base sequence : 122580796
  Distance between 3'-terminus of neighbour sequence of sequence listing upward to telomere on chrosomal short arm and 5'-terminus of this base sequence : -301
agcttaactgggttccaacgtgcaacatgtagactgaacaacacacacacacacacacacacacacacacacacacacacacacacacacactgcatttaaacaaagcacatcagaaaagagttcaggctttcaccc

SEQ ID NO: 1159 - DNA, 377 bp, Homo sapiens
  AL121982.19_80557
  Located on chromosome 1
  Distance between a terminus base of telomere on chromosomal short arm and 5'-terminus of this base sequence : 122604009
  Distance between 3'-terminus of neighbour sequence of sequence listing upward to telomere on chrosomal short arm and 5'-terminus of this base sequence : 23076
aaattatcctactctggctgaccaagtcgttgtttaattgagggtgctatcttgtggcaggaagcagagagtgaactatgccagttaagtggtgtgtgtgtgtgtgtgtgtgtgtgtgtgtgtgtgtgtgtgttttgtgggtgaatacctgtgtgaccagctttgagaaaaacagtgttcaaaagttaatagttgggaacttaatcagggagggattatgtgtatttcaaaaagaatttgccacagttttctttaaataccaaggacccaggacttagagaatctgagaggagatggagatgctttgagggaagcttgctagccaggggtctcagaaagacagcacctacagggagataacgtagtccagagtctgt

SEQ ID NO: 1160 - DNA, 345 bp, Homo sapiens
  chr10.fa.O7frz.51207267
  Located on chromosome 1
  Distance between a terminus base of telomere on chromosomal short arm and 5'-terminus of this base sequence : 122774528
  Distance between 3'-terminus of neighbour sequence of sequence listing upward to telomere on chrosomal short arm and 5'-terminus of this base sequence : 170142
gacctgtacttgtcagttcctaaacatagcaagccttggtctatcttgaacatttctgcagttataaatgagccttgggtcatgattttctgcctttttatcatagacaagatttaatttaggagatgtccttttaatgtgtaatgtgaatagtaagtgacacttatgaagcctattttcttccagccattttaattgtcaaatctgtccagtcaagatgcattgttagaggcttcactgacaacaccgtctgtgtgtgtggctgtgtgtgtgtgtatacatacatatgattgagcaggatttattgtaagtcaaaacagtctcaaatttctttggacaatacag

SEQ ID NO: 1161 - DNA, 444 bp, Homo sapiens
  chr1.fa.O7frz.129172323
  Located on chromosome 1
  Distance between a terminus base of telomere on chromosomal short arm and 5'-terminus of this base sequence : 122909376
  Distance between 3'-terminus of neighbour sequence of sequence listing upward to telomere on chrosomal short arm and 5'-terminus of this base sequence : 134503
caatatcattgctacactccagcctgggctacagcgtgagactctgtctcgaaagaaagaaaggaaggaaggaaggaaggaaggaaggaaggaaggaaggaaggaaggaaggaaggaaggaaggaaggaaggaaagacagagagagagagagagggagggagggagggaggaaggaaggaaggttgttaaaaataagcacgtcaagaataaaactaaagtagaagacttataagactatattttcatttttcataatcaacatatgtatctctaatacacacatgaaaagttcttaaaagtaagcactgccactcagctttgcatcatagtagtagccacttttaatagatttctgttttaaaagaacaagattgatgagaaaagaaagtatatacaatgttactgaaaaatgtagacatgtctatgtaggattttctattgca

SEQ ID NO: 1162 - DNA, 421 bp, Homo sapiens
  chr1.fa.O7frz.129285620
  Located on chromosome 1
  Distance between a terminus base of telomere on chromosomal short arm and 5'-terminus of this base sequence : 123022572
  Distance between 3'-terminus of neighbour sequence of sequence listing upward to telomere on chrosomal short arm and 5'-terminus of this base sequence : 112752
acaagtaatgattgtcatatggaccctgttggcaggagagggaagatgagaggtctcccagctcttagttaaggcctaggccatgggtctggtgttcccagtcgatggatcataattcattaaaattgtatattggacactggctatatccagagtctacacattagataatattaaaagaacataaaaggaatataaatgaatccaggtgctaagtgacttgggagtccttgaacttgttgcttttacctccatttatttatttatttatttatttatttatttattttcattcattcattcattcattgaacacatgttttattgagcacttactggaacggcacactgtgctgggcactggtattacaatattgggcaagacagaatcatccctacatcatgagctaatagtccaatg

SEQ ID NO: 1163 - DNA, 380 bp, Homo sapiens
  AL365325.4_120338
  Located on chromosome 1
  Distance between a terminus base of telomere on chromosomal short arm and 5'-terminus of this base sequence : 123224292
  Distance between 3'-terminus of neighbour sequence of sequence listing upward to telomere on chrosomal short arm and 5'-terminus of this base sequence : 201299
gagcgaaactctgtcagaaagaaagacagagagaaagaaaggaaggaaggaagggagggagggagagaaggaaggaaggaaggaaggaaggaaggaaggaaggaaggaaggaaggaaggaaggagaaagaaagaaaagaaagaaagagagagagaaagaaagaaagaaagagagagagagagagagaaagagagagtcctaagggaaggagagatgtcaaaggagaggagtgcaccgaagtccccagtcagcaatgtctggtgcccgggctgaacattccagcttgcttcaaaacattctgcatttgaattttgaaacctctactgcaccggcctggaatcagttgtttattttggacattttggaagactccttgatct

SEQ ID NO: 1164 - DNA, 382 bp, Homo sapiens
  AL365325.4_109510
  Located on chromosome 1
  Distance between a terminus base of telomere on chromosomal short arm and 5'-terminus of this base sequence : 123335610
  Distance between 3'-terminus of neighbour sequence of sequence listing upward to telomere on chrosomal short arm and 5'-terminus of this base sequence : 110938
gtaggtactctaggtcatgaccaggagaatggataagtaaaatttggtacttgcatggaatgttttgttgttgttgttgttgttgttgttgttgttgttgttttgaggcggagtctcgctctgttgcccaggctggagtgcagtggtgcaatctcaggtcactgcaagagacagggtttcacggtgttagccaggatggtctcgatctcctgacctcatgatccgcccgccctggcctcccaaagtgctgggattacaggcatgaaccaccgcgcccagccatttacatggaattttattagcaactagagacaacagattaaaagagtacccagcaacaagaagacaccttaaaaacaatactgctaatcagtagttgcca

SEQ ID NO: 1165 - DNA, 385 bp, Homo sapiens
  AL365325.4_4132
  Located on chromosome 1
  Distance between a terminus base of telomere on chromosomal short arm and 5'-terminus of this base sequence : 123364142
  Distance between 3'-terminus of neighbour sequence of sequence listing upward to telomere on chrosomal short arm and 5'-terminus of this base sequence : 28150
gatcaccaggtcaggagttcgagaccagcctggccaacatggtgaaaccccatctctactaaaaaaaaaaaatacagaaattagtcacgcttggtggcgtgggcccgtaatcccagttacttgggaggctgaggcaggtgaattgtttgaatccaggaggcagaggttgcagtgagccgagatcgtgccactgcactccagtctgggcaacagagcaagacttcgtctcagaaaaagtaaataaataaataaataaataaataaaaataaacttttcattactcctaaggaaaagtaagtctcagagtctccttttcttggccagggtcacatgaagagtaaaggaccccctgtgagatttgaactcagatcttatgactgatgg

SEQ ID NO: 1166 - DNA, 209 bp, Homo sapiens
  DID22N_0001429
  Located on chromosome 1
  Distance between a terminus base of telomere on chromosomal short arm and 5'-terminus of this base sequence : 123431308
  Distance between 3'-terminus of neighbour sequence of sequence listing upward to telomere on chrosomal short arm and 5'-terminus of this base sequence : 66781
tgatacagttaggaaatgtgacctactttaaaacccagcagagtgtgtgtgtgtgtgtgtgtgtgtgtgtgtgtgtgtgtgtgtgatgaaagtgaattgttttgctgaaatctgacactaaaaatagggcaccggatccttcccctgctggaaaaagaaaaaaaagaaagacattaaaatgagtgtgtgtctgtatgtctgggaatatg

SEQ ID NO: 1167 - DNA, 101 bp, Homo sapiens
  DID22N_0001430
  Located on chromosome 1
  Distance between a terminus base of telomere on chromosomal short arm and 5'-terminus of this base sequence : 141507947
  Distance between 3'-terminus of neighbour sequence of sequence listing upward to telomere on chrosomal short arm and 5'-terminus of this base sequence : 18076430
tgcaatgttagaggcttcactgacaacaccgtctgtgtgtgtgtgtgtgtgtgtgtgtgtgtgtatacatacatatgattgagcaggatttattgtaagtc

SEQ ID NO: 1168 - DNA, 115 bp, Homo sapiens
  DISO7_10002863
  Located on chromosome 1
  Distance between a terminus base of telomere on chromosomal short arm and 5'-terminus of this base sequence : 141574741
  Distance between 3'-terminus of neighbour sequence of sequence listing upward to telomere on chrosomal short arm and 5'-terminus of this base sequence : 66693
gtgatgaggacctgggtgcacccatgagtggagaagctaggcctgtccagagaagcaagacaaacacacacatacacacacacacacaggcacacatgcatacacaaatacattg

SEQ ID NO: 1169 - DNA, 91 bp, Homo sapiens
  DISO7_10002862
  Located on chromosome 1
  Distance between a terminus base of telomere on chromosomal short arm and 5'-terminus of this base sequence : 141574773
  Distance between 3'-terminus of neighbour sequence of sequence listing upward to telomere on chrosomal short arm and 5'-terminus of this base sequence : -83
gaagctaggcctgtccagagaagcaagacaaacacacacatacacacacacacacaggcacacatgcatacacaaatacattgcatacaca

SEQ ID NO: 1170 - DNA, 148 bp, Homo sapiens
  DISO7_10002866
  Located on chromosome 1
  Distance between a terminus base of telomere on chromosomal short arm and 5'-terminus of this base sequence : 141593119
  Distance between 3'-terminus of neighbour sequence of sequence listing upward to telomere on chrosomal short arm and 5'-terminus of this base sequence : 18255
gccttgttatgtagatgagaccacttatgtaaaaaaaaaaaagttttaaaaaataatttctgctaactggaatgttttttgttgttgtttatttgtttgtttgtttgtttgcagccataggagttttagccaattcagagggcttgct

SEQ ID NO: 1171 - DNA, 334 bp, Homo sapiens
  AL137861.5_45068
  Located on chromosome 1
  Distance between a terminus base of telomere on chromosomal short arm and 5'-terminus of this base sequence : 141736552
  Distance between 3'-terminus of neighbour sequence of sequence listing upward to telomere on chrosomal short arm and 5'-terminus of this base sequence : 143285
atgaaatagacttccaggtcaccataagtcattcatttacctaaaatcacgactttaaacatttttaaagggcaaaaatctttactcattgatagagggaagacttatcttcacaaacgatctgcctcttgtttttccttttttttctttttggtagtttgtttacaaggcaaacaaatttttcatttattttattttattttattttattttattattattattatactttaagttttagggtatatgtgcccaatgtgccagttagttacatatgtatacatgtgacattctggtgtgctgcacccattaactcgtcatttagcattaggta

SEQ ID NO: 1172 - DNA, 232 bp, Homo sapiens
  D1S442
  Located on chromosome 1
  Distance between a terminus base of telomere on chromosomal short arm and 5'-terminus of this base sequence : 142180381
  Distance between 3'-terminus of neighbour sequence of sequence listing upward to telomere on chrosomal short arm and 5'-terminus of this base sequence : 443495
ggtacttagcctcgaaatgagaactaagcaatgcttcagaacagcctaagtggttagagtaatgaatgtgaagcaaaacaaagctggactggtaatcatttcaactatgtatgtgcacttcaaaacatcatgttgtccaccttaaatgcatgcatgcatgcacacacacacacacacacacacacacacaatcggactggaaacacagaataaccaaccagttgtgtgacac

SEQ ID NO: 1173 - DNA, 253 bp, Homo sapiens
  D1S2344
  Located on chromosome 1
  Distance between a terminus base of telomere on chromosomal short arm and 5'-terminus of this base sequence : 142278921
  Distance between 3'-terminus of neighbour sequence of sequence listing upward to telomere on chrosomal short arm and 5'-terminus of this base sequence : 98308
tcatgggactctccatcagtgacaaccaccagtagcctggcagcctcgggtcggcccccatgggactgactgaacccttctgtgctgagaagagaaaggagtgaggtgagatcagatgtatgcagacacacacacacacacacacatacacacacacacacacacacacacacacacacacacacacaggatttaacatcagcacttccctgaggtcaagcatcttgccttttaggccatttcctgagtattt

SEQ ID NO: 1174 - DNA, 100 bp, Homo sapiens
  DISO7_10008046
  Located on chromosome 1
  Distance between a terminus base of telomere on chromosomal short arm and 5'-terminus of this base sequence : 142417788
  Distance between 3'-terminus of neighbour sequence of sequence listing upward to telomere on chrosomal short arm and 5'-terminus of this base sequence : 138614
acattggtgccactgatgacagaaaataataatgcaaaaatgagaaagaaacagtgagagagagagagagagagagaagacatagagggagacagagaca

SEQ ID NO: 1175 - DNA, 104 bp, Homo sapiens
  DISO7_10235113
  Located on chromosome 1
  Distance between a terminus base of telomere on chromosomal short arm and 5'-terminus of this base sequence : 142591627
  Distance between 3'-terminus of neighbour sequence of sequence listing upward to telomere on chrosomal short arm and 5'-terminus of this base sequence : 173739
tttcggaagtgatcctgggtgagaggaggaggaggaggaggaggaggaggaggaggaggtggaggagaagggggaggtcggctttccatttccagatgtgacct

SEQ ID NO: 1176 - DNA, 356 bp, Homo sapiens
  AL022240.8_87561
  Located on chromosome 1
  Distance between a terminus base of telomere on chromosomal short arm and 5'-terminus of this base sequence : 142675549
  Distance between 3'-terminus of neighbour sequence of sequence listing upward to telomere on chrosomal short arm and 5'-terminus of this base sequence : 83818
tagatttcatggctaacgtaaggaagagtttgaaaagaaaaaggacagatccattaatgaggtaacagattattgcctttatgttgggatagaacagggccaggtagaaaaagatgaaagacacacacacacacacacacacacacacacacacacagagcgagctcagtgaattggtcaggtgacacactgatgagggagtcaaaggacactctgtatttgtgctctcaggacacacagtgaacagtgatcatgaaaagcatgtcctcaataattttgcgtaaaatgtggtcaagtttccctgcagttaccatgagaatacagcttttgaggtatggtcaactttcactaggtta

SEQ ID NO: 1177 - DNA, 103 bp, Homo sapiens
  DISO7_10000698
  Located on chromosome 1
  Distance between a terminus base of telomere on chromosomal short arm and 5'-terminus of this base sequence : 143161817
  Distance between 3'-terminus of neighbour sequence of sequence listing upward to telomere on chrosomal short arm and 5'-terminus of this base sequence : 485912
ccaattgactgagctcacactgtgtgtgtgtgtgtgtgtgtgtgtgtgtgtgtgtgtgtgtgtctttctctttcatccttttctacctggccctagtctatca

SEQ ID NO: 1178 - DNA, 118 bp, Homo sapiens
  DISO7_10235136
  Located on chromosome 1
  Distance between a terminus base of telomere on chromosomal short arm and 5'-terminus of this base sequence : 143413960
  Distance between 3'-terminus of neighbour sequence of sequence listing upward to telomere on chrosomal short arm and 5'-terminus of this base sequence : 252040
gagcccaccatggagtagatatcccacactgtgtgtgtgtgtgtgtgtgtgtgtgtgtgtgtgtgtatgtgtgtgtgtatttctgtttacttttatgacccatatctgtgggccacac

SEQ ID NO: 1179 - DNA, 360 bp, Homo sapiens
  AL356378.12_265884
  Located on chromosome 1
  Distance between a terminus base of telomere on chromosomal short arm and 5'-terminus of this base sequence : 143592792
  Distance between 3'-terminus of neighbour sequence of sequence listing upward to telomere on chrosomal short arm and 5'-terminus of this base sequence : 178714
gacagaaaagcaaatctggttacttttattccattatggaagaagttccaaaacctgattatttatttatttatttatttatttatttatttttttgagaaggtatctcattctgtcacccaggcaggaatgcagtgacatgatcttggctcactgccacctccgcttcctgggttcaaacaattctcttgcctcagccccccaagtagctgggattacagccacatgccaccatgcccagctaatctttatatttttagtagaaacggggtttcaccatgttggctagcctggccttgaactcctggccccaagtgatctgcctgccttggcctcccaaagtgctggaattacaggtgg

SEQ ID NO: 1180 - DNA, 254 bp, Homo sapiens
  DISO7_00008923
  Located on chromosome 1
  Distance between a terminus base of telomere on chromosomal short arm and 5'-terminus of this base sequence : 143675274
  Distance between 3'-terminus of neighbour sequence of sequence listing upward to telomere on chrosomal short arm and 5'-terminus of this base sequence : 82122
attgaggacgtgggaagtgctgcaacaggaaggctgctgggaattctgagcagcggcccctaactgaggggatccaagatggcttcaggggaagctcacactggcctggggaggtgggaagaagaaattcctgccacaactgtatatggtaaatcagatgcatcaaaacatggtgtgtttggtggatgaaggagaacacacacacacacacacacacacacacacacacacacagagttagggctggttgaatt

SEQ ID NO: 1181 - DNA, 216 bp, Homo sapiens
  DISO7_10235122
  Located on chromosome 1
  Distance between a terminus base of telomere on chromosomal short arm and 5'-terminus of this base sequence : 143915373
  Distance between 3'-terminus of neighbour sequence of sequence listing upward to telomere on chrosomal short arm and 5'-terminus of this base sequence : 239845
atggtgctctttggaacctttccatatatatatatgtatatatatatatatatatatatatttttttttttttttttttgagacagggtctccctgtggtgtccaggctggtctcgaacacctgggctcaaaggatcctcctgcctcagcctccaaaagtgctagaattacaggtgtgagccaccacacccatccttccataatttcttgttgttc

SEQ ID NO: 1182 - DNA, 184 bp, Homo sapiens
  DISO7_10235119
  Located on chromosome 1
  Distance between a terminus base of telomere on chromosomal short arm and 5'-terminus of this base sequence : 143991601
  Distance between 3'-terminus of neighbour sequence of sequence listing upward to telomere on chrosomal short arm and 5'-terminus of this base sequence : 76012
gctcattagtgagacatgaaatcaatttagtgagctgaaatcaccatattttatcttaaaagagaaaagaaaatagtttgcgttgcacaaagtaaaggtgagtattgttttataaaacttctctttcggttgtgtgtgtgtgtgtgtgtgtgtgtgtgtattctgggtggagtattgagtgtat

SEQ ID NO: 1183 - DNA, 436 bp, Homo sapiens
  AC025692.4_51064
  Located on chromosome 1
  Distance between a terminus base of telomere on chromosomal short arm and 5'-terminus of this base sequence : 144079165
  Distance between 3'-terminus of neighbour sequence of sequence listing upward to telomere on chrosomal short arm and 5'-terminus of this base sequence : 87380
aatatcaggccactgcactccagcctgggtgacaaagcaagaccttgtctcaaaatagaaaagaaagaaaaagagagagagagaaagaaaggaaagaaagaaaggaagagagagagaaagaaagagaaagaaagaaagaaagaaagagaaagaaagaaagaaagaaagaaagaaagaaagaaagaaagaaagaaagaaagaaaggaaaaacgaaccctggtaggagaatgccaccattagattatccaaaatgtcaataatctaataatctataagattacagaatataaaattggaacttacatttgaatgtggttatgtctcctattctagacatttacttatttatctcaaataatgcaatacagacaccctgggaagacatccctctgaaagacctgagaaagtgattcttggtaggaatagacaagtcatc

SEQ ID NO: 1184 - DNA, 107 bp, Homo sapiens
  D1S252
  Located on chromosome 1
  Distance between a terminus base of telomere on chromosomal short arm and 5'-terminus of this base sequence : 144243016
  Distance between 3'-terminus of neighbour sequence of sequence listing upward to telomere on chrosomal short arm and 5'-terminus of this base sequence : 163415
gcagagaacatgtgtattaatgaagccctctgcctttgtgtgtgtgtgtgtgtgtgtgtgtgtgtgtgtgtgtgtgtgtgatatgaataggttaagagtaaaaagct

SEQ ID NO: 1185 - DNA, 328 bp, Homo sapiens
  AL139248.5_55846
  Located on chromosome 1
  Distance between a terminus base of telomere on chromosomal short arm and 5'-terminus of this base sequence : 144293342
  Distance between 3'-terminus of neighbour sequence of sequence listing upward to telomere on chrosomal short arm and 5'-terminus of this base sequence : 50219
ccaagaattgtctagaagctttatagttttatttttgtttgtttgtttgtttgtttttgagagagagagtttcactctgtcttccaggctggagtgccgtggtacaatcttggctcactgcaaccaccatctcctgggttcaagcaattcttatgcctcagcctcccaagtagtcccaagtagctgggactacaggtgtgcaccaataatttttttgtattttagtagaaacggagtttcaccatgttgcccaggctggtcccgaactcctgagctcaggcaatctacacatcttggcctcccaaggtgctaggattacaggtgtgag

SEQ ID NO: 1186 - DNA, 420 bp, Homo sapiens
  AL365264.6_107120
  Located on chromosome 1
  Distance between a terminus base of telomere on chromosomal short arm and 5'-terminus of this base sequence : 144361973
  Distance between 3'-terminus of neighbour sequence of sequence listing upward to telomere on chrosomal short arm and 5'-terminus of this base sequence : 68303
gaacttggttcttggattgttaaaaaaaatcctacttttaaaaaacattttttattttagatgggaggttactgtgtcactcaggctggagtgcagtggcacaattatagctcactgcagccttgaactcctgggctcaagcaattctcctgcctcagcctcccaagtagctgggactacaggtgcacaccactatccccagctctttctcttttagtgtacaaagcacagatatatatgtagtacaaaaccagagatagatagatagatagatagatagataggtagatagatagacagacagacagctagatagatagatgatagatagatagattaaagtttcctgaggggtgattaggaaaaaaaagagtctaaaattgttccttagggggttggtcatgaaaggctgactaacac

SEQ ID NO: 1187 - DNA, 317 bp, Homo sapiens
  AL365264.6_38687
  Located on chromosome 1
  Distance between a terminus base of telomere on chromosomal short arm and 5'-terminus of this base sequence : 144438893
  Distance between 3'-terminus of neighbour sequence of sequence listing upward to telomere on chrosomal short arm and 5'-terminus of this base sequence : 76500
aaacactgtcctgagttgtgactgacactgaatcaatcatttcaagaaaaccctgcactttccatctctttccttccaggagggtaaatgctgttctgagggaaaaagaggcaactagaatgtagctcaggggagaagcaaaaggtaggggagggaacttgcttccttcttcctctctggggagttcagcagcagcagcagcagcagcagcagcagcaagttctcctctccaaggagctcctaggaaaactagggacccaacctttgagctgggggggcctggggaggggtgttggtgtgaattgctcaagagtagc

SEQ ID NO: 1188 - DNA, 198 bp, Homo sapiens
  D1S2784
  Located on chromosome 1
  Distance between a terminus base of telomere on chromosomal short arm and 5'-terminus of this base sequence : 144528308
  Distance between 3'-terminus of neighbour sequence of sequence listing upward to telomere on chrosomal short arm and 5'-terminus of this base sequence : 89098
atgagccactgtgcccagccgtgtgtgtgtgtgtgtgtgtgtgtgtgtgtgtgtgtttactcatcttttgtaatggttatgcttgacttagcatattggcacattttatcagagtaatatatatccacaaagccatactgctcctacatgtgagaatttagtttacgcatttatgaatgggtctatccgtatccattc

SEQ ID NO: 1189 - DNA, 318 bp, Homo sapiens
  chr1.fa.O7frz.130418734
  Located on chromosome 1
  Distance between a terminus base of telomere on chromosomal short arm and 5'-terminus of this base sequence : 144662788
  Distance between 3'-terminus of neighbour sequence of sequence listing upward to telomere on chrosomal short arm and 5'-terminus of this base sequence : 134282
gcttgatgtattcagtgactaaagcaagttatagaccagtagttggttacagctgtgtgtgtgtgtgtgtgtgtgtgtgtgtgtgtgtgtgtgtgtgtgtgtatccattcagtcagctagtcatcacagtattttgccaagaaataatggcaccttggactaagatggtgttgtagagatgagagatataaatgatttcagggtattttggagataaatttaaaaggattgggtgatacgtggaggggggtataaaacagaaggaattgattttgtctctcaggtttctgtttttggtgctagattgatggtacgata

SEQ ID NO: 1190 - DNA, 394 bp, Homo sapiens
  chr1.fa.O7frz.130326652
  Located on chromosome 1
  Distance between a terminus base of telomere on chromosomal short arm and 5'-terminus of this base sequence : 144754846
  Distance between 3'-terminus of neighbour sequence of sequence listing upward to telomere on chrosomal short arm and 5'-terminus of this base sequence : 91740
agttccaaataacagttcctagtaatagtattttgagttatttttctttaggtttccttatactcaaattggctaggtcctatcttttcctctctctctctctctctctctctctctctctctctctctatatatatatatatatatatatatatatgagagatatatgagatatatgagagatcaagatctatatatgtatataaatacaattatacacagataatttttaatactctttgttaacaaacacagttgaaaactggtttcggctgcacaaataagcagaatatttgagtaactatatatgatatggagatattttaatccatttatcctggctcaagaacactgataaagatgattttctgttactttagctcattcagatcag

SEQ ID NO: 1191 - DNA, 256 bp, Homo sapiens
  Z23818.1_137
  Located on chromosome 1
  Distance between a terminus base of telomere on chromosomal short arm and 5'-terminus of this base sequence : 144850253
  Distance between 3'-terminus of neighbour sequence of sequence listing upward to telomere on chrosomal short arm and 5'-terminus of this base sequence : 95013
gtacttgttaggatagacttctcctataaatgaaaggaacatgggaattttgctaagggaatatactttattctagtagaaggggatggattcccacttattggtgagattgtagcccaaagttgagaatccatctacttgtggagtgaaggaagtcgtgtgtgtgtgtgtgtgtgtgtgtgtgtgtgtgtgtctgtgtctgtgtgtgttgtatattctgtgtatgaatgttgtagcctagacgaatgtagacatt

SEQ ID NO: 1192 - DNA, 229 bp, Homo sapiens
  D1S453
  Located on chromosome 1
  Distance between a terminus base of telomere on chromosomal short arm and 5'-terminus of this base sequence : 144850334
  Distance between 3'-terminus of neighbour sequence of sequence listing upward to telomere on chrosomal short arm and 5'-terminus of this base sequence : -175
ggggatggattcccacttattggtgagattgtagcccaaagttgagaatccatctacttgtggagtgaaggaagtcgtgtgtgtgtgtgtgtgtgtgtgtgtgtgtgtgtgtctgtgtctgtgtgtgttgtatattctgtgtatgaatgttgtagcctagacgaatgtagacattctctttttcactataagacaccttcagcctaggtgtcaaccaggtcgagatgtg

SEQ ID NO: 1193 - DNA, 236 bp, Homo sapiens
  chr1.fa.O7frz.130157908
  Located on chromosome 1
  Distance between a terminus base of telomere on chromosomal short arm and 5'-terminus of this base sequence : 144923617
  Distance between 3'-terminus of neighbour sequence of sequence listing upward to telomere on chrosomal short arm and 5'-terminus of this base sequence : 73054
gctgtattcttgtacatggaacaatgcctgagacataggaggcatcccaaaatattattatattatatatatatatatatatatatatgtgcatatatacacatttatattcacacgcatacagttatatatacacacatatatctatatatacacccatatgattacacacatacacatacataattaaaaatgcattttcttgccagaaatcttgatactaaactaggagtcca

SEQ ID NO: 1194 - DNA, 242 bp, Homo sapiens
  chr1.fa.O7frz.130668093
  Located on chromosome 1
  Distance between a terminus base of telomere on chromosomal short arm and 5'-terminus of this base sequence : 145000473
  Distance between 3'-terminus of neighbour sequence of sequence listing upward to telomere on chrosomal short arm and 5'-terminus of this base sequence : 76620
ctcctacaaagacactttgtctataaatagctgccaaatatttaagtggttttgtgtgtgtgtgtgtgtgtgtgtgtagggtgtgtgtgtaggctggggacctctattttgtcatcttgctgatgtcatctagtttgtcttttaagattactctggctactatatggaaaatggattgggaggccagttaggatgctattgtaaaattcaggcaaaatgaacttaccgtcatgtttatgaag

SEQ ID NO: 1195 - DNA, 416 bp, Homo sapiens
  AL122007.7_47334
  Located on chromosome 1
  Distance between a terminus base of telomere on chromosomal short arm and 5'-terminus of this base sequence : 145082079
  Distance between 3'-terminus of neighbour sequence of sequence listing upward to telomere on chrosomal short arm and 5'-terminus of this base sequence : 81364
taattgccaggttattgtaaagacaatatatttataatgccctacctgtatcaatatatcacatgtacccccaaaatatgtgcaactattatgtatcagtcaaaaatggccatatattaggtcacacagaagcctcaataaactagtatgtgtgtgtatatatatatatatatatatatatatatacacacacatacatatatatgtatattacaatgcctggatactatattatatatgtatcacaatgcaaaaaaatatatattttacaatgcctggcatactataaatgatagctaccactacttcattactattgcataggagatattttcttaagatgcacatgcatagcaaatctgctaagccaactctgggggcagagggaggtggcagctataagaattgcaaagaca

SEQ ID NO: 1196 - DNA, 165 bp, Homo sapiens
  D1S2669
  Located on chromosome 1
  Distance between a terminus base of telomere on chromosomal short arm and 5'-terminus of this base sequence : 145188175
  Distance between 3'-terminus of neighbour sequence of sequence listing upward to telomere on chrosomal short arm and 5'-terminus of this base sequence : 105680
gctgggcttctgaggaattaatacactcgtgtgtgtgtgtgtgtgtgtgtgtgtgtgtgtgtgtgtatgtgtatgtgtatgtacacatacatatatatagttgacacttgaaaaatgcaggtggtaggggcactgacccacccctacgccccgcacagtcaaaaa

SEQ ID NO: 1197 - DNA, 192 bp, Homo sapiens
  Z66583
  Located on chromosome 1
  Distance between a terminus base of telomere on chromosomal short arm and 5'-terminus of this base sequence : 145429820
  Distance between 3'-terminus of neighbour sequence of sequence listing upward to telomere on chrosomal short arm and 5'-terminus of this base sequence : 241480
gaacattgcatgggtgaaagagttggcccaagcaaaatttcgaagaggaaattactgtggtgtgtgtgtgtgtgtgtgtgtgtgtgtggtgtgctggtcagttggcatgtgggtagggtacagcaatgagtacagtgtgattggaatcaagaatgcattcaaataaagacaggccagatataaaatcgccag

SEQ ID NO: 1198 - DNA, 239 bp, Homo sapiens
  D1S2875
  Located on chromosome 1
  Distance between a terminus base of telomere on chromosomal short arm and 5'-terminus of this base sequence : 145449502
  Distance between 3'-terminus of neighbour sequence of sequence listing upward to telomere on chrosomal short arm and 5'-terminus of this base sequence : 19490
ctaagactctttagaacggtgttttctaggctttgtggactattggccagtgtaagaattgcattttcccttatgtatataatctatgtgcatatgcacacacacacacacacacacacacacacacacacacacacacgaggtgacagtttttgaaaataaggcttacctttatacctgtgatgctctgctaatttctactctattctagtttgtggaaaacaatgctgatccaggaa

SEQ ID NO: 1199 - DNA, 200 bp, Homo sapiens
  D1S2863
  Located on chromosome 1
  Distance between a terminus base of telomere on chromosomal short arm and 5'-terminus of this base sequence : 145762843
  Distance between 3'-terminus of neighbour sequence of sequence listing upward to telomere on chrosomal short arm and 5'-terminus of this base sequence : 313102
ggccatgggaagtagaaaaaatctgctcctatttttataagatttattagtaaccaaacaaagtgaaacacacacacacacacacacacacacacacaaatctagaataaaaaaggagagaagagatagtgtggttttggctgaaatactcaaagtataaaatgaccatgaaactgagaaggttggctttagatccctga

SEQ ID NO: 1200 - DNA, 191 bp, Homo sapiens
  Z67131
  Located on chromosome 1
  Distance between a terminus base of telomere on chromosomal short arm and 5'-terminus of this base sequence : 145922081
  Distance between 3'-terminus of neighbour sequence of sequence listing upward to telomere on chrosomal short arm and 5'-terminus of this base sequence : 159038
ttgattctctatcttggctattatgaacagtgttgcagttaacatggaagtggagatatctctttgatatacttatttcctttcatatatgtatacacacacacacacacacacacacacacacacacactcaggactgagattgctggatcatacggtatttatgtttttagtgtttttgaggaacctcc

SEQ ID NO: 1201 - DNA, 189 bp, Homo sapiens
  DISO7_10000694
  Located on chromosome 1
  Distance between a terminus base of telomere on chromosomal short arm and 5'-terminus of this base sequence : 146012444
  Distance between 3'-terminus of neighbour sequence of sequence listing upward to telomere on chrosomal short arm and 5'-terminus of this base sequence : 90172
gttggagttacaagttcttcctagattttatatatatatatatatatatatatatagagagagagagagagagagagagagagagagagagagagagaatatagagaaaatatacacataaaaatataaagagatatatatataataaagaaaaactgaaaataagaaatagaagaggttctgagttca

SEQ ID NO: 1202 - DNA, 102 bp, Homo sapiens
  DISO7_10000695
  Located on chromosome 1
  Distance between a terminus base of telomere on chromosomal short arm and 5'-terminus of this base sequence : 146254011
  Distance between 3'-terminus of neighbour sequence of sequence listing upward to telomere on chrosomal short arm and 5'-terminus of this base sequence : 241378
aactcatctccagaccgtgggtttaagatgtgtacacacacacacacacacacacacacatatcaccaaggccagtgttttctcaacagatggactcccact

SEQ ID NO: 1203 - DNA, 125 bp, Homo sapiens
  DISO7_10000696
  Located on chromosome 1
  Distance between a terminus base of telomere on chromosomal short arm and 5'-terminus of this base sequence : 146279720
  Distance between 3'-terminus of neighbour sequence of sequence listing upward to telomere on chrosomal short arm and 5'-terminus of this base sequence : 25607
ctgagctgaaagaagctgtgtgcctgggagtgtgagagagacagagggagagagagagagagagtgtgtgtgtgtgtgtgtgtgtgtgtcttcatgcaccacacaagtgcacaattatatgtgca

SEQ ID NO: 1204 - DNA, 340 bp, Homo sapiens
  chr1.fa.O7frz.131939403
  Located on chromosome 1
  Distance between a terminus base of telomere on chromosomal short arm and 5'-terminus of this base sequence : 146360460
  Distance between 3'-terminus of neighbour sequence of sequence listing upward to telomere on chrosomal short arm and 5'-terminus of this base sequence : 80615
cagtgatttcactccagaataaatggccatctgctatgcttccccacgacgtgaacacacacgtacacctactcctgtctctctctctctctctcacacacacacacacactcacacatatataggtatacttatacttgcacacacacacacattcacacatatatgaatacttacaatatttatacatacacacatagacacacactcacacatatacaggtttacttacacatacgcacactcaacattcacacacacacacacacacacacatgcatgcatgctcccagtgaagacttctcatcaggggcttaattacttggtaatggaaagtagc

SEQ ID NO: 1205 - DNA, 257 bp, Homo sapiens
  chr1.fa.O7frz.132011782
  Located on chromosome 1
  Distance between a terminus base of telomere on chromosomal short arm and 5'-terminus of this base sequence : 146432922
  Distance between 3'-terminus of neighbour sequence of sequence listing upward to telomere on chrosomal short arm and 5'-terminus of this base sequence : 72122
actggtacttctgactttggtcacagtcatcagtttatttacaagttaaatgaaaatgcccattacctggaagtttcaaaactgggatgctttagaatcgtcccatgatacctaggggtgacaaaacttttggcctcccaaattttatacattcccaatttgttaaactagctacacacacacacacacacacacacacacacacacacaatggcagtttcttgtcccaaattttgtctacatccaattcagaactg

SEQ ID NO: 1206 - DNA, 203 bp, Homo sapiens
  G07791
  Located on chromosome 1
  Distance between a terminus base of telomere on chromosomal short arm and 5'-terminus of this base sequence : 146587432
  Distance between 3'-terminus of neighbour sequence of sequence listing upward to telomere on chrosomal short arm and 5'-terminus of this base sequence : 154253
agcacatagcaggcactagctgttagttccttttctgaaagacatggaatatagagatagatagattagatagacagatagatagatagatagatagatagatagatagatagagagatagagagagagagagagatgggttttggggtttttttgtttgttggtttttcagacaggatcttaactgtgtagtggcacaatcg

SEQ ID NO: 1207 - DNA, 461 bp, Homo sapiens
  chr1.fa.O7frz.132234627
  Located on chromosome 1
  Distance between a terminus base of telomere on chromosomal short arm and 5'-terminus of this base sequence : 146615876
  Distance between 3'-terminus of neighbour sequence of sequence listing upward to telomere on chrosomal short arm and 5'-terminus of this base sequence : 28241
acgtaactccggaaacatatttccacaaaacagatgcttgtaatcccaacactttgtgagtccgaggtgggtggatcacctgaggtcagaggtttgacaccagcctgaccaatatggtgaaacttcgtctctactaaaaatacaaaaattagccaggtgtggtggcaggtgcctgtagttccggctactcgggaggctgagacaggagaactgcttggacctgggaggcaaaggttgcagtgagccgagattgctccactgcactccagcctgggcgacagagcgagactctgtctcaaaaaaattatatatatacacacacacacacacacacatatatatacacacatatatatacacacatatatatacacacatatatatataattaaaattattcacaaaaattattcacaaaaaaggaacgaaaatggaaacaaactaatttcttgccataggag

SEQ ID NO: 1208 - DNA, 427 bp, Homo sapiens
  chr1.fa.O7frz.132337813
  Located on chromosome 1
  Distance between a terminus base of telomere on chromosomal short arm and 5'-terminus of this base sequence : 146743636
  Distance between 3'-terminus of neighbour sequence of sequence listing upward to telomere on chrosomal short arm and 5'-terminus of this base sequence : 127299
ataaccaaaggactggtcatacaacccagaagtgccagggagttacttttctagggcagaacattaaccaattggaggcaaagagtgagagaggagtattggataaattgtctcccttccttccttccttccttcctttgttcttcctttctctttctctctttctgcctccctttgtctctctctctttttctctttttatctctctctctcttcctctctcttctttctttctttctttcattatttcccttttctctccccaacttctttctgctgggggattgtttctgtctgtagagacttgactttaaagagtaaacatatacacatttaagtggtattcatacacccccttatctaagaatggagaatagtacctctgaagaatacttaaatatgtaaatttcaatgagcataattagga

SEQ ID NO: 1209 - DNA, 359 bp, Homo sapiens
  chr1.fa.O7frz.132439889
  Located on chromosome 1
  Distance between a terminus base of telomere on chromosomal short arm and 5'-terminus of this base sequence : 146846258
  Distance between 3'-terminus of neighbour sequence of sequence listing upward to telomere on chrosomal short arm and 5'-terminus of this base sequence : 102195
aatgcttagcacctagtaggagtttaagaaatagtagtgtttcatacttaatgagtatatatacatatgtactcatatatatatatatatatatatactcatatatatacacactcatatatatatactcatatgtatatactcatatatatatactcatatatatatacttatatatatatatactcatatgtgtatatatatatactcatatatatactcatatatatactatacttattgtttggaaaattcctattaacttttcaaggcattgttcaactttcaactatcatcgaatattaacccaggctattttctctgtccttcctattgtactttgcacattccaatattac

SEQ ID NO: 1210 - DNA, 409 bp, Homo sapiens
  chr1.fa.O7frz.132590288
  Located on chromosome 1
  Distance between a terminus base of telomere on chromosomal short arm and 5'-terminus of this base sequence : 146996661
  Distance between 3'-terminus of neighbour sequence of sequence listing upward to telomere on chrosomal short arm and 5'-terminus of this base sequence : 150044
ccaatattcttacttgccaaaatataaagtgataaccctaggttcttttccaaaattaaagtatacacgtacacacacacacacacacacacacacgtccacaaaacccaaaagtctagaaattcttcctctctagagcccaaatgttcatttatttttatttttatgtttttcctatggctgcagcatggcccaatctctgtcagagccacagaagaatacaacactcagttgtaacccaagtgtgttacaaccactgcacttgggagtggggagtggggcacatggatctgtgcacgtggttgcggccccatagggatatttcctgacactgacagcatactcttcgtgggcaggtacccaacttctgttgggaacctgtgtccaagctagtatgccaggcttcatc

SEQ ID NO: 1211 - DNA, 416 bp, Homo sapiens
  chr1.fa.O7frz.132703607
  Located on chromosome 1
  Distance between a terminus base of telomere on chromosomal short arm and 5'-terminus of this base sequence : 147059855
  Distance between 3'-terminus of neighbour sequence of sequence listing upward to telomere on chrosomal short arm and 5'-terminus of this base sequence : 62785
cctttaatggtattgatgtcacattataattttcaacatccttacttggcaaaatataaagtgataaccctaggtcctttgccaaaattaaactacacacacacacacacacacaaaaacacacacacacatccaaacacccaaaagtctagaaattcttgctctccagaatccatatgtcagtttcttttcattttggtgtttttcctatggctgtagcatggcccagtctcagtcagagccacaaaagaatgtacctgagtctgttataaccactgcacttgggagtggagatatgtgcacgtggttggggccccttagggatatttcctgacactgacagaatgcttttcgttggtaggtacccagcttctgttggaggcctgtgtccaagctacagtgccagtcttcatcta

SEQ ID NO: 1212 - DNA, 151 bp, Homo sapiens
  D1S514
  Located on chromosome 1
  Distance between a terminus base of telomere on chromosomal short arm and 5'-terminus of this base sequence : 147177920
  Distance between 3'-terminus of neighbour sequence of sequence listing upward to telomere on chrosomal short arm and 5'-terminus of this base sequence : 117649
gactcagacttccatctggactaataggaggagacaggctgtgaagagtgtgtgtgtgtgtgtgtgtgtgtgtgtgtgtgtgtgtgtgtgtgttggtggtggtgggacaggaaggtggtgcggatgtttaaaaatgttgggaccacgcatt

SEQ ID NO: 1213 - DNA, 411 bp, Homo sapiens
  chr1.fa.O7frz.132894711
  Located on chromosome 1
  Distance between a terminus base of telomere on chromosomal short arm and 5'-terminus of this base sequence : 147250919
  Distance between 3'-terminus of neighbour sequence of sequence listing upward to telomere on chrosomal short arm and 5'-terminus of this base sequence : 72848
gtttgtctgagtcaactaaagaagccccaccaagaatctgtgaactgaagaccccacacctagacctcatcaaccagctgttccttacaaaaaccactcacgtcatttcttacaagaaggtattgatgaaaagaacaggaagttacagtgaaaaacatcaaggataacataaaaaaaattacagcatctaaaaaaaaaggctagctgaaagttttcaactttaactcaagatccaatggagatttgattaatctgtctcataataggcctgtgtgcgtacacacacacacacacacacacacacacacacacacactttttaaggctctagaaagctggtaattttgtgttctgccattcaggagggccttaattagacaaaggtctatacaatggagtcatttaaatcat

SEQ ID NO: 1214 - DNA, 192 bp, Homo sapiens
  AL359752.7_45877
  Located on chromosome 1
  Distance between a terminus base of telomere on chromosomal short arm and 5'-terminus of this base sequence : 147272294
  Distance between 3'-terminus of neighbour sequence of sequence listing upward to telomere on chrosomal short arm and 5'-terminus of this base sequence : 20964
ctacattgttgccggtattaatagtttggatttttttatattgctaagtactatttcattatatgaatgtggcacaggttatttattattattattattattattattattattattattattattattattcattcttggttgacgggcattttggctatttctggttttggcctaaagtttctatgaata

SEQ ID NO: 1215 - DNA, 167 bp, Homo sapiens
  D1S2696
  Located on chromosome 1
  Distance between a terminus base of telomere on chromosomal short arm and 5'-terminus of this base sequence : 147409587
  Distance between 3'-terminus of neighbour sequence of sequence listing upward to telomere on chrosomal short arm and 5'-terminus of this base sequence : 137101
aaaaatgagtccagtagaagccttatataaacacacacacacacacacacacacacacacacacacacacacacacacacacacaacaggcccctaatcaggatgtccagtgtagtgggaatgagcatgggctcaggggtcagattgcctgggatgtaattctggct

SEQ ID NO: 1216 - DNA, 335 bp, Homo sapiens
  AL049715.25_93840
  Located on chromosome 1
  Distance between a terminus base of telomere on chromosomal short arm and 5'-terminus of this base sequence : 147763784
  Distance between 3'-terminus of neighbour sequence of sequence listing upward to telomere on chrosomal short arm and 5'-terminus of this base sequence : 354030
gtgtcaatctatgtcactccacagatggttattaaactagttacaacttccctaaatcttttcactagatctatgcagcattctggacagctattccttgccaactgagattaggcactattataaaaaaagttttgaaaaaacaattccaaggtctattcctcctcccaacacacacacacacacacacacgcacacacacacagagttaaatcagagatacttaattcagatattcaaattttttaatttgaaatttaaaatattaccaaagccataaatattcctttaatgcagtgaatgtaagaaatctattaatttcaacctgtcttgaa

SEQ ID NO: 1217 - DNA, 166 bp, Homo sapiens
  Z66793
  Located on chromosome 1
  Distance between a terminus base of telomere on chromosomal short arm and 5'-terminus of this base sequence : 147930624
  Distance between 3'-terminus of neighbour sequence of sequence listing upward to telomere on chrosomal short arm and 5'-terminus of this base sequence : 166505
tacatcttactctcaaatggttcatcaaaataatactaatgattgtgtctgtgtgcttgtgtgtgtgtgtgtgtgtgtgtgtaaagagagaaaacaaatgtggcaaaatgttaacaatctatgaagcaattgaaagatttacaggactttattgtgctagttttac

SEQ ID NO: 1218 - DNA, 475 bp, Homo sapiens
  AL138791.4_75958
  Located on chromosome 1
  Distance between a terminus base of telomere on chromosomal short arm and 5'-terminus of this base sequence : 147967907
  Distance between 3'-terminus of neighbour sequence of sequence listing upward to telomere on chrosomal short arm and 5'-terminus of this base sequence : 37117
ttctatcatatccaccaatctaactgtaatgtattgttattctgttttatcagattatcttccccttagtagtatatttaatttcacctaaatgtggaagaaatcattttttctaattacatttatttatttatttatttatttttgagacagagtcttgctctgtcacccaggctggagtgcagtggtgccgtctcggctcactgcaacctccgcctcccaggttcaagcaattctcctgcctcagcctcccgagtagctgggattacatgcgcttgccaccacgcctggctaatttttgtagttttggtagagatggggtttcgccatgttggccaggctggtcttgagctcctgacctcaagtgatccacctgcctcaaccacccaaaaaactgggattacaggtgtgagccaccatgcccagcctctaattacttttaattaaaaattttgcatttacgtataaacattca

SEQ ID NO: 1219 - DNA, 228 bp, Homo sapiens
  HUMUT1054
  Located on chromosome 1
  Distance between a terminus base of telomere on chromosomal short arm and 5'-terminus of this base sequence : 147969438
  Distance between 3'-terminus of neighbour sequence of sequence listing upward to telomere on chrosomal short arm and 5'-terminus of this base sequence : 1056
ttgggctccttctggcaagttggcagaacgaaggaaagaaggcagggaaggagggagagaggagggagggaaggaaggaaggaaggaaggaaggaaggaggcaggcagagaggtgggggaaaagagaaaaaaaaaaagaaagagaaaggaagaaaggaaggaagggagagagtgagaaggagagaaagaaaaagagataggaagaaaagcatgcaaaggcattttgcc

SEQ ID NO: 1220 - DNA, 479 bp, Homo sapiens
  AL138791.4_118813
  Located on chromosome 1
  Distance between a terminus base of telomere on chromosomal short arm and 5'-terminus of this base sequence : 148017864
  Distance between 3'-terminus of neighbour sequence of sequence listing upward to telomere on chrosomal short arm and 5'-terminus of this base sequence : 48198
aaggtttggctttagataggagcatggatagttgatctatggttataagtggaaagacagagaatgtaacccgagatgtgtagatggattgatatggcggtaagagactgccagtgctttcttctggtttttttgtttgtttgtttgtttgtttgtttgtttgagacagagtatgtccctgttgcccaggctggagtgcagtggtgcaatctcggctcactacaacctctgcctcctgggttcaagcgatcctcctgcctcagcctcccaagtagctgggattacaggcacacaccaccacacctggctaatttttttgtatctttagtagagacggggtttcaccatgttgaccaagctggtctcgaactcctgacctcgtgatccgcccacctcggcctcccaaagtgctgggattacaggcgtgagccaccacacctgacccaggtgggccttttcttatcaccactgcctgaaat

SEQ ID NO: 1221 - DNA, 278 bp, Homo sapiens
  AL138791.4_156398
  Located on chromosome 1
  Distance between a terminus base of telomere on chromosomal short arm and 5'-terminus of this base sequence : 148055577
  Distance between 3'-terminus of neighbour sequence of sequence listing upward to telomere on chrosomal short arm and 5'-terminus of this base sequence : 37234
agagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttatt

SEQ ID NO: 1222 - DNA, 195 bp, Homo sapiens
  AL078463.11_123704
  Located on chromosome 1
  Distance between a terminus base of telomere on chromosomal short arm and 5'-terminus of this base sequence : 148483560
  Distance between 3'-terminus of neighbour sequence of sequence listing upward to telomere on chrosomal short arm and 5'-terminus of this base sequence : 427705
ttagaaatgattgctttatggatttaaaaggtgacccaaatgacttttttattattattattttttaatgctgggaggagtttgcgtgtgtgtgtgtgtgtgtgtgtgtgtgtgtgtgtgtgtgttttatctccttcaactctgaccacctggaagtcagcctaatctctgccctcgtgttgatctttaattcaa

SEQ ID NO: 1223 - DNA, 218 bp, Homo sapiens
  D1S2636
  Located on chromosome 1
  Distance between a terminus base of telomere on chromosomal short arm and 5'-terminus of this base sequence : 149034175
  Distance between 3'-terminus of neighbour sequence of sequence listing upward to telomere on chrosomal short arm and 5'-terminus of this base sequence : 550420
ggcatcttgttttgggaactgattatagagaatcatatatagtccagtcttcattttacatacacacacatattttacacacacacacattttacacacacacacacacacacacacatatgtttttctagtctctggcatgtgtagcctctcctggtcatagaccagtctctttgtaagttattgtggcagttcacacagtagccaccaggggtctc

SEQ ID NO: 1224 - DNA, 101 bp, Homo sapiens
  DISO7_10000247
  Located on chromosome 1
  Distance between a terminus base of telomere on chromosomal short arm and 5'-terminus of this base sequence : 149281109
  Distance between 3'-terminus of neighbour sequence of sequence listing upward to telomere on chrosomal short arm and 5'-terminus of this base sequence : 246716
ggaagttgaggtgtttatcttgaaaacaatacacacacacacacaccaaacacacacacgcacacacacacacacactgaaggggtccagaatatgccagg

SEQ ID NO: 1225 - DNA, 135 bp, Homo sapiens
  DISO7_10000246
  Located on chromosome 1
  Distance between a terminus base of telomere on chromosomal short arm and 5'-terminus of this base sequence : 149297694
  Distance between 3'-terminus of neighbour sequence of sequence listing upward to telomere on chrosomal short arm and 5'-terminus of this base sequence : 16484
tccattgttatcagattgggaaacacacagctgcacacacacacacacacacacacacacacaccttctattcatattaaacagaaatagagaaacagttcataagactagaggacagttaaacactagatgtgt

SEQ ID NO: 1226 - DNA, 101 bp, Homo sapiens
  DISO7_10000244
  Located on chromosome 1
  Distance between a terminus base of telomere on chromosomal short arm and 5'-terminus of this base sequence : 149337754
  Distance between 3'-terminus of neighbour sequence of sequence listing upward to telomere on chrosomal short arm and 5'-terminus of this base sequence : 39925
tcactcaaggtgcatagtttattagttgagacagttttgaagttttttttgttttgttttttgtttgtttgtttgtttgtttggtggcagctttagcatga

SEQ ID NO: 1227 - DNA, 174 bp, Homo sapiens
  DISO7_10000242
  Located on chromosome 1
  Distance between a terminus base of telomere on chromosomal short arm and 5'-terminus of this base sequence : 149373987
  Distance between 3'-terminus of neighbour sequence of sequence listing upward to telomere on chrosomal short arm and 5'-terminus of this base sequence : 36132
aagtccattgctacgtatgctataaaagaatatccactataacttgctgaataaagaaaaaatatgacatgcatatgagcattttgcatataaattgtgtgtgtgtgtgtgtgtgtgtgtgtgtgtgtctagaaaaatttctaagtagctaaaaccatatctgtcagtgccact

SEQ ID NO: 1228 - DNA, 250 bp, Homo sapiens
  DISO7_10008116
  Located on chromosome 1
  Distance between a terminus base of telomere on chromosomal short arm and 5'-terminus of this base sequence : 149419203
  Distance between 3'-terminus of neighbour sequence of sequence listing upward to telomere on chrosomal short arm and 5'-terminus of this base sequence : 45042
tgtgactaggcaatttgaggaaaacttattaaatcaaattttgtttaaacacaacttcttatttatgtatttatttatttatagacagggtctcactgtgtcacccacacgggagtgtagtgacgcaatcatggctcactgcagcctcatgcccctgggctcaagcaatcctcccaccttagcttccagaatagctgagactacaggcaccatcacgcccggctacaaatgcatcttcttacataacatt

SEQ ID NO: 1229 - DNA, 275 bp, Homo sapiens
  AC024468.3_37187
  Located on chromosome 1
  Distance between a terminus base of telomere on chromosomal short arm and 5'-terminus of this base sequence : 149529586
  Distance between 3'-terminus of neighbour sequence of sequence listing upward to telomere on chrosomal short arm and 5'-terminus of this base sequence : 110133
tctgacttgatcaaatccaaaggaaagttccaaattatggggacaagacctctgaattggataaatctctgcagaaaaaataaataaataaataataaaaatttaaaaagagggagagcagggaaagaaaaataaataaataaataaataaataaataaataaataaataagcagccatcacgaaaataaaggttttcattgggcacggtggctcacgcctgtaatcccagcactttgggaggccgaggcaggcaaatcatgaggtcaggagatg

SEQ ID NO: 1230 - DNA, 306 bp, Homo sapiens
  AL355866.1_30441
  Located on chromosome 1
  Distance between a terminus base of telomere on chromosomal short arm and 5'-terminus of this base sequence : 149610856
  Distance between 3'-terminus of neighbour sequence of sequence listing upward to telomere on chrosomal short arm and 5'-terminus of this base sequence : 80995
tcctttgatcgacttctatcatttcatgtgcacctcggaaaataaggcaaaatccactgtggatttagggccagagaagagcccttgaagcctcggtcacagaggcttcaggaccgacacagtctgggtcctgttttgaggtgaaattcattccttccttccttccttccttccttccttccttccttccttccttccttccttccttctttcctttccctccctccctttctttttctttctttctttctttgtctctctttctgtctttctttctttcttttctttccttaaagcctaggtcag

SEQ ID NO: 1231 - DNA, 125 bp, Homo sapiens
  DISO7_10000001
  Located on chromosome 1
  Distance between a terminus base of telomere on chromosomal short arm and 5'-terminus of this base sequence : 149818284
  Distance between 3'-terminus of neighbour sequence of sequence listing upward to telomere on chrosomal short arm and 5'-terminus of this base sequence : 207122
cactaagtatggctataggacaggtctctctctctctctctctctgtctctctctcattattgcatcattattttttgccatcagtgtgagtttttggttttgatgttatgaagtgaatttctgg

SEQ ID NO: 1232 - DNA, 101 bp, Homo sapiens
  DISD22_0000740
  Located on chromosome 1
  Distance between a terminus base of telomere on chromosomal short arm and 5'-terminus of this base sequence : 149899692
  Distance between 3'-terminus of neighbour sequence of sequence listing upward to telomere on chrosomal short arm and 5'-terminus of this base sequence : 81283
tgaagctcttgatctagtagatgagttatatatatatatatatatatatatatatatgccaaaaatattacaatttcagagaagtgttatagggtctaatg

SEQ ID NO: 1233 - DNA, 130 bp, Homo sapiens
  DISD22_0000751
  Located on chromosome 1
  Distance between a terminus base of telomere on chromosomal short arm and 5'-terminus of this base sequence : 150342323
  Distance between 3'-terminus of neighbour sequence of sequence listing upward to telomere on chrosomal short arm and 5'-terminus of this base sequence : 442530
gcatcctcaaatcatcatagcaaaaataccaaagcacaatccctccctgttttgtgtgtgtgtgtgtgtgtgtgtgtgtgtgtgtgtgtgtgtgtaaacttgtatgttgacaaatattctctagcatcag

SEQ ID NO: 1234 - DNA, 233 bp, Homo sapiens
  AL138795.4_28945
  Located on chromosome 1
  Distance between a terminus base of telomere on chromosomal short arm and 5'-terminus of this base sequence : 150489624
  Distance between 3'-terminus of neighbour sequence of sequence listing upward to telomere on chrosomal short arm and 5'-terminus of this base sequence : 147171
cagtagcaggatcgtgcttgtgaatagccactgcactccaccctgggtaacagaccctgtctctctagatagatagatagatagatagatagatagatagatagatagagcgtatatatatacatatgctaattctatagaaacatgtaactgtcctttgacattttaataaaaattgtgtatacaagatttcaaatttaattattctcttctccttccataggatcaaagac

SEQ ID NO: 1235 - DNA, 284 bp, Homo sapiens
  DISO7_00008972
  Located on chromosome 1
  Distance between a terminus base of telomere on chromosomal short arm and 5'-terminus of this base sequence : 150786034
  Distance between 3'-terminus of neighbour sequence of sequence listing upward to telomere on chrosomal short arm and 5'-terminus of this base sequence : 296177
ctgccttaggctagtgggggacaggtgtgtgtgtgtgtgtgtgtgtgtgtgtgtgtgtgtgtgtgtgtttagagggaaactacgtggtaagagacatggccacgtttacactgatttttcttccttagaagaggacttgtcccctgggtccactctcctggtcacccttatccttctctaggtccccatctcagtcttctcatgtctttctcttccccatcaatattcctggtttcccccatgctggccttggccatcttcttttctccctgcaactcaagtga

SEQ ID NO: 1236 - DNA, 121 bp, Homo sapiens
  DISO7_10000702
  Located on chromosome 1
  Distance between a terminus base of telomere on chromosomal short arm and 5'-terminus of this base sequence : 151009527
  Distance between 3'-terminus of neighbour sequence of sequence listing upward to telomere on chrosomal short arm and 5'-terminus of this base sequence : 223209
cttccacttgctctaatacccccttcagacacgcgcgcgcacacacacacacacacacacacacacacagtttctctctgtggggttctcattgtttgtctttctctgcttgactctaatg

SEQ ID NO: 1237 - DNA, 101 bp, Homo sapiens
  DISO7_10000700
  Located on chromosome 1
  Distance between a terminus base of telomere on chromosomal short arm and 5'-terminus of this base sequence : 151126673
  Distance between 3'-terminus of neighbour sequence of sequence listing upward to telomere on chrosomal short arm and 5'-terminus of this base sequence : 117025
tgagaagatcggagatgaagaaaacgtacaaaattatatatatatttatatatataataacatgacatatctatgtacaacatggctgggacagttgaaga

SEQ ID NO: 1238 - DNA, 444 bp, Homo sapiens
  AL356292.4_24806
  Located on chromosome 1
  Distance between a terminus base of telomere on chromosomal short arm and 5'-terminus of this base sequence : 151228190
  Distance between 3'-terminus of neighbour sequence of sequence listing upward to telomere on chrosomal short arm and 5'-terminus of this base sequence : 101416
aagcctgtactcataaactttgacatatcttcattacaaaggagaaaacagccactagatatgaaaagatttgcccaaagtcattcaactaggagagaaatgaagactagaaccttgttattagggttaaaaatagtgaaaatcttggtctaataattattttgaattataattaagtcactgttttgtgtgtttttttttgttgttgttgttgttgttgttttttgagacggagtctcactcttttgcccaagctggagtgcagtggcataatcttggctcactgcaacctccacctcctgggttcaagggattctcctgcctcagcctccccagtagctgggatcacaggcacgcaccaccacatccaactaatttttgtatttttagtagagatggggtttcaccatgttggccagactggtcttgaactcctgacctcag

SEQ ID NO: 1239 - DNA, 245 bp, Homo sapiens
  chr1.fa.O7frz.171662655
  Located on chromosome 1
  Distance between a terminus base of telomere on chromosomal short arm and 5'-terminus of this base sequence : 151269046
  Distance between 3'-terminus of neighbour sequence of sequence listing upward to telomere on chrosomal short arm and 5'-terminus of this base sequence : 40412
agctccttgtatgatttcctaggaaaacctgtcttactgcttttaacacaactcattcatgatctgatattgtctggttctcactcagccattccttcgttcatcaaactcaaaatgtctttattaatatatactatatgtatagtttagtaatatgcgtgtgtgtgtgtgtgtgtgtgtgtatgtgttagtatattcatggaaaaaaggatacactcaaatatatccaattgagaatgattacc

SEQ ID NO: 1240 - DNA, 301 bp, Homo sapiens
  AL355860.2_103471
  Located on chromosome 1
  Distance between a terminus base of telomere on chromosomal short arm and 5'-terminus of this base sequence : 151338455
  Distance between 3'-terminus of neighbour sequence of sequence listing upward to telomere on chrosomal short arm and 5'-terminus of this base sequence : 69164
gacttgtttcctctagccaaactctggccaaaagactgaacataataaaataggggagaaaaaaagaacaacagtacagatacaaacaacaacaacaacaacaacagaaaacaccttatacattgaccaataaccatatctatagaataaaaagctgttatcattgaacctagcacaaagccaagcaccaggaggtagaaaaaataccagataattatccatacaaatgagataaaaacatggataattcttttagaacggaaaaaaaaaagtattgtaggtttggcttttactgttctat

SEQ ID NO: 1241 - DNA, 289 bp, Homo sapiens
  AL355860.2_51625
  Located on chromosome 1
  Distance between a terminus base of telomere on chromosomal short arm and 5'-terminus of this base sequence : 151475753
  Distance between 3'-terminus of neighbour sequence of sequence listing upward to telomere on chrosomal short arm and 5'-terminus of this base sequence : 136997
gtttaatagcaccttgctatgaacttgggaaatcgtggggaaatgactgaaggaagtaaagagctttattattattattattattattatttttagaggcaggatcttgctatgttgcccagactgaactcaaactcctggtctcaagcaacccgtctgtctcagcccaagacctttttcgttagagctttttacgaaaagttaaactttcatctgagaagggatgtcttgagcatagtctctttttgaggaaagttggggggacctctgattagtcctattagccaga

SEQ ID NO: 1242 - DNA, 319 bp, Homo sapiens
  AC073204.3_2047
  Located on chromosome 1
  Distance between a terminus base of telomere on chromosomal short arm and 5'-terminus of this base sequence : 151593545
  Distance between 3'-terminus of neighbour sequence of sequence listing upward to telomere on chrosomal short arm and 5'-terminus of this base sequence : 117503
tgagatggtgacactgcactacagcctgggtgacagagcgaaactccatctcaaaaataaaataaaataaaataaaataaaataaaataaaataaaataaaataaaataaattaaactagttagaaatcttgtcttttctccaccctcctcccagcctgagactgcttccttcttgtaaacctacaggaatttggggctaggggaaggcctgggagatgaggttgaggaacattaaagttactgaaacaaaataagcctagtcactcaaattgattatcctcttgattcacatatgtttatgctagctgcatatcattt

SEQ ID NO: 1243 - DNA, 400 bp, Homo sapiens
  M1_151716728
  Located on chromosome 1
  Distance between a terminus base of telomere on chromosomal short arm and 5'-terminus of this base sequence : 151716685
  Distance between 3'-terminus of neighbour sequence of sequence listing upward to telomere on chrosomal short arm and 5'-terminus of this base sequence : 122821
cccctttccaactgaaatttaatcttttctgatttcctatctttgtgtgtgtgtgtgtgtgtgtgtgtgtgtgtgtgtctcactctgttgcccaggctggagtgctggagtgcagtggtgcgatctcagctcatcgcaacctccccctcctgggttcaagcgattctcccgcctcagcctcctgagtagctgggattacaggtgagcaccaccacgcccggctaatttttgtatttttagtagagacagggtttcaccatgttggccagactggtctcgtactcgtaaccttaggtgatccacttgcctctgcctcccaaagtgctgggattacaggggtgagccaccatgcctgacccctattcgttgttaatacctttacaaactcaccacattctgt

SEQ ID NO: 1244 - DNA, 191 bp, Homo sapiens
  D1S498
  Located on chromosome 1
  Distance between a terminus base of telomere on chromosomal short arm and 5'-terminus of this base sequence : 151881937
  Distance between 3'-terminus of neighbour sequence of sequence listing upward to telomere on chrosomal short arm and 5'-terminus of this base sequence : 164852
ttgctgaagggacatagtggagtttaagttaatttggaaggcctatatgtgtatggacacacacacatacacacacacacacacacacacacacacacacacacaccagtatatggtgaatgaatgaatggaaggcttcttagaaatattgtgagtcaggtcttagaatagatattggatataacccagca

SEQ ID NO: 1245 - DNA, 157 bp, Homo sapiens
  Z24441.1_137
  Located on chromosome 1
  Distance between a terminus base of telomere on chromosomal short arm and 5'-terminus of this base sequence : 151881951
  Distance between 3'-terminus of neighbour sequence of sequence listing upward to telomere on chrosomal short arm and 5'-terminus of this base sequence : -177
tagtggagtttaagttaatttggaaggcctatatgtgtatggacacacacacatacacacacacacacacacacacacacacacacacacaccagtatatggtgaatgaatgaatggaaggcttcttagaaatattgtgagtcaggtcttagaatag

SEQ ID NO: 1246 - DNA, 290 bp, Homo sapiens
  D1S2347
  Located on chromosome 1
  Distance between a terminus base of telomere on chromosomal short arm and 5'-terminus of this base sequence : 151902158
  Distance between 3'-terminus of neighbour sequence of sequence listing upward to telomere on chrosomal short arm and 5'-terminus of this base sequence : 20050
ttgagcactgccttagactgcatgtatacatatttgcagatactcataaataaatatgggtataacgggctggacatgatggctcatgcctataatctcaatactttgggaggcaaaggcaagaggattgcttggggccaggagtttgagaccagcctgggcaacaaagtgagactctgtctctctctaaacacacacacacacacacacacacacacacacacacacacacacacacaccacacacagccaggtgtggtggtacatgcctgtggttccagcaacttggg

SEQ ID NO: 1247 - DNA, 101 bp, Homo sapiens
  DISO7_10000703
  Located on chromosome 1
  Distance between a terminus base of telomere on chromosomal short arm and 5'-terminus of this base sequence : 152105115
  Distance between 3'-terminus of neighbour sequence of sequence listing upward to telomere on chrosomal short arm and 5'-terminus of this base sequence : 202667
aggtcagcacaatccctgcagctgccacttgtctttcgtgtgtgtgtgtgtgtgtgtgtgtgtgtgtataaaaccaaaatgtgtgacacaataaatgctgg

SEQ ID NO: 1248 - DNA, 335 bp, Homo sapiens
  chr1.fa.O7frz.172664015
  Located on chromosome 1
  Distance between a terminus base of telomere on chromosomal short arm and 5'-terminus of this base sequence : 152312431
  Distance between 3'-terminus of neighbour sequence of sequence listing upward to telomere on chrosomal short arm and 5'-terminus of this base sequence : 207215
cctaaaaggcaattgtttaaagcaaagataacaatgtatcattaagtttataacacatatagaagtcaatgtatgacaacaatagcacaaaggatggcggggggaaatatactcttgtaagtgtcttaaattatatatatagtgtgtgtttgtttgtgtgtgtgtgtgtgtgtgtctgtgtccagcctgggcaacagagagaaaccttgacacacgcacacacacagaaggtattatgctaagtatcttctataactacagtggggtaaagttagaaattggtaacagagggaaagctagaaaactcacaaatttgtaggaattaacatctgacg

SEQ ID NO: 1249 - DNA, 296 bp, Homo sapiens
  AF254851.1_953
  Located on chromosome 1
  Distance between a terminus base of telomere on chromosomal short arm and 5'-terminus of this base sequence : 152396329
  Distance between 3'-terminus of neighbour sequence of sequence listing upward to telomere on chrosomal short arm and 5'-terminus of this base sequence : 83563
gttggaggtgaactaagcttaccttaatgatctcctcatgtccatcatgggactccaccagttctgaagccagagaatgaccagctgagtggctggacaccatggcataggtcttcctgcccgcctggccaaagagagatgagagagagagagagagagagagatggctcagacaccacatggcaagcccagaactcctgcccctcagctaatgcagaagacctgtttctcaaaagacttgaaggattagtctgactttcctctccaaaaattcgtttccgaacttctaacagaag

SEQ ID NO: 1250 - DNA, 258 bp, Homo sapiens
  D1S2343
  Located on chromosome 1
  Distance between a terminus base of telomere on chromosomal short arm and 5'-terminus of this base sequence : 152397360
  Distance between 3'-terminus of neighbour sequence of sequence listing upward to telomere on chrosomal short arm and 5'-terminus of this base sequence : 735
ctagcatattcttcctgaactaaactataggaaagtacctgaattcaaactcccatttctatgagccacatggaaattatccaagtgaaaacaggcaagataataggtattcatctagagatcaacctaatttcaaagaatgaagcaggttttctttcataagtcaaagaagtgtgtgtgtgtgtgtgtgtgtgtgtgtgtgtgcgcgcgcgcgcgcatgactgcagcctcaacctcccaggcttaagtgatccaccc

SEQ ID NO: 1251 - DNA, 253 bp, Homo sapiens
  AC024491.4_84326
  Located on chromosome 1
  Distance between a terminus base of telomere on chromosomal short arm and 5'-terminus of this base sequence : 152443890
  Distance between 3'-terminus of neighbour sequence of sequence listing upward to telomere on chrosomal short arm and 5'-terminus of this base sequence : 46272
tctcaaactcctgaccttgtaatctgcccatctcagcctcccaaaatgttgggattacaggcgtgagccaccatgcccggcctacaatctcatttctcaaagttttattaggttctgtggcaaacctgcctaataatttttatagtttatcattgttttctctttttgtgatttcatcttttatttatttatttatttatttatttatttatttatttatttatttatttttctgatggagtatcgctctgtt

SEQ ID NO: 1252 - DNA, 101 bp, Homo sapiens
  DISD22_0000763
  Located on chromosome 1
  Distance between a terminus base of telomere on chromosomal short arm and 5'-terminus of this base sequence : 152641717
  Distance between 3'-terminus of neighbour sequence of sequence listing upward to telomere on chrosomal short arm and 5'-terminus of this base sequence : 197574
acttcttgaaggatgatggcaaaaacatatatatatatatatatatatatattcagcaaacttttcttctttctgcccaccattctattagtgctgattgc

SEQ ID NO: 1253 - DNA, 101 bp, Homo sapiens
  DISD22_0000765
  Located on chromosome 1
  Distance between a terminus base of telomere on chromosomal short arm and 5'-terminus of this base sequence : 152716518
  Distance between 3'-terminus of neighbour sequence of sequence listing upward to telomere on chrosomal short arm and 5'-terminus of this base sequence : 74700
tcctgttcaaattcagatacaaggaggtgtgtgtgtgtgtgtgtgtgtgtgtgtgtgtgtgtgtgtgtgtatgctgggagagaactactaaggagctgcct

SEQ ID NO: 1254 - DNA, 303 bp, Homo sapiens
  chr1.fa.O7frz.173215606
  Located on chromosome 1
  Distance between a terminus base of telomere on chromosomal short arm and 5'-terminus of this base sequence : 152887739
  Distance between 3'-terminus of neighbour sequence of sequence listing upward to telomere on chrosomal short arm and 5'-terminus of this base sequence : 171120
tcattaacagtttctttgaggtttggagaagaggaaatcaagatggctgacaaggttggaaattgagaatagaattgaacgaagcccgtggcagaggtgtgtgtgtgtgtgtgtgtgtggtgggggtacatgtgacacacatgttattccagctactacagatgcagaagtcactggggacacacacacacacacaggcactcagaatgtatgtgagagagatagacagatatagagaaaacaatgatcaaatatgagctttttgtatagtgaagaaatattctccaggaagtgcttatatca

SEQ ID NO: 1255 - DNA, 387 bp, Homo sapiens
  chr1.fa.O7frz.173399402
  Located on chromosome 1
  Distance between a terminus base of telomere on chromosomal short arm and 5'-terminus of this base sequence : 153071478
  Distance between 3'-terminus of neighbour sequence of sequence listing upward to telomere on chrosomal short arm and 5'-terminus of this base sequence : 183436
agatatgaaacgtctgagcacattttccctgcatgctgaaatcctggatttgaatctgggtaaagaactgagaaagacacccttctttgcaaagactgtctctatgtggttgggacgtacgtgtgtgtgtgtgtgtgtgtgtgtgtgtgtgtgtgtgcagtgagaggtataagagtacaggggttttggtccctgtgttgggttttccaagcaacatttctttaggaatgggctggttccttcaggagacactcataatgtacctagaaaagataactagaaaagttaattccaaatcagcctttaatataaaagataaacaattgatgcctcctttgataagagttaatagcgataaataaagtaagctggtttatgagatcatag

SEQ ID NO: 1256 - DNA, 421 bp, Homo sapiens
  chr1.fa.O7frz.173573587
  Located on chromosome 1
  Distance between a terminus base of telomere on chromosomal short arm and 5'-terminus of this base sequence : 153254604
  Distance between 3'-terminus of neighbour sequence of sequence listing upward to telomere on chrosomal short arm and 5'-terminus of this base sequence : 182739
ctaaagctatttgcaatgacaggtatgtctataattagaagactgcttatgaacctacactgcgatcaaatagcatattttcacttctatctgctttccatttcttctgttacataagctcactcctccaaacaagctcggctgagtacatattcctcagtgtcactacacttctggtgatgttttcttatatctcatatttcacacacacacacacacacacacacacacagacacacacacacacacacacacagacacacacacacacacaaaccctgggaagctgcctagttacccaccccttagtcaagctctgccttggcctcaggctctctgaagaagggctcactgatgattgtggactatgcagggctgagagagtgaccggggcacactttaagtaggaaacaggaacttt

SEQ ID NO: 1257 - DNA, 464 bp, Homo sapiens
  chr1.fa.O7frz.173491881
  Located on chromosome 1
  Distance between a terminus base of telomere on chromosomal short arm and 5'-terminus of this base sequence : 153320680
  Distance between 3'-terminus of neighbour sequence of sequence listing upward to telomere on chrosomal short arm and 5'-terminus of this base sequence : 65655
tgaaatagccaagtcagtaaagttgtttggacagaaaaatctaatttacttaagttaaaaaaatgtacttactgctccatacattttctaaagcaatattctctttctctctgtctctctctctctgtgtgtgtgtgtgtgtgtgtgtgtgtgtgtgtgtgtgtgtgtgtgtgtgtttaaaggattaatattaagaaagcagaatagcatcacatccacttgggaaccatgtagaaaagtgtaataatttttgtagctgttcttattaattgtgttgtgcacatgcaagagtctggttaaataaagttctattgaaacccaggtttctttctttaagaagcctatttacagtatccaaaagtcagaattggaattcaatgaagtactatttcccttgtcctctccactgtgtcccaaaggtaaggagcctcttgttacagagctctgctgacttaggactttct

SEQ ID NO: 1258 - DNA, 348 bp, Homo sapiens
  chr1.fa.O7frz.173740244
  Located on chromosome 1
  Distance between a terminus base of telomere on chromosomal short arm and 5'-terminus of this base sequence : 153359326
  Distance between 3'-terminus of neighbour sequence of sequence listing upward to telomere on chrosomal short arm and 5'-terminus of this base sequence : 38182
catttgtatattcttacaggcaactctatatagtcttattgcacaaatttctcttcttatctttctatatgcatgtctaatgatgatagtctgttttcactgctttatgtctatttctttcattgttcttcctcaatctatagttctctctctctctctctctctctttctctctctctttccctctctctttctttctctctttctctctctctttctaactcaatttttgtctctctaatttgaacctaatattaggaccagaagtaattttagaatttatttagaccaactgattcccagataattcaagtgattttgctggaggccagataacttctaatgtat

SEQ ID NO: 1259 - DNA, 372 bp, Homo sapiens
  chr1.fa.O7frz.173841071
  Located on chromosome 1
  Distance between a terminus base of telomere on chromosomal short arm and 5'-terminus of this base sequence : 153566132
  Distance between 3'-terminus of neighbour sequence of sequence listing upward to telomere on chrosomal short arm and 5'-terminus of this base sequence : 206458
tgtctatagcctgattctcaatagaaacctagaattctatatttccataaaaaatgagctcccccattggcttgctttcattttattcagctagattccagcagcttgaggacaggatctttttacatggcttccatttgcatggcacctgattctgtgcttagatacatggtaggtgctcaacaaatacccaggaggtgcattttgtttattcccccagtgcctagcaaaggacacggcgcacgaagaaagccccctacatagaagatagtagtggggacgaactgagtgtgtgtgtgtgtgtgtgtgtgtgtgtgtgtaggtgtgtagctgactatagagagacccaccctcacagaaccttgctatgac

SEQ ID NO: 1260 - DNA, 441 bp, Homo sapiens
  chr1.fa.O7frz.173957960
  Located on chromosome 1
  Distance between a terminus base of telomere on chromosomal short arm and 5'-terminus of this base sequence : 153674529
  Distance between 3'-terminus of neighbour sequence of sequence listing upward to telomere on chrosomal short arm and 5'-terminus of this base sequence : 108025
actttacaagttgacgtggagaactggaaactcagagttcctcacagaccagctacatgaggaatggccataacatgaagagggacagctaatagtcacagtttccccaagttaggacatccaggccctgagacatagagcgaggcatacttcacacacacacacacacacacacacacacacacacacacccctcatgggtctttatcatctatcttcatgtctaaagagcttagctttatgttctttaagagtctgatagccttaggctcattcctaatacttctacttcctgattttctagtagatcattaagtatgaattactagtacataaaaatgacaggaaagaacaaaaaatttatttggtctaatatttgatgcaacattttatctcatattttactatgatacattccactaaaccaaatagtgctagcaa

SEQ ID NO: 1261 - DNA, 343 bp, Homo sapiens
  chr1.fa.O7frz.174141251
  Located on chromosome 1
  Distance between a terminus base of telomere on chromosomal short arm and 5'-terminus of this base sequence : 153800890
  Distance between 3'-terminus of neighbour sequence of sequence listing upward to telomere on chrosomal short arm and 5'-terminus of this base sequence : 125920
aagtaccaaacgaaatcagataaaacctgagaaggaagatgcagatttggacaacagggaattcttggtcaatgtgcaatttgaatcagaagagcataggctatgagagcaccctatctggatgccaatcccaactgtcatcttgactgtgtactcatgagtgtatgtgtgtgtgtgtgtgtgtgtgtgtgtaagatgtaaaatttggcatgttagatcatcaaataaatcagccttgagaaacaaaaataaaatcctaagcctcccaactgactaagtggacccgctcttggccaagggggccccagagaaacctcaaaactgagttcctagcattacagaa

SEQ ID NO: 1262 - DNA, 107 bp, Homo sapiens
  D1S2346
  Located on chromosome 1
  Distance between a terminus base of telomere on chromosomal short arm and 5'-terminus of this base sequence : 153828916
  Distance between 3'-terminus of neighbour sequence of sequence listing upward to telomere on chrosomal short arm and 5'-terminus of this base sequence : 27683
aagtgggtctcaccaggcagagaatgtgtgtgtgtgtgtgtgtgtgtgtgtgtgtgtgtgtgtgtgtgtgtatgttggaggatgaagaggaggtgcagggcaagata

SEQ ID NO: 1263 - DNA, 255 bp, Homo sapiens
  AL157405.4_124921
  Located on chromosome 1
  Distance between a terminus base of telomere on chromosomal short arm and 5'-terminus of this base sequence : 153874961
  Distance between 3'-terminus of neighbour sequence of sequence listing upward to telomere on chrosomal short arm and 5'-terminus of this base sequence : 45938
ggtgctgataagaactagtggtaatggtgatgatagtggctgtagcagtggtggtgatgatgagaatgaatcaaggtagcaatgtgatagattggtgctggtgatggtggtggtgatggtggtggtggtggtaatggtggtggtaatggtggtgtaggtggtggaggtggtggtggtggtggtggtgatggtggtagaagtggtggtggtgaaggtggtggatgttggtggtggtgataattgtagtggaggtgg

SEQ ID NO: 1264 - DNA, 481 bp, Homo sapiens
  AL161636.7_109719
  Located on chromosome 1
  Distance between a terminus base of telomere on chromosomal short arm and 5'-terminus of this base sequence : 153903093
  Distance between 3'-terminus of neighbour sequence of sequence listing upward to telomere on chrosomal short arm and 5'-terminus of this base sequence : 27877
acacatcaccattacagcattaaagcattttaaattggactatataatacttttaccctgtgagttttatattttctatgtttttgtgttgctaaccagtgcccttttctttcatcttaaagaattccctttagcatttcttgtaatataggtctggtggtgatgaactctcctggcttttgtttgtctgagaaagtctttatctatccttcatttctgaagggcagatttgctgggtacagtattctacattgatcgttttgttttgttttgttttgttttgttttgttttgtttttccttcagcactgtgaatatattatccctctctccagggagagaatatattatccagagaatatatatatccagagaatatatatatccagagaatatatatatccagagaatatattatcactctctccaggcctgtaaggcctctgcagagaaatccactgttatccttactggagctcctt

SEQ ID NO: 1265 - DNA, 218 bp, Homo sapiens
  AC011666.28_49513
  Located on chromosome 1
  Distance between a terminus base of telomere on chromosomal short arm and 5'-terminus of this base sequence : 153968384
  Distance between 3'-terminus of neighbour sequence of sequence listing upward to telomere on chrosomal short arm and 5'-terminus of this base sequence : 64810
tcagcaatccaaatagtatcaacccaaagaaaaagaaatcattatatcaaaaagacatttgcactcatatgtttatctcaacactattcataatagcaaaggcgttgaatcacttcaatgtccatcaatggatgactgaataaagaaaaggtagggtgcgtgcgtgtgtgtgtgtgtgtgtgtgtgtgtacaccatagaatactattcagccatcaaa

SEQ ID NO: 1266 - DNA, 396 bp, Homo sapiens
  AL157404.7_50967
  Located on chromosome 1
  Distance between a terminus base of telomere on chromosomal short arm and 5'-terminus of this base sequence : 154134562
  Distance between 3'-terminus of neighbour sequence of sequence listing upward to telomere on chrosomal short arm and 5'-terminus of this base sequence : 165960
gtggtagatgctacagctctagagaaagttggcatttgttgtggctatttacctgctgtccatgcctgttgtgactgacatccagcaatgttgatggacactgttaggagctactcttattgtaacaatgagggtgccatgcaccactcccagtattctctttcttctctcttacgtctactttctgcccaatgatcctttattctcttgttagatacagaaatattgggaagaccaaggaagagctcagggctctggctgccttatagtgataggcagataggaaggcaaacactaacattaaattaaattaaattaaattaaattaaattaaattaaattaaattaaattaaaatataaaataaaataagccctacaaggagttgtctgtttgg

SEQ ID NO: 1267 - DNA, 101 bp, Homo sapiens
  DISD22_0000771
  Located on chromosome 1
  Distance between a terminus base of telomere on chromosomal short arm and 5'-terminus of this base sequence : 154211759
  Distance between 3'-terminus of neighbour sequence of sequence listing upward to telomere on chrosomal short arm and 5'-terminus of this base sequence : 76801
gatgggcaattggagttcctcatcatccttatttactagtagtagtagtagtagtagtagtagtagtagtagtagtaactctgaaattcaccagagtctga

SEQ ID NO: 1268 - DNA, 109 bp, Homo sapiens
  DISD22_0000777
  Located on chromosome 1
  Distance between a terminus base of telomere on chromosomal short arm and 5'-terminus of this base sequence : 154583960
  Distance between 3'-terminus of neighbour sequence of sequence listing upward to telomere on chrosomal short arm and 5'-terminus of this base sequence : 372100
tcttcatcacctggcctctggacacacacacacacacacacacgcacacacacacgcacacacgtacacacaccaaccccagctaaatttagactccacttctgggagg

SEQ ID NO: 1269 - DNA, 314 bp, Homo sapiens
  AL358472.21_99455
  Located on chromosome 1
  Distance between a terminus base of telomere on chromosomal short arm and 5'-terminus of this base sequence : 154654266
  Distance between 3'-terminus of neighbour sequence of sequence listing upward to telomere on chrosomal short arm and 5'-terminus of this base sequence : 70197
gtggatctgagtgatctgagatcacaccactgcactccagcctgggtgacacagcaagaccctgtctcaataaataaataaataaataaataaataaataaataaataaataaataaaaataaaaaaaatagatggctaggtgcagtggctcatgcctataatcctagcactttgggaggctgaggcagaaagatgacctgaatctaggagtttgagaccagcctggacaacatagcgagaccctgtgtctgcaaaaaaataaaaataattagccaggtatgctggcacacacttgtggtcctgctactttgga

SEQ ID NO: 1270 - DNA, 127 bp, Homo sapiens
  D1S2858
  Located on chromosome 1
  Distance between a terminus base of telomere on chromosomal short arm and 5'-terminus of this base sequence : 154710382
  Distance between 3'-terminus of neighbour sequence of sequence listing upward to telomere on chrosomal short arm and 5'-terminus of this base sequence : 55802
ggctgagtagtattccatcgcgtgtgtgtgtgtgtgtgtgtgtgtgtatcacagtttctttatccactcgttaattgatgggcatctcagttggttccacatttttgcaatttcaaagtgtgctgct

SEQ ID NO: 1271 - DNA, 381 bp, Homo sapiens
  AL354980.4_91142
  Located on chromosome 1
  Distance between a terminus base of telomere on chromosomal short arm and 5'-terminus of this base sequence : 154931541
  Distance between 3'-terminus of neighbour sequence of sequence listing upward to telomere on chrosomal short arm and 5'-terminus of this base sequence : 221032
cagaattagccaggcatagtagtgcatgcctgtaatcccagctactcactactcaggaggctgaggcaggagaatcacttgacccctggaggcagaggttgcagtgagccaagatcatgccattgcactccagcctggacaacaaaagcaaaactccatctcaaacaaaacaaaacaaaacaaaacaaaacaaaacaaaacaaacaaacaaacaaaaaaaacgagaataaaaactgagcagacacattagcagctgcacactgtggaatgatagactctacagtttaactccagacaaatgacacacacacacacatcagcatcaccagcatcaccaccattcagaaaaatacaatagaatccagactctacggtttaact

SEQ ID NO: 1272 - DNA, 172 bp, Homo sapiens
  D1S305
  Located on chromosome 1
  Distance between a terminus base of telomere on chromosomal short arm and 5'-terminus of this base sequence : 154947894
  Distance between 3'-terminus of neighbour sequence of sequence listing upward to telomere on chrosomal short arm and 5'-terminus of this base sequence : 15972
ccagtctcggtatgtttttactagcagcatgaaaatggactaacacagacgctgtctcaaaacacacacacacatacacacacacacacacacacacacacacacacacacacacatatatatatatatatatatagtgagctaactctgcaggcttggacagaggtttcag

SEQ ID NO: 1273 - DNA, 132 bp, Homo sapiens
  chr1.fa.O7frz.175671508
  Located on chromosome 1
  Distance between a terminus base of telomere on chromosomal short arm and 5'-terminus of this base sequence : 155368173
  Distance between 3'-terminus of neighbour sequence of sequence listing upward to telomere on chrosomal short arm and 5'-terminus of this base sequence : 420107
agtgatgtaagtatccatctcaagaagttagaaacacacacacacacacacacactcacacacacagagtaaattaaacacagaaagtagaaagaaaggaaatgataaagataggagtagacgtactgtgag

SEQ ID NO: 1274 - DNA, 319 bp, Homo sapiens
  chr1.fa.O7frz.175786800
  Located on chromosome 1
  Distance between a terminus base of telomere on chromosomal short arm and 5'-terminus of this base sequence : 155385409
  Distance between 3'-terminus of neighbour sequence of sequence listing upward to telomere on chrosomal short arm and 5'-terminus of this base sequence : 17104
gctaaagcaagtctaaggctagcacttctcatatcatgtctctctctctctctctctctctctctctgtgtgtgtgtgtgtgtgtgtgtgtgtgcgtttctgtctctatctctctccacacgtacacacaccctctccaagcatcttgggagacctgagccaacacataagaagtctagctaccctgaagccaccatactagagagatcatgtgtaaagacctcacagaaatagcgagagatgcctccaaaactgagctggcaagtattctctctttttctatcgtccacaaaaactcctataagattggaatgatctt

SEQ ID NO: 1275 - DNA, 406 bp, Homo sapiens
  AC034149.3_137858
  Located on chromosome 1
  Distance between a terminus base of telomere on chromosomal short arm and 5'-terminus of this base sequence : 155656085
  Distance between 3'-terminus of neighbour sequence of sequence listing upward to telomere on chrosomal short arm and 5'-terminus of this base sequence : 270357
gaagagtgacatcacctggttcacgtttttaaaaggtcagtctgggccgcatgcagtggctcacacctgtaatcccactattttgggaggccaaggtgggtggatcacctgaggtcaggagttcgagaccagcctggccaacatggtgaaaacccgtctctactaaaaatacaaaaattagccaggcgtggtggtggacacctgtagtcccagctgcttgggaggctgaggcagaagaatcacttaaacccaggaggcagaggttgcagtgagccaagattgcgccactgcactccagcccaggcgacaagtgtgagactccatctcaaaaataaataaataaataaataaataaataaataaataaataataaaaggtcagtctggctactgtgtaatgaataga

SEQ ID NO: 1276 - DNA, 274 bp, Homo sapiens
  AL139128.17_131024
  Located on chromosome 1
  Distance between a terminus base of telomere on chromosomal short arm and 5'-terminus of this base sequence : 155963199
  Distance between 3'-terminus of neighbour sequence of sequence listing upward to telomere on chrosomal short arm and 5'-terminus of this base sequence : 306708
caggtgaggtctcataattcactgcaacctacaattcctggccttaaatgatcctgctgcttcagccttctaaagtgctgggcttacaggtatgagccactgggctcaactagaaataactttttatttatttatttatttatttatttatttatttatttatttatttttaacgagacagagtcttactctgtagcccacgctagagtgcagtagcacaataatggctcactacaacctctaactcttggcttcaagtaatctttctgccttg

SEQ ID NO: 1277 - DNA, 379 bp, Homo sapiens
  AC044819.2_40556
  Located on chromosome 1
  Distance between a terminus base of telomere on chromosomal short arm and 5'-terminus of this base sequence : 156055763
  Distance between 3'-terminus of neighbour sequence of sequence listing upward to telomere on chrosomal short arm and 5'-terminus of this base sequence : 92290
gaagtcggtcatgtaaaacagtacagtatacatttattatttatttatttatttatttatttatttattttgagacggagtcttgctctgctgcccaggctggagtgcagtggtgcaattttggctcactgcaacatccgcctcccaagttgaagcaattctcctgcctcagcctcccaagtagcttggattacaggcgcatgccaccgtgcccggctaatttttgtatttttagtagagacaggttttcaccatgttgcccaggctggttgcaaactcctgaactcaagcagtctgcccgccttgggcttccaaagtgctgggattacaggcatgagccactgtgcccagccagctgtgaattttgacatgctgaatt

SEQ ID NO: 1278 - DNA, 240 bp, Homo sapiens
  AC044819.2_86769
  Located on chromosome 1
  Distance between a terminus base of telomere on chromosomal short arm and 5'-terminus of this base sequence : 156075971
  Distance between 3'-terminus of neighbour sequence of sequence listing upward to telomere on chrosomal short arm and 5'-terminus of this base sequence : 19829
agtggcttgattcatttattctacttcattttgtgtttgtgaaaagaggtgaatggtatatatatatatcttcatctatatctatatctatctatctatctatctatctatctatctatctatctatctttctttctttttttttttttgagacagagtcttgcactgtcgcccaggctggagtgcagtagcacgatctcagctcactgcaagctccacctccaggttcataccattctc

SEQ ID NO: 1279 - DNA, 240 bp, Homo sapiens; identical to SEQ ID NO: 1278
  AC069199.4_37234
  Located on chromosome 1
  Distance between a terminus base of telomere on chromosomal short arm and 5'-terminus of this base sequence : 156075971
  Distance between 3'-terminus of neighbour sequence of sequence listing upward to telomere on chrosomal short arm and 5'-terminus of this base sequence : -240

SEQ ID NO: 1280 - DNA, 187 bp, Homo sapiens
  D1S303
  Located on chromosome 1
  Distance between a terminus base of telomere on chromosomal short arm and 5'-terminus of this base sequence : 156126733
  Distance between 3'-terminus of neighbour sequence of sequence listing upward to telomere on chrosomal short arm and 5'-terminus of this base sequence : 50522
gcttcccagaggctaggattgcaggcataagccaccgtgcccagcctatatactttttctcaattttgtgtttgtatgtatgcatgtatgtgtgtgtgtgtgtgtgtgtgtgtttgtgtgtgtctgtgtctgtatgtatgtatgtatgtatgtatgtatgtattgagatggagtttcgctcttgtcg

SEQ ID NO: 1281 - DNA, 418 bp, Homo sapiens
  AL365181.11_10801
  Located on chromosome 1
  Distance between a terminus base of telomere on chromosomal short arm and 5'-terminus of this base sequence : 156233086
  Distance between 3'-terminus of neighbour sequence of sequence listing upward to telomere on chrosomal short arm and 5'-terminus of this base sequence : 106166
ccattaaagcttgctatcacaggtcatgccgggtgcagtctgtaatcccaacacttcgggaagccaaggcaggagaatcatttgagctcaggagtttgagaccatcctgggcaacatatcaaaaccccatctctataataataataataataataataataataataataattattattattattattattagccaggtgtggtggcacatgcctgtggtcccagctacttgggaggctgaggtgggaagatcgcttgagcccaggaggtagaggctgcagtgagctgtgatcatctaggcacttcagcctagatgacagagcaagattctgtctcaaaaacaaacacacaaacaaaaaaaacaacttgcaatcacacagtgtagtggaagggaccctaggctactcaccttgaatca

SEQ ID NO: 1282 - DNA, 203 bp, Homo sapiens
  D1S2624
  Located on chromosome 1
  Distance between a terminus base of telomere on chromosomal short arm and 5'-terminus of this base sequence : 156316257
  Distance between 3'-terminus of neighbour sequence of sequence listing upward to telomere on chrosomal short arm and 5'-terminus of this base sequence : 82753
tcctgcacagagtccaacccctggcccagtccgtgtgtgtgtgtgtgtgtgtgtgtgtgtgtgtgtgtcctatcctggccttgggcaggaggaattggcccctcatagagtgtcagccccatctctggggatgtggagtaggggccacatctgtgtctgcctctgcctccagggcacagcactaatctaacgatgtgctcgcc

SEQ ID NO: 1283 - DNA, 189 bp, Homo sapiens
  HUMUT2150
  Located on chromosome 1
  Distance between a terminus base of telomere on chromosomal short arm and 5'-terminus of this base sequence : 156509801
  Distance between 3'-terminus of neighbour sequence of sequence listing upward to telomere on chrosomal short arm and 5'-terminus of this base sequence : 193341
cttctgttccttctggccagaatcctcttccctctacatggcttgcccacctccttaagtctggccaaatgtccccttctcaatgaggccttctctgaccatccaattttatctatctatctatctatctatctatctatctatttatttatttgatatggagtctcactctgtcgcccaggctagagt

SEQ ID NO: 1284 - DNA, 306 bp, Homo sapiens
  chr1.fa.O7frz.178252111
  Located on chromosome 1
  Distance between a terminus base of telomere on chromosomal short arm and 5'-terminus of this base sequence : 156518268
  Distance between 3'-terminus of neighbour sequence of sequence listing upward to telomere on chrosomal short arm and 5'-terminus of this base sequence : 8278
cctaactgatagcctgtaagactcttgcttgatctgctgaaaagatggtaggggaggtttcggtggagtaggggttgctgcttgggtgtgaagaggggccagaggctatgggggtgcagagatgtttgtgtgtgtgtgtgtgtgtgtatgtctgtgtgtgtgtgtagtacaggtgagaccaggcagtggcccttgggcgggcacgtttgggaacacacatttgcatgagcacaggcttcgtctgtgctgggtggggcagtggcagggataagccttggccttttgtggtagcaagtgtttcagtac

SEQ ID NO: 1285 - DNA, 464 bp, Homo sapiens
  chr1.fa.O7frz.178451341
  Located on chromosome 1
  Distance between a terminus base of telomere on chromosomal short arm and 5'-terminus of this base sequence : 156709486
  Distance between 3'-terminus of neighbour sequence of sequence listing upward to telomere on chrosomal short arm and 5'-terminus of this base sequence : 190912
gagctatgttaataggtgcctacatggttaggattattacatcttcttcatgaattgactcctatatcattatgaaatgactctccttaaccctgataatattctttgctctgaaatgtactctctgatattaataaagtcactccaactttatttatttatttgtttatttatttatttatttttggggtggagtcttgctctgtcgcccaggctggagtacagtggcgtgataccggcccactgcaacctctgcctcccgggttcaagcaattctcctgcctcagcctcccgagtagctgggattacaggcctgtgtcaccacacttggctaatttttgtatttttagtagagacggggtttcaccatgttggccagactggtctcaaactcctgacctcaggtgatccgcctgccttgcctcccaaagtgctgggattacagatatgagcaaccactcctg

SEQ ID NO: 1286 - DNA, 353 bp, Homo sapiens
  chr1.fa.O7frz.178533949
  Located on chromosome 1
  Distance between a terminus base of telomere on chromosomal short arm and 5'-terminus of this base sequence : 156792162
  Distance between 3'-terminus of neighbour sequence of sequence listing upward to telomere on chrosomal short arm and 5'-terminus of this base sequence : 82212
gaccagcaagtgtcagtctacaaaactactagcggccgaggacaagataaacaccccaaaggaaggagcagacaaggaaaaacacacacacacacacacacacacacacacactctcacacacacacgagatacataataacgaggcaccggggctgaggcaggagcttcctcttccaccttagtgacaatgagggaggaaaaacacgaatttccccactgctccaggaagctgccctggactcttaactcctaggatgcgctgtcagatcgcgaggccttttaccctgccacagaactccctccaaccatcacgaccctggggtccaaatcccgttgcaacgataacctgac

SEQ ID NO: 1287 - DNA, 406 bp, Homo sapiens
  chr1.fa.O7frz.178642447
  Located on chromosome 1
  Distance between a terminus base of telomere on chromosomal short arm and 5'-terminus of this base sequence : 156900492
  Distance between 3'-terminus of neighbour sequence of sequence listing upward to telomere on chrosomal short arm and 5'-terminus of this base sequence : 107977
actccacctcaattataaccagatcctgtctggcttgttttttcttcttcaggattagcttctctgtaggtcagagagctcttgctcccttccttctctctctctctctttctctctctctctctctctctgagtctttcttcatcttcctgctggctgtgctcaccatccagtttctagggcagatcctccctggcagcctgagggctgagccttgtttcttcttccaggaagtggggtctgtcagggctgactattcaaccctcagctaaccagaagtccctgctctgctcagccactcaaggtgcctgcttctccttcccaggagagggccaagcctacccgccaccctgtatctgatcctgtaccttctgccttcaccttgtgactgtgaacagttcttgtt

SEQ ID NO: 1288 - DNA, 152 bp, Homo sapiens
  DISD22_0000788
  Located on chromosome 1
  Distance between a terminus base of telomere on chromosomal short arm and 5'-terminus of this base sequence : 157057167
  Distance between 3'-terminus of neighbour sequence of sequence listing upward to telomere on chrosomal short arm and 5'-terminus of this base sequence : 156269
cacacccatctaatggagggtttgtgtgtgtgtgtgtgtgtgtttgtgtgtgtgtgtgtgtgtgtgtgtgtgttttcctacggaaggccaggagatatataaagacagcacttttcctgcccctagtcccccacccacactgtgctttctgg

SEQ ID NO: 1289 - DNA, 102 bp, Homo sapiens
  DISD22_0000791
  Located on chromosome 1
  Distance between a terminus base of telomere on chromosomal short arm and 5'-terminus of this base sequence : 157150241
  Distance between 3'-terminus of neighbour sequence of sequence listing upward to telomere on chrosomal short arm and 5'-terminus of this base sequence : 92922
aacgtgacattcctgaactggaaatacacacacacacacacacacacacacacacacacacacaccgatttcttatccatgaagagccaagcaggtatatta

SEQ ID NO: 1290 - DNA, 260 bp, Homo sapiens
  D1S2777
  Located on chromosome 1
  Distance between a terminus base of telomere on chromosomal short arm and 5'-terminus of this base sequence : 157318051
  Distance between 3'-terminus of neighbour sequence of sequence listing upward to telomere on chrosomal short arm and 5'-terminus of this base sequence : 167708
caccactgtgcccagctaattttggagatttattttttgtagagaagggggtctccctgtgttgcacagggtagtctcaaactcttaggttcaagtaatcctcctgcctcagcttcccaaagtgttgggattacaggtgtgagccacgaggcctggccagaaaaagagagagagagagtgtgtgtgtatgtgtgtgtgtgtgtgtgtgtgtgtgtgtgacgtagtctggctgtgtagcccatactggagtgccgtggtgc

SEQ ID NO: 1291 - DNA, 267 bp, Homo sapiens
  AL139410.4_58688
  Located on chromosome 1
  Distance between a terminus base of telomere on chromosomal short arm and 5'-terminus of this base sequence : 157350024
  Distance between 3'-terminus of neighbour sequence of sequence listing upward to telomere on chrosomal short arm and 5'-terminus of this base sequence : 31713
tggagagtgatagattaattccagatagtgaggaatatattaaagagaatttagagtgttcaggaaaataaataaaaaagccagtgtggtcagactaaagacggttggttggttggttggttggttggttggttggttggttttgagatgagtcccactctgttgcccaggctggagtacagtggtgcaatctcggctcactgcaaccactgactcctgggttcaagtgattctcttgcctcagcctcctgagtagctggaattaca

SEQ ID NO: 1292 - DNA, 472 bp, Homo sapiens
  AL139130.9_151791
  Located on chromosome 1
  Distance between a terminus base of telomere on chromosomal short arm and 5'-terminus of this base sequence : 157745012
  Distance between 3'-terminus of neighbour sequence of sequence listing upward to telomere on chrosomal short arm and 5'-terminus of this base sequence : 394721
gactgctatttaagccatctacactcagtcaagacttgtttttattctcccttatcagattccagagttgataccttagaagataaacgtacagtcatttctcagtatctgtgagggattggttccaggacactcccctataccaaaatctgcagctgttcaggacacttacatcatcattatcattattattattattaaagacaatctctgtcacctagcttattattttattattattattattattattattattattattattattattagagacagaatctctgtcacccagcctggaacgcagcagcacaatcttggctcactgcaacctccacctcccgggttgaagcaattttcatgtctcagcctcctgagtagctgggattacatgcctggctaatttttgtattttttatagagatggggttttgccatgttggtcagtctggtctcaaactcttgactt

SEQ ID NO: 1293 - DNA, 185 bp, Homo sapiens
  AC007227.3_52787
  Located on chromosome 1
  Distance between a terminus base of telomere on chromosomal short arm and 5'-terminus of this base sequence : 157826655
  Distance between 3'-terminus of neighbour sequence of sequence listing upward to telomere on chrosomal short arm and 5'-terminus of this base sequence : 81171
ctagaggaagcaatgtcagagagagaagcaggagctggccacaggacaggagaagagcagcatggactaagttcaggcagtgtagctgaagggcgggtgtgtgtgtgtgtgtgtgtgtgtgcacgtgcacatatgtgcatgtgtgtgaagatgcagtaataataggaaactgaggactgattagt

SEQ ID NO: 1294 - DNA, 237 bp, Homo sapiens
  D1S2721
  Located on chromosome 1
  Distance between a terminus base of telomere on chromosomal short arm and 5'-terminus of this base sequence : 157866530
  Distance between 3'-terminus of neighbour sequence of sequence listing upward to telomere on chrosomal short arm and 5'-terminus of this base sequence : 39690
ttgctcggccagagtctgtgggacagacttgacaacatgtatatataaaatctacttgtggccaggcgcggtggctcacgcctgtaatcccagcactttgggaggccaaggtgggtggatcacgaggtcaggagttcaagaccagcctggccaacatggtgaaacccccgtcacacacacacacacacacacacacacacacacacacacacacacacaaattagccaggtgtgatg

SEQ ID NO: 1295 - DNA, 372 bp, Homo sapiens
  AC007227.3_97324
  Located on chromosome 1
  Distance between a terminus base of telomere on chromosomal short arm and 5'-terminus of this base sequence : 157871036
  Distance between 3'-terminus of neighbour sequence of sequence listing upward to telomere on chrosomal short arm and 5'-terminus of this base sequence : 4269
taatccatttaactctgagttgacacagcacacgtttcagagagcatggggttgggggtaaggttatagattaacagaatctcaaggcagaagaatttttcttagtacataacaaaatggagtctcctatgtctacttctttctacacagacacagtaacaatctgatctctcttgcttttccccacagtgccactgcactccagcctgggcgacagagcaagactctgtttcaaaaaatacacacacacatacacacacacacacacacacacacacacacacacacacacacacagtggcgcaatctcggctcacggcagactctgcctcctgggttcaagttattctcttaccttagcctccagagtag

SEQ ID NO: 1296 - DNA, 436 bp, Homo sapiens
  chr1.fa.O7frz.177243546
  Located on chromosome 1
  Distance between a terminus base of telomere on chromosomal short arm and 5'-terminus of this base sequence : 157957744
  Distance between 3'-terminus of neighbour sequence of sequence listing upward to telomere on chrosomal short arm and 5'-terminus of this base sequence : 86336
aaattccaaggtggattctggaatctatacctgctgtcttgatgtcttttgaggtttcatcccattttcagaatttgaccaccgtctcctcttctccctttctattagcccaggtgggagctgggggaggggttgagcaggcccagcctcctcttgctgaagagtgacaaaggagtgtgtgtgtgtgtgtgtgtatgtgtgtgcaagtgcgtgtgcgtgtgcatctgtgtgtgtgcatgcatgtgtgtgtgcatgcatgtgcacatgtggcctctcacatccttcagaggagccctccttgaacccatgggcccaggaccctaccctcctgttgctatgacaaccacttccgtgaggactccgggagtaaagaattgtgaatgtgtggtgagggagggagggggacatgccagtctcatggcattagtgatcatag

SEQ ID NO: 1297 - DNA, 470 bp, Homo sapiens
  chr1.fa.O7frz.179258170
  Located on chromosome 1
  Distance between a terminus base of telomere on chromosomal short arm and 5'-terminus of this base sequence : 158247801
  Distance between 3'-terminus of neighbour sequence of sequence listing upward to telomere on chrosomal short arm and 5'-terminus of this base sequence : 289621
acagtgcagaagtgttgactatgctgcagaggagggagataggatctgttttccggatgctgagtttgaggacagcatgggtggatagaaacccgcaaaggaacaggccatggcatcttttgcagattttgtgtaggggtctcttgggggtatcaggcagtgtgtgtgtgtgtgtgtgtgtgtgcgtgcatgttgggaggactgtctagtgcacattatacaactgaaccaaagccacctttctcatcacctgtgctaatctgagcctaattttcagcctcagcctgtggattcaaactcaaattcctgtagagtggaaatagaaatgtctatcatctcaaaaccttcccaacctctgtgtctcagggagtgaccctaagaggccacaggtggggattgtcttagaaaacagcctcagctcttcccttctcctaggatagcgcacttggttgtacgaacagatgtgaagt

SEQ ID NO: 1298 - DNA, 218 bp, Homo sapiens
  DISO7_10000710
  Located on chromosome 1
  Distance between a terminus base of telomere on chromosomal short arm and 5'-terminus of this base sequence : 158509276
  Distance between 3'-terminus of neighbour sequence of sequence listing upward to telomere on chrosomal short arm and 5'-terminus of this base sequence : 261005
ggagatatttcagagaccacaacttttgtgcagatctacctgtatgtacgtatgtatgtatgtatgtatgcatgtatctatctatctatctatctatctatctatctatctatctatcttcatcatcatcatcatcatctatcttctttatcattaatcatctatcacctacatatctatgtgtttatttaatcagactacttagaagctcactctcc

SEQ ID NO: 1299 - DNA, 193 bp, Homo sapiens
  DISO7_10000711
  Located on chromosome 1
  Distance between a terminus base of telomere on chromosomal short arm and 5'-terminus of this base sequence : 158509301
  Distance between 3'-terminus of neighbour sequence of sequence listing upward to telomere on chrosomal short arm and 5'-terminus of this base sequence : -193
ttgtgcagatctacctgtatgtacgtatgtatgtatgtatgtatgcatgtatctatctatctatctatctatctatctatctatctatctatcttcatcatcatcatcatcatctatcttctttatcattaatcatctatcacctacatatctatgtgtttatttaatcagactacttagaagctcactctcc

SEQ ID NO: 1300 - DNA, 430 bp, Homo sapiens
  AL356276.9_86311
  Located on chromosome 1
  Distance between a terminus base of telomere on chromosomal short arm and 5'-terminus of this base sequence : 158570129
  Distance between 3'-terminus of neighbour sequence of sequence listing upward to telomere on chrosomal short arm and 5'-terminus of this base sequence : 60635
gatcacttgaagtatctgatgaaggagtttgagaccagcttgtgcaacatagtgagacctcatatctaccgaagattttttttaaaaaattagctgggtgtagtggcacaaacctgtggtcccaactacttgggaggctgaagtgggaggatcacttgggtccaggaggtcaaggcggcagtaagctgtgattgtgctactgtactgcagcctggataatggagtaagactctatctcaataaataaataaataaataaataaataaataaataaataaataaataaataaataaaagagtagttccccatttctagggtggtaccagatgctgctatgaagttcattttggatctcttgaaccaatggctcatgcatgattggctaggaggaatacactaggaggttgtctaggtgaactcctttcaag

SEQ ID NO: 1301 - DNA, 389 bp, Homo sapiens
  AL139409.9_10595
  Located on chromosome 1
  Distance between a terminus base of telomere on chromosomal short arm and 5'-terminus of this base sequence : 158654848
  Distance between 3'-terminus of neighbour sequence of sequence listing upward to telomere on chrosomal short arm and 5'-terminus of this base sequence : 84289
atgataaagctctatgtcactgatttgggcagcaacttcactgatgaagttgctggataatagatagatagatagatagatagatagatagatagatagacaaaatatgtaaatcagtagtgtttctatatactaatagtgaactacctgcaaaagaaattaagaaaacaatcccattcacaatagttataaaataataaaatacttaggaataaatttaaccaagaagttgaaatatctctacagtgaaaactataaaacataaatgaagaaattgaagaagatgcaaataaattgaaagatatcacatgttcatggattggaagaataaatactgttaaaatgtcaatactacccagaatcatctacagattcaatgcaatctctat

SEQ ID NO: 1302 - DNA, 108 bp, Homo sapiens
  D1S1653
  Located on chromosome 1
  Distance between a terminus base of telomere on chromosomal short arm and 5'-terminus of this base sequence : 158786958
  Distance between 3'-terminus of neighbour sequence of sequence listing upward to telomere on chrosomal short arm and 5'-terminus of this base sequence : 131721
cctggatgacagagtgctctctcatagatagatagatagatagatagatagatagatagatagatagatagaattttattcctagtagcctcttcctacaggctttcc

SEQ ID NO: 1303 - DNA, 182 bp, Homo sapiens
  DISO7_10001596
  Located on chromosome 1
  Distance between a terminus base of telomere on chromosomal short arm and 5'-terminus of this base sequence : 158834275
  Distance between 3'-terminus of neighbour sequence of sequence listing upward to telomere on chrosomal short arm and 5'-terminus of this base sequence : 47209
aaggagagcaggagtccccaccataaacacacacacacacacacacacacacacacacacaccccacacagtcctgagaatgtcacacacatgcatacacacacacacacacacacacacacacacacacacacacacacacacacacacacacacacactgtcctgagaatgtcccagcct

SEQ ID NO: 1304 - DNA, 283 bp, Homo sapiens
  chr1.fa.O7frz.179657795
  Located on chromosome 1
  Distance between a terminus base of telomere on chromosomal short arm and 5'-terminus of this base sequence : 159089332
  Distance between 3'-terminus of neighbour sequence of sequence listing upward to telomere on chrosomal short arm and 5'-terminus of this base sequence : 254875
tacttccattgttagctgttctcccaggtgatggcaatgcagacggtaagaactctgacaactgcccagttgggtggtgggtgaaggtctctctctctctctctgtgtgtgtgtgtgtgtgtgtgtgtgtgtgtgtgtgtggtttccctagcatatacctggaaagtgagagtgccaggctggttccattctgactatccatgactccaggtccctgagctcttatgaaggtggttgataaggcatgggactgtgtggcaagtgaatgtctgctaagatcatg

SEQ ID NO: 1305 - DNA, 155 bp, Homo sapiens
  DISO7_10000713
  Located on chromosome 1
  Distance between a terminus base of telomere on chromosomal short arm and 5'-terminus of this base sequence : 159179861
  Distance between 3'-terminus of neighbour sequence of sequence listing upward to telomere on chrosomal short arm and 5'-terminus of this base sequence : 90246
tgttgccatttggatgaggtttatatatacatatattatttttatatatatatatatatatatatatatatatatatatatgtacacacacacacacacacacacacacacacatatgagaatgagttctttcagagagccaaggctctgtacag

SEQ ID NO: 1306 - DNA, 101 bp, Homo sapiens
  DISO7_10000718
  Located on chromosome 1
  Distance between a terminus base of telomere on chromosomal short arm and 5'-terminus of this base sequence : 159386350
  Distance between 3'-terminus of neighbour sequence of sequence listing upward to telomere on chrosomal short arm and 5'-terminus of this base sequence : 206334
agctttcacaattgcttgtccattgtagtgattacacacacacacacacacacacaaacacacattgctaaacaagtagaatgagatccttcagctctaga

SEQ ID NO: 1307 - DNA, 134 bp, Homo sapiens
  DISO7_10000719
  Located on chromosome 1
  Distance between a terminus base of telomere on chromosomal short arm and 5'-terminus of this base sequence : 159420508
  Distance between 3'-terminus of neighbour sequence of sequence listing upward to telomere on chrosomal short arm and 5'-terminus of this base sequence : 34057
ggttgactgccttatacctttacttacacttttcaacatttacttatagttttgaacatttctaatacacacacacacacacacgttatatatatgtatatatatatatgtatgtgtatacctctttggttgac

SEQ ID NO: 1308 - DNA, 396 bp, Homo sapiens
  AL353894.8_14719
  Located on chromosome 1
  Distance between a terminus base of telomere on chromosomal short arm and 5'-terminus of this base sequence : 159554987
  Distance between 3'-terminus of neighbour sequence of sequence listing upward to telomere on chrosomal short arm and 5'-terminus of this base sequence : 134345
agacagccatgagtaagtgaacaaagaaaattggggactgtttgaaaagggaactatgacaattcagttctaatgagagcctcaatcaagtcttgactagatgatctctcagaaaatggcattataaatgtggcatgctgtttcatatatacccatgcccagaaccacactgaacagagcttcctcctgtaaatacctttgccttccacccttattcaaagttctaaattctttaataatcaggtcttcaggttatgagatgatgatgatgatgatgattatgcatggtgaatgaattcggtctctttatgacttagtcatctacactcacctttgccaaaaacacagggactcctcagtctgcctgggtcactgcatccttaatattacttcagc

SEQ ID NO: 1309 - DNA, 460 bp, Homo sapiens
  AL353894.8_129771
  Located on chromosome 1
  Distance between a terminus base of telomere on chromosomal short arm and 5'-terminus of this base sequence : 159557768
  Distance between 3'-terminus of neighbour sequence of sequence listing upward to telomere on chrosomal short arm and 5'-terminus of this base sequence : 2385
aatttctagtggcaatgcatagacattttaaaggcagcaaaagtgaaaacaagagtaatgtagttcaaatgatatatatttctattacctatctgtctatctatctatctatctatctatctatcactttggaatgtgctggagactacttttaaccaaataattttattcaaccaaattggatgaattcaaccaaagcagtctaagtaaatgaagtttgaattcaacttggctccagataaataataacaacaaatatactataaataataatcatagctaagtattcctaagcatgagtttttgtttttaatatatcactctttattaaagcattctctaaaacatcaataacaaaagatagtaattagttgcaaatgatattaacagataacacttattttgcacaagctctgtgttttgcacattctctgcacttgcatggagtaagtcatttaat

SEQ ID NO: 1310 - DNA, 432 bp, Homo sapiens
  chr1.fa.O7frz.180346639
  Located on chromosome 1
  Distance between a terminus base of telomere on chromosomal short arm and 5'-terminus of this base sequence : 159780820
  Distance between 3'-terminus of neighbour sequence of sequence listing upward to telomere on chrosomal short arm and 5'-terminus of this base sequence : 222592
gtactgtcatacagaagccactctccagaattagagtcctctcattcttctctataacagagtgctttttatatattacataactgaattctagaagtggtagaactatggaaagtaacctattaatgaatggtaaaaaaaatcagtgaaaatagagaaaattatatgattgaggagacctatgtccttgcttttggaaaaaaatgttaaaaaacatttactgcaaatgctcaagtagattgttaagtatttctaaatatgattaacagccctgaggattctggctaacttatgcagactacaaaacagcagaattctgcatctggaattgtggatttgaaagaatccttctagcacagtgattagatagatagatagatagatagatagatagatagatagatagatgaaacataaagctggatttcctac

SEQ ID NO: 1311 - DNA, 151 bp, Homo sapiens
  Z67479
  Located on chromosome 1
  Distance between a terminus base of telomere on chromosomal short arm and 5'-terminus of this base sequence : 159941871
  Distance between 3'-terminus of neighbour sequence of sequence listing upward to telomere on chrosomal short arm and 5'-terminus of this base sequence : 160619
aatgagccacagtttaggtaggttttcatttattcttttactccttaaatcaacagatgtacatgtgtgtatgtgtgtgtgtgtgtgtgtgtgtgtgcgcgcactatagcatgttactgaaataagaattactaaagcaggatacgaaaaa

SEQ ID NO: 1312 - DNA, 180 bp, Homo sapiens
  Z67712
  Located on chromosome 1
  Distance between a terminus base of telomere on chromosomal short arm and 5'-terminus of this base sequence : 159978138
  Distance between 3'-terminus of neighbour sequence of sequence listing upward to telomere on chrosomal short arm and 5'-terminus of this base sequence : 36116
tagcaaggaaccattccagtgtaagggaaaggaaaagctagactctcaagatacttactgccaggctcagtgtgtacacacacacacacacacacacacacacacacacacacacacacacacactgctcttcataaatatattgtcctatatccaagaaatctatcagccccctgagtg

SEQ ID NO: 1313 - DNA, 157 bp, Homo sapiens
  D1S2635
  Located on chromosome 1
  Distance between a terminus base of telomere on chromosomal short arm and 5'-terminus of this base sequence : 160035083
  Distance between 3'-terminus of neighbour sequence of sequence listing upward to telomere on chrosomal short arm and 5'-terminus of this base sequence : 56765
tagcagatcccccgtcaccaagttgcgtgcacacgcatgcatacacacacacacgcatgcgtgcaagcacacacacacacacacacacacacacacacacacacttctctttcttgctttgtattatagatgagattctacttaggggtaggattca

SEQ ID NO: 1314 - DNA, 151 bp, Homo sapiens
  HUMUT1234
  Located on chromosome 1
  Distance between a terminus base of telomere on chromosomal short arm and 5'-terminus of this base sequence : 160489868
  Distance between 3'-terminus of neighbour sequence of sequence listing upward to telomere on chrosomal short arm and 5'-terminus of this base sequence : 454628
agcttggtttttgttacagacttatagccattagctatataaaacataagcattgttctgaaaaattaaaaagatagacagacagatagatagatagatagatagatagatagatagatagatttatcttcacagctcttaattgtgagta

SEQ ID NO: 1315 - DNA, 332 bp, Homo sapiens
  AL359843.2_160358
  Located on chromosome 1
  Distance between a terminus base of telomere on chromosomal short arm and 5'-terminus of this base sequence : 160496831
  Distance between 3'-terminus of neighbour sequence of sequence listing upward to telomere on chrosomal short arm and 5'-terminus of this base sequence : 6812
aatgttgcaaagtaattagcagactaaaatggtgacacaccttcatttaggggagagggaaagataagctgactctttatctattattattattattattattattattattattattattattattgttttgagatggagtctcactctgtcttgcccaagctgtagtgcagtggcatgatctcggcttactgcagcctctacctcctgggctcaagcaattcacctgtcccagctgcctgagtagctgggactacaggcatgtgccaccacacccggattatgttgtatttttagttagagacagggtttcaccactttggtcaggctag

SEQ ID NO: 1316 - DNA, 434 bp, Homo sapiens
  AL357565.3_21230
  Located on chromosome 1
  Distance between a terminus base of telomere on chromosomal short arm and 5'-terminus of this base sequence : 160797661
  Distance between 3'-terminus of neighbour sequence of sequence listing upward to telomere on chrosomal short arm and 5'-terminus of this base sequence : 300498
tcctaactattcagattccttgagcccaggagtttgagtccagcctggacaacatattgagacccccatctctctaaaaaaaaagagaaagaaagaaggaaagaaaaaaagaaagaaagaaagaaagaaagaaagaaagaaagaaagaaagaaagagaaagaaagaaggaaagaaggaaagaaggaaagaaagaaagaaagagaaagaaagaaaagaagattgtagctagggggagagtaggtgaaaagatgaacaacatgaccgggaagatttcctaatctcaccacagcctggctctaccttaaggtaggtagatggacaagtatagctacctgggtcacagatgctaagatgacatccagacaggtcagaaattaagaagaaaggcagatgaggaaggataaaccctatcttataagacaaattcctggca

SEQ ID NO: 1317 - DNA, 312 bp, Homo sapiens
  chr1.fa.O7frz.181504161
  Located on chromosome 1
  Distance between a terminus base of telomere on chromosomal short arm and 5'-terminus of this base sequence : 160815609
  Distance between 3'-terminus of neighbour sequence of sequence listing upward to telomere on chrosomal short arm and 5'-terminus of this base sequence : 17514
tggaaactttgagaagtgtattagtcagggttctctagagggacagaactaataggacatatatccctttatactcatatatatatatatatatatatatatatatatatatatatatatggagtttattaagtagtattaactcacacgatcacaaggtcccacaataggctgtctgcaagctgaggagcaagaaagccagtcccaaagctgaagaacttggagtccaatgttcaaggcaagaagcatccagcacaggagaaagatgtaggcttggaggctaagccagtctctttgctaaagcataacaag

SEQ ID NO: 1318 - DNA, 149 bp, Homo sapiens
  D1S2707
  Located on chromosome 1
  Distance between a terminus base of telomere on chromosomal short arm and 5'-terminus of this base sequence : 160923459
  Distance between 3'-terminus of neighbour sequence of sequence listing upward to telomere on chrosomal short arm and 5'-terminus of this base sequence : 107538
agccaggcatctgcaccttcatggtgaactgtgtgtgtgtgtgtgtgtgtgtgtgtgtgtgtgtgtgtgtgtgtctactctctgaaccctcctctttccctggctaggcccacactcctgcccccattcttgaaccctatgccaagggg

SEQ ID NO: 1319 - DNA, 463 bp, Homo sapiens
  AL121987.3_66483
  Located on chromosome 1
  Distance between a terminus base of telomere on chromosomal short arm and 5'-terminus of this base sequence : 160932243
  Distance between 3'-terminus of neighbour sequence of sequence listing upward to telomere on chrosomal short arm and 5'-terminus of this base sequence : 8635
catgttgaaggaatggtttaacagataaagaaaaaaaataagataaaaataaaagaaagaccaaaaagaaaacggaggagcagatgttaaaggagagatggggagaaaattcaacaccatccttgtagtccagtgaggaaactgacacagcagcaggacttggacagccactctggggctctgagcccaacctttttatttatttatttatttatttatttatttatttatttatttatttttgagacggagtctcgctctgtcgccaggctggagtgcactggcacgatctcggctcactacaacctccgactccctggttcaagcgattcttctgcctcagccccccgagtagctgggattacaggcatgtgccaccactcccagctaatttttatatttttagtagagacggggtttcaccatgttggccaggatggtctcaaactcctgacttcatgat

SEQ ID NO: 1320 - DNA, 345 bp, Homo sapiens
  chr1.fa.O7frz.181927972
  Located on chromosome 1
  Distance between a terminus base of telomere on chromosomal short arm and 5'-terminus of this base sequence : 161196016
  Distance between 3'-terminus of neighbour sequence of sequence listing upward to telomere on chrosomal short arm and 5'-terminus of this base sequence : 263310
agtgacagagcagaagtcaaggccccaggggctgggtgggggttgcctaaaatctctctctctctctctctctctctctctctcacacacacacacacacacacgcgcacacacacacactgtcataggctgccaggcatatggcctctttgtgcccacacaatggaggccctgtctgtgccctttcccaagtctgggcacagtgtggagggtgctccgcttcctcattccacccacctcccttccctctccacccccagtgcaggccctgtcttctttgcctttgcttcttcctctttctggaaagccctttctaccacccagttcctttatctttctgctttc

SEQ ID NO: 1321 - DNA, 324 bp, Homo sapiens
  AL138930.8_156117
  Located on chromosome 1
  Distance between a terminus base of telomere on chromosomal short arm and 5'-terminus of this base sequence : 161294458
  Distance between 3'-terminus of neighbour sequence of sequence listing upward to telomere on chrosomal short arm and 5'-terminus of this base sequence : 98097
agtcaacatggttgtatgcttttctctgactacctttagttatgcaaattcaggcatgattgagccaaacagttggatttaagtagtattaacttattattattattattattattattattattattattattattaggcctggcagttacaacataaagttgagggacaacggaatcaactgctttgtatgaaagaaagtggtgagaatgacttttatttaagctgaataaggaggaaagtgatggcacaaggggtgtgaaggatagtgaaaagtgcttggatcaatggattgtaggccagaggatggaagttaaaggattg

SEQ ID NO: 1322 - DNA, 300 bp, Homo sapiens
  AL121985.13_145488
  Located on chromosome 1
  Distance between a terminus base of telomere on chromosomal short arm and 5'-terminus of this base sequence : 161578573
  Distance between 3'-terminus of neighbour sequence of sequence listing upward to telomere on chrosomal short arm and 5'-terminus of this base sequence : 283791
tttattgcaatctgtcaagaacatagccagcaacagggaagagttgataaaccataacatgatcatttataatatttaatgtttagtacagtcacaattgccaatcattgttctaaataatacatatatatatgtgtgcatgtatatacatatgtacatttatttaatcttcataacaaacataaccattttatagatgaggtagttgagaccaagattgtcttttgtctaattgggttttgtgggttgttttgttttgttttgttttgttttgttttgttcggctcatatgtattactg

SEQ ID NO: 1323 - DNA, 246 bp, Homo sapiens
  AL121985.13_185137
  Located on chromosome 1
  Distance between a terminus base of telomere on chromosomal short arm and 5'-terminus of this base sequence : 161618329
  Distance between 3'-terminus of neighbour sequence of sequence listing upward to telomere on chrosomal short arm and 5'-terminus of this base sequence : 39456
ctcactttagtatcaggaacatctgaaattaaatcattgctccatcatttattagtgatgagggcctctatttcttaagtgtaaaatatagttagtaggatgcatcatgcaacactcttacagattgtagatgatctatacacacacacacacacacacacacacacgtatagtggcacatagttggcagaagctatgattgttattattataattactgttacgtgcattctttggaaactatta

SEQ ID NO: 1324 - DNA, 142 bp, Homo sapiens
  D1S484
  Located on chromosome 1
  Distance between a terminus base of telomere on chromosomal short arm and 5'-terminus of this base sequence : 161618382
  Distance between 3'-terminus of neighbour sequence of sequence listing upward to telomere on chrosomal short arm and 5'-terminus of this base sequence : -193
agtgatgagggcctctatttcttaagtgtaaaatatagttagtaggatgcatcatgcaacactcttacagattgtagatgatctatacacacacacacacacacacacacacacgtatagtggcacatagttggcagaagct

SEQ ID NO: 1325 - DNA, 381 bp, Homo sapiens
  AL121985.13_189976
  Located on chromosome 1
  Distance between a terminus base of telomere on chromosomal short arm and 5'-terminus of this base sequence : 161623182
  Distance between 3'-terminus of neighbour sequence of sequence listing upward to telomere on chrosomal short arm and 5'-terminus of this base sequence : 4658
ttaaatttactgtagctgccagtgtacacgtgtggaccccattttatttttacaccaatttggtgaaaatgctgctttcctcagcctccccacaattaaactgcacatggtctctaaaaaaataaaaataaataaataaataaataaataaaaagtatcttttctccccagtgtaagtttttgttggatttgtcaaaggtcaattggctataaacctgtggctttatttctgtgttctctattctgttccattggtctatgtgtctatttttataacaccatgctgttttggttgctatagccatatacagtatactgaagtcgagtaatgtgatgcctctagctttgttctttttgcttagcattgctatgactattcat

SEQ ID NO: 1326 - DNA, 173 bp, Homo sapiens
  AL121985.13_193016
  Located on chromosome 1
  Distance between a terminus base of telomere on chromosomal short arm and 5'-terminus of this base sequence : 161626261
  Distance between 3'-terminus of neighbour sequence of sequence listing upward to telomere on chrosomal short arm and 5'-terminus of this base sequence : 2698
ttccatctagaagctctgtctaatgctgagagtggagtgctgaagtcctccactactattctgttgcagtctctctctctctgtctcacacacacacacacacacacacacacacacacacacacactcttactctcactctctctctggtaatatttgctttatgaatttgg

SEQ ID NO: 1327 - DNA, 337 bp, Homo sapiens
  AL354714.7_79226
  Located on chromosome 1
  Distance between a terminus base of telomere on chromosomal short arm and 5'-terminus of this base sequence : 161805827
  Distance between 3'-terminus of neighbour sequence of sequence listing upward to telomere on chrosomal short arm and 5'-terminus of this base sequence : 179393
tagctcacacctgtaattccagcactttgggaggccgaggtggggagactgcttgagggcaggagttcgagaccagcttggccaacgtggcgaaatctcgtctctagtaaaagtacaaaaaccagccaggggtggtggcactagcctgtaatcccagctactcgggaggctgaggcaggagaatcactgaacccaggaggtggaggctgaagtgagcctagatagtgccactgcactccagcctgggtgacagagcaagactctgtctcaaaaataaaataataataataataataataataataataatagatatggaaattaaaccaaatagctt

SEQ ID NO: 1328 - DNA, 135 bp, Homo sapiens
  DISO7_10008154
  Located on chromosome 1
  Distance between a terminus base of telomere on chromosomal short arm and 5'-terminus of this base sequence : 161853804
  Distance between 3'-terminus of neighbour sequence of sequence listing upward to telomere on chrosomal short arm and 5'-terminus of this base sequence : 47640
tcccaatccagattctccctgaaaataccttattctctctctctctctctctctctctctctctctctctctctctcgaatgaccttaaccccttctctacctcttaaattgtatgcataattcttccaattctc

SEQ ID NO: 1329 - DNA, 159 bp, Homo sapiens
  DISD22_0000824
  Located on chromosome 1
  Distance between a terminus base of telomere on chromosomal short arm and 5'-terminus of this base sequence : 162039957
  Distance between 3'-terminus of neighbour sequence of sequence listing upward to telomere on chrosomal short arm and 5'-terminus of this base sequence : 186018
tcttctgcttcttcatttgcattaaattataattaatgtttctctaaagatgagttaaaaccccaagtgcaggctggagtcatacacacacacacacacacacacacacacacagagagagagactgagttaaaaagatccttgtttaggttaccagaa

SEQ ID NO: 1330 - DNA, 121 bp, Homo sapiens
  DISD22_0000830
  Located on chromosome 1
  Distance between a terminus base of telomere on chromosomal short arm and 5'-terminus of this base sequence : 162112206
  Distance between 3'-terminus of neighbour sequence of sequence listing upward to telomere on chrosomal short arm and 5'-terminus of this base sequence : 72090
aaggacaaagaggtgagacggagagacagaatgtgtgtgtgtgtgtgtgtgtgtgtgtgtgtgtgtgtgtgtgtgtgtgtgtgtatgtatatgagatgtaggtttctgaagtgttggatat

SEQ ID NO: 1331 - DNA, 160 bp, Homo sapiens
  DISD22_0000831
  Located on chromosome 1
  Distance between a terminus base of telomere on chromosomal short arm and 5'-terminus of this base sequence : 162343709
  Distance between 3'-terminus of neighbour sequence of sequence listing upward to telomere on chrosomal short arm and 5'-terminus of this base sequence : 231382
cattctcactacaacttcctcaggtgagtgtgtgtgtgtgtacatttgtgtgtgtgtggtttgtgtgtgtgtgcatgcacatgcacttgtgtgtggggcatggtattttttgaatagcctattacattttccttttctggccttgccctcttcactgaga

SEQ ID NO: 1332 - DNA, 104 bp, Homo sapiens
  DISO7_10000728
  Located on chromosome 1
  Distance between a terminus base of telomere on chromosomal short arm and 5'-terminus of this base sequence : 162518760
  Distance between 3'-terminus of neighbour sequence of sequence listing upward to telomere on chrosomal short arm and 5'-terminus of this base sequence : 174891
aatatctatggcagcaaacaaggtttcctgtgttcacacacacacacacacacacacacacacacacacacacacacattttccatgtgccattatttctgcca

SEQ ID NO: 1333 - DNA, 101 bp, Homo sapiens
  DISO7_10004887
  Located on chromosome 1
  Distance between a terminus base of telomere on chromosomal short arm and 5'-terminus of this base sequence : 162680171
  Distance between 3'-terminus of neighbour sequence of sequence listing upward to telomere on chrosomal short arm and 5'-terminus of this base sequence : 161307
gaatggatctattggaatctattgtaatgaatatatatatatatatatatgagatggtgggggtaattttctaggattggcccaggagttagatgtattct

SEQ ID NO: 1334 - DNA, 336 bp, Homo sapiens
  chr1.fa.O7frz.185074695
  Located on chromosome 1
  Distance between a terminus base of telomere on chromosomal short arm and 5'-terminus of this base sequence : 162804983
  Distance between 3'-terminus of neighbour sequence of sequence listing upward to telomere on chrosomal short arm and 5'-terminus of this base sequence : 124711
gcaggtagttgtcactgaataacgcagtcaatactgtggagtgtgtttttcagtccttaaacaccatctcctcaagtctgtctacaaattgtcaccttggcagggctctgagccctgcttctgagctgtgcgtgtgtgtgtgtgtgtgtgtgtgtgtgtgtgtgtatacatatataaatacagaagcaatgaagctcacgcaatgggagggattctaagcagaggtcactatgcctagtctctgaccagcactttgggagataaagctgataattagtaaagagcttcaaacccactaagtgctcaactcaactaacctatgtcagagtcagtgtc

SEQ ID NO: 1335 - DNA, 235 bp, Homo sapiens
  chr1.fa.O7frz.185218120
  Located on chromosome 1
  Distance between a terminus base of telomere on chromosomal short arm and 5'-terminus of this base sequence : 162901909
  Distance between 3'-terminus of neighbour sequence of sequence listing upward to telomere on chrosomal short arm and 5'-terminus of this base sequence : 96590
caactgaagtttgaagtctgaccctggcaggggccctttttcaggctttctcagatgctcctgagggcagaaaatttgtactgtggagaagagaattatgaacttggtgggaaactcttatcaattactctaaatggatcctccctgtagcaggaactacacaagtgtgtgtgtgtgtgtgtgtgtgtgtgtctgtgtgtgtatgtctgtgtgtgtgtttgtactgaggacaacc

SEQ ID NO: 1336 - DNA, 451 bp, Homo sapiens
  chr1.fa.O7frz.185341510
  Located on chromosome 1
  Distance between a terminus base of telomere on chromosomal short arm and 5'-terminus of this base sequence : 162972129
  Distance between 3'-terminus of neighbour sequence of sequence listing upward to telomere on chrosomal short arm and 5'-terminus of this base sequence : 69985
aaggtttaccaagataggtcagagttctgggtaatgacagtctttcagaattttaagggatttaaaccatacaaagcatgttctctgacaagaaaattaaaataaaataaaaatttgaaagacatctgaaaaattcacaaattttgaaaattaaacacccaatttaaaataatacatatgcaaaggaaggaaacacaaagaaaattagaatgtatttaaaaaattgtttagcatcttactggggttaattgacacacacacacacacacacacacacacaaaccctctacatactcaaaatgtactaatggatgaatttgttatatatagacacttgtgaaaccatcatcataattaataagtcgaatatttccactattccccaaagtttctacatgcccctttgtaatatcattgcaaaaacaaaacaattatccaatttcttatgaag

SEQ ID NO: 1337 - DNA, 360 bp, Homo sapiens
  chr1.fa.O7frz.185551756
  Located on chromosome 1
  Distance between a terminus base of telomere on chromosomal short arm and 5'-terminus of this base sequence : 162992905
  Distance between 3'-terminus of neighbour sequence of sequence listing upward to telomere on chrosomal short arm and 5'-terminus of this base sequence : 20325
gagtactgagtatcactctgcatactaagaggcaaagcttatgtctaaaggagtgttggttcaacattagaaatgcttctgctccttaataatggaagattatattccagattctgatgtgtgttgtacatagaagttcttttctcatgacaacacttttaacttttggttaccctatcaaaagggaatggaagaatcacagaaaggaaaaggggaacaaataagcacacacacacacacacacacacacaaatccacaatcatttagtctgatgaaggcagcaggctaaaaatgagaaacacttttctgcccacctgaacccatactaatacctctactcttacagacgtacattccaa

SEQ ID NO: 1338 - DNA, 468 bp, Homo sapiens
  chr1.fa.O7frz.185634410
  Located on chromosome 1
  Distance between a terminus base of telomere on chromosomal short arm and 5'-terminus of this base sequence : 163264602
  Distance between 3'-terminus of neighbour sequence of sequence listing upward to telomere on chrosomal short arm and 5'-terminus of this base sequence : 271337
ttgatgttctttggtatctgaggattgaagagttaagtattttttgcagtcttcattgtctgggcttatttgtagccatccttcttgggaaggctttccatatatttgaaaggtcttggctgctgtgatctaagctgtatctgctgtaggggacaccccaagctcgataatgttttggttttatggttcttgtaaattcataaaggtactgcctttatgaccttggacaagatccgaagaattatttggattactagacagagactcttgttcttaccaaacatacagggtctctctctctctctctctctctctgttctgagccacttaaagctaggggtgaactgacacaggcatccctgtggccaccaccactattactgcattgagtaagacctgaagccagcatagcactgggtctcacccaaggcctgctgtgaccatttcttagctactgctacattcagc

SEQ ID NO: 1339 - DNA, 409 bp, Homo sapiens
  chr1.fa.O7frz.185743814
  Located on chromosome 1
  Distance between a terminus base of telomere on chromosomal short arm and 5'-terminus of this base sequence : 163382938
  Distance between 3'-terminus of neighbour sequence of sequence listing upward to telomere on chrosomal short arm and 5'-terminus of this base sequence : 117868
gacctttcagtggaaactttacaggccaggagagagtggcatgacatatttaaaatgttgaaggaaataaataaataaataaataaataaataaataaataaataaaaccttttaccctagactataatatccagcaaaaatatcatttaaacatgaaggagaaataaagacctgcccagacaaacaaagctgagggattttatcagcaccaggcctgtcttacaagaaatgctaaaggaagctctttgatctgaaagaaaaggatgtttgtgagcaaaaagaaatcacctgaaggtataaaactcacaggtaatagtaaatgcagagaaaaatacataatagactaacactgtaattatagtatataaacttctcttgacttaagtagcaagactaaataatgaacca

SEQ ID NO: 1340 - DNA, 337 bp, Homo sapiens
  chr1.fa.O7frz.185910690
  Located on chromosome 1
  Distance between a terminus base of telomere on chromosomal short arm and 5'-terminus of this base sequence : 163549696
  Distance between 3'-terminus of neighbour sequence of sequence listing upward to telomere on chrosomal short arm and 5'-terminus of this base sequence : 166349
aactgtagaactcttcattgtcagcaaagcaaagagccactgcatcaatgaaagttcaagaacctcctgtacttaaaaatgatttgcaatgttctgttattttttttgtatgtttagaatgctgaaatgtttttgaagttaaataaacagtattacatttaaaaaaataaataaatatatgcaattatgtgtcaactatacctcagtaaagctgaaataaataaataaataaataaataaggttttaagcttgtgattttctttctctaaattctgtagttcaggaagaaccagtcatcacatccacaccactctttatgcaccataaagttctatt

SEQ ID NO: 1341 - DNA, 353 bp, Homo sapiens
  chr1.fa.O7frz.185980940
  Located on chromosome 1
  Distance between a terminus base of telomere on chromosomal short arm and 5'-terminus of this base sequence : 163619563
  Distance between 3'-terminus of neighbour sequence of sequence listing upward to telomere on chrosomal short arm and 5'-terminus of this base sequence : 69530
gatttgtgagtcagaatagcacaaagagtgaattacatgtccagataaaaacagcttattctaatccttatagaattcatttttcaagaaaaaaaatcgagcaactgcaaggtgtcaacatttttctaagcactggaatacaacagtgaccaaaggtaaacaaaggtcttcccctcgaggagtttaccttctgatttaagagacagaaaatacataataaatgtgtgtgtgtgtgtgtgtgtgtgtgtgtgtgtgtgtgtgtgtgtagtaaatttgcttaatctatgaggcaaaatctttaaagcatcactaaccttttttttaatatgctactttgaagctttcttcctaat

SEQ ID NO: 1342 - DNA, 300 bp, Homo sapiens
  HUMUT1398
  Located on chromosome 1
  Distance between a terminus base of telomere on chromosomal short arm and 5'-terminus of this base sequence : 163699204
  Distance between 3'-terminus of neighbour sequence of sequence listing upward to telomere on chrosomal short arm and 5'-terminus of this base sequence : 79288
gaatcacctcatcaacagctaaacatctagaaagaaagaaagaaagaaagaaagaaagaaagaaagaaagaaagaaagaaagaaagaaagaaagagagagaaaagaaagaaagaaagaaagaaagaaagaaaaaaagaaagaaagagagagaaagaaagaaagaaagagagagagagaaaggaagaaagaaagaaagaaagaaagaaagaaagaaagaaagaaagaaagaaattgattgattctcctttaatcatatacctacctccttctactaactttcctctcttctggctccagct

SEQ ID NO: 1343 - DNA, 410 bp, Homo sapiens
  chr1.fa.O7frz.186268216
  Located on chromosome 1
  Distance between a terminus base of telomere on chromosomal short arm and 5'-terminus of this base sequence : 163898766
  Distance between 3'-terminus of neighbour sequence of sequence listing upward to telomere on chrosomal short arm and 5'-terminus of this base sequence : 199262
agaccttggatattctgatcacagctccgctggcatcgagattggaatacagattatgggagggagcgtctgtgacatgaagccctggcttaaatcttcccaaggttttaacgtgccttaccatatgaatattttgttattttatttggcagtatttccacaggaggccaggaaggagagcactgagtaagccaggggtagggcaaatctagagatgggagagattagaacagtattgtggctaatgagactaacaccactgaggtgtgtgtgtgtgtgtgtgtgtgtgagagagagagagagagagagagagagagagagagagaaagtgctgaatcccctgtaatcctgtctcatacaaggccctggtgctaaaaccactgtaactgtttatgaattcactccagcta

SEQ ID NO: 1344 - DNA, 444 bp, Homo sapiens
  chr1.fa.O7frz.186342324
  Located on chromosome 1
  Distance between a terminus base of telomere on chromosomal short arm and 5'-terminus of this base sequence : 163968334
  Distance between 3'-terminus of neighbour sequence of sequence listing upward to telomere on chrosomal short arm and 5'-terminus of this base sequence : 69158
agtgcaaagttttaagcctaacttgagcaataaaagatttcttttctgtgcaatgattaactttcccttctttaatttcaagaggttaatgaatctgtgagcttagtatacttgtcattgtacatatggcttgtcattgtatgtatggctgggctaaaatttaatattgaatctctgcagtaaatcttgtggttttacatttgtgtgtgtgtgtgtgtgtgtgtgtgtgtgtgtgtggtgggaggagagagagagagagagagagagagagagagagagaggaggtgtgggggggcggggggctgccatccagaagatggaggtacaagtaatggaagctttttttcttctccctacatatgaactgaataaatgcttggccgtcaacagaataatagtttcggaaaaccacaccttgaaattcaccttagcatctttgaaata

SEQ ID NO: 1345 - DNA, 262 bp, Homo sapiens
  chr1.fa.O7frz.186541832
  Located on chromosome 1
  Distance between a terminus base of telomere on chromosomal short arm and 5'-terminus of this base sequence : 164165811
  Distance between 3'-terminus of neighbour sequence of sequence listing upward to telomere on chrosomal short arm and 5'-terminus of this base sequence : 197033
atggctatgaagtaaggaaaatacgtttccagagtgagattgacttggccctttgaatgctgtctcaaaccctcccccaccacttttatttatttatttatttatttatttatttatttatttatttatttattttgagatagagtctcgctctgtcgctcaggctggagtgcagtggtgcaagcatggctcactgaaacctggacctctcaggctcaggtcatcctcctgcctcagcctcttgcatatctgaaacaagaac

SEQ ID NO: 1346 - DNA, 121 bp, Homo sapiens
  D1S2628
  Located on chromosome 1
  Distance between a terminus base of telomere on chromosomal short arm and 5'-terminus of this base sequence : 164371126
  Distance between 3'-terminus of neighbour sequence of sequence listing upward to telomere on chrosomal short arm and 5'-terminus of this base sequence : 205053
accctaaggcccacatgctattgatttcctttggagaggtaggggtgtgtgtgcgtgtgtgtgtgtgtgtgtgtgtgtgtgtgtgcgtgtccacatgcatatgagatgaatgggtcagggg

SEQ ID NO: 1347 - DNA, 466 bp, Homo sapiens
  AL390730.4_82647
  Located on chromosome 1
  Distance between a terminus base of telomere on chromosomal short arm and 5'-terminus of this base sequence : 164376928
  Distance between 3'-terminus of neighbour sequence of sequence listing upward to telomere on chrosomal short arm and 5'-terminus of this base sequence : 5681
ctaagtggagatagttctgcgtacacagctgctgatgcataaggaactaaaattgacaaaagaaattttctagtggttccctccaatatgaagaacttctgcaaagtaaattccactacagggatgttgcctttctccctattatatcttcagaatctacaatgcctggcacttaacatatacaggaaagaaggaaggaaggaaggaaggaaggaaggaaggaaggaaggaagggagggagggagggagggagggagggagggagggaggaaggaaggaaggaaggaagggagagagggagggagggagggaggaagaaaggaagaaacgatggaaggaaggtcgtgtccatggtgtttacatatttgaatcctttaaatccctattgcacagtctgtagagttgcaagtcctgcgaatgagtcaaggctccaagcattataaccttgagcaagtcaactaagtgc

SEQ ID NO: 1348 - DNA, 252 bp, Homo sapiens
  AL160058.8_257
  Located on chromosome 1
  Distance between a terminus base of telomere on chromosomal short arm and 5'-terminus of this base sequence : 164533181
  Distance between 3'-terminus of neighbour sequence of sequence listing upward to telomere on chrosomal short arm and 5'-terminus of this base sequence : 155787
tcatagagcttatggtctagtgacatagacagacaataaaccaaatatatatatatatatatatatttcaaattgtaataagtgccttgaagatgatgaatagcacatagtaatacagaaccaaggaatttagataacctggttttctatccctgtggccatgcctttcttaaaataatgttattcttttttcaaagcatctgcttaatttacatgtctaaacagtttctgctagacctttagtacatgagt

SEQ ID NO: 1349 - DNA, 318 bp, Homo sapiens
  AC026651.2_62267
  Located on chromosome 1
  Distance between a terminus base of telomere on chromosomal short arm and 5'-terminus of this base sequence : 164534809
  Distance between 3'-terminus of neighbour sequence of sequence listing upward to telomere on chrosomal short arm and 5'-terminus of this base sequence : 1376
gtgaacctttgagtttggtactatcattatccctgttttagagagaagaaatgggcacagaacaagtaagacccttgcccatggtaacacagctaaggaacagcgggacaaggatttgatcccagatactctggttcctaagtctatgctcttaacaactacactgtcttggcttatcatacacagcttctaaaactatgtataagcttttactcatatataaataataataataataataataataataataataataacacccaatcctgtagagtactctacactttaccaaaaggcctttcaggttaattatct

SEQ ID NO: 1350 - DNA, 274 bp, Homo sapiens
  AL160058.8_86070
  Located on chromosome 1
  Distance between a terminus base of telomere on chromosomal short arm and 5'-terminus of this base sequence : 164619019
  Distance between 3'-terminus of neighbour sequence of sequence listing upward to telomere on chrosomal short arm and 5'-terminus of this base sequence : 83892
aatgttggaatctgtcatatgttttgttttgttttgttttgttttgttttgttttgttttgttttgtttgagacggagtctcgctctgttgcccaagctggagtgcagtggcatggtggcactatctcagctcactgcaacctccgcctcccaggctcaagcaattctcctgcctcagcctcctgagtagctgggattacaggcacctgccaccacaccgggctaattttttgtatttttagtagagacggggtttcactgtattagccaggat

SEQ ID NO: 1351 - DNA, 396 bp, Homo sapiens
  AC026651.2_147030
  Located on chromosome 1
  Distance between a terminus base of telomere on chromosomal short arm and 5'-terminus of this base sequence : 164619019
  Distance between 3'-terminus of neighbour sequence of sequence listing upward to telomere on chrosomal short arm and 5'-terminus of this base sequence : -274
aatgttggaatctgtcatatgttttgttttgttttgttttgttttgttttgttttgttttgttttgtttgagacggagtctcgctctgttgcccaagctggagtgcagtggcatggtggcactatctcagctcactgcaacctccgcctcccaggctcaagcaattctcctgcctcagcctcctgagtagctgggattacaggcacctgccaccacaccgggctaattttttgtatttttagtagagacggggtttcactgtattagccaggatggtctccatctcctgatctcatgatccacccacttcggcctcccaaagtgctaggattataggcatgagccaccgtgcccggcctgaatcagtcatggttttcttaggctgatggaatatca

SEQ ID NO: 1352 - DNA, 179 bp, Homo sapiens
  D1S2878
  Located on chromosome 1
  Distance between a terminus base of telomere on chromosomal short arm and 5'-terminus of this base sequence : 164625875
  Distance between 3'-terminus of neighbour sequence of sequence listing upward to telomere on chrosomal short arm and 5'-terminus of this base sequence : 6460
accagaaccacaatctctaaacaatgaattgcatgtgtgtatgtgtgtgtgtgtgtgtgtgtgtgtgtgtcagagagagagacttactgagaaaggggacacaaaagccagggtacttagaactacagaattcttaccaaggtaaggaagttgcttagcaacctcatcctcagccaata

SEQ ID NO: 1353 - DNA, 233 bp, Homo sapiens
  D1S194
  Located on chromosome 1
  Distance between a terminus base of telomere on chromosomal short arm and 5'-terminus of this base sequence : 164659669
  Distance between 3'-terminus of neighbour sequence of sequence listing upward to telomere on chrosomal short arm and 5'-terminus of this base sequence : 33615
gtctcttgctggactgggaatggcttccctgccggaggatactgcaggactatagtggacctgttgtttttgctttttttctatattaaaaagcacattgttgagcacagaggtcatgtgtgcgcgtgtgtgtgtgtgtgtgtgtgtgtagaagcgtaaagagtcttggaaaattgaattttgcttttagaacaagagatgatgatgtggagcagaaaacttacagcctagct

SEQ ID NO: 1354 - DNA, 308 bp, Homo sapiens
  AL160058.8_126826
  Located on chromosome 1
  Distance between a terminus base of telomere on chromosomal short arm and 5'-terminus of this base sequence : 164659706
  Distance between 3'-terminus of neighbour sequence of sequence listing upward to telomere on chrosomal short arm and 5'-terminus of this base sequence : -196
gatactgcaggactatagtggacctgttgtttttgctttttttctatattaaaaagcacattgttgagcacagaggtcatgtgtgcgcgtgtgtgtgtgtgtgtgtgtgtgtagaagcgtaaagagtcttggaaaattgaattttgcttttagaacaagagatgatgatgtggagcagaaaacttacagcctagctcatagaaagaagtgcatttttgctttttggaagcctggagaatgaaggaaggaggggagaaaggagaggaggaggggaagacttttgctggtatttcaataacaccaagcag

SEQ ID NO: 1355 - DNA, 278 bp, Homo sapiens
  chr1.fa.O7frz.187278662
  Located on chromosome 1
  Distance between a terminus base of telomere on chromosomal short arm and 5'-terminus of this base sequence : 164815874
  Distance between 3'-terminus of neighbour sequence of sequence listing upward to telomere on chrosomal short arm and 5'-terminus of this base sequence : 155860
cacatactcattgctactgagatattattgtttctaggccttcacaagagacggagctagaaatatatgaacacacacacacacacacacacacacacacacacacagcctagatatttttttatgccagtctgtaaaagccatactcaaaaccatgagttcacaccaatatttccaatccttaactaacactccagagttttttccaacctttgcttttccatgttcgtaatccctttctcagacagtgagaaacctggattccatttagtctcaat

SEQ ID NO: 1356 - DNA, 385 bp, Homo sapiens
  AL356441.9_72384
  Located on chromosome 1
  Distance between a terminus base of telomere on chromosomal short arm and 5'-terminus of this base sequence : 164904271
  Distance between 3'-terminus of neighbour sequence of sequence listing upward to telomere on chrosomal short arm and 5'-terminus of this base sequence : 88119
agtattcagcaatgaggaaactacccagggccaggggaaaaaccaccagaaaggaggaggcaggaaaaatcccttgacctcatataggactgggaatagtttgggttcccagcagccagcgtggaaagatcttatagggcattgtgtagggtcctcagaaggctattgcctcaataatgggctcaaattagccctaggctagtggctgttctgggcctgccataacaaagcttaaaaggaagcctctcacgcctctgcgctccagcctgggcgacagaggggaactccgtctcaaaataaataaataaataaataaataaataaataaataaataaataaataaataaaagcctcggaagaatcaaaccaattccaaataactta

SEQ ID NO: 1357 - DNA, 313 bp, Homo sapiens
  AL358115.6_141251
  Located on chromosome 1
  Distance between a terminus base of telomere on chromosomal short arm and 5'-terminus of this base sequence : 165070983
  Distance between 3'-terminus of neighbour sequence of sequence listing upward to telomere on chrosomal short arm and 5'-terminus of this base sequence : 166327
gatatccattcagttgcttcagcaccacttcttgaaaaggctgtccttcctccactgaattgcatttgcatctttgtcatatcagttattcatatttgcgtgggtctgaaataagagtttggcccatatctactgatagttctgccagtttcacaaattaataaaagaaaatcattatattcaaaggatgtttgctttttattattattattattattattattttgtcagtagtagattagccctgaaaatttatgatgacttccagtgtgatgaacttactcctccttatacagtaacgtggtctatgtgg

SEQ ID NO: 1358 - DNA, 363 bp, Homo sapiens
  chr1.fa.O7frz.187525476
  Located on chromosome 1
  Distance between a terminus base of telomere on chromosomal short arm and 5'-terminus of this base sequence : 165168319
  Distance between 3'-terminus of neighbour sequence of sequence listing upward to telomere on chrosomal short arm and 5'-terminus of this base sequence : 97023
gcatgcaaccagtatacactacccaatttgtagtcttttatctctcaacccctcccatcctttccctcaaggccccaaagtctattttatcattcttatgcctttgcatccttatagctcatctcccacttatgagtgagaacatatgatatttggttttccattcctgagttacttcacttagaataatggtctccaattccatccaggttgctgtggatgccattattttgttcctttttatggctgagtagtatttgatgggagatatttatatatatataaaatatatatatatatatatatatctcacaattgttgactgaagggcatttgggctggttccatagctttgttattgtg

SEQ ID NO: 1359 - DNA, 207 bp, Homo sapiens
  D1S2681
  Located on chromosome 1
  Distance between a terminus base of telomere on chromosomal short arm and 5'-terminus of this base sequence : 165275743
  Distance between 3'-terminus of neighbour sequence of sequence listing upward to telomere on chrosomal short arm and 5'-terminus of this base sequence : 107061
agacgcacatccacagatagtattcttttcacaaagagcacctactttgttcttaacattgtgttagactttgtggataacacagaggatgtagaaaccacacacacacacacacacacacacacacacactctctctctctctctctctctctctctttctctctctctctttgcatataatttcatctggtgagggtctcaagtc

SEQ ID NO: 1360 - DNA, 102 bp, Homo sapiens
  DISO7_10000733
  Located on chromosome 1
  Distance between a terminus base of telomere on chromosomal short arm and 5'-terminus of this base sequence : 165387960
  Distance between 3'-terminus of neighbour sequence of sequence listing upward to telomere on chrosomal short arm and 5'-terminus of this base sequence : 112010
aatgctcaagtgtctcctacctttaaaaaccaaccaaccaaccaaccaaccaaccaaccaaccaaccaaccaatgaacgaaccagccaaccaatactcaatc

SEQ ID NO: 1361 - DNA, 110 bp, Homo sapiens
  DISO7_10004888
  Located on chromosome 1
  Distance between a terminus base of telomere on chromosomal short arm and 5'-terminus of this base sequence : 165479659
  Distance between 3'-terminus of neighbour sequence of sequence listing upward to telomere on chrosomal short arm and 5'-terminus of this base sequence : 91597
tggagttagaaatgtcatcttctctttatctctatttctctatttctctctctctctctctctctctctctctctctctctctctctatctccccttgctgcatagtggt

SEQ ID NO: 1362 - DNA, 439 bp, Homo sapiens
  chr1.fa.O7frz.188127180
  Located on chromosome 1
  Distance between a terminus base of telomere on chromosomal short arm and 5'-terminus of this base sequence : 165626464
  Distance between 3'-terminus of neighbour sequence of sequence listing upward to telomere on chrosomal short arm and 5'-terminus of this base sequence : 146695
ccatgacataggtacgatgtagggaagtaaagcagtgaacaacttttactttatctggacacctggactgaggatgatcttgccaataaatctaccctactttacttccattttggcaacattcactaacaccacgaaaaacaccattttcttctgtgtgtgtgtgtgtgtgtgtgtgtgtatggcaaggaggggtgttaaaacttactacatatcaattctaagatccaggggggctttatttacactttcctatctctgaaattgagatacctcttacatataatatggtgcatcataatttaattggtggcaatttttattttttcataatatataaagtaataataaaattggaattcatcttccaaattgttgatatctatcttgatgatgataactgatgaaatctggtagtatgaagcatgttacctaaatc

SEQ ID NO: 1363 - DNA, 116 bp, Homo sapiens
  D1S2673
  Located on chromosome 1
  Distance between a terminus base of telomere on chromosomal short arm and 5'-terminus of this base sequence : 165803629
  Distance between 3'-terminus of neighbour sequence of sequence listing upward to telomere on chrosomal short arm and 5'-terminus of this base sequence : 176726
acgatccacacacatgcacacacacatgcacatgtgcgagcatacacacacacacacacacacacacacacacacacacacacacacacacctcccttcctggcctcttacctagc

SEQ ID NO: 1364 - DNA, 446 bp, Homo sapiens
  chr1.fa.O7frz.188411262
  Located on chromosome 1
  Distance between a terminus base of telomere on chromosomal short arm and 5'-terminus of this base sequence : 165908192
  Distance between 3'-terminus of neighbour sequence of sequence listing upward to telomere on chrosomal short arm and 5'-terminus of this base sequence : 104447
gatgacttgagcttaggaagttgaggctgcagtgagctgagactgtgccactgcactccagcctgggcaacagagaccctgcctcaaaaagaaaggtagtgtcctgagcatttttaggtctaatcatattagagagaaaattccaaaaaccccaaaaccaattatgaaaatccatctttaaaattattttccccaacagccattcctggttccaaaatctttattagtcagggttcttcagagagatagaactaataggatatagatagatggatggatgaatagtagatagatagacagatagatagatagatagatagatagatagatgatagatagatagatagatagatagacacatagatagatacacagttacatagatagatgagaggatttattagagaaattggttcatgcaattatgaaagcttagaagtcctaca

SEQ ID NO: 1365 - DNA, 267 bp, Homo sapiens
  chr1.fa.O7frz.188604188
  Located on chromosome 1
  Distance between a terminus base of telomere on chromosomal short arm and 5'-terminus of this base sequence : 166101244
  Distance between 3'-terminus of neighbour sequence of sequence listing upward to telomere on chrosomal short arm and 5'-terminus of this base sequence : 192606
aagctaggtgcctaagtcataccagcaacaaaaagaggctgggagggtggggttgtatattaatgtccattataatttaactacattcagttgaacaaagcgtttttccaaaaacaaggttaatagaaattgacatatatatgtgtgtgtgtatacatacatatatatatatatatatatataaatatatataaatatatatatttatatatatatatatatatatatatccttctagctttgctctactggacattaacgtctcag

SEQ ID NO: 1366 - DNA, 238 bp, Homo sapiens
  D1S2762
  Located on chromosome 1
  Distance between a terminus base of telomere on chromosomal short arm and 5'-terminus of this base sequence : 166178567
  Distance between 3'-terminus of neighbour sequence of sequence listing upward to telomere on chrosomal short arm and 5'-terminus of this base sequence : 77056
aaaaatctggaaggcataaataattaggaatgaaaaggaaggggacgtgtgtgtgtgtgtgtgtgtgtgtgtgtgtgtgtgtttaaaattacaatcaactgttacatttgtttttatgccaatgttttttaaagtcaactttattgactttaaaatgaaacacacctattttaagtccatagtttgatgaattttgacaaatatatactactaatagccaccaacaccacaattaagg

SEQ ID NO: 1367 - DNA, 272 bp, Homo sapiens
  D1S2630
  Located on chromosome 1
  Distance between a terminus base of telomere on chromosomal short arm and 5'-terminus of this base sequence : 166438566
  Distance between 3'-terminus of neighbour sequence of sequence listing upward to telomere on chrosomal short arm and 5'-terminus of this base sequence : 259761
cagtaatcccatagacagtaaatcgattagtttatacttttagatgctttaggatataaataaattggtaactatgaaccacgtgctatagagtttaatgctaaatgtaattttacaagtaaatcaggttatatatatatgtgtgtgtgtgtgtgtgtgtgtgtgtgtgattgaattttttttttttccttaaagaaacagggtctcactctgtcgcccaggatgaagtgcagaggtgagatcagggctcactgcactctcaaccttctggg

SEQ ID NO: 1368 - DNA, 117 bp, Homo sapiens
  HUMUT1089
  Located on chromosome 1
  Distance between a terminus base of telomere on chromosomal short arm and 5'-terminus of this base sequence : 166731996
  Distance between 3'-terminus of neighbour sequence of sequence listing upward to telomere on chrosomal short arm and 5'-terminus of this base sequence : 293158
agaagcctgatgtagaagcacatggtgtggagggaatgataaacccaggaaaacctagcagcagcagcagcagcagcagcagcagcagcagcaaatcaggcctctgcttctcctctt

SEQ ID NO: 1369 - DNA, 108 bp, Homo sapiens
  AL031733_158775
  Located on chromosome 1
  Distance between a terminus base of telomere on chromosomal short arm and 5'-terminus of this base sequence : 166732006
  Distance between 3'-terminus of neighbour sequence of sequence listing upward to telomere on chrosomal short arm and 5'-terminus of this base sequence : -107
tgtagaagcacatggtgtggagggaatgataaacccaggaaaacctagcagcagcagcagcagcagcagcagcagcagcagcaaatcaggcctctgcttctcctcttg

SEQ ID NO: 1370 - DNA, 277 bp, Homo sapiens
  D1S196
  Located on chromosome 1
  Distance between a terminus base of telomere on chromosomal short arm and 5'-terminus of this base sequence : 166826556
  Distance between 3'-terminus of neighbour sequence of sequence listing upward to telomere on chrosomal short arm and 5'-terminus of this base sequence : 94442
agctctcatgtctttacattctcacagactgtcagtattactatgatgagagtgtgtgtgtgtgtgtgtgtgtgtgtgtgtacatattggtgtatataatgtgtttgttttgtgacctactttttcatccatatctttttacttcagtaaacattttctaccacattttttaaaattatgggactaggagatagaagagaaacatgtaacgaatccaaatcttaaaaagattattttgatatttcaccgtgaaacactaggagaaacacccacagcc

SEQ ID NO: 1371 - DNA, 344 bp, Homo sapiens
  Z99943.1_15580
  Located on chromosome 1
  Distance between a terminus base of telomere on chromosomal short arm and 5'-terminus of this base sequence : 166930799
  Distance between 3'-terminus of neighbour sequence of sequence listing upward to telomere on chrosomal short arm and 5'-terminus of this base sequence : 103966
ggtttcaccatgttagtcaacctggtcttgagctcctgacctcaggttatctgcctgccttagcctaccaaagtgctgggattataggtgtgaaccactgcacccagccaaagggactaatacatacacatacatatatacatatatacatatatatatatatatatatatatatacacatatatatatttatgtttattctttcttggcgttcctgctgcagtatgaatctctgccaaggcccagaaaagtgactgggacatagaatgaattcaggtgtttgttgaatgaatttattggtggtgtgcagagtgttaccatgctttgttggtttgttaattgaa

SEQ ID NO: 1372 - DNA, 110 bp, Homo sapiens
  D1S2750
  Located on chromosome 1
  Distance between a terminus base of telomere on chromosomal short arm and 5'-terminus of this base sequence : 166952376
  Distance between 3'-terminus of neighbour sequence of sequence listing upward to telomere on chrosomal short arm and 5'-terminus of this base sequence : 21233
gatgatgccaattacatccaagcaaagttgaataggctgtgtgtgtgtgtgtgtgtgtgtgtgtgtgtgtgtgtgtgtgtgtgtacaggtgtcatcagcatttgaaactg

SEQ ID NO: 1373 - DNA, 419 bp, Homo sapiens
  AC069147.3_149902
  Located on chromosome 1
  Distance between a terminus base of telomere on chromosomal short arm and 5'-terminus of this base sequence : 167038908
  Distance between 3'-terminus of neighbour sequence of sequence listing upward to telomere on chrosomal short arm and 5'-terminus of this base sequence : 86422
taacgaaacataaatggcactcttttgaagactgaggaccttgagatgtccctaggccacctttctaaacattgaaagttgcttatggatggcatgaattggagctgagttcatactaaaacattccttgaaagtcatttttctttaaaagaataataatacatctttctttctttctttctttcttttttgagacagagtttttctcttgttgcccaggctggagtgcaatggcgtgatctcggctcactgcaacctccgcctcctgggttcaagcaattctcctgcctcagtctcctcagtagctgggattacatgcatgcgccaccatgcccggctaatttttttttgtatttttagtagagacggggtttctccatgttggtcaggctggtctctagaacttctgacctcaagtg

SEQ ID NO: 1374 - DNA, 211 bp, Homo sapiens
  D1S431
  Located on chromosome 1
  Distance between a terminus base of telomere on chromosomal short arm and 5'-terminus of this base sequence : 167042302
  Distance between 3'-terminus of neighbour sequence of sequence listing upward to telomere on chrosomal short arm and 5'-terminus of this base sequence : 2975
ggaggatagcataccaaaaagggggccgtgtgtgtgtgtgtgtgtgtgtgtgtgtgtgtgtgtgtgtgtgttgggagtaggagagtggggctcaaggatatgacgtggtccatgctattttatgcttatttccccttccaggacctagcattgagacaaccattctttccatcactcaaccagtattaactgattgcctctaggtgctagg

SEQ ID NO: 1375 - DNA, 182 bp, Homo sapiens
  Z23745.1_215
  Located on chromosome 1
  Distance between a terminus base of telomere on chromosomal short arm and 5'-terminus of this base sequence : 167176800
  Distance between 3'-terminus of neighbour sequence of sequence listing upward to telomere on chrosomal short arm and 5'-terminus of this base sequence : 134287
cgtggcaattcaagataagatttaggtgagatcatagccaaaccacgtcgtgtgtgtgtgtgtgtgtgtgtgtgtggtgtgtgtgtgtgtggtgtgtgtgtgcgtgcgcgtgtgcacgtggcttaaagtaacaaatttattatcttactgttctggaagtcagaagtctgaaataaggtgta

SEQ ID NO: 1376 - DNA, 150 bp, Homo sapiens
  D1S445
  Located on chromosome 1
  Distance between a terminus base of telomere on chromosomal short arm and 5'-terminus of this base sequence : 167176826
  Distance between 3'-terminus of neighbour sequence of sequence listing upward to telomere on chrosomal short arm and 5'-terminus of this base sequence : -156
tgagatcatagccaaaccacgtcgtgtgtgtgtgtgtgtgtgtgtgtgtggtgtgtgtgtgtgtggtgtgtgtgtgcgtgcgcgtgtgcacgtggcttaaagtaacaaatttattatcttactgttctggaagtcagaagtctgaaataa

SEQ ID NO: 1377 - DNA, 182 bp, Homo sapiens
  AL031287.3_44057
  Located on chromosome 1
  Distance between a terminus base of telomere on chromosomal short arm and 5'-terminus of this base sequence : 167183866
  Distance between 3'-terminus of neighbour sequence of sequence listing upward to telomere on chrosomal short arm and 5'-terminus of this base sequence : 6890
attagaagtcaacttccattcacattttttcagtaaaggaaggccaggattacacacacacacacacacacacacacacacaaacaccgaatgcacattcatatattcacatattttatattgttaaaaataaaggtggacttgggcagaaaccaacaatgtcagtaaagatggacatagat

SEQ ID NO: 1378 - DNA, 206 bp, Homo sapiens
  AL033531.10_19070
  Located on chromosome 1
  Distance between a terminus base of telomere on chromosomal short arm and 5'-terminus of this base sequence : 167233433
  Distance between 3'-terminus of neighbour sequence of sequence listing upward to telomere on chrosomal short arm and 5'-terminus of this base sequence : 49385
tttattcatgcctgaatcatagctttctcaatggaaaaaataaatatatatataccaccttagcttttttttgccaaaatagctatatattcctttctggtttaaaagaaatacatgtttgtcgcgcacacacacacacacacacacacacacacacacacacacaaattcagtataaaaaatttacctgcagtaattctactgac

SEQ ID NO: 1379 - DNA, 305 bp, Homo sapiens
  AC026140.4_156991
  Located on chromosome 1
  Distance between a terminus base of telomere on chromosomal short arm and 5'-terminus of this base sequence : 167280665
  Distance between 3'-terminus of neighbour sequence of sequence listing upward to telomere on chrosomal short arm and 5'-terminus of this base sequence : 47026
tgtaattcacatgccatgtaactgactcatttaaagtatacaattcaatgagaattgtatactttacaatctttatatactttacagttcaatcttttatgaactgaagcctccacaacaatggcagttcaccactgtgcccccagcatctggcacagggtccggccaaggcaggaacgtggcaaataactgctgaatgaatgaatgaatgaatgaatgttgcagtgcctctggatccctttagttgtctgagaacagggaagcagactggggagtaacagagactttccttaaatcacatgagg

SEQ ID NO: 1380 - DNA, 201 bp, Homo sapiens
  D1S2799
  Located on chromosome 1
  Distance between a terminus base of telomere on chromosomal short arm and 5'-terminus of this base sequence : 167315106
  Distance between 3'-terminus of neighbour sequence of sequence listing upward to telomere on chrosomal short arm and 5'-terminus of this base sequence : 34136
agcaagaccctgtctcaaaaaattatatgtatgtatctgtctatctatctatctatatctatctatatagatatagatatagatatgcacatacatacacacacacacacacacacacacacacacacacacacacacttgtttgcatggaagctggagtggccattagacccagtctgcaaagtggtggaaagctatcca

SEQ ID NO: 1381 - DNA, 334 bp, Homo sapiens
  AL021397.1_14805
  Located on chromosome 1
  Distance between a terminus base of telomere on chromosomal short arm and 5'-terminus of this base sequence : 167393333
  Distance between 3'-terminus of neighbour sequence of sequence listing upward to telomere on chrosomal short arm and 5'-terminus of this base sequence : 78026
atttgccattgagattagaatagaacaggctctattcatgcaaactatatgaaatgaaaaacttttaagactcttcattaattggagcttctgggcaacatcgtgtgtgtgtgtgtgtgtgtgtgtgtgtgtgtgtgtatacagacattttttttttaacttgttgattcagatgtcttggtccctgaatagtcctagattacttattttgagaattcattgttaaaaattacagggaattaaaataattgccttttttttttttagagggtaagagatgggtagaagagtatgcctctgaaaattttattagtttattcttgtggagaatacc

SEQ ID NO: 1382 - DNA, 272 bp, Homo sapiens
  D1S2658
  Located on chromosome 1
  Distance between a terminus base of telomere on chromosomal short arm and 5'-terminus of this base sequence : 167476904
  Distance between 3'-terminus of neighbour sequence of sequence listing upward to telomere on chrosomal short arm and 5'-terminus of this base sequence : 83237
agcatccatgcaccatgtatgtcacacacacacacacacacacacacacacacacacacacccctctaaaagttctgatgagtatttgataaatagtagagttttgaggagagatggaggaaagtgtttacaagtttaactttttgaatttgcttttaactctctgctgttccctcacctgtaaaatctgcctcatctctgcccctctttcttcttgcaaacctcacttctcatagcctcctccagcagcactgacttctggagattccctg

SEQ ID NO: 1383 - DNA, 186 bp, Homo sapiens
  AL009051.1_29500
  Located on chromosome 1
  Distance between a terminus base of telomere on chromosomal short arm and 5'-terminus of this base sequence : 167484918
  Distance between 3'-terminus of neighbour sequence of sequence listing upward to telomere on chrosomal short arm and 5'-terminus of this base sequence : 7742
cgtgactgcctatcagaatgaggaggtaagagtgtgtgtgtgtgtgtgtgtgtgtgtgtgtgtgtgtgtgtgtaactgtcacctgggagatcatggcaggatgggcggggggggtccttttagatgaaaggtaggttttccaggatttggatacactcagcagacatgaagttaaacaatggagta

SEQ ID NO: 1384 - DNA, 245 bp, Homo sapiens
  AL022100.13_8567
  Located on chromosome 1
  Distance between a terminus base of telomere on chromosomal short arm and 5'-terminus of this base sequence : 167522831
  Distance between 3'-terminus of neighbour sequence of sequence listing upward to telomere on chrosomal short arm and 5'-terminus of this base sequence : 37727
aaccattctatgacataggctccattattttcttatagagaaggaaacaagcttagagaggttaagaaacttgtttaaggtcacacagctggtaagtagctgagccaaaaagagatgttataggggtgtgtgtgtgtgtgtgtgtgtgtgtgtgtgtgtgtgtgtgtgtatgtgtgtgtgtgttctaggccaacccctaacccatgataggaattatttctgtgacatcttacagtgttagacct

SEQ ID NO: 1385 - DNA, 297 bp, Homo sapiens
  AL022100.13_35452
  Located on chromosome 1
  Distance between a terminus base of telomere on chromosomal short arm and 5'-terminus of this base sequence : 167549787
  Distance between 3'-terminus of neighbour sequence of sequence listing upward to telomere on chrosomal short arm and 5'-terminus of this base sequence : 26711
taatgagtatctctgagcctgtatgtataagtatgtatgtgtgtatataaaaatacacacacacacacacacacacacacttctcctcctcctcctcctctgccttcttttttttcttcaattatttcttctgggtaagttccttggagtgggatgactgagttgaaagttgtgaacttcttattgactcatgcgttgcattaacaattcaaaatgattgatcaatttaatttgttacaagcaataaatgagtgcactgattttgccataagcctactagcattaggcattatcatt

SEQ ID NO: 1386 - DNA, 199 bp, Homo sapiens
  AL022100.13_76239
  Located on chromosome 1
  Distance between a terminus base of telomere on chromosomal short arm and 5'-terminus of this base sequence : 167590555
  Distance between 3'-terminus of neighbour sequence of sequence listing upward to telomere on chrosomal short arm and 5'-terminus of this base sequence : 40471
aggataaggcagaggtgacgatctcctcctgcctggacccctgtcctggcccatcactacccatagggtaggggtgtgtgtgtgtgtgtgtgtgtgtgtgtgtgtgtgtgtgtggtctgagtgggatgggaaggtggatggcttggtatacataaggtctttttcagaacacttgaaatgcagaccttgtctgataata

SEQ ID NO: 1387 - DNA, 144 bp, Homo sapiens
  D1S433
  Located on chromosome 1
  Distance between a terminus base of telomere on chromosomal short arm and 5'-terminus of this base sequence : 167590603
  Distance between 3'-terminus of neighbour sequence of sequence listing upward to telomere on chrosomal short arm and 5'-terminus of this base sequence : -151
gcccatcactacccatagggtaggggtgtgtgtgtgtgtgtgtgtgtgtgtgtgtgtgtgtgtgtggtctgagtgggatgggaaggtggatggcttggtatacataaggtctttttcagaacacttgaaatgcagaccttgtct

SEQ ID NO: 1388 - DNA, 309 bp, Homo sapiens
  AL023755.5_78991
  Located on chromosome 1
  Distance between a terminus base of telomere on chromosomal short arm and 5'-terminus of this base sequence : 167616328
  Distance between 3'-terminus of neighbour sequence of sequence listing upward to telomere on chrosomal short arm and 5'-terminus of this base sequence : 25581
tacgcatctatttgtaatttcttggtaccgatgatcagtttaatgaatgtcaactgagcactttgtccaagtccctgggtgggagacagatgaacaaggcatggtccacattaccagagtgctggggatagatggattcacagacacaaagtcatcatctctgcaatacagaggaaacaaaatgaaatgaaacagtaacacagaagcagagaaggtgagggaggtgatggagtgtgtttgtgtgtgtgtgtgtgtgtgtgtgtgtgtatttaagggtgacactggcagagctaggacaaaggctggaac

SEQ ID NO: 1389 - DNA, 379 bp, Homo sapiens
  AL023755.5_63072
  Located on chromosome 1
  Distance between a terminus base of telomere on chromosomal short arm and 5'-terminus of this base sequence : 167632296
  Distance between 3'-terminus of neighbour sequence of sequence listing upward to telomere on chrosomal short arm and 5'-terminus of this base sequence : 15659
ggagtctagtaaggccacttactggctgtgagacttagtcaggtcacttacctctggtcctcagtctcactttgattttcagtagttattgattactactgaaaatcaaagtgagaaaattactactattgattcagtagttattgattaatatctcttccagcaccacattacatagcatgtatatgtgtgtgtgtgtgtgtgtgtgtgtgtgtgtgagagagagagagagagagtgaagagagagagaagagaggcaggctatcaaatagaatagcttttggggggaaatttgtataaggcaagacagaaacatacattattggggactgaggaaagcctttcactttaatttccatttcaatcattgaagctcata

SEQ ID NO: 1390 - DNA, 375 bp, Homo sapiens
  AL023755.5_46793
  Located on chromosome 1
  Distance between a terminus base of telomere on chromosomal short arm and 5'-terminus of this base sequence : 167648540
  Distance between 3'-terminus of neighbour sequence of sequence listing upward to telomere on chrosomal short arm and 5'-terminus of this base sequence : 15865
gctacagaaatgtttgaaattaagcctatattcagggcaagactgagcacttcagaggattcaaagaagtaggagccacaatttcttttttagaaatttctttcttttctttccttccttccttccttccttccttccttccttccttccttccttccttcccttctttccttcttttcttttctctttctttctttctttctttctttctttctttctttctttctttctttctttctttctttctttcttttctttttttctttcttttcttctttctttccttctttgactttctggaatgccagataagtaagacacccatggggagccatgggcggcttctgaggagaaaagtctccttattgccttcat

SEQ ID NO: 1391 - DNA, 288 bp, Homo sapiens
  AL031736.16_9707
  Located on chromosome 1
  Distance between a terminus base of telomere on chromosomal short arm and 5'-terminus of this base sequence : 167715994
  Distance between 3'-terminus of neighbour sequence of sequence listing upward to telomere on chrosomal short arm and 5'-terminus of this base sequence : 67079
gtattaggtaattcttgaagcactataaagaaatacctgaggctgggaaatttataagaaaagagatctaattggcaggctgttcaggaagcacagtggcatctgcttctaaggggggcctcaggaagcttccaatcatggcagaaggcaaagggggagcaggcacataatgtggcaagaatggagagagagagagagagagagagagagagtttgtgagagagtgtttgtggggagaggtgccacacacatttaaacaatgagatctcaccagaattcactatcatg

SEQ ID NO: 1392 - DNA, 415 bp, Homo sapiens
  AL031736.16_96633
  Located on chromosome 1
  Distance between a terminus base of telomere on chromosomal short arm and 5'-terminus of this base sequence : 167802929
  Distance between 3'-terminus of neighbour sequence of sequence listing upward to telomere on chrosomal short arm and 5'-terminus of this base sequence : 86647
agtaactgttaacattaagccaaaaagttatgctaaagtacaattttcaaaaaggtaaaatcatgactcacatgcaaatgtaacatgaataaatgtcaaaaattttacttaacccattaattaattagggaatgagtaagatgctaaaatgagttcaaggagaatttgaagaatacacacacacacacacacacacacacacacacacacaaaatcaggagtgctgaaatgaatttgctaaaaagataaatgacgagttaatgggtgcagcacaccaacatggcacatgtatacatatgtaacaaacctacatgttgtgcacatgtaccctagaacttaaagtataataataaaaaaaacaaaaacaaacaactgcaaaaggtagaaaactgattaatagcctacaatgctgtaa

SEQ ID NO: 1393 - DNA, 283 bp, Homo sapiens
  AL049798.7_40879
  Located on chromosome 1
  Distance between a terminus base of telomere on chromosomal short arm and 5'-terminus of this base sequence : 167914451
  Distance between 3'-terminus of neighbour sequence of sequence listing upward to telomere on chrosomal short arm and 5'-terminus of this base sequence : 111107
ttgagaattgttctgactctaaacttcattaacttttcaatacttcaagatccctcaaagaaacacacacacacacacacacacacacacacacacgatatcttaactctgcagaaatctcttattgattgagaagattgtgtcctgcaggttcccagacagaagcaaatcccctcctgggaggagggagcttttgccatccttacaagagcagccaacaaccatttttgcagagctcaagttcccccagacaattgattcctagcacttaggagagtgacct

SEQ ID NO: 1394 - DNA, 363 bp, Homo sapiens
  AL356573.9_94825
  Located on chromosome 1
  Distance between a terminus base of telomere on chromosomal short arm and 5'-terminus of this base sequence : 167916691
  Distance between 3'-terminus of neighbour sequence of sequence listing upward to telomere on chrosomal short arm and 5'-terminus of this base sequence : 1957
cacatcaatttcagattcactaaacttttactacctgcccatgatgtgctaggcatttgttttagacttcaatttgctttagagttttcttatactttatcctacaagtatcacagtaacacaagtagcagcttgtgaggtgggagtcacaccttcctttttcttcctttgcttttctttcctttccattcctttcctttcctttcctttcctttcctttcctttctctttcccttcctttcttccttccttctttccttccttccttcaatccttccttcctccctccctcccttccttctctctctctctttctttctttcttctctttcttttttgccagaatgagataccgaatgtcac

SEQ ID NO: 1395 - DNA, 369 bp, Homo sapiens
  AL049798.7_43245
  Located on chromosome 1
  Distance between a terminus base of telomere on chromosomal short arm and 5'-terminus of this base sequence : 167916692
  Distance between 3'-terminus of neighbour sequence of sequence listing upward to telomere on chrosomal short arm and 5'-terminus of this base sequence : -362
acatcaatttcagattcactaaacttttactacctgcccatgatgtgctaggcatttgttttagacttcaatttgctttagagttttcttatactttatcctacaagtatcacagtaacacaagtagcagcttgtgaggtgggagtcacaccttcctttttcttcctttgcttttctttcctttccattcctttcctttcctttcctttcctttcctttcctttctctttcccttcctttcttccttccttctttccttccttccttcaatccttccttcctccctccctcccttccttctctctctctctttctttctttcttctctttcttttttgccagaatgagataccgaatgtcacagataca

SEQ ID NO: 1396 - DNA, 421 bp, Homo sapiens
  AL031275.1_78928
  Located on chromosome 1
  Distance between a terminus base of telomere on chromosomal short arm and 5'-terminus of this base sequence : 167978952
  Distance between 3'-terminus of neighbour sequence of sequence listing upward to telomere on chrosomal short arm and 5'-terminus of this base sequence : 61891
atgtggtaactgataaggcttttcaatttcaggtttgttgataggggtttctttttcctggtataatatatgatatgtgtatacgtgtctgtgcatgtatgtgcttaagggataaaggaaagagaaaggtgtctctattcatccttagaaagttagaagtttagtgcaaatttttaaagtataaaggaaaacggcagattaattttgaaaataagaaattaagaacagggaaaggacaagtgttatgcagttgaatgggcatatgctcaggaagggtgtgtgtgtgtgtgtgtgtgtgtctgtgtctgtgtgtgtctgtgtgtgcatgtgtgagtgtgcatatgtgtgttccctatttctccatatgttttattttcattaactgttcaaaagactaaaaaggcttacactgaagttattg

SEQ ID NO: 1397 - DNA, 371 bp, Homo sapiens
  AL031275.1_54967
  Located on chromosome 1
  Distance between a terminus base of telomere on chromosomal short arm and 5'-terminus of this base sequence : 168003061
  Distance between 3'-terminus of neighbour sequence of sequence listing upward to telomere on chrosomal short arm and 5'-terminus of this base sequence : 23688
gatgaaatagacagtctgaagtctgacatctgggctcccacaggaatacctgcagtggtatagcaggtgatggggagaatggaaatgcgctaggaagaatcaaagaaagtagtgtgtatgtttgtgtgtgtgtgtgtgtgtgtgtgtgtgtatgcacgcacgcatgcaatcacaagtgatgaaagaagtgcatttactacttcagacactgagaggtgtcatcttttcgtgcataacaaagatccaaaacattacttgctgaatttgccccaacacactgtagtgaacatttccacatactatatagaggtttttctattgatagaaatagaccgtaaccttgaaatcagtgaaacaaagaatgctatgac

SEQ ID NO: 1398 - DNA, 195 bp, Homo sapiens
  D1S1569
  Located on chromosome 1
  Distance between a terminus base of telomere on chromosomal short arm and 5'-terminus of this base sequence : 168003095
  Distance between 3'-terminus of neighbour sequence of sequence listing upward to telomere on chrosomal short arm and 5'-terminus of this base sequence : -337
ctcccacaggaatacctgcagtggtatagcaggtgatggggagaatggaaatgcgctaggaagaatcaaagaaagtagtgtgtatgtttgtgtgtgtgtgtgtgtgtgtgtgtgtgtatgcacgcacgcatgcaatcacaagtgatgaaagaagtgcatttactacttcagacactgagaggtgtcatcttttcg

SEQ ID NO: 1399 - DNA, 474 bp, Homo sapiens
  chr1.fa.O7frz.190626668
  Located on chromosome 1
  Distance between a terminus base of telomere on chromosomal short arm and 5'-terminus of this base sequence : 168124150
  Distance between 3'-terminus of neighbour sequence of sequence listing upward to telomere on chrosomal short arm and 5'-terminus of this base sequence : 120860
tttacagaaggcttatcatgacatagatagaaatggacttttacaatgcaacagtggtggctctgaaggatagtgaaaactaaaattcttccaatgggacaaatgtgaaatgctttaacttgtggtcaggatgaaaggagaaatgctctcaggtaagcatctacatctactagcaggttctttaaagaagcaaaacagaattgatgacaaagagtcttagagaagagctatgtatacgaactggcaatgatcccagaatacactcatgtctcatgtgatataagtactccgacaaaatactcctccatggaggatattcttccagatcaagtaagtaagaggatccatttgttgttgttgttgttgttgttgttttgtttcaaattagtactaatctttaatcaaagagctacaaattcccaggtagtcttggaagcaagaccgctcagtattttggtaatgcttgtatttgac

SEQ ID NO: 1400 - DNA, 418 bp, Homo sapiens
  chr1.fa.O7frz.190714694
  Located on chromosome 1
  Distance between a terminus base of telomere on chromosomal short arm and 5'-terminus of this base sequence : 168212395
  Distance between 3'-terminus of neighbour sequence of sequence listing upward to telomere on chrosomal short arm and 5'-terminus of this base sequence : 87771
aagaaatattaaggctaggcatactggctcatgtaatcccagcatgttgggaggccaagacaagaggatcacttgaagtcaggagttccagactaacttgggcaacatagtgagacaccatctcttaaaaaataaataaataaataaataaataaataaataaatacataaatacataaaaattaaattagccaggcattctgacacatacctgaagtcccagctactcaggaggctgaagcagaaggatctcttgagcccaggagtttgaggcttcagtgagctatgtttgtgccactgcactccagtctgggtgacagagtgaaatcttgcctctaaaaaaaattaataaatacataaaaaaaaagtaagaactgattttgtttttatgaactcctttaaattgaagttaatgcca

SEQ ID NO: 1401 - DNA, 386 bp, Homo sapiens
  AL390855.4_14136
  Located on chromosome 1
  Distance between a terminus base of telomere on chromosomal short arm and 5'-terminus of this base sequence : 168270918
  Distance between 3'-terminus of neighbour sequence of sequence listing upward to telomere on chrosomal short arm and 5'-terminus of this base sequence : 58105
gatctttccattaatacaaagcacttccagcctttggagaaacaggggaattactgttttctggttggacaaggttttgtttcataatcttaggggcacagagatgcaccacattgctatcaccaagagcccagtctgagctgctagaccaagaagcacgtgtagacagtggataaaattagatcatagttgggtgcctgtaactccaactacttggggggctaaggtggaaggatcacttgagcccaggagttggagaccagccgcctgggcaacatagtgagacactgtctcaataataataataataataataataataatgagatcttgagcaagtcatgactgtgactaataagtgtgtgataatggctaagcttaatgtt

SEQ ID NO: 1402 - DNA, 472 bp, Homo sapiens
  AL390855.4_134869
  Located on chromosome 1
  Distance between a terminus base of telomere on chromosomal short arm and 5'-terminus of this base sequence : 168390879
  Distance between 3'-terminus of neighbour sequence of sequence listing upward to telomere on chrosomal short arm and 5'-terminus of this base sequence : 119575
ggccagtatcatactgtttaagagtgcagagtatcattaaatagtgataattataataacctctattacaagagtgacaataatgttagctaacacttattaagtattcactatgttctagaaagtttacataaattatctcacttattcttcacaataataattccatgaggtagatatcattattattacaattttacaaatgaagaaactaaagttttcaaaggataccacacttgccaagagcaaagctactgagtggtggaggtaggatttgaacttagatagataacagaacccagggtcttttttattattattattattattattattattattattattattatttttaaattgagatggagcctcactatgttgcccaagctggtctcaaactcctgggctcaagtgatcctcccgcctcagcctcccaagtagctgagtctaaagtgtatttcaccatgcc

SEQ ID NO: 1403 - DNA, 167 bp, Homo sapiens
  Z99758.7_74259
  Located on chromosome 1
  Distance between a terminus base of telomere on chromosomal short arm and 5'-terminus of this base sequence : 168450038
  Distance between 3'-terminus of neighbour sequence of sequence listing upward to telomere on chrosomal short arm and 5'-terminus of this base sequence : 58687
atcaggtcactgcactcagcctggatgacagagtaagaccttgtctcaaaaaaaataaaataaaataaaataaaacatatatatatatatatatatatatatatatacacacacacacacacacatacacacacacatatatcttctcattctcaaagttagccttt

SEQ ID NO: 1404 - DNA, 269 bp, Homo sapiens
  AL356852.3_36583
  Located on chromosome 1
  Distance between a terminus base of telomere on chromosomal short arm and 5'-terminus of this base sequence : 168541884
  Distance between 3'-terminus of neighbour sequence of sequence listing upward to telomere on chrosomal short arm and 5'-terminus of this base sequence : 91679
caagatcgtgccaagaaagaaagaaagaagaaagaaaggaaggaaaggaaggaaaggaaggaaagaaaggaaagaaagggagaaaagaaagaaagaaagaaagaaagaaggaaggaaggaaggaaggaaggaaggaaggaaggaaggaaagagccctgctctcaaggagctcactctccttagtacattactgagtcccaactcagagagccagacagcaggatagagaggtattaataaattcccaatgcatgtctttgaaagtagat

SEQ ID NO: 1405 - DNA, 216 bp, Homo sapiens
  chr1.fa.O7frz.191200853
  Located on chromosome 1
  Distance between a terminus base of telomere on chromosomal short arm and 5'-terminus of this base sequence : 168667468
  Distance between 3'-terminus of neighbour sequence of sequence listing upward to telomere on chrosomal short arm and 5'-terminus of this base sequence : 125315
ggatcacttgaacctagaagatcaaggctgcagtgatccgtgatcacgccactgcactccagcctgggcgacagagacagactctgtctcaaaaaacaaacgtgtgtgtgtgtgtgtgtgtgtgtatatatacacacacaccatatatatcatttttataaaattaatagatattttctcctcttatatacagtaacagtgaccatcaacattagt

SEQ ID NO: 1406 - DNA, 358 bp, Homo sapiens
  Z99572.1_59299
  Located on chromosome 1
  Distance between a terminus base of telomere on chromosomal short arm and 5'-terminus of this base sequence : 168741987
  Distance between 3'-terminus of neighbour sequence of sequence listing upward to telomere on chrosomal short arm and 5'-terminus of this base sequence : 74303
tctaggatactattgacatggactataacaccttccattagtcctactctctcacccttttcctcaccacgcagagtatgtctgtgtacacacacacacacacacacacacacacgcttggaatagaagatcaaacgcatttctaaggatgtgagcctttgacctcttgcttaaaaatgttgctatgatgtcacccacggatttcatcaccaagtctttggactggaagtgaggattggaggtgccccttagcgagtagattttaatccatgtctctgactctaggcacagtcatatttcaaccacaggaatgaaaaactgatgaacaaaaatagtactctgacttactgctcatgat

SEQ ID NO: 1407 - DNA, 374 bp, Homo sapiens
  AL022146.1_68030
  Located on chromosome 1
  Distance between a terminus base of telomere on chromosomal short arm and 5'-terminus of this base sequence : 168799016
  Distance between 3'-terminus of neighbour sequence of sequence listing upward to telomere on chrosomal short arm and 5'-terminus of this base sequence : 56671
acatgtggatttataactggaacttccaagaggttgaacacaggtcattgttccattctgagggcttagcaaaggtgtgcagggaatggctatcatgggcatggcagaggagaaaagaagagatcattttataattcagcaacctgaactctgtaactctctctctctttctccctctctctctctgtgtgtgtgtgtgtgtgtgtgtgtgtgtgtgtgtgtgtgtgattaatatacaacgatggtatttggctaaaagtgattgtttgaatttcatgatgcttcatcaccagttagagattgtagaggtgtaaaatagcagcagcttacagttgattgacatcctgaagtgctcaatcacaaacagctttaga

SEQ ID NO: 1408 - DNA, 302 bp, Homo sapiens
  AL022146.1_26544
  Located on chromosome 1
  Distance between a terminus base of telomere on chromosomal short arm and 5'-terminus of this base sequence : 168840640
  Distance between 3'-terminus of neighbour sequence of sequence listing upward to telomere on chrosomal short arm and 5'-terminus of this base sequence : 41250
ttcctagacagccaattgtactatttcttcttccctccctctcctcctttcttccttccttccttccttccttccttccttccttcctttcttcctcccttccttttttattttttggcagggtctcactctgttacccaggctggggtacagtactgcaataatagcttactgcagccttgacctccaaggctctagtgatcctcccacctcagcctctcgagtagctgggactataggcatgtgcccccacacctggctaatttttgtattttttttataatgacgaggtctcattatgt

SEQ ID NO: 1409 - DNA, 181 bp, Homo sapiens
  AL022146.1_19050
  Located on chromosome 1
  Distance between a terminus base of telomere on chromosomal short arm and 5'-terminus of this base sequence : 168848143
  Distance between 3'-terminus of neighbour sequence of sequence listing upward to telomere on chrosomal short arm and 5'-terminus of this base sequence : 7201
aggctatattactcagaacttcaaggtttcagtttttttgtttgtttgtgtgtgtgtgtgtgtgtgtgtgtgtgtgtgtggttttttttgttttgttttttgtttgtttgtttgagacatggtcttgctctctcacccaggctagagtgcaatggcacaatctcacttgactgcaaactcc

SEQ ID NO: 1410 - DNA, 427 bp, Homo sapiens
  AL021940.1_27096
  Located on chromosome 1
  Distance between a terminus base of telomere on chromosomal short arm and 5'-terminus of this base sequence : 168893972
  Distance between 3'-terminus of neighbour sequence of sequence listing upward to telomere on chrosomal short arm and 5'-terminus of this base sequence : 45648
ccaatggtagtgactaatcagaaaatgataatgcctggtgcacaaaatgtgtctagatgagcccatgcacaaggacacatgtttctggaactgttccttattcctttcctaaaagaaaggagggaaagtctccatactaagactactagggcaggggacaaagtgctagagtcagaagattcatctgaggacagaagaataggggtgaaggctctagtcacttcattggctaccatgctctaaatagttacctgtgccctttttctaactattagaacccaaaaagcctataaattctctctctctctctctctctctctgtgtatatatatacatatacacacacacatagacacacacacacacctaaacacacacatagagatttatgactttttacttttatccttgtaaatgccattaacta

SEQ ID NO: 1411 - DNA, 445 bp, Homo sapiens
  AL121714.33_6961
  Located on chromosome 1
  Distance between a terminus base of telomere on chromosomal short arm and 5'-terminus of this base sequence : 169122224
  Distance between 3'-terminus of neighbour sequence of sequence listing upward to telomere on chrosomal short arm and 5'-terminus of this base sequence : 227825
atgtgatctgaaaccagtacagaataaaagatcctatatctgactttacactattgtaggctaaaactgtattaatcttaaacaaaaattttaagaagacattatcacaaagttgcctaatattgactgcttataattgactgtgtatatatgtgtatatatatataacattgagttatatatagttatataatattgagttatagttacatgtaacattaagttttttctgtatatatgtacagttgtgtgtgtacacacacacacacacacacacattcaaaattttacttataactaccatgctaaatttcatctttttagtctgagtctgtctttaggaattctattcttcccaagacaaaatcatttatgactacatatttataaataggcagcagtgatttttcttaacaaaccagtctttgtgatccatcaggtaata

SEQ ID NO: 1412 - DNA, 129 bp, Homo sapiens
  DISO7_10000736
  Located on chromosome 1
  Distance between a terminus base of telomere on chromosomal short arm and 5'-terminus of this base sequence : 169194155
  Distance between 3'-terminus of neighbour sequence of sequence listing upward to telomere on chrosomal short arm and 5'-terminus of this base sequence : 71486
gactacaactagtgcttcaccagatatatatatatatatatacacacacacacacacacacacacacacacacacacaccacacacactttttttttttcttgaggaaacagtgtgaaaggaggtgatg

SEQ ID NO: 1413 - DNA, 187 bp, Homo sapiens
  D1S2851
  Located on chromosome 1
  Distance between a terminus base of telomere on chromosomal short arm and 5'-terminus of this base sequence : 169543557
  Distance between 3'-terminus of neighbour sequence of sequence listing upward to telomere on chrosomal short arm and 5'-terminus of this base sequence : 349273
tttatatttgtattcctactgcccagcaaagagaccttcatatagtaggtgctcaataaatgtttgtttattgtatgcatgaacagatgcattcaataataattcaaagtgtgtgtgtgtgtatgtgtgtgtgtgtgtgtgtgtgtgtgtgtgtgtgcatgtgttttgggtggcagtggtgggaaga

SEQ ID NO: 1414 - DNA, 467 bp, Homo sapiens
  chr1.fa.O7frz.184581939
  Located on chromosome 1
  Distance between a terminus base of telomere on chromosomal short arm and 5'-terminus of this base sequence : 169780214
  Distance between 3'-terminus of neighbour sequence of sequence listing upward to telomere on chrosomal short arm and 5'-terminus of this base sequence : 236470
actcactaattctcacggtctaacttaccactgatttgcgcatgctacctttactggacttgtgtgtgtgtgtgtgtgtgtgtgtgtgcgtgtgtttggaggcaattccctttgacccaaaccttctggtcaccactggctctcctccaagaaggggaacaggaacaacgtgaccaggacagtgtgccaagtgcctatttcctgccggcatgctgtccgagtgtgattcctggagtggctaactcagattccctgtaaaatgcctccccaaacagtggtaaaataaaatcaagacagttggggtattcctttatcttttttcttttttgcttcaggtgttaaacaacagcaataaccaaagagtcactctgtggatggttcaatatctagcaaacttagagaaagaaaaggatacagaaaagtgattcttagagaggaatctggccttggtatctatttcttgcctc

SEQ ID NO: 1415 - DNA, 183 bp, Homo sapiens
  D1S2844
  Located on chromosome 1
  Distance between a terminus base of telomere on chromosomal short arm and 5'-terminus of this base sequence : 169884352
  Distance between 3'-terminus of neighbour sequence of sequence listing upward to telomere on chrosomal short arm and 5'-terminus of this base sequence : 103671
aagaagtcactgagaacctgggaaaaaagtaaagagtgtgtgtgtgtgtgtgtgtgtgtgtgtgtgtgtgtgtgtgtgtgtgatgagggataagaagacaatagggaaggctgggcgcggtggctcacgcctgtaatcccagcacttctggaggcggaggggggcggcatcgcaaggtcagga

SEQ ID NO: 1416 - DNA, 189 bp, Homo sapiens
  G07850
  Located on chromosome 1
  Distance between a terminus base of telomere on chromosomal short arm and 5'-terminus of this base sequence : 169915869
  Distance between 3'-terminus of neighbour sequence of sequence listing upward to telomere on chrosomal short arm and 5'-terminus of this base sequence : 31334
ggaaggcctctgtaaggaagcacctgctgaatggaggactgaatagagtgagagattaaagcccagagatattgatgaaagatagatatttagatagatagatagatagatagatagatgatagatagatagatagacagatagatagacagatagatagataatctgggtaaagagtggtcctgtcag

SEQ ID NO: 1417 - DNA, 273 bp, Homo sapiens
  chr1.fa.O7frz.184395591
  Located on chromosome 1
  Distance between a terminus base of telomere on chromosomal short arm and 5'-terminus of this base sequence : 169990773
  Distance between 3'-terminus of neighbour sequence of sequence listing upward to telomere on chrosomal short arm and 5'-terminus of this base sequence : 74715
agtcctggttgactcctaatataaatttctccttctttcaaagtagtggaaccccaaatatttagatgggtacatggctgcccaggaagaaacaaacaaacaaacaaacaaaaacattgcccagactcctttgcagctagatgtggccatgtgaataagttcaagtcaataaattttaaacaagtttcttgtaacagcttctggaatcttccttaaatacatggtgatttttttatatacacaggtgattttaaacataccatcggatgtatt

SEQ ID NO: 1418 - DNA, 126 bp, Homo sapiens
  DISO7_10000725
  Located on chromosome 1
  Distance between a terminus base of telomere on chromosomal short arm and 5'-terminus of this base sequence : 170232286
  Distance between 3'-terminus of neighbour sequence of sequence listing upward to telomere on chrosomal short arm and 5'-terminus of this base sequence : 241240
gaacgttcccatagtaagttaggggcaggagatgtttcataaggggaatggaaaagcgcacacacacacacacacacacacacacacacacacacacacacaatgagggtggccatgaaactgaga

SEQ ID NO: 1419 - DNA, 194 bp, Homo sapiens
  D1S2768
  Located on chromosome 1
  Distance between a terminus base of telomere on chromosomal short arm and 5'-terminus of this base sequence : 170320520
  Distance between 3'-terminus of neighbour sequence of sequence listing upward to telomere on chrosomal short arm and 5'-terminus of this base sequence : 88108
aagagccattacatctctgaagtatttttttcaaatattccttatctttatatcatgtcaaaacaaataaatgtagtgggagtaagggatattagtgtgtgtgtgtgtgtgtgtgtgtgtgtgtgtgtgttttaggggctgtcaaagtggcctaccatttacttctcctggcctctatccagcagaaaatgtgt

SEQ ID NO: 1420 - DNA, 306 bp, Homo sapiens
  AL359699.1_34863
  Located on chromosome 1
  Distance between a terminus base of telomere on chromosomal short arm and 5'-terminus of this base sequence : 170471136
  Distance between 3'-terminus of neighbour sequence of sequence listing upward to telomere on chrosomal short arm and 5'-terminus of this base sequence : 150422
gatcttaggaaagatacaagcctctctaaaatggagacaatatttatctcataaattactattagttttgtcatggaagtcttcctttcagttaccagaaactgcaatacctgatgccagccacaagaggccagacagccatcaagaaaactagtactgcttgagggttttattttcctttctttccttccttccttccttccttccttccttccttccttccttccttccttccttccttccttttctttctctctctctttttttgtaaagccctgctgagtaccatggtagctattagacctg

SEQ ID NO: 1421 - DNA, 306 bp, Homo sapiens; identical to SEQ ID NO: 1420
  AC068536.4_64899
  Located on chromosome 1
  Distance between a terminus base of telomere on chromosomal short arm and 5'-terminus of this base sequence : 170471136
  Distance between 3'-terminus of neighbour sequence of sequence listing upward to telomere on chrosomal short arm and 5'-terminus of this base sequence : -306

SEQ ID NO: 1422 - DNA, 155 bp, Homo sapiens
  D1S1679
  Located on chromosome 1
  Distance between a terminus base of telomere on chromosomal short arm and 5'-terminus of this base sequence : 170471273
  Distance between 3'-terminus of neighbour sequence of sequence listing upward to telomere on chrosomal short arm and 5'-terminus of this base sequence : -169
gccatcaagaaaactagtactgcttgagggttttattttcctttctttccttccttccttccttccttccttccttccttccttccttccttccttccttccttccttttctttctctctctctttttttgtaaagccctgctgagtaccatggt

SEQ ID NO: 1423 - DNA, 404 bp, Homo sapiens
  chr1.fa.O7frz.183460889
  Located on chromosome 1
  Distance between a terminus base of telomere on chromosomal short arm and 5'-terminus of this base sequence : 170803953
  Distance between 3'-terminus of neighbour sequence of sequence listing upward to telomere on chrosomal short arm and 5'-terminus of this base sequence : 332525
tgctcatatgtttaaagtccacgtggcatccaagtatgggaaaagacgcagggagaggcaccagaggcaaacttttccaaatatgcaattttgcccaaggttgaccccatgcatgtgtgtatatgtatgaacacacactcatacacacacacacacacacacacacacacacaaagacttataagtatgagcccagtcatcacactgcctgagtttgaattttggtcaaattcaaacctctctgtcccttagcttcctcttctgtaaactagaaacaattactgtatgatgtttgagatgcctcataataatatgggatggggggaggtaggtgggcatatagatgaagcaaaattggccatcagttgattattgttgatgagttgatcattgtacatgaggtt

SEQ ID NO: 1424 - DNA, 468 bp, Homo sapiens
  chr1.fa.O7frz.183345986
  Located on chromosome 1
  Distance between a terminus base of telomere on chromosomal short arm and 5'-terminus of this base sequence : 170958832
  Distance between 3'-terminus of neighbour sequence of sequence listing upward to telomere on chrosomal short arm and 5'-terminus of this base sequence : 154475
gtactttctaaagcctaccagttttctttcatcataaatagaacagtaagttctcagtttccattcagttttgtgtgtgtgtgtgtgtgtgtgttttgttttttttgttttttgtttttttgttttgttttgttttatacagtctcattctgtcacccaggctggagtacagtagcgcaatctcagctcactgcaaactctgcctcctgggttcaagtgattcttctgcctcagcctcctgagtagctaggattacatgcacccgccaccatgcccagctaatttttgtatttttagtagagacagtgcttcgctatgttggccaggctggtctcgaactcctgacctcaggtgatccacccacttcagcctcccaaagtgctgggattacaggcgtgagtcaccatacctggcttccattcagttttaaagtgcatttttaaggtatgatgcatttgtaggaaatac

SEQ ID NO: 1425 - DNA, 336 bp, Homo sapiens
  chr1.fa.O7frz.183002021
  Located on chromosome 1
  Distance between a terminus base of telomere on chromosomal short arm and 5'-terminus of this base sequence : 171173888
  Distance between 3'-terminus of neighbour sequence of sequence listing upward to telomere on chrosomal short arm and 5'-terminus of this base sequence : 214588
tagtttgaggctagagtgaagtatgattgcaccactgcactccagcctatgtgacacagtgagaccctgtctcaaacacacacacacacacacacacacacacacacacacgcagcttccagactactgaaaatatgtaatagaggtacttttccctattcctcctgctaagtacagctaaaaaccctagatattatatataaaacagaaataagaagacttaaaaatggagaaaagagaaaagaaagcagatgagcaagggaccttggaacctggggaacaaaatggtgatgagttccgtaggttttctttttgtttcatgtatgctacatctgg

SEQ ID NO: 1426 - DNA, 261 bp, Homo sapiens
  HUMUT7954
  Located on chromosome 1
  Distance between a terminus base of telomere on chromosomal short arm and 5'-terminus of this base sequence : 171336959
  Distance between 3'-terminus of neighbour sequence of sequence listing upward to telomere on chrosomal short arm and 5'-terminus of this base sequence : 162735
agaggccgactcgtcccatcttgcgctttctctgccgcccagggtcgagagactgcccgccggggtctccaggggaaggaccggccgtggcccgcgcccgaatgcccgtgtgggcagatttgctgtggcgggccttgctgagcgcggatccccggcacagacccagagtttttgtgttttgtttttgttgtttctttctgtctttctttctttcgtgaggtgttttttttttcaccaccgtggggccagccttctcacttg

SEQ ID NO: 1427 - DNA, 468 bp, Homo sapiens
  chr1.fa.O7frz.192367177
  Located on chromosome 1
  Distance between a terminus base of telomere on chromosomal short arm and 5'-terminus of this base sequence : 171455186
  Distance between 3'-terminus of neighbour sequence of sequence listing upward to telomere on chrosomal short arm and 5'-terminus of this base sequence : 117966
gaattgacctaaaggttataccacaggaactgtttgcactatagcaggcgaaatttaaaaatccacatagaattgggttcattagaaaaaggagaaaagccagaaaccaaatcagtgtgggagagagatgaaagaaagaaagaaagaaagaaagaaagaaagaaagaaagaaagaaagaaagaaagagaagggaataaggaaggaaggaaggaaggaaagaagagagagagagaaagaaaagaaagaaggagaagaaagagagaaagaaagaaagaaaaagaaaaagaaaagagagagaaagaaagaaaatataagaaaggaagaaagagagagagaaaaagaaagaaaaggtagagaaagaaaaagaaaggaaggaagaaagaaggaaaggaaggaaggaacaagtcagagcaaaggatttcaaaactggagtctgaccaaaattattcagatcttcgagtatgttg

SEQ ID NO: 1428 - DNA, 408 bp, Homo sapiens
  chr1.fa.O7frz.192488802
  Located on chromosome 1
  Distance between a terminus base of telomere on chromosomal short arm and 5'-terminus of this base sequence : 171595982
  Distance between 3'-terminus of neighbour sequence of sequence listing upward to telomere on chrosomal short arm and 5'-terminus of this base sequence : 140328
aagtgagctagcagatacagttagtactgtactaggtaatgacagtaagtctcagcagttttagtgggctacgtagagaactcaaacaagtaaaacttttgcattgcaagaagttgttccttctcatgtgagcaattgaatctgcttctagttctcatgtttctagcactgctgttaccagttcaattttgggttctctgggctaagtcacacatatacccacatagacacacacacacacacatacacacacacacacacacacacacacacacacaaacattttatgagaaattatgccccccacccttaaatgttagattttttaaaaactctggaactttataaatagtttttcaacagttttctttggtctcttgttaagtatttgaatacctgctaaatctg

SEQ ID NO: 1429 - DNA, 424 bp, Homo sapiens
  AL031285.1_655
  Located on chromosome 1
  Distance between a terminus base of telomere on chromosomal short arm and 5'-terminus of this base sequence : 171670392
  Distance between 3'-terminus of neighbour sequence of sequence listing upward to telomere on chrosomal short arm and 5'-terminus of this base sequence : 74002
ggagcatagaacttatctcgaggccacaccaaatcattaactttttaaggagttaagccgggcgaggtggctcatgcctgtaatcccagcactttgggaggccgaggcaggcagatcacgaggtcaggagatcgagatcatcctggctaacacggtgaaaccccgtctctactaaaaatacaaaaaaattagccgggcgtggtggtgggcgcctgtagtcccagctgctggggaggctgaggctggagaatgtcgtgaacccgggaggcggagcttgcagtgagccgagatcgcgccactgcactccagcctgggcgacagagcgagactctgtctcaataaataaataaataaataaataaataaataaataaataaataaaaaataaaaaattttaaggagttgaaagccatgattaagtta

SEQ ID NO: 1430 - DNA, 186 bp, Homo sapiens
  AL031285.1_112022
  Located on chromosome 1
  Distance between a terminus base of telomere on chromosomal short arm and 5'-terminus of this base sequence : 171782032
  Distance between 3'-terminus of neighbour sequence of sequence listing upward to telomere on chrosomal short arm and 5'-terminus of this base sequence : 111216
gatgtcattaacatttgcagtactgcctcagttcattccccataaatgataaatgatataggatacacacacacacacacacacacacacacacaagaatatccaaaatgaggaaaagtgaattagttattgggtgagattcagctgaaaatcttcagggagaacttgaacattgagtataacctt

SEQ ID NO: 1431 - DNA, 121 bp, Homo sapiens
  D1S210
  Located on chromosome 1
  Distance between a terminus base of telomere on chromosomal short arm and 5'-terminus of this base sequence : 171782057
  Distance between 3'-terminus of neighbour sequence of sequence listing upward to telomere on chrosomal short arm and 5'-terminus of this base sequence : -161
cctcagttcattccccataaatgataaatgatataggatacacacacacacacacacacacacacacacaagaatatccaaaatgaggaaaagtgaattagttattgggtgagattcagct

SEQ ID NO: 1432 - DNA, 345 bp, Homo sapiens
  AC003115.1_194566
  Located on chromosome 1
  Distance between a terminus base of telomere on chromosomal short arm and 5'-terminus of this base sequence : 171813046
  Distance between 3'-terminus of neighbour sequence of sequence listing upward to telomere on chrosomal short arm and 5'-terminus of this base sequence : 30868
ctgagtcaggagaattacttgaacccaggaggcggaggttgcagtgagccaagattgtgccactgcactccagcctgggtgacagagtgagactctgtctcataataacaataataataataataataataataataataataataataggggacaccccacttttggcaatggacagataattcaggcagaaaatcaacaaataaatatgagaattaaactgcactttagatcaaatgggcatcatagacatttacagaacattttatccaactgctgcagaacacacattcttctcatcagcacatgaaacagtctccaagataaaccacatgttaggccata

SEQ ID NO: 1433 - DNA, 402 bp, Homo sapiens
  AL031965.7_36339
  Located on chromosome 1
  Distance between a terminus base of telomere on chromosomal short arm and 5'-terminus of this base sequence : 171832520
  Distance between 3'-terminus of neighbour sequence of sequence listing upward to telomere on chrosomal short arm and 5'-terminus of this base sequence : 19129
cttctgcaatttgagtctagttacgggtctagaagcaaagaagagtggtggggttgagtccctaagaagactcagcattatcttgcttggcaactgcctcaggggaggcaattacagtttcctccggcaatgtagagtagacacacacacacacacacacacacacacacacacacacacaccctcagagaataccgataattttatcaagagtaaaattttagatttgtcctaaaatttctttatgtatgtcttcaatcctgtgaaaatttttaagaaacttttgctaaagcaaagtctttgatagggtaggccagtaacatacatttactaaaatatgggatattcaaaaacagcaaggaaagcactccagttatggagtaacagctgaattgtatggaa

SEQ ID NO: 1434 - DNA, 381 bp, Homo sapiens
  AC003115.1_163677
  Located on chromosome 1
  Distance between a terminus base of telomere on chromosomal short arm and 5'-terminus of this base sequence : 171843996
  Distance between 3'-terminus of neighbour sequence of sequence listing upward to telomere on chrosomal short arm and 5'-terminus of this base sequence : 11074
aaagccatgcaatgtagattagggaaagaaaagaaaagaaaagaaaagaaaagaaagagaaagaaaggatggagagagggaggggagggaggagagggagagagagagagagatgaaagaaagaaaaagaaaggaaggaaggaagaaagagaaagaaagagagagagagagagagaaagaaagaaagaaaaaaagagagagaaagaaagaaacaccgtgaaaagagtcatcaccaattattatttcagccatttctctaggtcacaagtcattttctcttaaaaaaaaattgaatgcataacttacattgttttgtgatatccgttatgactgatgaaaacatgatggtggtctgattctctagtctttgtcacctggatt

SEQ ID NO: 1435 - DNA, 387 bp, Homo sapiens
  chr1.fa.O7frz.195722527
  Located on chromosome 1
  Distance between a terminus base of telomere on chromosomal short arm and 5'-terminus of this base sequence : 171977737
  Distance between 3'-terminus of neighbour sequence of sequence listing upward to telomere on chrosomal short arm and 5'-terminus of this base sequence : 133360
atactatttctgtcacttgcgatgagtgcccttcaactagcctcatttccttgtgtcccttgttcaagattcaagatcgcaggatagatcccctgatgggctgagcttaaataatgtgcctgcccccaggcttgtgctgagagagagaaaagaagaatcctgcttcttagtcttccggtgtgggaagttagctatatcttttattagaattctctgaaactgagataggagtgctttaaagaaggtgtgtgtgtgtgtgtgtgtgtgtgtgtgtgtgtgtgttggaagggtggggagttggatgtcagacactgaagaattataagtttccactgtaattcttctgtaaaatgaaagagttgaactaaaccatctcaaatacaagac

SEQ ID NO: 1436 - DNA, 335 bp, Homo sapiens
  chr1.fa.O7frz.195649051
  Located on chromosome 1
  Distance between a terminus base of telomere on chromosomal short arm and 5'-terminus of this base sequence : 172030689
  Distance between 3'-terminus of neighbour sequence of sequence listing upward to telomere on chrosomal short arm and 5'-terminus of this base sequence : 52565
atcttaatgtattctgatttgcatttcccaaattacgaacaattctgagcatcttttcatgcttactggccatttctgtattttctctggagaaatatctatttgaattgcttgcccatttttatttttttcttttcctggtcattaaagggaagaaacttttccttccttccttccttccttccttccttccttccttccttctttccttccttccttctttccttctttccttctttccttcctccctctctctctttcttttctttctttcattttaagacaggctctcactctgttgcccaggctgcagtgcagtggcacagttacagctc

SEQ ID NO: 1437 - DNA, 230 bp, Homo sapiens
  chr1.fa.O7frz.195543468
  Located on chromosome 1
  Distance between a terminus base of telomere on chromosomal short arm and 5'-terminus of this base sequence : 172135624
  Distance between 3'-terminus of neighbour sequence of sequence listing upward to telomere on chrosomal short arm and 5'-terminus of this base sequence : 104600
ataaggtcacattccaggatactgggagttaggacttcagcataagaattgggtgggaggtggtgtgtgtgtgtgtgtgtgtgtgcacaattcaacccataataactccctcccagttctaaagtctatgactctgagccttgaagtatagctcagactctagcttgctttgttttggctttgtgttattcctattcacctgtcaagtggaacataagcttacttgtaag

SEQ ID NO: 1438 - DNA, 177 bp, Homo sapiens
  chr1.fa.O7frz.195460853
  Located on chromosome 1
  Distance between a terminus base of telomere on chromosomal short arm and 5'-terminus of this base sequence : 172202833
  Distance between 3'-terminus of neighbour sequence of sequence listing upward to telomere on chrosomal short arm and 5'-terminus of this base sequence : 66979
gtcagcaatattaggtgtaaacagccaacctcattatagtcaccagttttcccaaaattttctctctctctctctccatatatatatatatatatatatatatatatatatatatatattatatacacagtcaccacatttttttgatgcttataagtggttgactaggagtatcca

SEQ ID NO: 1439 - DNA, 262 bp, Homo sapiens
  AL021026.1_138196
  Located on chromosome 1
  Distance between a terminus base of telomere on chromosomal short arm and 5'-terminus of this base sequence : 172483588
  Distance between 3'-terminus of neighbour sequence of sequence listing upward to telomere on chrosomal short arm and 5'-terminus of this base sequence : 280578
gttgcttgttacaagaatgtagtctcaaggtaggtttatatatatatatatatatatatatatatatatatatatatatataggtttatatacatatataatgtatatatataaaacatacatataacatatattatgctttatttatatatattaggttatagtttgcttcatttagagacagcattaggccaaagtttaatttaacaattcccctcttttatcagcctttgaattttgagaaattgaccataacctaggt

SEQ ID NO: 1440 - DNA, 301 bp, Homo sapiens
  AC024490.3_27544
  Located on chromosome 1
  Distance between a terminus base of telomere on chromosomal short arm and 5'-terminus of this base sequence : 172803550
  Distance between 3'-terminus of neighbour sequence of sequence listing upward to telomere on chrosomal short arm and 5'-terminus of this base sequence : 319700
aaggagtacctaatggtacaggacaaaagaactccaaagattctactgggaaaaaaagagaagaccccaaaccaggccctaaaaaaccaaaagagaaagtggatgctctatcacagtttgatctcaacaattatgcaagtatgtcttaggtttctttcattttatttatttatttatttatttatttatttatttatttgctacattttaaaatgtagatgccacaattaaagaagttttccaagaaggaaagatttggacattcaaggtatacatagtggctgattatgaaacactaact

SEQ ID NO: 1441 - DNA, 186 bp, Homo sapiens
  Z97171.1_121
  Located on chromosome 1
  Distance between a terminus base of telomere on chromosomal short arm and 5'-terminus of this base sequence : 172910813
  Distance between 3'-terminus of neighbour sequence of sequence listing upward to telomere on chrosomal short arm and 5'-terminus of this base sequence : 106962
gattcttagaaaataaccttccagaagtctgtttggagtttctttttaaaaagaacatcccaatttatgcacccataccccaataatagttcctatatctccacctggttttacacacacacacacacacacacacacgtacacacacttacaccaggactactggtgtgctgatttcaacaagga

SEQ ID NO: 1442 - DNA, 296 bp, Homo sapiens
  AF049791.1_1565
  Located on chromosome 1
  Distance between a terminus base of telomere on chromosomal short arm and 5'-terminus of this base sequence : 172910813
  Distance between 3'-terminus of neighbour sequence of sequence listing upward to telomere on chrosomal short arm and 5'-terminus of this base sequence : -186
gattcttagaaaataaccttccagaagtctgtttggagtttctttttaaaaagaacatcccaatttatgcacccataccccaataatagttcctatatctccacctggttttacacacacacacacacacacacacacgtacacacacttacaccaggactactggtgtgctgatttcaacaaggatatatttctagtttatatttccattcactctgcaaactcattgagaacctgcactgtgccaggcactatgctaggaactggagatccaaacaagtcctttaagacgtagc

SEQ ID NO: 1443 - DNA, 296 bp, Homo sapiens; identical to SEQ ID NO: 1442
  Z98750.1_63386
  Located on chromosome 1
  Distance between a terminus base of telomere on chromosomal short arm and 5'-terminus of this base sequence : 172910813
  Distance between 3'-terminus of neighbour sequence of sequence listing upward to telomere on chrosomal short arm and 5'-terminus of this base sequence : -296

SEQ ID NO: 1444 - DNA, 300 bp, Homo sapiens
  Z98751.1_34582
  Located on chromosome 1
  Distance between a terminus base of telomere on chromosomal short arm and 5'-terminus of this base sequence : 172961356
  Distance between 3'-terminus of neighbour sequence of sequence listing upward to telomere on chrosomal short arm and 5'-terminus of this base sequence : 50247
catttggttaccgactgactgattatcatatgtgtgcgtgtgtgtgtgtgtgtgtgtgtgtgtttgtgtgtatatatatatatatatatatatatatatatatatatatatatacacataggttcctgactttctactactcattactgttggctgatgcaaaatttgattgtgcaacatacatctcctcaaggatgaacaggaaatgcaaagatataaaattcaaagtattaatagatggttttgctactttttgtacttttggtaaatgagatagttggaagttagaggctattaact

SEQ ID NO: 1445 - DNA, 305 bp, Homo sapiens
  Z98751.1_67838
  Located on chromosome 1
  Distance between a terminus base of telomere on chromosomal short arm and 5'-terminus of this base sequence : 172994569
  Distance between 3'-terminus of neighbour sequence of sequence listing upward to telomere on chrosomal short arm and 5'-terminus of this base sequence : 32913
aatcattggtgactccttaaagtttattagtaaaagcttgctagcaattaatctattggtggattctatttccccattaaaaaacaaaacaaaacaaaacaaaacaaaacaaaacaaaacaaaacaggccgagtgcagtgtcaaatgtctgtaatcccagcactttgggaggccaaggcaggtggattacttgagctcaggaatttgagaccagcctgggcaacacggcaaaaccccatctttacgagaaaaacaaaaactagctgggcatgatatcatgcacctgtagtctttgctactcagga

SEQ ID NO: 1446 - DNA, 222 bp, Homo sapiens
  D1S2815
  Located on chromosome 1
  Distance between a terminus base of telomere on chromosomal short arm and 5'-terminus of this base sequence : 173003791
  Distance between 3'-terminus of neighbour sequence of sequence listing upward to telomere on chrosomal short arm and 5'-terminus of this base sequence : 8917
ctgacatggaatacctctatgatgctataaggtgagaaaagtaaggtgcaaaatagtgtgtagactctacttccatttgagcatcacacacacacacacacacacacacacacacacaccaggaggactgtgaatctggcatggaaagtgttatggactgaattatgtcccctcaaaattcatatgttgaagtcttaacttccagtgtgactagatttggag

SEQ ID NO: 1447 - DNA, 184 bp, Homo sapiens
  D1S1619
  Located on chromosome 1
  Distance between a terminus base of telomere on chromosomal short arm and 5'-terminus of this base sequence : 173026165
  Distance between 3'-terminus of neighbour sequence of sequence listing upward to telomere on chrosomal short arm and 5'-terminus of this base sequence : 22152
cgcaaacatgtgaaaagaaagaaaaaagaaataataataataataataataataataacaataataaggcagttttccttctggctctgggtttgttgttattttgtgtaagaccaatccctccccacttttaaagggaattatttaaccaaaaaactccctagcatcttttctgtgactctga

SEQ ID NO: 1448 - DNA, 242 bp, Homo sapiens
  AL031864.1_20529
  Located on chromosome 1
  Distance between a terminus base of telomere on chromosomal short arm and 5'-terminus of this base sequence : 173057236
  Distance between 3'-terminus of neighbour sequence of sequence listing upward to telomere on chrosomal short arm and 5'-terminus of this base sequence : 30887
gtcttagcatagctaggtctttaagagaagccagaaatctcgtgcgtgtgtgcgtgtgtgtgtgtgtgtgtgtgtgtgtgtgttgacattaaaatgttggccaatcagtatacattttcaagttataatctattttgcatagagagattataggggagatagcctatggaattcctgagaatctggcatgcacccagcttctgagtacaaaacaaggagcaagctgatagcaatgagttaca

SEQ ID NO: 1449 - DNA, 416 bp, Homo sapiens
  AL031864.1_32818
  Located on chromosome 1
  Distance between a terminus base of telomere on chromosomal short arm and 5'-terminus of this base sequence : 173069414
  Distance between 3'-terminus of neighbour sequence of sequence listing upward to telomere on chrosomal short arm and 5'-terminus of this base sequence : 11936
cacttgaaccttgtgaacttacatctccacttagtttgtctcctccatttactttggagtaaaaactacttatgcatatgagcacaccagaggatgcagtgattgtgctcttggaagagaaagagtgggaagggccgtaatcccagagagaaacttgtttgaaaacacacacacacacacacacacacacacacgtgcacatgcatgtgcatcattttccttgattccctgtgttgtagtggaaaatttaccaagcagtgatggaaactcagattggcagagaccaggaaaagagtggtgaattttggtttggggtcttccctccaggaaccccatttcttctcagtggtgtgtgggtccagatcacaagctgttctctaaagcacattcacttcttcctgatcagagcttatttc

SEQ ID NO: 1450 - DNA, 427 bp, Homo sapiens
  AL031864.1_38389
  Located on chromosome 1
  Distance between a terminus base of telomere on chromosomal short arm and 5'-terminus of this base sequence : 173074880
  Distance between 3'-terminus of neighbour sequence of sequence listing upward to telomere on chrosomal short arm and 5'-terminus of this base sequence : 5050
cctagtatgtgctcaataaatgagtgctaaacttaattacaaaaattaacatggcatattttgccttctcttgagaatttttgtctgaagttgaagaactctgtattttgaaaattaaatctatacagaagtaggaaaatggtaaaaattatggaatcgagggatagatagacctggattcaaattcatattcttttttcatcattaactgtaactgcatggccatagctaaaccacttaactcatctgagcctgtcctcatttgtaaaacacacacacacacacacacacacacacacacagtctcccatggttattaaaataattaaatgggataacctaagtaaaggccttagtacatgctgaacacttggtacttgcttattgttatttcattgaacatgttatgctcaacaagttatctagc

SEQ ID NO: 1451 - DNA, 348 bp, Homo sapiens
  AL137157.7_19937
  Located on chromosome 1
  Distance between a terminus base of telomere on chromosomal short arm and 5'-terminus of this base sequence : 173403149
  Distance between 3'-terminus of neighbour sequence of sequence listing upward to telomere on chrosomal short arm and 5'-terminus of this base sequence : 327842
aggctagagaagtaatttgaagatagagggtagatgaaatagtaaacagaaagttgaacactggaaggcagagctcatttggaaacctttttgagctttcctgtggcactttattttctggtatttcactcgtcaaaaagggcagataagtttctgtctgtctgtctgtctgtctgtctctctctctctctctctctccccctcttcccctctccctccctctctctccctccctccctccttccctcccgctctctctctctttctctccttctctctctccctccttctcctgtctgttgaatctgtcagcagcttgcaggctgctctagacttgaacagtaatta

SEQ ID NO: 1452 - DNA, 308 bp, Homo sapiens
  AL137157.7_55988
  Located on chromosome 1
  Distance between a terminus base of telomere on chromosomal short arm and 5'-terminus of this base sequence : 173439220
  Distance between 3'-terminus of neighbour sequence of sequence listing upward to telomere on chrosomal short arm and 5'-terminus of this base sequence : 35723
ttaattgttagtacatttccaagacaagaaatgcaatctgttgacacgcccttcaaaataatcagatgaaaacaaggaacacaaatatgtccagccctgaactcttcatttttcctcttgatgaatcctttcttatgctttaaaacacttgagtttacacacacacacacacacacacacacacacacacacacatatttctggtaggcgtggagatatatatctatatatatcttgctattagggcaattccctgaaagattacactaccttctttatgcataacgtcaatgcctgatattaaacag

SEQ ID NO: 1453 - DNA, 321 bp, Homo sapiens
  AL137157.7_101884
  Located on chromosome 1
  Distance between a terminus base of telomere on chromosomal short arm and 5'-terminus of this base sequence : 173485112
  Distance between 3'-terminus of neighbour sequence of sequence listing upward to telomere on chrosomal short arm and 5'-terminus of this base sequence : 45584
gcatactcataacttagctctcacttacaagtgagaatatgcagcacttggtttttcattcctgagttagttcacttagaataatcaccccccagttacatccaagttgctgcaaataacatttcattctttttttttaatggctggatagtattttgtgatatatatatatatatatatatatatatatatatcacattttctttatccactcgtcagatgatggccacttaggctggttctatatctttgcggttgtgaattatgctatgataaacatacacatgcaagtgtctttttgatacagtaacttctcctttg

SEQ ID NO: 1454 - DNA, 374 bp, Homo sapiens
  AL133514.7_10853
  Located on chromosome 1
  Distance between a terminus base of telomere on chromosomal short arm and 5'-terminus of this base sequence : 173545663
  Distance between 3'-terminus of neighbour sequence of sequence listing upward to telomere on chrosomal short arm and 5'-terminus of this base sequence : 60230
caatgaatcatggtactttgagacaacaggcaacggtcaacctccaatttgaatggttgttgcattgatctttgaggatgctatagaaagataaggaaaaaagtatttataatatatataaaatatatatatatatacacatgcacacacacacacacacacacacacatatattttttgagacaagatcttgctctgttgccaggctgtggtacagtggcactatcacagcttatttgcagcctctaactcctgggctcaagccatcctcctgcctcagcctcccaaagtgataggattacatgagccactgtgtctgaccaaggaaaagtattttaaataaatgagggatactaagctaattcaaccattgg

SEQ ID NO: 1455 - DNA, 275 bp, Homo sapiens
  AL133514.7_15649
  Located on chromosome 1
  Distance between a terminus base of telomere on chromosomal short arm and 5'-terminus of this base sequence : 173550485
  Distance between 3'-terminus of neighbour sequence of sequence listing upward to telomere on chrosomal short arm and 5'-terminus of this base sequence : 4448
taaaatagaacaaatgcataggagagctaaaaggatgttgcattaattagaaacctattcatatgggaaacacttgaaaatattggctgaagggttggcttagagaatagaagacttcacacacacacacacacacacacgcgcgtgcgtatattccttacacgcaactattaagttggtgcaaaagtattgcggtttttgcaaaaactgccattacttttgcattaacctaatatgtggtttgtgaaaatgtttatcaagtcatggtttcataa

SEQ ID NO: 1456 - DNA, 372 bp, Homo sapiens
  AL133514.7_36815
  Located on chromosome 1
  Distance between a terminus base of telomere on chromosomal short arm and 5'-terminus of this base sequence : 173571716
  Distance between 3'-terminus of neighbour sequence of sequence listing upward to telomere on chrosomal short arm and 5'-terminus of this base sequence : 20956
cacaactagttcagtaccttcaactgggtgaatgtgttcaatgtctcatagcatttatttatttatttatttatttatttacttacttatttttattatactttaagttctaggatacatgtgcagaatgtgcaggtttgttacataggtatacgtgtgccatggtggtttgctgcacccatcaaccagtcatctacattacatatttctcctaatgctatccctcccctagccccctaccccccgacaggccccagtgtgtgatgttcccctccctgtttacactgttggtgggagtgtaaattagttcaaccattgtggaatgtagtgtggcaactcctcaaggatctagaaccagaaatactgtttgac

SEQ ID NO: 1457 - DNA, 286 bp, Homo sapiens
  chr1.fa.O7frz.194503122
  Located on chromosome 1
  Distance between a terminus base of telomere on chromosomal short arm and 5'-terminus of this base sequence : 173695677
  Distance between 3'-terminus of neighbour sequence of sequence listing upward to telomere on chrosomal short arm and 5'-terminus of this base sequence : 123589
tacctatgtaacaaacctgcacattgtgcacatgtaccctagaacttaaagtataataataataataataataataataataaacaaaacgatttatttctactagaaaaaaaaatattgacaaaggtagctacactcaacaatagatattcaatgtagataaaaaagccttctattggaaggtgccatctaggattttcatagctaaagaggagaagtcaatgtctggcttcaaaggacaggctgactctcttgttaggggctaatgtagttggtgacttgacat

SEQ ID NO: 1458 - DNA, 367 bp, Homo sapiens
  AC003117.1_103946
  Located on chromosome 1
  Distance between a terminus base of telomere on chromosomal short arm and 5'-terminus of this base sequence : 173782795
  Distance between 3'-terminus of neighbour sequence of sequence listing upward to telomere on chrosomal short arm and 5'-terminus of this base sequence : 86832
ggacagtcatctagccatgtagagttggggagggtatctgatagttcttaacttgcaatcacttcctaccaccacaagcaccaaacacacatacctttatttattattatattattattattattattattattattattattattgagacagggtcttgctctgttgcccaggctggagtgcagtggtgtgatctcagctcattgcaacctccacctcctgggctccagcgattgtcgtgcctcagcccctggagtagctgggtctacaggtgtgtgccactacgcctggctaatttttatattgttagtagagacggggttttgccatgttggccaggctggtctcgaactcttgaactcaagtg

SEQ ID NO: 1459 - DNA, 422 bp, Homo sapiens
  Z96050.1_61554
  Located on chromosome 1
  Distance between a terminus base of telomere on chromosomal short arm and 5'-terminus of this base sequence : 173901661
  Distance between 3'-terminus of neighbour sequence of sequence listing upward to telomere on chrosomal short arm and 5'-terminus of this base sequence : 118499
cacagttactaggtccttatctgtgtctttattctctgtcacgtgattctctccagcctcctcctttgccctgagtctggtgctgggtaacctgagcacagggagaaggagcaggaatctgcggggggtcacacatgcatgcgcacacacacacacacacacacacacacacacacacttgacacaggagccagagaagtgcttgctatgcagaaataagggaggtacagagctgtaagggaaggttaatccagaggtaaaggaaaccctggcacctttgctcccttgctgaaattcccacccttacagtatgggcatcaaagagagcccagggctgagccagggctctctttctttgtggttaagtcactttgatgtgtgagagcctggatggggcaaggtaaagtgcattgtaggattga

SEQ ID NO: 1460 - DNA, 364 bp, Homo sapiens
  Z96050.1_84367
  Located on chromosome 1
  Distance between a terminus base of telomere on chromosomal short arm and 5'-terminus of this base sequence : 173924387
  Distance between 3'-terminus of neighbour sequence of sequence listing upward to telomere on chrosomal short arm and 5'-terminus of this base sequence : 22304
ctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatag

SEQ ID NO: 1461 - DNA, 422 bp, Homo sapiens
  Z98043.1_71213
  Located on chromosome 1
  Distance between a terminus base of telomere on chromosomal short arm and 5'-terminus of this base sequence : 173996913
  Distance between 3'-terminus of neighbour sequence of sequence listing upward to telomere on chrosomal short arm and 5'-terminus of this base sequence : 72162
ctgactttagcatcaggatagtactagcctcataaaaatccctttgtaagttttccctcctcttcgatttttttgggagagtgagaatgattggtattcattcctctttcaatgcttaatagaattcaccagtgaggccatctattattgggctttaatttgatgggagatttttgattcctgatttaatcttattactcattattggtatgttcagattttctatttctttttgtttcagacttgataagttttatgtatatatatatatatatatatatatatatatatatatatatatatatacacatacatatttaggatttatccatttcttatagactgttcagttttttggtgtataattgtttcttgtagtctcttacaatcctttgtatttctgtggtatttgtcataacgtc

SEQ ID NO: 1462 - DNA, 278 bp, Homo sapiens
  Z97198.1_54908
  Located on chromosome 1
  Distance between a terminus base of telomere on chromosomal short arm and 5'-terminus of this base sequence : 174076517
  Distance between 3'-terminus of neighbour sequence of sequence listing upward to telomere on chrosomal short arm and 5'-terminus of this base sequence : 79182
gacctgaaaatcaagctagaagagccctaatcattcatctgtcatcagcacataaacatcccttttctactggtactcagacaaggcaggcttgcttgaatgcactacttgctctgaagttcttcatttataaaataatagaccaggaatggcggaaggggtgtgtgtgtgtgtgtgtgtgtgtgtgtgtgtgtgtgtgtgtgttcatatgtgtgtataatgtacatctcttctttgaccccctttggtttccagtgtttgcatcattaactaagctg

SEQ ID NO: 1463 - DNA, 304 bp, Homo sapiens
  Z97198.1_75506
  Located on chromosome 1
  Distance between a terminus base of telomere on chromosomal short arm and 5'-terminus of this base sequence : 174097098
  Distance between 3'-terminus of neighbour sequence of sequence listing upward to telomere on chrosomal short arm and 5'-terminus of this base sequence : 20303
ggaagcctagaactcatctagtacaatccttagttttacaggcaaagagacacaggaaggtgacgtgacttcttcagggtcccacagccattcatagagaacagcaccttgatctcttgaagctaaatttcatgtttcttacagggggttatttagaatagatcagataatagttccatatatatatatatatatatatatatatatggtggatgtttttaattttcaaataattttcacatgtagagtaagaaactgggttgttattcttaatttttccttctacaatggtgagcactattgt

SEQ ID NO: 1464 - DNA, 381 bp, Homo sapiens
  chr1.fa.O7frz.194996920
  Located on chromosome 1
  Distance between a terminus base of telomere on chromosomal short arm and 5'-terminus of this base sequence : 174189260
  Distance between 3'-terminus of neighbour sequence of sequence listing upward to telomere on chrosomal short arm and 5'-terminus of this base sequence : 91858
taattcacgtttatcttcctagagtcttataaataattgatttattttaaaaaataactttatataagactattcttcaaactattctgtaacacatgtgcatttgttcacatatttattcagaaaatatttattatcctattatacctgggagtacaggtgtgagaaagacagaaaaggtctctgctttcatggagcttagattccaagtgaggggagacagacaaaaaaagtactaaacaaacaacagaccgaaaggtgaattattagatagatagatagatagatagatagatagatagataattttatttagctggttataactgtaaaaaggagctttatttaactataaaagggagcatgatagcaatcatacag

SEQ ID NO: 1465 - DNA, 268 bp, Homo sapiens
  AL031599.1_49457
  Located on chromosome 1
  Distance between a terminus base of telomere on chromosomal short arm and 5'-terminus of this base sequence : 174286682
  Distance between 3'-terminus of neighbour sequence of sequence listing upward to telomere on chrosomal short arm and 5'-terminus of this base sequence : 97041
tagctagtggtctatcaatctgatttatcttttcgaataagcaacttttggttttgttgatcttttgtatggttttgtttatcttttgtatggttttgttttgtaaatatatatatatacatatattttgtgtgtgtgtgtgtatatatatatatatatatatatatatatatatatatatagtcttactggtaactctaaccaagacccaggatcctgttatttttttcattcacttcaatatttgttgaatgtcttcaatattcca

SEQ ID NO: 1466 - DNA, 249 bp, Homo sapiens
  D1S2790
  Located on chromosome 1
  Distance between a terminus base of telomere on chromosomal short arm and 5'-terminus of this base sequence : 174312968
  Distance between 3'-terminus of neighbour sequence of sequence listing upward to telomere on chrosomal short arm and 5'-terminus of this base sequence : 26018
tggctatgttttactagctcaagtacaacttcaagtaaaaagtctaatggccaatttccattgaagcctttctgtgctagccacctgccttacaactaatcatttagaatggctctgtgatgttataggtccctatctctctagcctgagccctctatgtcagtggcatgttgttttgtgtgtgtgtgtgtgtgtgtgtgtgtgtgtgtgtgtgtgtgtgtatgccctttctggactaatgagcatttt

SEQ ID NO: 1467 - DNA, 413 bp, Homo sapiens
  AL031599.1_23132
  Located on chromosome 1
  Distance between a terminus base of telomere on chromosomal short arm and 5'-terminus of this base sequence : 174312978
  Distance between 3'-terminus of neighbour sequence of sequence listing upward to telomere on chrosomal short arm and 5'-terminus of this base sequence : -239
ttactagctcaagtacaacttcaagtaaaaagtctaatggccaatttccattgaagcctttctgtgctagccacctgccttacaactaatcatttagaatggctctgtgatgttataggtccctatctctctagcctgagccctctatgtcagtggcatgttgttttgtgtgtgtgtgtgtgtgtgtgtgtgtgtgtgtgtgtgtgtgtgtatgccctttctggactaatgagcattttgtattttggccataggaggagtatcttaaataccttttgatgggaagaatgacttgctgcttaggatctcaatgaaaacattggccattgtgcaatatggcataatacttcctatttgaaaccatcaaacatcaccctagaatctgtaatgaatgagcattgctgttaaattac

SEQ ID NO: 1468 - DNA, 281 bp, Homo sapiens
  AL031599.1_16391
  Located on chromosome 1
  Distance between a terminus base of telomere on chromosomal short arm and 5'-terminus of this base sequence : 174319719
  Distance between 3'-terminus of neighbour sequence of sequence listing upward to telomere on chrosomal short arm and 5'-terminus of this base sequence : 6328
gtatttatccgtatgacagcactggtattaccacaatataatcatctgcataccatcttctctatttgggtgtaggcctctaaaggcaaggagttgttaaaatctcctaacacctgaaacccacctaaggcctggatcatagaggaggcacaataaacattgaatgagtggatggatggatggatggatggatggatggatggatggatggttggatggttttactaacattatatcaccacggagcagcgatcagactagattcagctttcaagacttaa

SEQ ID NO: 1469 - DNA, 379 bp, Homo sapiens
  AL049596.15_43348
  Located on chromosome 1
  Distance between a terminus base of telomere on chromosomal short arm and 5'-terminus of this base sequence : 174379364
  Distance between 3'-terminus of neighbour sequence of sequence listing upward to telomere on chrosomal short arm and 5'-terminus of this base sequence : 59364
atcctagctaacaggatgaaaccccgtctctactaaaaacacaaaaaaaaattagccgggcatggttgcgggcgcctgtactcccagctactcgggaggctgaggcgggacaagggcgtgaacacgggaggcggagcttgcagtgagcagaggtggcgccactacactccagcctggtcaacagagcgagactccgtctcaaaaaataaataaataaataaataaataaataaataaataaataaatagtgctgaagatgaaagaaaaattttccgtctgtcatccataaaaaaacaaattttgatcagccatgctaggttaaatattgaattatctttctattttctatggagaatattacaatgtattgccatagga

SEQ ID NO: 1470 - DNA, 264 bp, Homo sapiens
  AL022310.1_14450
  Located on chromosome 1
  Distance between a terminus base of telomere on chromosomal short arm and 5'-terminus of this base sequence : 174407236
  Distance between 3'-terminus of neighbour sequence of sequence listing upward to telomere on chrosomal short arm and 5'-terminus of this base sequence : 27493
ttaaatactgtagccattcatgtacgtaccattcatttacacttgtaacatcttgcactatattgttatttgtgatattatgtgtaaaggcagctaaaatagagtgaagaaaactccatcagggttatttctcacaggcatttatatatatatataaatatatatataatatatctgtgtgtatgtgtatatatatatatatatatatatacacacacatatatatatgcacctctcatgcttgctacttgataaatgttcact

SEQ ID NO: 1471 - DNA, 134 bp, Homo sapiens
  DISD22_0000837
  Located on chromosome 1
  Distance between a terminus base of telomere on chromosomal short arm and 5'-terminus of this base sequence : 174532091
  Distance between 3'-terminus of neighbour sequence of sequence listing upward to telomere on chrosomal short arm and 5'-terminus of this base sequence : 124591
aacaggttggtgtccctgcttctccatgttcatacacacacacacacacacacacacacacactctgtatatacatatagtttctgtatttttcttttcaaaatagaatcatattgttaaacacatattgctca

SEQ ID NO: 1472 - DNA, 205 bp, Homo sapiens
  AL109921.21_103777
  Located on chromosome 1
  Distance between a terminus base of telomere on chromosomal short arm and 5'-terminus of this base sequence : 174718627
  Distance between 3'-terminus of neighbour sequence of sequence listing upward to telomere on chrosomal short arm and 5'-terminus of this base sequence : 186402
ccaaggaatactgttaagtgaagaaccctgtattcttgagtatacaaaagagcagctgttaaactccagcactctaagtgctgtcatctgtataaaaactgggggaaggatgcagaatatacattcagtgtgtgtgtgtgtgtgtgtgtgtgtatttgcttgtatatatgttaggaaatgtctctggaaggatacctaagtatct

SEQ ID NO: 1473 - DNA, 337 bp, Homo sapiens
  chr1.fa.O7frz.196094961
  Located on chromosome 1
  Distance between a terminus base of telomere on chromosomal short arm and 5'-terminus of this base sequence : 174882040
  Distance between 3'-terminus of neighbour sequence of sequence listing upward to telomere on chrosomal short arm and 5'-terminus of this base sequence : 163208
ctgacaagattaaatggatgttactgtactatgactaaaaagcactggactaccacaataaatctaacatgctgaaataaaggatttacagtaccaaacagaattatacctatttaaatagaaggcaatgttacccaattttaattcaacaggtttctctcaggagaaaaacacgcacaacacacacacacacacacacacacacacacagagagagagagagagagagggagaaatttaaaagtattaagtcacccatcctacctgagcacccacgagctgcagcaatgctgagttcacagggaggagctcaatgtctgtattgatagtggtctgg

SEQ ID NO: 1474 - DNA, 268 bp, Homo sapiens
  D1S2814
  Located on chromosome 1
  Distance between a terminus base of telomere on chromosomal short arm and 5'-terminus of this base sequence : 174892879
  Distance between 3'-terminus of neighbour sequence of sequence listing upward to telomere on chrosomal short arm and 5'-terminus of this base sequence : 10502
tgagccgagattgagccactgcactccagcctgggcaacaagagcaagactcctatcacacacacacacacacacacacacacacacacacgtacggggaatcatccttgactactctcttttctcacacccctacccatcaactcatcaatcgccatgtacatattatttctttaatgtttcttaaaaccttcttatccattcccaataccaacatctctgacctggatcactgtgacaatttcttaactggtatccctggtaacaa

SEQ ID NO: 1475 - DNA, 346 bp, Homo sapiens
  chr1.fa.O7frz.196210650
  Located on chromosome 1
  Distance between a terminus base of telomere on chromosomal short arm and 5'-terminus of this base sequence : 174997845
  Distance between 3'-terminus of neighbour sequence of sequence listing upward to telomere on chrosomal short arm and 5'-terminus of this base sequence : 104698
cacctagattcactcattgttaacattttgtcacatttgctttatttctctttcagttgcactacacacacacacacacacacacactttttttgctgacttcatttgaaagtaagttttagacatggtgacccttcacttccaaataatttagcatgcattagctatgatatataacatacataaccacaatgcaaatatcattcaggataattaacaattatatatatatacatgcacatacatatttacacacacacagcctgtattcaaatttcctcagttgttccaataatgtattttatagctgttttttaaaaattaataaaggactcaatcaggaatt

SEQ ID NO: 1476 - DNA, 276 bp, Homo sapiens
  AL031286.1_63551
  Located on chromosome 1
  Distance between a terminus base of telomere on chromosomal short arm and 5'-terminus of this base sequence : 175068911
  Distance between 3'-terminus of neighbour sequence of sequence listing upward to telomere on chrosomal short arm and 5'-terminus of this base sequence : 70720
taatttaacttgccactcaaacaattgcacaagtgcattttcttctgaaaactattatactttggtgtgcagcagaaatactttgtgtatttcctactttgtcacatagaatgttaaaaagatgtgtgctcaaaaggttggagataatttttactgtttcattaaagacagtcttagcacgtgcacacacacacacacacacacacacacacacacacacactttttaactgagcatatatggttgtacagtgactaccagtatactttggtgctg

SEQ ID NO: 1477 - DNA, 204 bp, Homo sapiens
  D1S1589
  Located on chromosome 1
  Distance between a terminus base of telomere on chromosomal short arm and 5'-terminus of this base sequence : 175181513
  Distance between 3'-terminus of neighbour sequence of sequence listing upward to telomere on chrosomal short arm and 5'-terminus of this base sequence : 112326
ctgctttgggtttcacttgtgtttctttttctggcttcatgtgaagattagatcatttattattattattattattattattattattattattgacagggtcttgctctgtcacccaggctggagtgcagtggcacgaccatagttcactgtagtgttgaactcctgggctcaagcgagtctcccatctctgcctcctgagta

SEQ ID NO: 1478 - DNA, 349 bp, Homo sapiens
  AL021069.1_84473
  Located on chromosome 1
  Distance between a terminus base of telomere on chromosomal short arm and 5'-terminus of this base sequence : 175405515
  Distance between 3'-terminus of neighbour sequence of sequence listing upward to telomere on chrosomal short arm and 5'-terminus of this base sequence : 223798
ataggagccaagcttctaatagaagtgtgtaaaaaacagtaataatgatagttcctggaaaatcacttgcaaatattcaactgcaaaataaacttaagaacttttattaacaatatagattattatgaaagtcaagggatgaaaactgaagctctacacacacacacacacacacacacacacacacacacacacacacacgctttgagatagggtctcgctctgtcacccagactagagtgcagagtggcacaatcacagctcactgcggcctcgacctcctgggctcaagtgatcctcctccctcagcttcctgagtagctgggactataggcatatgccaaataca

SEQ ID NO: 1479 - DNA, 246 bp, Homo sapiens
  Z16701.1_92
  Located on chromosome 1
  Distance between a terminus base of telomere on chromosomal short arm and 5'-terminus of this base sequence : 175423567
  Distance between 3'-terminus of neighbour sequence of sequence listing upward to telomere on chrosomal short arm and 5'-terminus of this base sequence : 17703
tggctagcagtaggctactagtagttgagtttttggggagtcaaaagttatacatggatttttgactgtgcatagggccagtgccccaactcctgcattgttcagaggtcaactctgtgtgtgtgtgtgtgtgtgtgtgtgtgtgtgtgtgtgtgtgtgtgtgtgtccctaaacaatatttagcaagttgactgtttttaaactttatatcaatggtgtatattaaatatgatcgtctacagtttg

SEQ ID NO: 1480 - DNA, 331 bp, Homo sapiens
  AL021069.1_66456
  Located on chromosome 1
  Distance between a terminus base of telomere on chromosomal short arm and 5'-terminus of this base sequence : 175423567
  Distance between 3'-terminus of neighbour sequence of sequence listing upward to telomere on chrosomal short arm and 5'-terminus of this base sequence : -246
tggctagcagtaggctactagtagttgagtttttggggagtcaaaagttatacatggatttttgactgtgcatagggccagtgccccaactcctgcattgttcagaggtcaactctgtgtgtgtgtgtgtgtgtgtgtgtgtgtgtgtgtgtgtgtgtgtgtgtgtccctaaacaatatttagcaagttgactgtttttaaactttatatcaatggtgtatattaaatatgatcgtctacagtttgcttttacagctcaatagtttaaaaacaaaacaaaacaaaaagctgcagtaatccccctgccgttattcatgaggattacatttca

SEQ ID NO: 1481 - DNA, 439 bp, Homo sapiens
  AL161671.6_77259
  Located on chromosome 1
  Distance between a terminus base of telomere on chromosomal short arm and 5'-terminus of this base sequence : 175596661
  Distance between 3'-terminus of neighbour sequence of sequence listing upward to telomere on chrosomal short arm and 5'-terminus of this base sequence : 172763
tttaatggatactgccaaacagccttccaaggtagcatgagcattaactttgagttgtttttattcaataaagatctttcttgtgatcaagggcaaggttttgttctgttttgttttgttttgttttgttttgttttgtttttaggtcgcagataatgggtcagataagagtccatgaatacgcaacaaaatgaaactcatttggtgattggaatgattgacctgatctctgaagttgcatacaggcagattgaaagctaagaactggacctaaaagcagagtccctttagtgcttttatgagagaagttactatgatggggaaaatccagcaaagtattttcagtcttacaaagagcaatgtagagacggtatgacatttgagttaggatattggactttttagtcaacctttcctagacagccttgttcaagttact

SEQ ID NO: 1482 - DNA, 349 bp, Homo sapiens
  AL008735.1_23463
  Located on chromosome 1
  Distance between a terminus base of telomere on chromosomal short arm and 5'-terminus of this base sequence : 175763724
  Distance between 3'-terminus of neighbour sequence of sequence listing upward to telomere on chrosomal short arm and 5'-terminus of this base sequence : 166624
aaactgcaatctgtaagactgtatgtatcatgttcacatctcaactgtgctcatatctcatttgcattgtcaaccactgtacaaagagaacaatgtaggataactagagtgaagtttaaagattcatacttagtaagttatctgatacaaagacaatatctgccaaatagtttaggacaaaaatgatttttaagagatatgtatctttgagagagagtgaaggagaggaggggagagggagggagggggagagagagagagagagagagagagagagagagagagagagagagagagagagatgccagcctgccaatattcaaagagtttaaacttcaaccataacgtt

SEQ ID NO: 1483 - DNA, 402 bp, Homo sapiens
  Z99715.1_29430
  Located on chromosome 1
  Distance between a terminus base of telomere on chromosomal short arm and 5'-terminus of this base sequence : 176019896
  Distance between 3'-terminus of neighbour sequence of sequence listing upward to telomere on chrosomal short arm and 5'-terminus of this base sequence : 255823
gtgaacaaatagttgaagcaatccttgaccaccataaaattggaattttgtatgttatatgtcatccccccaccccaataaaaaccctccccttgtactcctcttattcaggctgttgtacattagctgatgagcccatattctgaacaatttcttgatgcttgtcagtctttcattcggctttagcagtgtggctgtcatctttgtctgcacagtagtgtgtgtgtgtgtgtgtgtgtgtgtgtgattatttgagcttttggtggcactttgctataaaaacagaataaggaaagtgctgattcaaataataagaagtataggtctcattaatttaattcaactgtgacaacacagaaatgagcagttcagtggaaagtgaaggaacctttagcctctagt

SEQ ID NO: 1484 - DNA, 271 bp, Homo sapiens
  AL008626.1_77032
  Located on chromosome 1
  Distance between a terminus base of telomere on chromosomal short arm and 5'-terminus of this base sequence : 176102876
  Distance between 3'-terminus of neighbour sequence of sequence listing upward to telomere on chrosomal short arm and 5'-terminus of this base sequence : 82578
taattatcatggctttgtgataactcagcaaaggaagtttttggaagaaggattttgtctttcatttagagattcaattctagtctcccaaatgtgatctaaattttgctcatccatctagttctaattatccttcaagatgctacacacacacacacacacacacacacacacacacacacacacccctgcttctgtcgctccaacataaaatggaatgtaaactccgtgaaaactagaatctcatctgtcttgttcactgtgatagctc

SEQ ID NO: 1485 - DNA, 299 bp, Homo sapiens
  AL008626.1_73597
  Located on chromosome 1
  Distance between a terminus base of telomere on chromosomal short arm and 5'-terminus of this base sequence : 176106409
  Distance between 3'-terminus of neighbour sequence of sequence listing upward to telomere on chrosomal short arm and 5'-terminus of this base sequence : 3262
agccatattaggattctccagggaaacagaaccaatgggatatataggagatgtgtgtgtgagtgtgtgtgtgtgtgtgtgtgtgtgtacagagagagggggagtattggggagggaaagagacaccaatataagcaaattcactgaacaaaattaaattatgaagattgatatccatccttggatcaattggtacctctcagtcatctggcatctgtggaccatgccctgagtcatggggcttcttaaatatttttttgtattgaaaacaagataagaataacttgctacttgattca

SEQ ID NO: 1486 - DNA, 148 bp, Homo sapiens
  D1S416
  Located on chromosome 1
  Distance between a terminus base of telomere on chromosomal short arm and 5'-terminus of this base sequence : 176107766
  Distance between 3'-terminus of neighbour sequence of sequence listing upward to telomere on chrosomal short arm and 5'-terminus of this base sequence : 1058
aaggcgttgagtgttgtgctaaggagttaagacttccttctgaaggtaatggggggctattcactgtttttaggacaggacacacacacacacacacacacacacacacacacacacactcaccctatatagcccattggttcggttt

SEQ ID NO: 1487 - DNA, 230 bp, Homo sapiens
  Z94057.1_61522
  Located on chromosome 1
  Distance between a terminus base of telomere on chromosomal short arm and 5'-terminus of this base sequence : 176198430
  Distance between 3'-terminus of neighbour sequence of sequence listing upward to telomere on chrosomal short arm and 5'-terminus of this base sequence : 90516
agtgtcacagtgatttgcttagggtacttgggcatccccatgggcctggggagtattcgaggttggaatcattagatgtgtgtgtttgtgcatgtgcacctgtgtatgtgtgcatgcatgtgtgtgtgtgcatgtgtgtgtgtgtgtgtgtgtgtgtgtgtgtgtgaatgattggaaggaggagcctgtgtgttaaccaaaatagactcacatagattctaaaccttgag

SEQ ID NO: 1488 - DNA, 245 bp, Homo sapiens
  HUMUT417
  Located on chromosome 1
  Distance between a terminus base of telomere on chromosomal short arm and 5'-terminus of this base sequence : 176430258
  Distance between 3'-terminus of neighbour sequence of sequence listing upward to telomere on chrosomal short arm and 5'-terminus of this base sequence : 231598
gaaggatgggtggcatgctttctctcatttagacaaaggagaaagaaagatagaaggaaagaaagaaagaaagaaagaaagaaagaaagaaagaaagaaagaaacaaagaaacaaagaaagaaagaaagagaaagaaagaaaggaagaagaaagaaagaaagaaagagagagagaaagaaagaaaaaagaaagagaaaagaaagaaaagggtgctctagacagaaggagaagcatgtgcaaaggc

SEQ ID NO: 1489 - DNA, 348 bp, Homo sapiens
  AL021919.4_42117
  Located on chromosome 1
  Distance between a terminus base of telomere on chromosomal short arm and 5'-terminus of this base sequence : 176436351
  Distance between 3'-terminus of neighbour sequence of sequence listing upward to telomere on chrosomal short arm and 5'-terminus of this base sequence : 5848
tttctgtggtaattaagatgagagtagctcctcagttctgcagcatttttaattcagaaagaaagaaaaatacaataataatataaagtggctctaagaatgaatttgttaggggacttgagtgtatgataaataatttcagcccatcttaaaacacacacacacacattcgtgtagatatacatacatatcatacatatgcatatacaagaacaaacacacacacacacacacacacacacacacaaacaataattacccaattctggaaaaacaggattcaaaatgcaccaatggaaatactgtcattctgtgggcagaacaaatgcattatcttaaactctaggc

SEQ ID NO: 1490 - DNA, 176 bp, Homo sapiens
  D1S2643
  Located on chromosome 1
  Distance between a terminus base of telomere on chromosomal short arm and 5'-terminus of this base sequence : 176436472
  Distance between 3'-terminus of neighbour sequence of sequence listing upward to telomere on chrosomal short arm and 5'-terminus of this base sequence : -227
gtgtatgataaataatttcagcccatcttaaaacacacacacacacattcgtgtagatatacatacatatcatacatatgcatatacaagaacaaacacacacacacacacacacacacacacacaaacaataattacccaattctggaaaaacaggattcaaaatgcaccaatgg

SEQ ID NO: 1491 - DNA, 118 bp, Homo sapiens
  D1S1565
  Located on chromosome 1
  Distance between a terminus base of telomere on chromosomal short arm and 5'-terminus of this base sequence : 176590735
  Distance between 3'-terminus of neighbour sequence of sequence listing upward to telomere on chrosomal short arm and 5'-terminus of this base sequence : 154087
ctaggaacaggtacaaagagccatgtgtgtgtttgtgtgtgtgtgtgtgtgtgtgtgtgtgtgtgtgtgtgtgtatttaaacctaggtgtaattttccatcttaatgcagcaaggctg

SEQ ID NO: 1492 - DNA, 273 bp, Homo sapiens
  AL023285.1_46113
  Located on chromosome 1
  Distance between a terminus base of telomere on chromosomal short arm and 5'-terminus of this base sequence : 176591975
  Distance between 3'-terminus of neighbour sequence of sequence listing upward to telomere on chrosomal short arm and 5'-terminus of this base sequence : 1122
atgtgacgatatgccttgtgtgtagcttctttgtaatacagccaaaattgggcttcctcccttgctttcacacacacacacatacacacacacacacacacacacacacacacacacgcacttccaacaaggagaaatcaggaatttattcaaaatgctgtctagggcacattctctacctttgcttcaaacataagaccaaagttcaaatgagctccccaaatcccccatttattaattaggtttctgtagttagttgctttggtacaattg

SEQ ID NO: 1493 - DNA, 235 bp, Homo sapiens
  Z67625
  Located on chromosome 1
  Distance between a terminus base of telomere on chromosomal short arm and 5'-terminus of this base sequence : 176592009
  Distance between 3'-terminus of neighbour sequence of sequence listing upward to telomere on chrosomal short arm and 5'-terminus of this base sequence : -239
aatacagccaaaattgggcttcctcccttgctttcacacacacacacatacacacacacacacacacacacacacacacacacgcacttccaacaaggagaaatcaggaatttattcaaaatgctgtctagggcacattctctacctttgcttcaaacataagaccaaagttcaaatgagctccccaaatcccccatttattaattaggtttctgtagttagttgctttggtaca

SEQ ID NO: 1494 - DNA, 322 bp, Homo sapiens
  AL023285.1_66219
  Located on chromosome 1
  Distance between a terminus base of telomere on chromosomal short arm and 5'-terminus of this base sequence : 176612104
  Distance between 3'-terminus of neighbour sequence of sequence listing upward to telomere on chrosomal short arm and 5'-terminus of this base sequence : 19860
ttcttaaataagccacagttagagcaaacagaatgagcattcaagtttctggtgtaaggcctctctctctctctctctctctgtccccctttcaagacagggtcttgctctgtctccacgccagagtgcagtggtgagatcataactcactgcaacgtcgaacttctggcctctaacgatcccctacctcaacctcccaaaacactgggattacaggcataagccaccatgcctagtctcttccttcctccctccctcccttccttttctttcattcatttatttctgtatctctcattctcactaaacaatcttgccttta

SEQ ID NO: 1495 - DNA, 248 bp, Homo sapiens
  AL023285.1_79768
  Located on chromosome 1
  Distance between a terminus base of telomere on chromosomal short arm and 5'-terminus of this base sequence : 176625693
  Distance between 3'-terminus of neighbour sequence of sequence listing upward to telomere on chrosomal short arm and 5'-terminus of this base sequence : 13267
cacctgtcttatgcaacagtacacacacacacacacacacacacacacacacccgcaaggccagagtccaatccccctttaattcggtaaacatagttttgcgcctttcttttccctacgcagaacccgactctactggcagcagagaaatagatgtaaccctagtgccaaatgccttgcagaacacacagatacacaggaaccaaaatgcatctcatagctctccttggtgctgaaatcacgttagc

SEQ ID NO: 1496 - DNA, 340 bp, Homo sapiens
  AL023285.1_80434
  Located on chromosome 1
  Distance between a terminus base of telomere on chromosomal short arm and 5'-terminus of this base sequence : 176626218
  Distance between 3'-terminus of neighbour sequence of sequence listing upward to telomere on chrosomal short arm and 5'-terminus of this base sequence : 277
cttcactccactagtggtaattccttgggtcagagaggacccccttctctcactctccctgggtctgcccgtctcctctgggtgttgagccaacagccttagcacagtcggttcctgcctctgacgtgaaagagaggaggaagcctgggactgctttgctgtctctctctctctctctctctctctctctctctctctctctctctcacgcgctctctcttttcccctcttgctgaaatttcagcagcatgatttttttaagcctccgttttttccatccccctacaagcagccccctagtggacagaaaagaaaagcatcctaaatcctcttgaacagt

SEQ ID NO: 1497 - DNA, 313 bp, Homo sapiens
  chr1.fa.O7frz.198130868
  Located on chromosome 1
  Distance between a terminus base of telomere on chromosomal short arm and 5'-terminus of this base sequence : 176834063
  Distance between 3'-terminus of neighbour sequence of sequence listing upward to telomere on chrosomal short arm and 5'-terminus of this base sequence : 207505
gaacagttattcactcagcaactggtggatttattcatagagatagatgtaactgattttaaatgtaaattaattttagtataggtataagtatatacaatgtatttaaatataagatacgtgaatatatatatatatatatatatataaaaacttccatttttggccataacagagtaaacagactaaatttgttttcctaccatatacaactggaaaactgaaaaaaatatgtaagataccactggaccacaggcagtacaggactgtgatctttgagagaaaagaaacaaatgaagtgagtcctataatc

SEQ ID NO: 1498 - DNA, 101 bp, Homo sapiens
  DISD22_0000842
  Located on chromosome 1
  Distance between a terminus base of telomere on chromosomal short arm and 5'-terminus of this base sequence : 176952706
  Distance between 3'-terminus of neighbour sequence of sequence listing upward to telomere on chrosomal short arm and 5'-terminus of this base sequence : 118330
ataaatgagtatggcacactcctgtgaaaaaaatttggagcatatttgtctctctctctctctctctctctctctctctccctggcttctccagaatttgg

SEQ ID NO: 1499 - DNA, 253 bp, Homo sapiens
  AL359265.7_66519
  Located on chromosome 1
  Distance between a terminus base of telomere on chromosomal short arm and 5'-terminus of this base sequence : 177175828
  Distance between 3'-terminus of neighbour sequence of sequence listing upward to telomere on chrosomal short arm and 5'-terminus of this base sequence : 223021
catttgccttacttctggtaacatttgaggatctgtgctctttcttatttttctgtccatgtggttctgaacagagcccaaaactccaggaagtgtagcatataatccaggtttaaaccagtgaatcacattcacaatgccttcctgagagattggttcaaggatgagcaaatgattcaagaaagaggagcttgtgttttgtttgttgttgttgttgttgttgttgtttttctcattggatctgaagcataag

SEQ ID NO: 1500 - DNA, 182 bp, Homo sapiens
  D1S1651
  Located on chromosome 1
  Distance between a terminus base of telomere on chromosomal short arm and 5'-terminus of this base sequence : 177225574
  Distance between 3'-terminus of neighbour sequence of sequence listing upward to telomere on chrosomal short arm and 5'-terminus of this base sequence : 49493
aatggagagcaaagaaagaggtaagtttaaattaatgtggtttaaaacaatgataaaactgtcttatggtatttagaattctatctatctatctatccatctattatctgtcatctatctatctatctatctatctatctatctatctatctacctacctacctacctatcttctctctgtg

SEQ ID NO: 1501 - DNA, 190 bp, Homo sapiens
  D1S1652
  Located on chromosome 1
  Distance between a terminus base of telomere on chromosomal short arm and 5'-terminus of this base sequence : 177225618
  Distance between 3'-terminus of neighbour sequence of sequence listing upward to telomere on chrosomal short arm and 5'-terminus of this base sequence : -138
aaacaatgataaaactgtcttatggtatttagaattctatctatctatctatccatctattatctgtcatctatctatctatctatctatctatctatctatctatctacctacctacctacctatcttctctctgtgtctaagatattgtgatttataataacaaatatccatttggtcttcaacccta

SEQ ID NO: 1502 - DNA, 154 bp, Homo sapiens
  D1S1650
  Located on chromosome 1
  Distance between a terminus base of telomere on chromosomal short arm and 5'-terminus of this base sequence : 177225619
  Distance between 3'-terminus of neighbour sequence of sequence listing upward to telomere on chrosomal short arm and 5'-terminus of this base sequence : -189
aacaatgataaaactgtcttatggtatttagaattctatctatctatctatccatctattatctgtcatctatctatctatctatctatctatctatctatctatctacctacctacctacctatcttctctctgtgtctaagatattgtgatt

SEQ ID NO: 1503 - DNA, 258 bp, Homo sapiens
  DISD22_0000848
  Located on chromosome 1
  Distance between a terminus base of telomere on chromosomal short arm and 5'-terminus of this base sequence : 177404120
  Distance between 3'-terminus of neighbour sequence of sequence listing upward to telomere on chrosomal short arm and 5'-terminus of this base sequence : 178347
gacttggtcaaggtttgagggaagtaagtgtgtgtgtgtgtgtgtgtgtgtgtgtgtgtgtgtgtatacatacatgtgtgtgttgatagagagaagggttcgttcctggggaggactttttaggtagcaagtttagagggtgcagatgacttaaggcaagaataagaatggtgtgtctgaggaaatacaaagtctaatgtagctagagcccagggagtgagaacagctataatagttagaatgatgagcagtattcct

SEQ ID NO: 1504 - DNA, 272 bp, Homo sapiens
  AL031734.9_57134
  Located on chromosome 1
  Distance between a terminus base of telomere on chromosomal short arm and 5'-terminus of this base sequence : 177538250
  Distance between 3'-terminus of neighbour sequence of sequence listing upward to telomere on chrosomal short arm and 5'-terminus of this base sequence : 133872
taatagcactgaaggtagactgagataagctaaaatgtatattttaaaatttaaagcaacacatacacacacacacacacacacacacacacacacacacacataccccaaaaatgaaaaaacagagggagagctaataagccagagataaaacccaattataaaaacatttaatttaatccaaagaaggcagaaaaaaggaacaaaaaaagaattaatggggcaaattgaaaacaactattaagatagttaattcaaacatagccatatca

SEQ ID NO: 1505 - DNA, 237 bp, Homo sapiens
  AL031734.9_84043
  Located on chromosome 1
  Distance between a terminus base of telomere on chromosomal short arm and 5'-terminus of this base sequence : 177565184
  Distance between 3'-terminus of neighbour sequence of sequence listing upward to telomere on chrosomal short arm and 5'-terminus of this base sequence : 26662
aagtaaacaagatgtccgtttcaaggcagtaggtatggagtgtgtgtgtgtgtgtgtgtgtgtgtgtgtgtgtgtatgtacgtgtgtgtgttaacgctgtgacctctgggaccctggccctgatactcagacccataatgtcatcttgatctttctgccttttaccctcttggctacttggacttctgttgcttctttcatctccacccacccctgcataatttaatctcatgtttc

SEQ ID NO: 1506 - DNA, 301 bp, Homo sapiens
  AL031734.9_91739
  Located on chromosome 1
  Distance between a terminus base of telomere on chromosomal short arm and 5'-terminus of this base sequence : 177572719
  Distance between 3'-terminus of neighbour sequence of sequence listing upward to telomere on chrosomal short arm and 5'-terminus of this base sequence : 7298
ttaacataagctcaggtgtgattgaaggagcttgctacgaataacaaaaaatgctcctttcacctttgtctcccctatcacttaggaaatcttgagggttttaggagctgtgtgccagtacctgggacaaagaccaaatatagtcgccttctctctgtataactgtgttcctcatccatggattcaaccaacctcagaaaaaataaataaataaataaataaataaataaataaataaataaataatacacctgaactgaaactgtgcatgatttttttcttgccattataccataatcaa

SEQ ID NO: 1507 - DNA, 339 bp, Homo sapiens
  AL031734.9_137409
  Located on chromosome 1
  Distance between a terminus base of telomere on chromosomal short arm and 5'-terminus of this base sequence : 177618541
  Distance between 3'-terminus of neighbour sequence of sequence listing upward to telomere on chrosomal short arm and 5'-terminus of this base sequence : 45521
ggagataacattacaggctaagtaaaagtaaatatagtcacacacatgcacacacacacacacacacacacacacacacacacacacaaaattccagtgtagaagatttggctgaagtgagtaatttatataaaggcaggttctgaggactcttataatgaatattactgggtaaactggcaggatgttcggcttggcaatatctgatcttatctcttggaattctttggctttggcactctctagccttcccagacagtctgactggtgatcaaggtagccctaatctcatgggcagatttggatggtggatgccttctaggaatcaaattgttaaca

SEQ ID NO: 1508 - DNA, 231 bp, Homo sapiens
  D1S2769
  Located on chromosome 1
  Distance between a terminus base of telomere on chromosomal short arm and 5'-terminus of this base sequence : 177687738
  Distance between 3'-terminus of neighbour sequence of sequence listing upward to telomere on chrosomal short arm and 5'-terminus of this base sequence : 68858
gccgtggaacactgttggcaactgaaatctataggcattctcctcccattgattggtgttaaacccagagtttctaatgctgtattttagtaattgtttgtttgtgtgtgtgtgtgtgtgtgtgtgtgcttaagtgtagattttacatcagaaacttttagattttaccttctgagtttactctcataattataacttttttgaggcaaatttaagtcatgtcgttcgcaa

SEQ ID NO: 1509 - DNA, 438 bp, Homo sapiens
  AC027620.4_179601
  Located on chromosome 1
  Distance between a terminus base of telomere on chromosomal short arm and 5'-terminus of this base sequence : 177710371
  Distance between 3'-terminus of neighbour sequence of sequence listing upward to telomere on chrosomal short arm and 5'-terminus of this base sequence : 22402
cactggaagtaattacataggcacatgcagaccagccctcaacctccccgttttatgggcatataatattcagccctaaaaattttacagaactgttttagagtttttcaaccaatatccttttctcaagttgcccaaagctatttatttatttatttatttatttatttatttatttatttatttatttgctggaagtggctttgggaatcattctctttaccatgagccacttgggcattcatgtgttaaagcctggaaaagccagtaggaacttagaaatatagaatcactttggaagcttggctgtttactactaagatttcatcttctaattagcagattctttcttttcttcccccacaccatcccctagaccacacaacaattctcttattgttttggcttgtcttttgtaatcaaggctgaaagatcttc

SEQ ID NO: 1510 - DNA, 210 bp, Homo sapiens
  D1S2659
  Located on chromosome 1
  Distance between a terminus base of telomere on chromosomal short arm and 5'-terminus of this base sequence : 177730225
  Distance between 3'-terminus of neighbour sequence of sequence listing upward to telomere on chrosomal short arm and 5'-terminus of this base sequence : 19416
ggaaggtgtcagagtgagtattttgtgtgtgtgtgtgtgtgtgtgtgtgtgtgtgagagagagagagagagagagagagagggagggagagagagcagggacactgttctctaaacagaagtttcaggagtttgacttgttttggaaatgtagggagcaaggcaccatttgattctagtgttgaaattctaaaatctgggacttggttgt

SEQ ID NO: 1511 - DNA, 233 bp, Homo sapiens
  Z67240
  Located on chromosome 1
  Distance between a terminus base of telomere on chromosomal short arm and 5'-terminus of this base sequence : 177761754
  Distance between 3'-terminus of neighbour sequence of sequence listing upward to telomere on chrosomal short arm and 5'-terminus of this base sequence : 31319
gccagtcgtctgattctgatctaacccccttccatggacttgacaaatcatacattgttgaatgtctacccctagttcgggtgggattatagtggttcccccttcatttcaaaaaattatgagttgatctcacccttctgaaacacacacacacacacacacacacacacacaaactcatgatgtgtttgtagcctttcttatactatgaaggaataactcaggaaatcagct

SEQ ID NO: 1512 - DNA, 254 bp, Homo sapiens
  AC027620.4_66559
  Located on chromosome 1
  Distance between a terminus base of telomere on chromosomal short arm and 5'-terminus of this base sequence : 177763096
  Distance between 3'-terminus of neighbour sequence of sequence listing upward to telomere on chrosomal short arm and 5'-terminus of this base sequence : 1109
caatggttagattgcgtagttaacatgcagcctttggatgaaaaatcaactgagtgtgtgagactggctttcccatctctcagaatctatctatctatctatctatctatctatctatctatctatctatctatctatctatctatcatctatctgtctgtctatctctatctgtctacccatcctttgttcattttctctttgtttcaaaatattttgtaatgaattcactaagctaatttcactagcaatcc

SEQ ID NO: 1513 - DNA, 254 bp, Homo sapiens; identical to SEQ ID NO: 1512
  AL139282.4_91131
  Located on chromosome 1
  Distance between a terminus base of telomere on chromosomal short arm and 5'-terminus of this base sequence : 177763096
  Distance between 3'-terminus of neighbour sequence of sequence listing upward to telomere on chrosomal short arm and 5'-terminus of this base sequence : -254

SEQ ID NO: 1514 - DNA, 468 bp, Homo sapiens
  AL139282.4_21475
  Located on chromosome 1
  Distance between a terminus base of telomere on chromosomal short arm and 5'-terminus of this base sequence : 177832391
  Distance between 3'-terminus of neighbour sequence of sequence listing upward to telomere on chrosomal short arm and 5'-terminus of this base sequence : 69041
aaatgcttgtccaataaagtgtactttcttcccagcatagagaaagaaaggaagagaggaaaagaaagaggaaaaatggttttcctcatctcctggggtaataattgaagtgagtgttcactccatccatgaacactgtgatattatcagataatagattaccttcttccttcccttccttccttccttccttccttccttccttttatttttccttttttctttttttctctttcataaagccatatttattaattctaccaaagtccacaatcctagattctacttaagccaagaagattttgttctctagggaatgtacctagggataaagacttatcttataattatagtctccttttacatagaactgattagttttcttcatacttatgggatgattaaaatccacctaattcttggctctgctttctctgtgagcatgtatttcttgcaagttcatcctat

SEQ ID NO: 1515 - DNA, 358 bp, Homo sapiens
  AL031290.1_30351
  Located on chromosome 1
  Distance between a terminus base of telomere on chromosomal short arm and 5'-terminus of this base sequence : 177837221
  Distance between 3'-terminus of neighbour sequence of sequence listing upward to telomere on chrosomal short arm and 5'-terminus of this base sequence : 4362
gcctgactaacaagtcgtaattgaggggatgtacttcattctgggatgtgaaaggctgcatacaggcctggaaatgagaggatcagaggaggggatggggaaggttagcttgccggagacattgcccgaggaatagtggcaatcacgggcttctgcatcatgtcggaccctttcagaggaaggggtttgtcactttgtggagttttgtctccttatttttaggacaagatgcagtgtgtgtgtgtgtgtgtgtgtgtgtgtgtgtgtgtgtgtgtgtgtgtgttacagttcttcccatttgaccctgtgaagcacccctgtagtgtggtaaaatctgtcagcacattcagaaattcta

SEQ ID NO: 1516 - DNA, 174 bp, Homo sapiens
  AL031290.1_36777
  Located on chromosome 1
  Distance between a terminus base of telomere on chromosomal short arm and 5'-terminus of this base sequence : 177843825
  Distance between 3'-terminus of neighbour sequence of sequence listing upward to telomere on chrosomal short arm and 5'-terminus of this base sequence : 6246
atctcctgatttcctaatacaatagatgaggttttagctctctgacatcatcacgcacacacacacacacacacacacacgcatacacactcctgcacttttgcctttagaggtaccagatgcctctaattcctgagctttctgttggttctaggtattctaggcatttaggtt

SEQ ID NO: 1517 - DNA, 302 bp, Homo sapiens
  AL022145.1_65528
  Located on chromosome 1
  Distance between a terminus base of telomere on chromosomal short arm and 5'-terminus of this base sequence : 177997989
  Distance between 3'-terminus of neighbour sequence of sequence listing upward to telomere on chrosomal short arm and 5'-terminus of this base sequence : 153990
ccagcatgtctggtgataggattccttgtataagacttgccatccagggaaagggagaagaaatagagataggtaggtaggtaggtaggtaggtaggtaggtagatagatagatagatagacagacagacagacagatagatagataaaagaaagcaagaaagaaggaaagtagggagataagcagagtgagagagaatatatgtatgtatatatgtatctgtgtatatatgaatgtgggtatgggtgtgtgtgtgtgtgtgtgtgtgtgtgtgtattctctttgatatagtccagcataga

SEQ ID NO: 1518 - DNA, 248 bp, Homo sapiens
  AL022145.1_39999
  Located on chromosome 1
  Distance between a terminus base of telomere on chromosomal short arm and 5'-terminus of this base sequence : 178023729
  Distance between 3'-terminus of neighbour sequence of sequence listing upward to telomere on chrosomal short arm and 5'-terminus of this base sequence : 25438
aggtaaatggcaagtaagagacagagtcatatatcctctctctctctctctctctctctctctcacacacacacacacacacacagagagagagagagagacagagacagagaaagagaaagagatttctaactttatagcagattcctcacagtaattatcaagtatatatccagaacttcccaggcagtttctttcccttcccaacccccatcccatggcgccttagattaccaactgtaacctca

SEQ ID NO: 1519 - DNA, 406 bp, Homo sapiens
  AL022145.1_2005
  Located on chromosome 1
  Distance between a terminus base of telomere on chromosomal short arm and 5'-terminus of this base sequence : 178061615
  Distance between 3'-terminus of neighbour sequence of sequence listing upward to telomere on chrosomal short arm and 5'-terminus of this base sequence : 37638
gagtatgcctccaaatacattaaagggggcttttccagtctcataataattataccttggatttataaaatttctttccctgaaaatcttcctatttatcctccccctctcaccatcgctgtgagcaaaggaacacacacacacacacacacacacacacacacacacacactgccactttcaagcaggcagcacagaggagcagagacacgaggcaacagagtcagctgccaagtgacagcctatatcatgtggcttgttggggacagatgtatgctgacctcctggttttcaattatttctttttttgcagaaccctttctcctggtgcaagctcttatgcaagtatagagaaagaataaacatgctcaggttccattatgggtatgagtccaaagccaagtat

SEQ ID NO: 1520 - DNA, 237 bp, Homo sapiens
  AL021398.1_52590
  Located on chromosome 1
  Distance between a terminus base of telomere on chromosomal short arm and 5'-terminus of this base sequence : 178197790
  Distance between 3'-terminus of neighbour sequence of sequence listing upward to telomere on chrosomal short arm and 5'-terminus of this base sequence : 135769
aatgtttcctgatttagctgtcctggcctctaaatctgtttcactctctagccatcttactgggttcttgctctcttttgcctctctctcctcttgggtctctggggtgtgtgtgtgtgtgtgtgtgtgtgtgtgtgtgtgtactatttctcacttgggggctcatttctaattaagtaatccaagaggctaaaaaatgcacaaaacaaccaaatgaaacctcaaattagatggaaa

SEQ ID NO: 1521 - DNA, 296 bp, Homo sapiens
  AC069000.2_51913
  Located on chromosome 1
  Distance between a terminus base of telomere on chromosomal short arm and 5'-terminus of this base sequence : 178239381
  Distance between 3'-terminus of neighbour sequence of sequence listing upward to telomere on chrosomal short arm and 5'-terminus of this base sequence : 41354
tttcttacctcaatggattatcactgtgatgattgctaaataataattctctaattccataatttttgtgcatgtattagttgacattatattataaataaaaggtttcttttctttctctgtttgagtatatcaatcaatctacctacctacctatgtgccatctgtctacatatctctatagacacagatagatagatagatagatagatagatagatagatagatagatgatagataaaatgtggcctcatagattagtattttactcactgaaatgtaatctatttgccatt

SEQ ID NO: 1522 - DNA, 287 bp, Homo sapiens
  AL021398.1_10909
  Located on chromosome 1
  Distance between a terminus base of telomere on chromosomal short arm and 5'-terminus of this base sequence : 178239386
  Distance between 3'-terminus of neighbour sequence of sequence listing upward to telomere on chrosomal short arm and 5'-terminus of this base sequence : -291
tacctcaatggattatcactgtgatgattgctaaataataattctctaattccataatttttgtgcatgtattagttgacattatattataaataaaaggtttcttttctttctctgtttgagtatatcaatcaatctacctacctacctatgtgccatctgtctacatatctctatagacacagatagatagatagatagatagatagatagatagatagatagatgatagataaaatgtggcctcatagattagtattttactcactgaaatgtaatctatttgc

SEQ ID NO: 1523 - DNA, 228 bp, Homo sapiens
  AL022143.1_68924
  Located on chromosome 1
  Distance between a terminus base of telomere on chromosomal short arm and 5'-terminus of this base sequence : 178281716
  Distance between 3'-terminus of neighbour sequence of sequence listing upward to telomere on chrosomal short arm and 5'-terminus of this base sequence : 42043
atccgcttagtctatttcagagtgttcatgttgacatttgcactgaaggtacaaaataaaactgctggtactttaatttgaataaaagcagtcataccacataacactaagagtcatgtattcttcatcattacacacttgcacctaaacacataagcacacatgcacacacacacacacacacacacacacacactatcttcacttaagaatgtccttaaagcagta

SEQ ID NO: 1524 - DNA, 283 bp, Homo sapiens
  AC069000.2_142051
  Located on chromosome 1
  Distance between a terminus base of telomere on chromosomal short arm and 5'-terminus of this base sequence : 178293425
  Distance between 3'-terminus of neighbour sequence of sequence listing upward to telomere on chrosomal short arm and 5'-terminus of this base sequence : 11481
atcctggctaatatggtgaaaccctatctttagtaaaaatacaaaaaattagctgggcgtggtggcaggcgcctgtagtcccagctacttgggaggctgaggcaggagaatggcatgagcccaggagctggagcttgcagtgagtggagattatgccactgcattccagcctgggtgacagagtgagactccatctcaaaataataataataataataataatattaaccatagcactgctggagtgtgaaaaagattaattcctgttcttaactaaacgatg

SEQ ID NO: 1525 - DNA, 268 bp, Homo sapiens
  AC069000.2_38252
  Located on chromosome 1
  Distance between a terminus base of telomere on chromosomal short arm and 5'-terminus of this base sequence : 178314498
  Distance between 3'-terminus of neighbour sequence of sequence listing upward to telomere on chrosomal short arm and 5'-terminus of this base sequence : 20790
ttggatccatacttaccatttaagtgacctttattcttcatttgtctcatatgtcactcaactgctacatcctcacctccctaaaatttttcattcccttctctttctgaacatttacctccttgcatatgtttgctccatactccccaacatccagaatgtgtcccttcaattccctaaaattccatcttccttccttccttccttccttccttccttccttccttccttccttccttccttccttcactaagtgataggcactagg

SEQ ID NO: 1526 - DNA, 443 bp, Homo sapiens
  AL022143.1_4102
  Located on chromosome 1
  Distance between a terminus base of telomere on chromosomal short arm and 5'-terminus of this base sequence : 178346589
  Distance between 3'-terminus of neighbour sequence of sequence listing upward to telomere on chrosomal short arm and 5'-terminus of this base sequence : 31823
ctataaggctcctaggtagttcacagtcatttttagacatttctgaaactaatgtgagatgtagagtttatagaaatttacccgtcatgactcattcgtgtatatcaatatatggctgagtgtgtgtgtgtgtgtgtgtgtgtgtataaaacttatttaaggcagagctgtaaatgcccttgaaaatagaaaattagatatccaactgaaagcagggctccaaattagaatatacttcattgggggtgttatctttgatctttctttcctaagaggagtggtctagaaatattgagaggtaaagccagctggacttcctgggtcgagtggagacttggagaacttttctgtctagctagaggattgtaaatgcaccaatcagcactctgtaaaaatgcaccaatcagcactctgtgtctagctaaaggactgtaaatgcacaa

SEQ ID NO: 1527 - DNA, 203 bp, Homo sapiens
  D1S2786
  Located on chromosome 1
  Distance between a terminus base of telomere on chromosomal short arm and 5'-terminus of this base sequence : 178346603
  Distance between 3'-terminus of neighbour sequence of sequence listing upward to telomere on chrosomal short arm and 5'-terminus of this base sequence : -429
ggtagttcacagtcatttttagacatttctgaaactaatgtgagatgtagagtttatagaaatttacccgtcatgactcattcgtgtatatcaatatatggctgagtgtgtgtgtgtgtgtgtgtgtgtgtataaaacttatttaaggcagagctgtaaatgcccttgaaaatagaaaattagatatccaactgaaagcaggg

SEQ ID NO: 1528 - DNA, 199 bp, Homo sapiens
  D1S480
  Located on chromosome 1
  Distance between a terminus base of telomere on chromosomal short arm and 5'-terminus of this base sequence : 178405586
  Distance between 3'-terminus of neighbour sequence of sequence listing upward to telomere on chrosomal short arm and 5'-terminus of this base sequence : 58780
agatggcctcctgtgggaccttgtgattgtgtgagttaatacttaataaactcccctttacatacatacatacatatatgtacacatatatgtaaatatacatatatatgtgtacatatacgtgtgtgtgtgtgtgtgtgtgtgtgtgtgtattttccattagttctgtccctctagacaaccctgacaaatacatcag

SEQ ID NO: 1529 - DNA, 434 bp, Homo sapiens
  chr1.fa.O7frz.199596410
  Located on chromosome 1
  Distance between a terminus base of telomere on chromosomal short arm and 5'-terminus of this base sequence : 178456549
  Distance between 3'-terminus of neighbour sequence of sequence listing upward to telomere on chrosomal short arm and 5'-terminus of this base sequence : 50764
atgtcttcaaatgtagcaaattaccaggagctatgggtctatacagatgagaagccagcaacagttttcaactctacttctcagagacatttaaagaaaaatgtaagcattattaaatactagaatgatttgtccaaaatgaggaatacaatctcttattccaaagagctataaaaaagaagataatcaatctacttgagaagccaattgttggcatacctaaaggcagggaaatggcctctatggactcttagattctcctctggctttgtgattctataaatccttctaataaaaatattgtcagacataccaagtgatttatgtttatttttgtctctgagtacacacacacacacacacacacacacaagtcaccagcaggtggctcatctggggacttagttttccagaggaattaggcctttatcaat

SEQ ID NO: 1530 - DNA, 355 bp, Homo sapiens
  chr1.fa.O7frz.199715710
  Located on chromosome 1
  Distance between a terminus base of telomere on chromosomal short arm and 5'-terminus of this base sequence : 178576010
  Distance between 3'-terminus of neighbour sequence of sequence listing upward to telomere on chrosomal short arm and 5'-terminus of this base sequence : 119027
acaacataccaaagcttatgtaaggcagcaaaggcaattctaagagggaagtttatggtgataaacgcctacatttaaaaaaagaaatatctcaaacaaccacctctaggaactagaaaaaggacaaattaaccccacagtttgcataaggaagaaaacaatgaatattagagtagaaataaatgaaatgaaatgaaatgaaatgaaatagaagctaaaaagaatagtagttttctaaagaaacagaaaggatcatgagagactactatgaactactatacatcaaaaaattgaataacctagaaaaactgaataaatatctagaaacatacaacataccaagatggaattatga

SEQ ID NO: 1531 - DNA, 223 bp, Homo sapiens
  chr1.fa.O7frz.199902104
  Located on chromosome 1
  Distance between a terminus base of telomere on chromosomal short arm and 5'-terminus of this base sequence : 178731288
  Distance between 3'-terminus of neighbour sequence of sequence listing upward to telomere on chrosomal short arm and 5'-terminus of this base sequence : 154923
ttgaaggaactagtctttgttaagaggagagaccaccacagttgaattcatgtgtgctcaagtacacacacacacacacacacacacacacacacacagtatctctgcaactgataacataagctaagtgtaagactcttcaagtattcctattaccttcttgattttaaccaaagttccaacaggtacagatatttttgaaactcgtttctagtcttcctac

SEQ ID NO: 1532 - DNA, 337 bp, Homo sapiens
  AC024503.2_103470
  Located on chromosome 1
  Distance between a terminus base of telomere on chromosomal short arm and 5'-terminus of this base sequence : 178886032
  Distance between 3'-terminus of neighbour sequence of sequence listing upward to telomere on chrosomal short arm and 5'-terminus of this base sequence : 154521
taacttcgaaacactaggtgaaacgtttattttgtttatttatttatttatttatttatttttgagacagagactccctctgtcacctaggctggggtgcagtggcgcaatctcctgtcactgcaacttccgcctcctgggctcaagcaattcgcctgcctcaggttccccagtagctgggattacaggcacgcgcccccacgattggctagtttttgcatttttagtagagacggggtttcaccatattggcctgactggtcttaaactcctgacctcaagtgatccgcccaccttggcctcccaaagtgctgggattacaaacatgagccactgt

SEQ ID NO: 1533 - DNA, 387 bp, Homo sapiens
  AL139132.6_89867
  Located on chromosome 1
  Distance between a terminus base of telomere on chromosomal short arm and 5'-terminus of this base sequence : 179180855
  Distance between 3'-terminus of neighbour sequence of sequence listing upward to telomere on chrosomal short arm and 5'-terminus of this base sequence : 294486
cgaatcttgaattgtcagagtatcaagaataaagagagaatcccagtagccggtggtgtagagaaaagaagtcacatattaagatcagtaatgggaatgggatgaggtttctcacctgcagcattggcaggtagaagaccttcaaaattacaggacatgtctttctccaattcaatccccagccaaacttggaaatctcattattattattattattattattattattattattattattattattattattgagacagggtctcactatgttgtttaggctggtctcaaactcctggcctcaagtgattctcctgcctcagcctcccaaagtgttgggattacaggcatgagctactgagcctggcctaaacttgaaatcttata

SEQ ID NO: 1534 - DNA, 417 bp, Homo sapiens
  chr1.fa.O7frz.200949730
  Located on chromosome 1
  Distance between a terminus base of telomere on chromosomal short arm and 5'-terminus of this base sequence : 179305420
  Distance between 3'-terminus of neighbour sequence of sequence listing upward to telomere on chrosomal short arm and 5'-terminus of this base sequence : 124178
ctcctaaagaatgaagcctactttcctagcggaccttccactagtttccttcacaaaaaccatctgttccaataaaacaaattcactcattttcccctaaatattttcatgctttctgcctactcaaagaataaggctcaagccaaaccaaccaaccaaccaaccaaataaataaataaataaataaataaataaataaataaaaaaaatgcaactcctccttgaggcccttgttgacgcctacaggtttgaagtgatcgttcctctccatgaatacctctactctctgtaacatacataagacattttgtatagtccctcttaaattatcaattatctttacatacactcagaatacatctaactaagaggctttccaactatattataagctccttcctggtagatggttacagt

SEQ ID NO: 1535 - DNA, 448 bp, Homo sapiens
  AL355806.4_41515
  Located on chromosome 1
  Distance between a terminus base of telomere on chromosomal short arm and 5'-terminus of this base sequence : 179384618
  Distance between 3'-terminus of neighbour sequence of sequence listing upward to telomere on chrosomal short arm and 5'-terminus of this base sequence : 78781
ctgaggtcaggagttcaagaccagcctggccaacatggggaaaacctgtctctactaaaaaatacaaaaaattagccaggtgtggtggcaggcacctataatcttagctacttgggaggctgaggcaggagaatcgcttgaacccaggaggcagaggctgcagtgagccaagatcgcaccactgcactccagcctgggcaacagagcaagactctgtctctaaataaataaataaataaataaataaataaataaataaaagggttggtcatatgtataagccagtaaaaccaacaggaatctgttttcccctagaaagtctattaaccaagaatacagataggaaacttgtattcttctctaatgatagacctttaaacattttttagagtaccattgatatgatagagtagaatgcaaaatttacatccatttcaaagatagaaca

SEQ ID NO: 1536 - DNA, 400 bp, Homo sapiens
  chr1.fa.O7frz.200675459
  Located on chromosome 1
  Distance between a terminus base of telomere on chromosomal short arm and 5'-terminus of this base sequence : 179619852
  Distance between 3'-terminus of neighbour sequence of sequence listing upward to telomere on chrosomal short arm and 5'-terminus of this base sequence : 234786
tgcatctagaccttggactactacccagcaataaaaagggagcaaaccatggatacacacaaaacttggatggatttcaagtgaaaaagccaatcccaaagaattacgtatgttatgattttatttatataacgttcttgaaaccataaaattagtgtgagagagtatagtttagtgattggcaggggttagggccagggggtggaggatggaaggagagggaaatagattatgttacaaaaaggcaacataagagatggtgattgatatacaaacctccacatgtgataaaatggcatagaattaaatacacgtgcacgtgcacacacacacacacacacacacacacagagtaaatgtaagacaggagggaaatctgatcaagatctatggattgtac

SEQ ID NO: 1537 - DNA, 180 bp, Homo sapiens
  D1S2791
  Located on chromosome 1
  Distance between a terminus base of telomere on chromosomal short arm and 5'-terminus of this base sequence : 179751076
  Distance between 3'-terminus of neighbour sequence of sequence listing upward to telomere on chrosomal short arm and 5'-terminus of this base sequence : 130824
atcatttaggtcccaggcacattacaatcagagtgattgattgagacagctctctgtttgcccagggactgtttcaacaccctgcttgttgtcaccaccactgtgtgcacatgtacacacacacacacacacacacacacacacacacacacacacccctcagcagtacctcacgtctag

SEQ ID NO: 1538 - DNA, 121 bp, Homo sapiens
  D1S212
  Located on chromosome 1
  Distance between a terminus base of telomere on chromosomal short arm and 5'-terminus of this base sequence : 179981952
  Distance between 3'-terminus of neighbour sequence of sequence listing upward to telomere on chrosomal short arm and 5'-terminus of this base sequence : 230696
ccaggctgattttgtgtatgtgtatgtgtgtgggcatgcatgcctgcgagtgtgtgtgtgtgtgtgtgtgtgtgtgtgtgtgtgtgtgtgtgtgtgtgtgtgtagaggcagagtcttgctg

SEQ ID NO: 1539 - DNA, 362 bp, Homo sapiens
  chr1.fa.O7frz.200367037
  Located on chromosome 1
  Distance between a terminus base of telomere on chromosomal short arm and 5'-terminus of this base sequence : 180110862
  Distance between 3'-terminus of neighbour sequence of sequence listing upward to telomere on chrosomal short arm and 5'-terminus of this base sequence : 128789
tttagccattctttatgcataggtctgctaatgacaatttttataattcattctctctctctctctctctctctctctctctctctctctctctctctctctctctctctttcatctctctctcttgtctctctctctccccactcctgggctcaagcagtcctccaccctcggcttcttaaagtgctgtgatgggattataagtgtgagccaccaatgcctggcccacttacattcttgaatctgtaggtttacgtcttttgccaaatttaggaagttttcaccattatttctttgaatacccttttagctctactttcttctctcctagatctctggtgatacagatgttggatcttatt

SEQ ID NO: 1540 - DNA, 300 bp, Homo sapiens
  AL035702.7_66468
  Located on chromosome 1
  Distance between a terminus base of telomere on chromosomal short arm and 5'-terminus of this base sequence : 180299339
  Distance between 3'-terminus of neighbour sequence of sequence listing upward to telomere on chrosomal short arm and 5'-terminus of this base sequence : 188115
tacgaatcctaacttgctgacaaaataagaaagaagggaaaaacaaaggcaaaaaagtacacacacacacacacacacacacacacacacacacacccctcttataccagcagaatactatacggtaataattgagtcaatttatgatcataatatttctgcaatttggaaaaatacaaagctgactccgtactgtactcttttcatctctcctcctctgccaaaaaatccaaatggattgaatgaaaacttaaaagcactaaaagaaaatgtagcttatttcttatgatcttggaattt

SEQ ID NO: 1541 - DNA, 302 bp, Homo sapiens
  AL035702.7_58481
  Located on chromosome 1
  Distance between a terminus base of telomere on chromosomal short arm and 5'-terminus of this base sequence : 180307305
  Distance between 3'-terminus of neighbour sequence of sequence listing upward to telomere on chrosomal short arm and 5'-terminus of this base sequence : 7666
atattgagatggaaatcaggacttttgaaagacaaggtcttgtgataaaaagttgagcttcgactctgtgtgtgtgtgtgtgtgtgtgtgtgtgtgtgtgtgtgtgtgtgtgtgtgttttgccaaagtagaaagaaacaaaatgaagattcagccactactattctgtcaatcatataagaggataaagctataacatgaaaaacaaaaagaaatcatttgtcttttggcaatacctttgcataagaaagaatatataagataaccttaaagagtatatatttctccgtcttccaaaatagg

SEQ ID NO: 1542 - DNA, 256 bp, Homo sapiens
  AC040900.3_16647
  Located on chromosome 1
  Distance between a terminus base of telomere on chromosomal short arm and 5'-terminus of this base sequence : 180308371
  Distance between 3'-terminus of neighbour sequence of sequence listing upward to telomere on chrosomal short arm and 5'-terminus of this base sequence : 764
gtattggtaaggatgtcactcatcatgttatttttctaaccacagcatcagtggttcaagatctgagaccatgtttttcttatttatccatccatccatccatccatccatccatccatccatccatcctaattccaggacattttgacctaaatgtcttatttatttttgaaatcccctgtaactaacccagaccccagcacattgcaggtgcctgatttttgaataaacaaaattgccaactatcataaggtaa

SEQ ID NO: 1543 - DNA, 286 bp, Homo sapiens
  AL035702.7_32813
  Located on chromosome 1
  Distance between a terminus base of telomere on chromosomal short arm and 5'-terminus of this base sequence : 180332891
  Distance between 3'-terminus of neighbour sequence of sequence listing upward to telomere on chrosomal short arm and 5'-terminus of this base sequence : 24264
atgctgagaaggtagaacctagtctgcttcatcaactttctgatcccaaaatgacaggccactaaaaaggttatctagctaagaacataaactcatcccacccccatcttcacctctaccccttatgttaatcatcctatacatatctatgtaaaataggtcagtggtgtgtgtgtgtgtgtgtgtgtgtgtgtgtgtgaatatacatggaaaatgttcatcttgctagggggtggcagttagctactattttttttaatgtagatgccttaatctagaggacact

SEQ ID NO: 1544 - DNA, 435 bp, Homo sapiens
  chr1.fa.O7frz.201598289
  Located on chromosome 1
  Distance between a terminus base of telomere on chromosomal short arm and 5'-terminus of this base sequence : 180603279
  Distance between 3'-terminus of neighbour sequence of sequence listing upward to telomere on chrosomal short arm and 5'-terminus of this base sequence : 270102
taggaatgcaagttcgtaatataacatctgtaatgtatctataggtacactggatacaacccaattgataaaaaattaatggctatatatgtatatatatatatagccattaattgcagggtacattatgtgtgtgtgtgtgtgtgtgtgtgtgtgtgtgtgtgtgtgtgtgtattgcctgccagcattaagtagttatgaaacatgaaaaaggtaatatttataataatttcaaaattataaagtacttaggaataaatctaataaaagttgatcagtttctttctagagtatatttcaaactttatttgagaaacattaaaagacctaagtggaagatacaccatgttcatgaactgaaagattctatattgtaaagatgtcaattctcctcaggatgctatgtagcgatcctgtccaatacagtagccacta

SEQ ID NO: 1545 - DNA, 203 bp, Homo sapiens
  D1S215
  Located on chromosome 1
  Distance between a terminus base of telomere on chromosomal short arm and 5'-terminus of this base sequence : 180850737
  Distance between 3'-terminus of neighbour sequence of sequence listing upward to telomere on chrosomal short arm and 5'-terminus of this base sequence : 247023
tgtcttggtgaattgacccttttatcattatgaaatgtctttattcacaattactttttttgcactgaagtgtacataatgcactgatatcagtatagccattccagttttcgtgtgtgtgtgtgtgtgtgtgtgtgtgtgtgtgtgtgtgtgcgcgcgcttgcctggtatatttttttccatccttctaacctacctgtgtc

SEQ ID NO: 1546 - DNA, 235 bp, Homo sapiens
  AL359853.15_33473
  Located on chromosome 1
  Distance between a terminus base of telomere on chromosomal short arm and 5'-terminus of this base sequence : 180931323
  Distance between 3'-terminus of neighbour sequence of sequence listing upward to telomere on chrosomal short arm and 5'-terminus of this base sequence : 80383
tgactaccatacgatctagcaatagttgccctgggcatttaccttacaaactagaaatagttctcctgggcatttatcccagagatatgaaaatgtatgctcacttgtaaacctgtaaacaaatgtttgtggcaactttatttggtttttgttgttgttgttgttgttgttgttgagacgtcttgctctgttctcccaagctgaagtgcggtggttcaatcctagcttactgcag

SEQ ID NO: 1547 - DNA, 306 bp, Homo sapiens
  AL353708.4_129985
  Located on chromosome 1
  Distance between a terminus base of telomere on chromosomal short arm and 5'-terminus of this base sequence : 181100594
  Distance between 3'-terminus of neighbour sequence of sequence listing upward to telomere on chrosomal short arm and 5'-terminus of this base sequence : 169036
ttggaacagctttgtatactcataattttacataataaaggctgaaatgcacaagttatattttcatgtttagggttttttttctgttttttgttttgttttgttttgttttgttttgttttgttttgtttttgagatggagtcttgctgtgttgcccaggctggagtacagtggtgcaacctcagttcactgcaacctctgcctcccgggttcaagcaattctcctgcctcagcctcccaagtagccaggactacaggcgcgtaccaccacacccagctaatttttgtattgttacacgcctggc

SEQ ID NO: 1548 - DNA, 203 bp, Homo sapiens
  DISO7_10000248
  Located on chromosome 1
  Distance between a terminus base of telomere on chromosomal short arm and 5'-terminus of this base sequence : 181182890
  Distance between 3'-terminus of neighbour sequence of sequence listing upward to telomere on chrosomal short arm and 5'-terminus of this base sequence : 81990
tgtggtttcttaattggtgggtgaaaacctccatgtcagtactctctacctaaactgtgatatgtatatatatatatgtgtgtgtgtgtgtgtgtgtgtgtgtgtgtgtgtgtgtgtatatatatatatatatacatttttttttaacctgggagtttgttaggttgtatatgatacttctctcttaagtgagtgagagccat

SEQ ID NO: 1549 - DNA, 238 bp, Homo sapiens
  D1S2751
  Located on chromosome 1
  Distance between a terminus base of telomere on chromosomal short arm and 5'-terminus of this base sequence : 181233322
  Distance between 3'-terminus of neighbour sequence of sequence listing upward to telomere on chrosomal short arm and 5'-terminus of this base sequence : 50229
atttctgccctctggtaagctttttagaaaaatatcaactttattgatgtataatttataaacaataaaatgtacctattttaagtatgcaatttggtgagttttctctcacacacacacacacacacacacacacacacacacatctccctataaccatcaccacaatccagaaatagcatatttcctcatgtctctttgcaaccagtccctaatctcagtcctggggaaccactga

SEQ ID NO: 1550 - DNA, 398 bp, Homo sapiens
  chr1.fa.O7frz.203310668
  Located on chromosome 1
  Distance between a terminus base of telomere on chromosomal short arm and 5'-terminus of this base sequence : 181277632
  Distance between 3'-terminus of neighbour sequence of sequence listing upward to telomere on chrosomal short arm and 5'-terminus of this base sequence : 44072
gtcattgaaataactgttggagataaagtactattagaatgaatagtattgctcaaaaatgtaccttaatagctatgtcagtcagaaaagagccctctagagagtgccatacgatccatctcttccagcattctacttaatggcataaacaaagacaaaagaaaattctgtatttaacttttaaaattacagtatatgagatatgcatatatatatatatatatataaaatacatagcagttcatataaaaatctattggattttatttgatcacagatttaataaatggactgcactcatatatgtatagctttcagatcttagtagtcatagtcctcatatatacctattgagctagaacacctagctgtggtgtaggtttaataccaggagttat

SEQ ID NO: 1551 - DNA, 193 bp, Homo sapiens
  D1S2883
  Located on chromosome 1
  Distance between a terminus base of telomere on chromosomal short arm and 5'-terminus of this base sequence : 181327338
  Distance between 3'-terminus of neighbour sequence of sequence listing upward to telomere on chrosomal short arm and 5'-terminus of this base sequence : 49308
aaatctggtcttctgttttcactatgaccaaataatttcctatgaattcatcctctcacatatacaaaatataatctctggaaaacacacacacacacacacacacacacacacacacacacacacaaactgcatacagacactggagagtgaaaaaggcaggcagattctgaagcagagtcaacatttggaa

SEQ ID NO: 1552 - DNA, 368 bp, Homo sapiens
  AL139131.5_41844
  Located on chromosome 1
  Distance between a terminus base of telomere on chromosomal short arm and 5'-terminus of this base sequence : 181395041
  Distance between 3'-terminus of neighbour sequence of sequence listing upward to telomere on chrosomal short arm and 5'-terminus of this base sequence : 67510
cctctgagctttagtcaattgtaggtggtcaatagattcagataaggcaatccagttaaactgtatatcccacttgctgttttctgtccctaaattctctctgagtacactgcagccctgaagttctttgaacctgttctgggttctgagggctgtccaattactgaatcatacataaaagccaagtaagattttaaaatttgttataattttggtttttaacaacttctgttgtaaataataaaagcactaaatccctactgaaaataaagggcctaaagactgaatgagagatgcaattttttttggctaacctattggcaaagaaatgatgatgatgatgatgatgatacctagtgttgctggag

SEQ ID NO: 1553 - DNA, 101 bp, Homo sapiens
  DISO7_10000250
  Located on chromosome 1
  Distance between a terminus base of telomere on chromosomal short arm and 5'-terminus of this base sequence : 181583516
  Distance between 3'-terminus of neighbour sequence of sequence listing upward to telomere on chrosomal short arm and 5'-terminus of this base sequence : 188107
ttgaaataggtggtagttacacaagggtatgtgtatgtgtatagatgtgtgtgtgtgtgtgtgtgtatgtatgtaaaacacactgtgctgtatccttaaga

SEQ ID NO: 1554 - DNA, 372 bp, Homo sapiens
  chr1.fa.O7frz.204576709
  Located on chromosome 1
  Distance between a terminus base of telomere on chromosomal short arm and 5'-terminus of this base sequence : 181744379
  Distance between 3'-terminus of neighbour sequence of sequence listing upward to telomere on chrosomal short arm and 5'-terminus of this base sequence : 160762
catccaaagtttgatcaagacaaaggaaaacataattaggagctcagggtaagaaagtatgataaagcctggtgggctatgggctattgccttgttttttgtttctgttcattttttctttttgttattttaactgttatgctctacttgttttgcaactatactatttatttatttatttatttatttatttatttagttagttagttagttagtttttgagacagagtctcactctgttgcccaggctagagtgcagtggtgagatcttggctcactgcaacctctgcctcctgggttcaagctattcacctgcctcggccttcccagtagctgggattacaggcacccaccgctatacttggctagtta

SEQ ID NO: 1555 - DNA, 190 bp, Homo sapiens
  D1S2640
  Located on chromosome 1
  Distance between a terminus base of telomere on chromosomal short arm and 5'-terminus of this base sequence : 181949336
  Distance between 3'-terminus of neighbour sequence of sequence listing upward to telomere on chrosomal short arm and 5'-terminus of this base sequence : 204585
tgttggaatgaccaccatacatgtcctaaagaaatagaaggatatatgtatacatatatatgaacatatagaaggatacacacacacacacacacacacacacacacacattattcagccacatttaaaaaagaatgaaatcctgtcctttacggcaatatggatggacctgcaggccattgtgttaagt

SEQ ID NO: 1556 - DNA, 336 bp, Homo sapiens
  chr1.fa.O7frz.204956316
  Located on chromosome 1
  Distance between a terminus base of telomere on chromosomal short arm and 5'-terminus of this base sequence : 181976061
  Distance between 3'-terminus of neighbour sequence of sequence listing upward to telomere on chrosomal short arm and 5'-terminus of this base sequence : 26535
agcctcctttattgtaatctaaatttgtatacattatgcagatttacttctagactctgtattctgttctttttgctgtgtttttctcatttatttactaaaagtatacttttaattacagtagtttaccaagtcttttgaaatctgagaaaacaaaaacattgtccttcatttagcttattttgcacacaattcttgctgttttatttatattttttcgcctgttagtttttttcgtgtgtgtgtgtttgtgtgtgtgtgtgtgtgtgtgtgtgtgtgtgtgttactataaccttactctaccttcttctgattaatggctattttatgtctgaa

SEQ ID NO: 1557 - DNA, 423 bp, Homo sapiens
  chr1.fa.O7frz.205043895
  Located on chromosome 1
  Distance between a terminus base of telomere on chromosomal short arm and 5'-terminus of this base sequence : 182044569
  Distance between 3'-terminus of neighbour sequence of sequence listing upward to telomere on chrosomal short arm and 5'-terminus of this base sequence : 68172
gttcaggttaggaaatttctattctatctttcagttgccagttctttcctctgtcccttctattattctgttaacagtgagttttatttcagttattgtatttttggcttctaatatttctatttggttcttctttgtgtttcctgtatctttggtgagactgtttctttgctaaggcatttttatcatagctgctgtgagatctttgtccagtaattccaacatctctatcatctcagttttgacatctttgattgtcttttcattaagtttgagatcttccttgttctttgtatgactagtgatttttttaattgaaaactggacagtttgggtattttgttattagactatagacacacacacacacacacacacacacacacacacacacacaccctacctcttaattatcctttggat

SEQ ID NO: 1558 - DNA, 307 bp, Homo sapiens
  AL162431.7_136334
  Located on chromosome 1
  Distance between a terminus base of telomere on chromosomal short arm and 5'-terminus of this base sequence : 182116037
  Distance between 3'-terminus of neighbour sequence of sequence listing upward to telomere on chrosomal short arm and 5'-terminus of this base sequence : 71045
gatggtgtttgtcatttcaaacatgccttccccttgctgacgacaaagtgatctcatcacaggtgactttagtacatattcggggattccatcctttgcttagtaagggggtgagagtaatttaacaaaacaatggtgctaatgataaaataataataataataataataaatgctaacatttgtggactcttaccaagtgcccagctctgtgctaatctcttttaaaggagtcactctcacttatcttaacaactgagcccttatttagcagatagggaaactgaggctcaactcctaagtaacct

SEQ ID NO: 1559 - DNA, 361 bp, Homo sapiens
  AL162431.7_93360
  Located on chromosome 1
  Distance between a terminus base of telomere on chromosomal short arm and 5'-terminus of this base sequence : 182280679
  Distance between 3'-terminus of neighbour sequence of sequence listing upward to telomere on chrosomal short arm and 5'-terminus of this base sequence : 164335
tcacgaggtcaggagattaagaccatcctggccaatatggtgaaaccctgtctctactaaaatacaaaaaattagctgggcatggtgttgcgtgcctgtagtcccagctacttgggaggctgagacaggggaattgcttgaacccgggaggcagagattgcagtgagccgagatcacgccactgcactccagcctggcgacagagtgagactctatctcaaaataataataataataataataataataataataataataacagtatatttggtgtcaggagagggctcaattctcatttctgcctttcctgtgctggctcatggtagctgggcatgacttgccttcctacataggttgt

SEQ ID NO: 1560 - DNA, 264 bp, Homo sapiens
  AL358393.5_87728
  Located on chromosome 1
  Distance between a terminus base of telomere on chromosomal short arm and 5'-terminus of this base sequence : 182355465
  Distance between 3'-terminus of neighbour sequence of sequence listing upward to telomere on chrosomal short arm and 5'-terminus of this base sequence : 74425
gtggagtgctgtttggaagagtcaggccagggaggcatgttgtccatttgtggagtcttttttttttttccattctccatttattcatttatttatttatttatttatttatttatttatttatttatttatttgagatgaggtctcactatgttgcccaggctggccttgaactcctgggatgcggtgatcctcccacctcagtcttgctagtagcagggattacagacctgtgccacatcacctggttcattgtatgaagtc

SEQ ID NO: 1561 - DNA, 403 bp, Homo sapiens
  chr1.fa.O7frz.205769242
  Located on chromosome 1
  Distance between a terminus base of telomere on chromosomal short arm and 5'-terminus of this base sequence : 182510865
  Distance between 3'-terminus of neighbour sequence of sequence listing upward to telomere on chrosomal short arm and 5'-terminus of this base sequence : 155136
gagcctatttaggcagttagattatactccaagcactggcattgccctgcccttggagcctgagaaacatctctttgtataccgggcacaggagagaacaactggcttgtgccttcctttgctccagcttcatttcttgaacatctgttttcccagaggtgggctagggtgccaactcctgacaggcagctagagtgagtttactatgcatttgtgtgtatgcgcatgtgtttgacggtataagtgtgcatgtgtgtgtgtgtatgtgtatgtggggagtgagactgaggcgggacaattccgtgtgtgtgtgtgtgtgtgtgtgtatgtgtgtttatagtctgtgaagctctctttattcctggagagaacataatgggtttactggattatggttgtactc

SEQ ID NO: 1562 - DNA, 333 bp, Homo sapiens
  chr1.fa.O7frz.206056154
  Located on chromosome 1
  Distance between a terminus base of telomere on chromosomal short arm and 5'-terminus of this base sequence : 182550886
  Distance between 3'-terminus of neighbour sequence of sequence listing upward to telomere on chrosomal short arm and 5'-terminus of this base sequence : 39618
ttagctacaactcagtgcactttgcacaaaggcaaaaagatgtatacgggatcctagaatgttagttgctatagcaacatctgcctttattatcacctaaatccattcaccatgtaaatatagtaactatttgacttccccacacccagtccatttggtaggattaaaaaaaattgtgacaactggaaaaaaccccaacaaacagaagcattgtgtgtgtgtgtgtgtgtgtgtttgtgcgtgtgtgtgtgtgtgtgtgtgtttagcagtctttcagaggacaaaagaggatgaggacatttatggggtgtgtagatgttcatagattccaag

SEQ ID NO: 1563 - DNA, 282 bp, Homo sapiens
  chr1.fa.O7frz.206644947
  Located on chromosome 1
  Distance between a terminus base of telomere on chromosomal short arm and 5'-terminus of this base sequence : 182882596
  Distance between 3'-terminus of neighbour sequence of sequence listing upward to telomere on chrosomal short arm and 5'-terminus of this base sequence : 331377
caagttgcagatactttgaaaccttttattgcatgggtgtccagggcccacagactcacatactctgacttccagcctgtcagtcattgaacttgagtttactgaaggcctcctgctattctgatggctggatttagggctagggggactgttacccaaagactgtctacctgtttggactgtctgctacctgtttggactgttcctacacacacacacacacacacacacacacacacacacacacacttatacacactggttgcgtaccatgaagttaac

SEQ ID NO: 1564 - DNA, 296 bp, Homo sapiens
  chr1.fa.O7frz.207743707
  Located on chromosome 1
  Distance between a terminus base of telomere on chromosomal short arm and 5'-terminus of this base sequence : 183079438
  Distance between 3'-terminus of neighbour sequence of sequence listing upward to telomere on chrosomal short arm and 5'-terminus of this base sequence : 196560
gagttaagaacttcatgtgaagaccagtgtgatcgctctcttcacatgcacacactcatgtatgtgtgtatatgcacatgtacacacacacacacacacacacacacacacaggtccaccttagtctgtatagttaatcagagggacctctcctttctctatagaatgcagaaatatttttaacccagcaaaagaattctggcttcttttcactggagatggagaagcctcattttagcaaaagagcctcatcgtcccatatgtaatgtatggagtatgatcctagtgatcccacc

SEQ ID NO: 1565 - DNA, 288 bp, Homo sapiens
  AL390856.5_56685
  Located on chromosome 1
  Distance between a terminus base of telomere on chromosomal short arm and 5'-terminus of this base sequence : 183612474
  Distance between 3'-terminus of neighbour sequence of sequence listing upward to telomere on chrosomal short arm and 5'-terminus of this base sequence : 532740
agcagaggttgcactgaaccgagatcgtgccactgcactccagcctgggtgacagagcaagactccttctcaaaacaaacaaacaaacaaacaaacaaacaaacaaaaaacctttcagaaacacattggtactcctaagcttttacatatgttcataagcctttaaattagggtggaggaaaaattatctcaattcctgaaaagatagacattaaaaggaaccaccaaataaaggcaaacccattttccaggtgctagaaaagggtgaggagtggtacaatctatgca

SEQ ID NO: 1566 - DNA, 184 bp, Homo sapiens
  D1S2619
  Located on chromosome 1
  Distance between a terminus base of telomere on chromosomal short arm and 5'-terminus of this base sequence : 183685282
  Distance between 3'-terminus of neighbour sequence of sequence listing upward to telomere on chrosomal short arm and 5'-terminus of this base sequence : 72520
gctctatcaatcctcctgtctcaacctccagagttgctgggactacaggcagatgccactgcacctggaaaacacttcttaaatagaacacacacacacacacacacacacacacatatacctatccataaagaaaagagtgataatgtagacttccattaaaatgtaaacattctgagccagg

SEQ ID NO: 1567 - DNA, 169 bp, Homo sapiens
  D1S466
  Located on chromosome 1
  Distance between a terminus base of telomere on chromosomal short arm and 5'-terminus of this base sequence : 183712694
  Distance between 3'-terminus of neighbour sequence of sequence listing upward to telomere on chrosomal short arm and 5'-terminus of this base sequence : 27228
tcctgcctatctggggactaaggcaatgtgtgtgtgtgtgtgtgtgtgtgtgtgtgtgtgtgtgtgtgtgtgtgtgtgtatcagagtgtttttcatgtttacatgaagtttccatccaaaacaaaacaaaatttctcccattaaagagaaaaggtccccaaaggcagtg

SEQ ID NO: 1568 - DNA, 453 bp, Homo sapiens
  AL139344.7_80646
  Located on chromosome 1
  Distance between a terminus base of telomere on chromosomal short arm and 5'-terminus of this base sequence : 183747260
  Distance between 3'-terminus of neighbour sequence of sequence listing upward to telomere on chrosomal short arm and 5'-terminus of this base sequence : 34397
acgcaccaagaatacagtttcttttttgttgttcttcttctttttgagtcacagtgtcactcttgcttaggctgaagtgacatgatcatagctcactacagcccaaactcctgagctcaagtgattctcccaccccagcctcctgagtagctgggatgacaaacgtgcaccaccatacctggctatttatttatttatttatttatttatttattagacatggggtctttctatgttgcccaggctagtctcaaactcctgggctcaagggatcctcccacttcagcctcccaaagtgctgaaattacgggcacgagtcatgttgtctggcagaagaatatagtttctaaaataaaacggtgccatgtcacaaaaaattaaaacagaaagagatccgtaactcttgcaactaaaataaacacacgctgttgtcgcattcatacaatggtatac

SEQ ID NO: 1569 - DNA, 265 bp, Homo sapiens
  D1S2818
  Located on chromosome 1
  Distance between a terminus base of telomere on chromosomal short arm and 5'-terminus of this base sequence : 183748032
  Distance between 3'-terminus of neighbour sequence of sequence listing upward to telomere on chrosomal short arm and 5'-terminus of this base sequence : 319
gttgtggtggcaggtacctataatctcagatactcaggaggctgaagcaagagaatcacttgaacctgggaggcagaagttgcagtgaacagagatggtgccactgcactcaagggcaatagagtgggactcagtctcaaacacacacacacacacacacacacacacacacacacacacataataataataaaatggggatagtaatagtaacactacctcatagagttattgttcaattaaatgagtcaacacaacttagcat

SEQ ID NO: 1570 - DNA, 380 bp, Homo sapiens
  AL139344.7_185866
  Located on chromosome 1
  Distance between a terminus base of telomere on chromosomal short arm and 5'-terminus of this base sequence : 183839409
  Distance between 3'-terminus of neighbour sequence of sequence listing upward to telomere on chrosomal short arm and 5'-terminus of this base sequence : 91112
gaaagtaactgcctatgcttaaagaaagttgcaggctcagaaaagatatagggagataaatttatgcctcaggccaattcttggcacagagatatcctacagtaataataataataataataacaactaacaaaattaacaacaaaaacccccccagcaaactctgtgaaaaggagggaatctgatttccagagttaacacatcattaggttcaaatattcagtttttaacaaaaaaaaatcagaaggcacacaaagaggaaagtatggtcaatttaaagaaaataaagataaacctaaagaagctgtccttgagagagctctgatggcagatctactagataaagactttaaaacaactgccttaaatatggtcaaaga

SEQ ID NO: 1571 - DNA, 403 bp, Homo sapiens
  AL158215.3_35375
  Located on chromosome 1
  Distance between a terminus base of telomere on chromosomal short arm and 5'-terminus of this base sequence : 183972235
  Distance between 3'-terminus of neighbour sequence of sequence listing upward to telomere on chrosomal short arm and 5'-terminus of this base sequence : 132446
tctaagcttaggaataaattgcattttacttgccaaaagcccttcttggatcttggtgagaagacaatggggtcgaattgatcactgcactccagcctgggtgacagaatgagaccctgtctcaaaaagaaaaagaagaaagaaagagagaaaagaaaagaaagaaaagaaaagaagaaagaaagaaagaaagaaaagaaaagaagaaagaaaaaaagaaagaaagaagaaagaaaggaaggaaggaagaaagaaagaaagaaagaacgaaagaaagaaagaaagaaagaaagaaagaaagaaagaaaaaagaaagaaagaaagaaagattacactgatgtgctcacatcagtaatatgagaatggtttggaatggtttgatgttatgtagcaatggctaact

SEQ ID NO: 1572 - DNA, 399 bp, Homo sapiens
  AL138776.5_51446
  Located on chromosome 1
  Distance between a terminus base of telomere on chromosomal short arm and 5'-terminus of this base sequence : 183972239
  Distance between 3'-terminus of neighbour sequence of sequence listing upward to telomere on chrosomal short arm and 5'-terminus of this base sequence : -399
agcttaggaataaattgcattttacttgccaaaagcccttcttggatcttggtgagaagacaatggggtcgaattgatcactgcactccagcctgggtgacagaatgagaccctgtctcaaaaagaaaaagaagaaagaaagagagaaaagaaaagaaagaaaagaaaagaagaaagaaagaaagaaagaaaagaaaagaagaaagaaaaaaagaaagaaagaagaaagaaaggaaggaaggaagaaagaaagaaagaaagaacgaaagaaagaaagaaagaaagaaagaaagaaagaaagaaaaaagaaagaaagaaagaaagattacactgatgtgctcacatcagtaatatgagaatggtttggaatggtttgatgttatgtagcaatggctaact

SEQ ID NO: 1573 - DNA, 101 bp, Homo sapiens
  DISO7_10000251
  Located on chromosome 1
  Distance between a terminus base of telomere on chromosomal short arm and 5'-terminus of this base sequence : 184058781
  Distance between 3'-terminus of neighbour sequence of sequence listing upward to telomere on chrosomal short arm and 5'-terminus of this base sequence : 86143
taaccagatcctaagttcatcaagggcagaaagcatgggttcattcattcattcattcatctgactaacatttaagtgtctcctatgtgccaagcaaggtc

SEQ ID NO: 1574 - DNA, 101 bp, Homo sapiens
  DISD22_0000856
  Located on chromosome 1
  Distance between a terminus base of telomere on chromosomal short arm and 5'-terminus of this base sequence : 184166090
  Distance between 3'-terminus of neighbour sequence of sequence listing upward to telomere on chrosomal short arm and 5'-terminus of this base sequence : 107208
cagtaagacgtttctggaacaccctcctgcctcttcacacacacacacacacacacacacacacacaccacccccttcagcccagattagagctcagtgtt

SEQ ID NO: 1575 - DNA, 281 bp, Homo sapiens
  D1S2623
  Located on chromosome 1
  Distance between a terminus base of telomere on chromosomal short arm and 5'-terminus of this base sequence : 184359015
  Distance between 3'-terminus of neighbour sequence of sequence listing upward to telomere on chrosomal short arm and 5'-terminus of this base sequence : 192824
ccaactcctgattcatagggataaaaatacattaaatcagtaatctcccattttaaggccctttattgtcattcaacaatactgctgttactaaagtttttccctgtgtgcgtgtgtgtgtgtgtgtgtgtgtgtgtgtgtgtgtgtgtgcgcatgcgcatttttagagatggttctcgctatgttgcccaggctagtctcgaactcctgggctcaagtgatcctcctgcctcacctcctgagtaagttgggactacaggtgcatagcacagtgcccagct

SEQ ID NO: 1576 - DNA, 364 bp, Homo sapiens
  DISO7_00009621
  Located on chromosome 1
  Distance between a terminus base of telomere on chromosomal short arm and 5'-terminus of this base sequence : 184534734
  Distance between 3'-terminus of neighbour sequence of sequence listing upward to telomere on chrosomal short arm and 5'-terminus of this base sequence : 175438
gtggattacaggcactgtactaaaaacaggtttcctatttaatataaaaagaaagtgaatcttcttttggatagaatcatccattcccatcgccgcaccccctaccccccaaacacacacacacacacacacacacacacacacacacacacacacacacacgccctactcttcatttgctaggggaaggtcacagcacaactaaatccaggacaggacattgtgaccatgacccagccacagtcaataccagaaagatgattcagagtctgaagtggtgccccaggtgccaacaggataacctctaccccccgactttgtctctggggtcctgttccttcctgcaaagcccaatccaagactg

SEQ ID NO: 1577 - DNA, 373 bp, Homo sapiens
  AL139013.5_72023
  Located on chromosome 1
  Distance between a terminus base of telomere on chromosomal short arm and 5'-terminus of this base sequence : 184566898
  Distance between 3'-terminus of neighbour sequence of sequence listing upward to telomere on chrosomal short arm and 5'-terminus of this base sequence : 31800
ctagacatttcctatcaatggaattataccatatgtggtctttcgtgactggcttctttcacttagcatgatgcttttgaggttcatctatgtcatagtatgtgtcagtacataaattctttttggtgacagaatacatatattctttttggttactgttttcacttttcagctattatgagtaatgttgctgtgaatgtgtgtgtacaagtttttgtgcagatatctaccttctcatttctcttgggtgtatacctaggagtggaattgctgggattgctgggtttaatagacttttgtttgtttgtttgtttgtttgtttgtttgtggcaagattttctcaatgaaggtatcagagctttcactgaattct

SEQ ID NO: 1578 - DNA, 182 bp, Homo sapiens
  DISD22_0000872
  Located on chromosome 1
  Distance between a terminus base of telomere on chromosomal short arm and 5'-terminus of this base sequence : 185013552
  Distance between 3'-terminus of neighbour sequence of sequence listing upward to telomere on chrosomal short arm and 5'-terminus of this base sequence : 446281
catccatcaactatttatgactgactacttcctcaaactttcatcaaaacaatatcttatcaaatgttttaatcttttacagtttgataggtgaaaattatatgtgtgtgtgtgtgtgtgtgtgtgtgtgtgtgtgtgtttataatgcaggaaccaaagagagaagttgcaactcaggtaag

SEQ ID NO: 1579 - DNA, 159 bp, Homo sapiens
  DISD22_0000873
  Located on chromosome 1
  Distance between a terminus base of telomere on chromosomal short arm and 5'-terminus of this base sequence : 185109495
  Distance between 3'-terminus of neighbour sequence of sequence listing upward to telomere on chrosomal short arm and 5'-terminus of this base sequence : 95761
caagagtatattaaggcttatgcagtttttttttttagattcactataatatatatatatgtgtgtgtgtgtgtgtgtgtgtgtgtgtgtgtgtgtgtgtgtattttttttcttggaaaaatatgagacttttttattgacaattatacttgtcccggc

SEQ ID NO: 1580 - DNA, 231 bp, Homo sapiens
  chr1.fa.O7frz.212573011
  Located on chromosome 1
  Distance between a terminus base of telomere on chromosomal short arm and 5'-terminus of this base sequence : 185295669
  Distance between 3'-terminus of neighbour sequence of sequence listing upward to telomere on chrosomal short arm and 5'-terminus of this base sequence : 186015
gcaaagatttcttaaacaggacacaaaatagcataaacataaaaagtataaaaaatttataaattgggctacatcaaaatttaaaacccgtttataagaaaatgcaaatgcaaaggtagacctcagacagataaaatatatatgtgtgtgtgtgtgtgtgtgtgtatactattttatattataaggactgatatctagaatatataaagaagtctttcaactcactgatag

SEQ ID NO: 1581 - DNA, 433 bp, Homo sapiens
  chr1.fa.O7frz.212643997
  Located on chromosome 1
  Distance between a terminus base of telomere on chromosomal short arm and 5'-terminus of this base sequence : 185357241
  Distance between 3'-terminus of neighbour sequence of sequence listing upward to telomere on chrosomal short arm and 5'-terminus of this base sequence : 61341
gcacaggatacaataagttaacagaagggcattctaacaagttataaaagagaaattgcttggaacaatgttaactatattatctagttagctatcaggaaaagtatagtacttatttggctataaggttgccacaaaataccattgcaccattatttctttacaatgcctttctgttgggtttatgttattctggaaataagtcattaattcttattacagaagtttgaaatgaaggccagcccactctatcagttctcccctcccacgatatatacacacatagcacagatagcacatgtatgtgtacacacacacacacacacacaatctctggagggaaggagagaagagagaggaaaatgggagaagaatcagggtaggggtgagagctgggtgcagctttctagagcattagctattcactcatcta

SEQ ID NO: 1582 - DNA, 208 bp, Homo sapiens
  DISO7_00009651
  Located on chromosome 1
  Distance between a terminus base of telomere on chromosomal short arm and 5'-terminus of this base sequence : 185604192
  Distance between 3'-terminus of neighbour sequence of sequence listing upward to telomere on chrosomal short arm and 5'-terminus of this base sequence : 246518
ctagtccaggttccgctcgtacagctgaggtctgtggccttccctagagccgcgagttgtggccctgtctgccaatgagcctgtgagtgtgtgtgtgtgtgtgtgtgtgtgtgtgtgtgtgtgtacataacggtacaaccccaagaaaatttattctgcttttgcaaaccgcagactgaagcccttcacagtgatgcaatgtatccag

SEQ ID NO: 1583 - DNA, 459 bp, Homo sapiens
  chr1.fa.O7frz.212942604
  Located on chromosome 1
  Distance between a terminus base of telomere on chromosomal short arm and 5'-terminus of this base sequence : 185662049
  Distance between 3'-terminus of neighbour sequence of sequence listing upward to telomere on chrosomal short arm and 5'-terminus of this base sequence : 57649
tcaaattaacagaggtcatgagagtggggccttaatccaacaggactaatattcttataaaatggggaagaaacaggataccagagatctctatctctctcccccttctctctctctctctctctctctctctctctctctctgtgtctctctctctttcccagttgtacacagaagaaagcccatatgaggacacagcaagaaggtggctgtcttcaagccaagaagagaggcctcatcagagatggaatgttcctgcacttcggtctggatttctagtgtccagaactgtgagaaaataaatttctgttgtttaagccacctggtctgtggtattttgttatgacaggcctagcaaactaacgtaaaatgctttggtacagcagcaggcacaaggtagagattcattaattgtaataataccatataaataattattgataatggcactatcaataa

SEQ ID NO: 1584 - DNA, 335 bp, Homo sapiens
  chr1.fa.O7frz.213174388
  Located on chromosome 1
  Distance between a terminus base of telomere on chromosomal short arm and 5'-terminus of this base sequence : 185894196
  Distance between 3'-terminus of neighbour sequence of sequence listing upward to telomere on chrosomal short arm and 5'-terminus of this base sequence : 231688
gtctagaataactcaggcatacagtagttattcagtagatatttttgaactactaaatgaaaaatccattttattagttttcattgcttttcctattattatataacaaaatatttacagtttctatgaaggtttggaaaaaatgtttctctctctctctctctccccctccctccctctctctcttcctccctctctgtctccctccctctctctctctctccctccctccctccctctctctctctgtgtgtgtgtctgtgtgtgtgtgtgtgtgtgtgtgtgtatttctttcccaagagcccaaggaagtcactgaaagctagatatagcaa

SEQ ID NO: 1585 - DNA, 423 bp, Homo sapiens
  AL078645.31_50821
  Located on chromosome 1
  Distance between a terminus base of telomere on chromosomal short arm and 5'-terminus of this base sequence : 186011717
  Distance between 3'-terminus of neighbour sequence of sequence listing upward to telomere on chrosomal short arm and 5'-terminus of this base sequence : 117186
gaagctgtcactgacttatgacttgtccattcattctaataaagtcacctcacagatgtgtttataaatgcattaaaatcaggcatgttttcagagaaagtttttagaatataaaatgttataatgtaaaaccacgcccttttttcagacctctctctctctctctctctctctctctctcgcaaggagctgctctccttctcctttcttctgtctattaaactttccactctttacccccccacccaaccccataaaaaaaggaaaaacctattaatttatctggacctttttttttttacctgattcgactacactttaaattaaaacgtgctttgtttttagagctggagtttgttgctaacgaaagggtaattatagttcacaggaacactcaactcattggaacatacttgctgtaga

SEQ ID NO: 1586 - DNA, 338 bp, Homo sapiens
  AL078645.31_81212
  Located on chromosome 1
  Distance between a terminus base of telomere on chromosomal short arm and 5'-terminus of this base sequence : 186042215
  Distance between 3'-terminus of neighbour sequence of sequence listing upward to telomere on chrosomal short arm and 5'-terminus of this base sequence : 30075
atactgtagccttgaagacattactgctaaataatggaatagggtgtgtgtgtgtgtgtgtgtgtgtgtgtgtgtgtgtgtgtgtgtgtgtccatccacaggcctggatttcatatagtttgagatgaagacttgttaacattaagttacatcaagtatggggaagatataaacattagccatctaggagaaaatcttcctggtttgtagaactttaccaaccaactctacacttcctattaataatttaacataaccactgatagagaatagtttgaagaattatatgagaaatgaccaatgttatagtcattgtcaatatttatggcaatttgtat

SEQ ID NO: 1587 - DNA, 167 bp, Homo sapiens
  AL078645.31_110784
  Located on chromosome 1
  Distance between a terminus base of telomere on chromosomal short arm and 5'-terminus of this base sequence : 186071798
  Distance between 3'-terminus of neighbour sequence of sequence listing upward to telomere on chrosomal short arm and 5'-terminus of this base sequence : 29245
aatcatagaatccacttgtgatacataaagaaatatatatatatatatatatatatatatatatatacacacatgccatatatatatagacatgtatatattcacctatatatatttatatcagtgttctgtgtatttaaataattagaaactcaccattagcaatt

SEQ ID NO: 1588 - DNA, 392 bp, Homo sapiens
  AL358152.7_48239
  Located on chromosome 1
  Distance between a terminus base of telomere on chromosomal short arm and 5'-terminus of this base sequence : 186125851
  Distance between 3'-terminus of neighbour sequence of sequence listing upward to telomere on chrosomal short arm and 5'-terminus of this base sequence : 53886
cactttctgccatgagtaaaagctccctgaggcctccccagaagcagatgcagctgtgcttcctgtaaagcctgcaaaaccatgagcccattaaaccactttttaaataaattacctggtgtcaggcatctttctttctctcctttccctccttccttccttccttccttccttccccccttccttccttccttccttccttccttccttccttccttccttccttcctctctctttcttcccctccctccctctcttcctcccttccttccttccttccttcctccctccctccctcccttactttctttcctttctttcacatgttctgtcacccagactaaagtgcagtggcacaatccagtcatggctcactacaacctgagctcaag

SEQ ID NO: 1589 - DNA, 284 bp, Homo sapiens
  DISO7_00009646
  Located on chromosome 1
  Distance between a terminus base of telomere on chromosomal short arm and 5'-terminus of this base sequence : 186514614
  Distance between 3'-terminus of neighbour sequence of sequence listing upward to telomere on chrosomal short arm and 5'-terminus of this base sequence : 388371
accaatcaggtaaccgatggacggaaaggcaagccaggggtttaccttaaggagggccttctctgtggaaacacggggtgtaggaatcaagtgtctctgtctctgtctctctaacacacacacacacacacacaggccatggacctctcagcatcacctcttccccagcctcccagggcccaggtgttgtttctgtgtctctggagaccgaatgtaatggctaccaccactctcttatgaacagattgtgtgggatcctgccacgaattcgaagctccaaatca

SEQ ID NO: 1590 - DNA, 123 bp, Homo sapiens
  G07795
  Located on chromosome 1
  Distance between a terminus base of telomere on chromosomal short arm and 5'-terminus of this base sequence : 186600225
  Distance between 3'-terminus of neighbour sequence of sequence listing upward to telomere on chrosomal short arm and 5'-terminus of this base sequence : 85327
taagggagaaaaaaaagcacctaagtcttttaacgagatggtctctgattagatagatagatagatagatagatagatagatagatagatgatagatagctggagagatagttaataaacaga

SEQ ID NO: 1591 - DNA, 430 bp, Homo sapiens
  chr1.fa.O7frz.213828593
  Located on chromosome 1
  Distance between a terminus base of telomere on chromosomal short arm and 5'-terminus of this base sequence : 186810605
  Distance between 3'-terminus of neighbour sequence of sequence listing upward to telomere on chrosomal short arm and 5'-terminus of this base sequence : 210257
tatgaaccagattcaatttcacattattcaaatcagctacttcagaaaattttctttgcaatgttagtttctgtactgtatctgtattttgtattaaaatactcttaagaccatttctttaaggtaattatcacacactaaaatgattactttttaaacatcttcactgagatataattcgtataccataaattcaccctttttgccaaaggctcgaattagttcagtagtcatttagcatctttaaaatgtgtgtgtgtgtgtgtgtgtgtgtgtgtgtgtgttttggattcccttgcacatcatagaactatgaagcccttgtttgccatggtctcatatgagttagtggaatctatctacttaactgcctgcagagcagagactatttcaaacttctttgtaattctccaagtaccttatacagcct

SEQ ID NO: 1592 - DNA, 241 bp, Homo sapiens
  D1S240
  Located on chromosome 1
  Distance between a terminus base of telomere on chromosomal short arm and 5'-terminus of this base sequence : 187051773
  Distance between 3'-terminus of neighbour sequence of sequence listing upward to telomere on chrosomal short arm and 5'-terminus of this base sequence : 240738
attgcagtgattgtggaacatcaaatagtatttccatcaattcctgtatatgtatgtgagacgtattgcttccgagtatttgtttgacttttactgagtaaaactgtatacattcctctggggaagtaatcaagaaggttcagtctacttagtgtgcatgtgtgcgtgcacacagacacacacacacacacacacacacacacacacactcttctagatttatgaccaccctaagttccta

SEQ ID NO: 1593 - DNA, 414 bp, Homo sapiens
  AL078644.10_80647
  Located on chromosome 1
  Distance between a terminus base of telomere on chromosomal short arm and 5'-terminus of this base sequence : 187209208
  Distance between 3'-terminus of neighbour sequence of sequence listing upward to telomere on chrosomal short arm and 5'-terminus of this base sequence : 157194
cataaggcagtggttaaatttaagtcttaaggagggctttaattgcacagaagctgagattgggaatttttgtattggcaaaaaagaaatccattacttgattttgtttttattatttgatattcctaaatgtttacttgtatgaatctatttattatttattttcatttttactggatcacataatatagagtgtgtatacatatattagagggatgaaaatccacaagtttttttcattcttttttatttttttattttattttattttattttattttattttattttattttattattattatactttaagttttagggtacatgtgcacaatgtgcaggtttgttacatatgtatacatgtgccatgttggtgtgctgcacccattaactcgtcatttagcattaggta

SEQ ID NO: 1594 - DNA, 438 bp, Homo sapiens
  AL078644.10_118403
  Located on chromosome 1
  Distance between a terminus base of telomere on chromosomal short arm and 5'-terminus of this base sequence : 187246993
  Distance between 3'-terminus of neighbour sequence of sequence listing upward to telomere on chrosomal short arm and 5'-terminus of this base sequence : 37371
ggtaggaatacatgaaagttgtagtaggaattttagagtctagcctgatttaaatagaggaggcttgttgatgagcagcttgaaatgaaactgggtatgcagcctaagaggcccaaacactgtaaacttgggaccaggactttgaagtaagggttagcaaagctcattgtggatcccagatcacagcctcagagttccttttaattcatcttctgtattgtactgtattgtattgtattgtattgtattgtattgtattgtattgtattgtattgtattgtattgtattgtaattgtattgtattatttattgagacggagtctcactctgttgcccaggctggagtgcagtggtgcgatctcggctaactgcaacttttgcctcctgggttcaagtgattctcctgcctcagcctctcatgtagctgagattacagg

SEQ ID NO: 1595 - DNA, 323 bp, Homo sapiens
  AL117347.10_48109
  Located on chromosome 1
  Distance between a terminus base of telomere on chromosomal short arm and 5'-terminus of this base sequence : 187306813
  Distance between 3'-terminus of neighbour sequence of sequence listing upward to telomere on chrosomal short arm and 5'-terminus of this base sequence : 59382
gtggaagtcgctacatagattaaggatgtttatagaaatttttgactttattattcgaagggccataaacatgaaggtagtaagtgtcattaaactttattaatatccataacacttggtatgataatattacaagatgttaaggcacagtctctgcccttgaggtggtcaccttggataggaggagtgtgtgtgtgtgtgtgtgtgtgtgtgtgtgtgtgtgtgtctgtgtgtctgtgtctgtgttggggggtggtaccatttctcaggaagttctccatgaagcatgactatcaggaccctttctaagtcaactcaaagca

SEQ ID NO: 1596 - DNA, 202 bp, Homo sapiens
  chr1.fa.O7frz.214478902
  Located on chromosome 1
  Distance between a terminus base of telomere on chromosomal short arm and 5'-terminus of this base sequence : 187491179
  Distance between 3'-terminus of neighbour sequence of sequence listing upward to telomere on chrosomal short arm and 5'-terminus of this base sequence : 184043
tactggctattggtcagagacatcagtgtgtgtgtgtgtgtgtgtgtgtgtgtgtgtgtgtgtgtgagagagagagagagagagagagagagagagagagagaggcagcactagatggaagttacattacttatgtgacctaagcttgcaagtgatagctcatcacttttgccatattctattcattagaaggaatgcacta

SEQ ID NO: 1597 - DNA, 158 bp, Homo sapiens
  Z23332.1_262
  Located on chromosome 1
  Distance between a terminus base of telomere on chromosomal short arm and 5'-terminus of this base sequence : 187617955
  Distance between 3'-terminus of neighbour sequence of sequence listing upward to telomere on chrosomal short arm and 5'-terminus of this base sequence : 126574
acctatgaggtgaatgtgtttatatgtgtgcatttgtgtatgtcagagtgagaaagagaaaattgtatgaagcgccatgatgtatgtgtgtgtgtgtgtgtgtgtgtgtgtgtgtgtgtgtgcatgcacgtgtgttttaatgaacaattggcctgaaa

SEQ ID NO: 1598 - DNA, 177 bp, Homo sapiens
  D1S444
  Located on chromosome 1
  Distance between a terminus base of telomere on chromosomal short arm and 5'-terminus of this base sequence : 187618012
  Distance between 3'-terminus of neighbour sequence of sequence listing upward to telomere on chrosomal short arm and 5'-terminus of this base sequence : -101
gaaaattgtatgaagcgccatgatgtatgtgtgtgtgtgtgtgtgtgtgtgtgtgtgtgtgtgtgcatgcacgtgtgttttaatgaacaattggcctgaaaggcagacagaaaatatttaccttctgggataccctctgtatcaggaatgagaagaattagattaaggctggggttg

SEQ ID NO: 1599 - DNA, 202 bp, Homo sapiens
  D1S254
  Located on chromosome 1
  Distance between a terminus base of telomere on chromosomal short arm and 5'-terminus of this base sequence : 187641470
  Distance between 3'-terminus of neighbour sequence of sequence listing upward to telomere on chrosomal short arm and 5'-terminus of this base sequence : 23281
ggactcgatttaatcccacaatcagtttatgtacaacattaactatgttcctaaagagtgacaactaaataaatatcaactttgtgtgtgtgtgtgtgtgtgtgtgtgtgtgtgtgtatctcacatgtgcacaacacaggaagaccataaattcttcccataatgattaaaatttattaagtgcctggaaaataaaagttgt

SEQ ID NO: 1600 - DNA, 446 bp, Homo sapiens
  AL135796.6_53303
  Located on chromosome 1
  Distance between a terminus base of telomere on chromosomal short arm and 5'-terminus of this base sequence : 187667693
  Distance between 3'-terminus of neighbour sequence of sequence listing upward to telomere on chrosomal short arm and 5'-terminus of this base sequence : 26021
aagtagacctggtgtctattcttaccttcttggtgtccatatgtattcaatgtttagctcccacttgtaagtgagaacattcagtacttggtttctgttcctgtgttagtttgcttaggctaatggcctctagctccatccatgttgctgtaaaaacatgatcttgtccttttttatgactgcatggtattctatggtgtatattccatggtgtgtgtgtgtgtgtgtgtgtgtgtatatataaaatatatatataaatatatatatatgtgtcacattttctttatccagtctactgttgatgggcatttaggttgattccatgtcttggcaattgtgaatagtgctgtgatgaacatatatgtatcacaaaatacgtttaagacttgtaatacatgtaactgtaataaatttcacagatgttgtaaccattcacaatcttacca

SEQ ID NO: 1601 - DNA, 165 bp, Homo sapiens
  D1S191
  Located on chromosome 1
  Distance between a terminus base of telomere on chromosomal short arm and 5'-terminus of this base sequence : 187683452
  Distance between 3'-terminus of neighbour sequence of sequence listing upward to telomere on chrosomal short arm and 5'-terminus of this base sequence : 15313
atgcatttgcttacaaatatcctacacacacacacacacacacacacacacacacacacacacacacacactttaaaggaggactggcttgtatttaatttagggaagaaagtatgataaggcatttaactcatagtatgcataaaccttcaagcagaacagtgg

SEQ ID NO: 1602 - DNA, 120 bp, Homo sapiens
  D1S2848
  Located on chromosome 1
  Distance between a terminus base of telomere on chromosomal short arm and 5'-terminus of this base sequence : 187696430
  Distance between 3'-terminus of neighbour sequence of sequence listing upward to telomere on chrosomal short arm and 5'-terminus of this base sequence : 12813
atctgggttcactattaaacagagtataaagtcaataattatataagcatacacacacacacacacacacacacacacacacacacacacacacacacattcacatattctacttgccca

SEQ ID NO: 1603 - DNA, 243 bp, Homo sapiens
  AL118512.8_58794
  Located on chromosome 1
  Distance between a terminus base of telomere on chromosomal short arm and 5'-terminus of this base sequence : 187869850
  Distance between 3'-terminus of neighbour sequence of sequence listing upward to telomere on chrosomal short arm and 5'-terminus of this base sequence : 173300
ttaagacgagttggtagttaacatactacagtggatgcagtgaagggggtacacacttgtgttcatgtgcacacacacacacacacacacacgcctagaaatcaataaataaaattccactccggcataaaaaactgatttttttaacaaactggcaaaacttgtttttcctcatctgtgaaatggagaaattgatacttgctctgtttatctcacaggatggctgtgattagatcttaaata

SEQ ID NO: 1604 - DNA, 256 bp, Homo sapiens
  AL118512.8_35161
  Located on chromosome 1
  Distance between a terminus base of telomere on chromosomal short arm and 5'-terminus of this base sequence : 187893452
  Distance between 3'-terminus of neighbour sequence of sequence listing upward to telomere on chrosomal short arm and 5'-terminus of this base sequence : 23359
tttcacttaagataaaggcctccggttccattcatattgctgcaaaagacatgatttcattctttttatggataggtagtattccatggaatgtgtgtgtgtgtgtgtgtgtgtgtgtgtgtgcatatatatatatatatatatatatatatatatatatcacattttcattacccaacctctgttaatggacacttaggttgattccatatctttgctattgtgaatagtgctctggtaaacatactaatgcagg

SEQ ID NO: 1605 - DNA, 392 bp, Homo sapiens
  AL133553.9_142864
  Located on chromosome 1
  Distance between a terminus base of telomere on chromosomal short arm and 5'-terminus of this base sequence : 188017421
  Distance between 3'-terminus of neighbour sequence of sequence listing upward to telomere on chrosomal short arm and 5'-terminus of this base sequence : 123713
cttaagaattgtattgaactccatggaccctctttcttgaaaatccaaccatcaatcaatctcacattctctgtctctgtctcacacacacacacacacacacacacacacacacacacacacacgcatgcaaacattttcattcacagatcccctgatgcccaaaaataaaccccaaattaaagtggtggctcaaaaacactttcaggaagcacttaagtgtgtttctacttaacttagtgtagaaaacaacaaaataaagagtatttcttttgcgtattttccccataccattagcctaaggagagcatcccactaccaaacaacagaggatagactcaacacagtccagatcaaggtgaactgctccattcgatcagcttacattgtag

SEQ ID NO: 1606 - DNA, 346 bp, Homo sapiens
  AL133553.9_97053
  Located on chromosome 1
  Distance between a terminus base of telomere on chromosomal short arm and 5'-terminus of this base sequence : 188063096
  Distance between 3'-terminus of neighbour sequence of sequence listing upward to telomere on chrosomal short arm and 5'-terminus of this base sequence : 45283
atgcctaaggagatttattgtaaggaattgactcacataattatgaagactggtaggccaacaaactgctgtagaaccaggaagagtcaacatcccaggtcaaaaaccacaagtctgggagagccaatgtttcagttcaaaggctggcaggcaggagaattctctctcagtaaggggagggtcagtcattcattctattcaggccttcagctgactgaaagacacacacacacacacacacacacacacacacacacacactccatggaggacaatctgctttactaagtctacccacttaaatgttaatctcatccaaaccatcttcatagaaacatccagaatg

SEQ ID NO: 1607 - DNA, 405 bp, Homo sapiens
  AC074116.5_2995
  Located on chromosome 1
  Distance between a terminus base of telomere on chromosomal short arm and 5'-terminus of this base sequence : 188093398
  Distance between 3'-terminus of neighbour sequence of sequence listing upward to telomere on chrosomal short arm and 5'-terminus of this base sequence : 29956
gctcagcttcaaattagttcaatgcgtaaagttggaacaatatgaagaagccagacgaaagtaaatgtaaatccactctagaagattacatcttcctggaactccaattgtttctgtaattttgcaaattcaaagtctggcataataataataataataataataataataataataataataataataaacagttccatgaaaggaccgcccaacatgaatgaaaactagcagaaaaaaaaaaaaaaaaacagtcctacaggggactcagatagtggcattatcagacacggactcagtacgtgctgaaaaagaaacaaaagactttgatctctggagctatgcaggtgagaaagggacaggattactggaatatcaaactgctgcttctagatacaagccaac

SEQ ID NO: 1608 - DNA, 350 bp, Homo sapiens
  AL096803.8_98739
  Located on chromosome 1
  Distance between a terminus base of telomere on chromosomal short arm and 5'-terminus of this base sequence : 188412123
  Distance between 3'-terminus of neighbour sequence of sequence listing upward to telomere on chrosomal short arm and 5'-terminus of this base sequence : 318320
aatatctggtgatcctaaccactgaccaattaaatttataaataaaagtctatgttgattaatgcaggtagctggcaggggtgcttccttttcaattgtgcagcatggtttaaacaaaaaggtttgttttgaaatataagggccgtgggtaagtatacaggtcctatagacagagagatttctttttatggcctgtaattcatcaaaacagtctaattctgaaaaattcttacaaggacctgctcagttacacacacacacacacacacacacacacacacacacacacttcagaagagcatgcaggtgtgtacttcaggcttaagctgcttattgcaatttgtatagat

SEQ ID NO: 1609 - DNA, 307 bp, Homo sapiens
  AL022241.2_77091
  Located on chromosome 1
  Distance between a terminus base of telomere on chromosomal short arm and 5'-terminus of this base sequence : 188585973
  Distance between 3'-terminus of neighbour sequence of sequence listing upward to telomere on chrosomal short arm and 5'-terminus of this base sequence : 173500
gccagaattgttaaagatatgagagtttggcagggtgtgatggctcactcctatagtcccagcactttgggaggccaatgcaggtggatctcttgagcccaggagtttgagatcagcctgggcaacacagcgaaactctgtctcctctttctctctctgtctctgtctctgtctctctctctctctctctctctctctctgtgtgtatatatatatataatgacccttatatattttatgtatatgatatatatatcatatatatgtatataatgagagtaattaatggactatcattatcactgtc

SEQ ID NO: 1610 - DNA, 234 bp, Homo sapiens
  AL022241.2_18405
  Located on chromosome 1
  Distance between a terminus base of telomere on chromosomal short arm and 5'-terminus of this base sequence : 188644656
  Distance between 3'-terminus of neighbour sequence of sequence listing upward to telomere on chrosomal short arm and 5'-terminus of this base sequence : 58376
taacactgctatccagatgaatgaccttcagccattctctttgcctttgtggcttggattagacagtgctctccagagaaagggagccaacaggatagatagatggttggatagattgacagacagacagatagattattgattgattgattgagaatagaatagaatagaatagaatagaatagaatagaatagaatagaatggaatgggggatttattgtaggaattggctc

SEQ ID NO: 1611 - DNA, 267 bp, Homo sapiens
  AL022241.2_16233
  Located on chromosome 1
  Distance between a terminus base of telomere on chromosomal short arm and 5'-terminus of this base sequence : 188646871
  Distance between 3'-terminus of neighbour sequence of sequence listing upward to telomere on chrosomal short arm and 5'-terminus of this base sequence : 1981
actcatattgagcctcaaattcaatatgaccggtccttaaagctgtaacttttgtctcatagctgattctctcctggtgtcacctctctcagtgaatgacatatgagccaattcccacaataaatctcctcttcttctatctatctatctatctatctattatctgtccatcatctacctaaagatatttaagtggcgatgtcaagtagagaagtaagtgcataggcctgaagcttggaattttagataccttcaaaggtcaataag

SEQ ID NO: 1612 - DNA, 308 bp, Homo sapiens
  AL022147.3_3572
  Located on chromosome 1
  Distance between a terminus base of telomere on chromosomal short arm and 5'-terminus of this base sequence : 188666535
  Distance between 3'-terminus of neighbour sequence of sequence listing upward to telomere on chrosomal short arm and 5'-terminus of this base sequence : 19397
tacagtattgccttggagtaaggagaaacaggtgaggctgacttgaatcaggatgggaccagatattttgagaccatgttaaaggaattggcgagccatggaaggaaagtgacaagatatttgtgtactaaagtgatgatgaccatattgcctactgttaggaaaagatatggggaaaatgaggaaaagaggggagcccgtgtgtgtgtgtgtgtgtgtgtgtgtgtgtttgtgtgtgatgaaaaatatattggattgctctaaatctgggcagtaagggaatgctatctggcagattgtattaactg

SEQ ID NO: 1613 - DNA, 244 bp, Homo sapiens
  AL022147.3_32458
  Located on chromosome 1
  Distance between a terminus base of telomere on chromosomal short arm and 5'-terminus of this base sequence : 188695528
  Distance between 3'-terminus of neighbour sequence of sequence listing upward to telomere on chrosomal short arm and 5'-terminus of this base sequence : 28685
tctttctgtaggttcaattatgatctggtgtcatttccttggtccagtatacctccattccatctcctttcttttgtgctattatttcatacgtgtgtgtgtgtgtgtgtgtgtgtgtgtgtctatagttgtttgcaataattctgcccggttttgtcaatgtgtttgtttttctgggagaggatttcccacattcctcgttctgccattttgtaagctggttcacctatgtattggactttaa

SEQ ID NO: 1614 - DNA, 330 bp, Homo sapiens
  AL049797.8_7816
  Located on chromosome 1
  Distance between a terminus base of telomere on chromosomal short arm and 5'-terminus of this base sequence : 188785371
  Distance between 3'-terminus of neighbour sequence of sequence listing upward to telomere on chrosomal short arm and 5'-terminus of this base sequence : 89599
tccttgtgaattctaaggaatatgtgtcataaatgctgaacaagcagagaccattaatccaatgccaatggttgaagtattctaggtttttctgtttctcgccagggtttgtatttccaagccaactgcttcatgagacgggaaaagagagagagagagagagagagagaacaccagattacttcaatcttcagagagtacattgtgcatttattaaaagtatgagaaggtccagaatatcatatcttttttgatttggatgaatcacatggtagactttggaataactataggaataaatgaactgtgtatctttcaagtattcaaagc

SEQ ID NO: 1615 - DNA, 283 bp, Homo sapiens
  AL049797.8_66884
  Located on chromosome 1
  Distance between a terminus base of telomere on chromosomal short arm and 5'-terminus of this base sequence : 188844441
  Distance between 3'-terminus of neighbour sequence of sequence listing upward to telomere on chrosomal short arm and 5'-terminus of this base sequence : 58740
aagagcaatcctaatggagtctgtttttgtttgtttgattttttcagcttcctcaattcctgcaatatgtgttatttctgttttccagtattcacttaatcatctttaagtagcaagaacccaacacccaaacagatgaccagcacacacacacacacacacacacacacacacacacacaccccacagtggccatgaaagactctagatgcaacatgcagtcagccaacatgatcagcttctgtgtcaattgggtcattactacaaatagtgcctgtgctac

SEQ ID NO: 1616 - DNA, 83 bp, Homo sapiens
  D1S202
  Located on chromosome 1
  Distance between a terminus base of telomere on chromosomal short arm and 5'-terminus of this base sequence : 188844562
  Distance between 3'-terminus of neighbour sequence of sequence listing upward to telomere on chrosomal short arm and 5'-terminus of this base sequence : -162
caacacccaaacagatgaccagcacacacacacacacacacacacacacacacacacacaccccacagtggccatgaaagact

SEQ ID NO: 1617 - DNA, 410 bp, Homo sapiens
  chr1.fa.O7frz.216362923
  Located on chromosome 1
  Distance between a terminus base of telomere on chromosomal short arm and 5'-terminus of this base sequence : 189035719
  Distance between 3'-terminus of neighbour sequence of sequence listing upward to telomere on chrosomal short arm and 5'-terminus of this base sequence : 191074
tactaagcaaactaacacaggaacagaaaaccaaataccacatgttctcacttataagaggaagctaaatgataataactttgtgaacacaaagaaggaaacaacagaagtcaggatctacttgaggggggaaagcaggaggagggaaaggagtagaaaagataactattgggtactgggcttaacacctgggttaatcacccaggtgttatatatatattatatatataacatatacaacataattaattatatacaacaaaccctcatgacatatgtttacttatgtaacaaaccttcacatgcacccccaaacttaaacataaaagtttaaaaaaaggaattgtgtgtgtgtgtgtgtgtgtgtgtctattaaggttgcagggaagtgtaaagccaggaattacttt

SEQ ID NO: 1618 - DNA, 257 bp, Homo sapiens
  D1S1642
  Located on chromosome 1
  Distance between a terminus base of telomere on chromosomal short arm and 5'-terminus of this base sequence : 189110356
  Distance between 3'-terminus of neighbour sequence of sequence listing upward to telomere on chrosomal short arm and 5'-terminus of this base sequence : 74227
tgcccgtatctgaagtacctagggataagttaggacaaataaaaaatgactatgttttaattactatagcataatttgtctatttgttctatctatctatctatctatctatctatctatctatctatttatctatctacatatatatgtgtatatatatttacttactaaatatttaacatactgtactaaaattattaaaaatcttattcaatgagctaaacttcttttagagaggtgtcagctacactgcaagt

SEQ ID NO: 1619 - DNA, 321 bp, Homo sapiens
  chr1.fa.O7frz.216525641
  Located on chromosome 1
  Distance between a terminus base of telomere on chromosomal short arm and 5'-terminus of this base sequence : 189198381
  Distance between 3'-terminus of neighbour sequence of sequence listing upward to telomere on chrosomal short arm and 5'-terminus of this base sequence : 87768
tatacagtaagcactgaacctgtaaatggcctagggtgttgtacaaataccaagctttaaaatccatgtggagaatagaagacaaagccttggggctaaatgaggcagacagttggaaatgagatcacacacacacacacacacacacacacacacacacacacacagagtcaagactcaaagaaatacagtatcagtgaaagagttagaagaaccatcctatagtagcaaaagtagcaatgaggagaattgtatgtcaaataaggagaattctgtcagcttttatgtcagctatgtgtagaaattggaaataggtatcct

SEQ ID NO: 1620 - DNA, 209 bp, Homo sapiens
  G07854
  Located on chromosome 1
  Distance between a terminus base of telomere on chromosomal short arm and 5'-terminus of this base sequence : 189429416
  Distance between 3'-terminus of neighbour sequence of sequence listing upward to telomere on chrosomal short arm and 5'-terminus of this base sequence : 230714
tgcagatcttgggacttctcggtgccgttattgtgtgagtcaattccttgttataaaattatatatacatatatttgtggatggatagaagatgatagatagatagatatgtagatagatagatagatagatagatagatagatagatagatagatagatagattctgtttctctggagaactctaatgcagttgcccacactcttttt

SEQ ID NO: 1621 - DNA, 204 bp, Homo sapiens
  D1S1604
  Located on chromosome 1
  Distance between a terminus base of telomere on chromosomal short arm and 5'-terminus of this base sequence : 189514255
  Distance between 3'-terminus of neighbour sequence of sequence listing upward to telomere on chrosomal short arm and 5'-terminus of this base sequence : 84630
actactgttaaatgcaataacatgcatgtatttaatactcatactatcaagaaaacaagaatatttcagaagaatacttagttttgttccatttaagtaaaatatgaaaagatgtaagaccaaatctgttatctatctatctatctatctatctatctatctatctctgttacttgataaaactataatgaaaagaaagggaat

SEQ ID NO: 1622 - DNA, 266 bp, Homo sapiens
  D1S222
  Located on chromosome 1
  Distance between a terminus base of telomere on chromosomal short arm and 5'-terminus of this base sequence : 189648151
  Distance between 3'-terminus of neighbour sequence of sequence listing upward to telomere on chrosomal short arm and 5'-terminus of this base sequence : 133692
ctgaagaacccgctatgaaggagttgatattaaattactgtataaatagacaagtggcttaaccagttacctgtcattgtgcatttttgttgttttctgtgtttaactgttacgtgtacatcttttgaaagttcttgtctaatgcgatgtgtgtgtgtgtgtgtgtgtgtgtgtgtgtttcatttcttttgtgcaaacaccaaagagtaaaccttttaggccagggaggaatagatatatcttcaagagtttcagagccagaaggc

SEQ ID NO: 1623 - DNA, 451 bp, Homo sapiens
  chr1.fa.O7frz.217244160
  Located on chromosome 1
  Distance between a terminus base of telomere on chromosomal short arm and 5'-terminus of this base sequence : 189765235
  Distance between 3'-terminus of neighbour sequence of sequence listing upward to telomere on chrosomal short arm and 5'-terminus of this base sequence : 116818
gtaatcacttttgattcaaggagcagagacagcatttcacaaccagaaaacaatgctttgtgtcgctgtacacacacacacacacacacacacacacacacacacacataaacattttaaatagttatttctgcaagggcagtagactgtagtaacagtgaatcaacattgtttcttcaattacattttactgttaattttttcttataaaatatcttgtttagtcacactaaaaatggataagtgattaaattacaatagaatccagaatatataattttcatatctgaaacatagaattataagaaattccagttcttcagaggagtagcaaatattgaagaactgtgaacaagatgacagtataaattgtgactgctatggaaaatgggatatatactgcctagaatattggaagtgacagcagctgccattctgttaagtcttatag

SEQ ID NO: 1624 - DNA, 432 bp, Homo sapiens
  chr1.fa.O7frz.217348395
  Located on chromosome 1
  Distance between a terminus base of telomere on chromosomal short arm and 5'-terminus of this base sequence : 189869287
  Distance between 3'-terminus of neighbour sequence of sequence listing upward to telomere on chrosomal short arm and 5'-terminus of this base sequence : 103601
gtaatcaagaaattcacagatcacttggcctttcactttttatactttcattctttctcatccctctagtgatagatagagatgaagatttagagagagttttatatctctatctgtatctctatctctatgtatgtatgtatgtatgtatgtatgtatctatctatctatctatctatctatctatctatcattgcatctttgtcgtatgacagcctacttcttttagcatcagaaggaattcctaacctttccttttcatgtctgggagagattatctcatggggtaatgttctcctcaccagataattttcaataaaagcagaaatggctcccaaagatattcatgctcgaatccctggaacttgtgaatatgtcaccttatatggcaaagggaactttgtataggtatgtgattgaggttacagactc

SEQ ID NO: 1625 - DNA, 276 bp, Homo sapiens
  AL136372.8_106797
  Located on chromosome 1
  Distance between a terminus base of telomere on chromosomal short arm and 5'-terminus of this base sequence : 189969920
  Distance between 3'-terminus of neighbour sequence of sequence listing upward to telomere on chrosomal short arm and 5'-terminus of this base sequence : 100201
tactctattgctggaggtgagaacacacacagacacaggtacataatcacacacacacacacacacacacacacacacacacaccacacacacacacacttcaaattacttaccatcctatactaaaattgtacaattagtccactctgtctcttactgccttgcaaagttaagacacagctctcattattttatatcattttacttctaagctcaagttctgtgcctaccacatagttagagatgaagacactttgttagatctgagatcaattg

SEQ ID NO: 1626 - DNA, 286 bp, Homo sapiens
  D1S238
  Located on chromosome 1
  Distance between a terminus base of telomere on chromosomal short arm and 5'-terminus of this base sequence : 190023952
  Distance between 3'-terminus of neighbour sequence of sequence listing upward to telomere on chrosomal short arm and 5'-terminus of this base sequence : 53756
tcatgtgtagatcctgtgcctccttaaactaccatctcactttctccttcccttaataagcaaagacttctaaagaatatgcttgactttctgtctctattatatcacctgataatcttccactgaaatgaatcaaattcagccatgcctcttatggatatgtaaacctgttcaggatgactctctgtcatttgcttacagaacccctctctctctctctctgacacacacacacacacacacacacacacacacacacacacacacacaatctaaactgcctcca

SEQ ID NO: 1627 - DNA, 222 bp, Homo sapiens
  AL136372.8_161005
  Located on chromosome 1
  Distance between a terminus base of telomere on chromosomal short arm and 5'-terminus of this base sequence : 190024134
  Distance between 3'-terminus of neighbour sequence of sequence listing upward to telomere on chrosomal short arm and 5'-terminus of this base sequence : -104
ctctgtcatttgcttacagaacccctctctctctctctctgacacacacacacacacacacacacacacacacacacacacacacacaatctaaactgcctccatggcctcatttctgctagggaagcttttaggaggccatcaacaaatcactgactgatgttgtagtttggtctgggtttttacaaatcagtgagcttgtgaatctgaagcctagaaact

SEQ ID NO: 1628 - DNA, 169 bp, Homo sapiens
  DISO7_10000749
  Located on chromosome 1
  Distance between a terminus base of telomere on chromosomal short arm and 5'-terminus of this base sequence : 190319955
  Distance between 3'-terminus of neighbour sequence of sequence listing upward to telomere on chrosomal short arm and 5'-terminus of this base sequence : 295599
ggcctatgatatttggaagctatatagatagtattttacatacatacacacacacacacacacacacacacacacacacacaaattttaaaggtcctgaaaccaaaaatgtagggcccattagacatattaaaaaactaatagtgaatagaaggtagatttgagtgaca

SEQ ID NO: 1629 - DNA, 432 bp, Homo sapiens
  chr1.fa.O7frz.217927808
  Located on chromosome 1
  Distance between a terminus base of telomere on chromosomal short arm and 5'-terminus of this base sequence : 190399107
  Distance between 3'-terminus of neighbour sequence of sequence listing upward to telomere on chrosomal short arm and 5'-terminus of this base sequence : 78983
taatcaaatagcttacaaccaatcataaagagaaactcttaaaaggagccaaaatatacacaacacaaacacacacacacacacacacacacacacacaaaacattacatatacagtaacagaaaaaggaaggcaacatctttccaatactgaaaggaaagcaaacaaacaaagaaacaaacctgccaacttagagctctatttttagtaaaaaatacctttcaaaaataaaggaaaaataaagacttattttcagatatacaacagctgaaataatcacccactcacctgtatcagaaaaaaatactgaataaaaaccctccaacagaaagaaaattatggcattgggaataaaaaacactggaaacagcaaatgtgggggaatataagatactttttgttttataaacctccatacatgataatggactg

SEQ ID NO: 1630 - DNA, 345 bp, Homo sapiens
  AC019006.3_42915
  Located on chromosome 1
  Distance between a terminus base of telomere on chromosomal short arm and 5'-terminus of this base sequence : 190461922
  Distance between 3'-terminus of neighbour sequence of sequence listing upward to telomere on chrosomal short arm and 5'-terminus of this base sequence : 62383
tccattcaagttgaatccattccattgcattccattccattccattgccctgcagtcgggttgattccattccattccattccattcttccattccattccattccattccgttccattccattccattccattccgttcaattccattccattccattctattcgggttaattccattccattccattccattccattccattccattccattccaatcgagttgattccattccattccattccattccattccattctattccattccattgcaatcgagttgaatccattgcctttcattccattccattccattccattccattccggaagattccattc

SEQ ID NO: 1631 - DNA, 345 bp, Homo sapiens; identical to SEQ ID NO: 1630
  AC019006.3_29600
  Located on chromosome 1
  Distance between a terminus base of telomere on chromosomal short arm and 5'-terminus of this base sequence : 190461922
  Distance between 3'-terminus of neighbour sequence of sequence listing upward to telomere on chrosomal short arm and 5'-terminus of this base sequence : -345

SEQ ID NO: 1632 - DNA, 241 bp, Homo sapiens
  AC019006.3_29994
  Located on chromosome 1
  Distance between a terminus base of telomere on chromosomal short arm and 5'-terminus of this base sequence : 190464794
  Distance between 3'-terminus of neighbour sequence of sequence listing upward to telomere on chrosomal short arm and 5'-terminus of this base sequence : 2527
ttccattctattcaggttaattccattccattccatttgattgcaatcgatttgattccattccattctattccattccattccattcctttccattccattacggatgattccattccattgcattccattccattccattcccctgtactcgggttcattccattccattccattccaatccatgccattccactcgtgttgattccattctttccattccattcaagttgaatccatt

SEQ ID NO: 1633 - DNA, 551 bp, Homo sapiens
  AC019006.3_58690
  Located on chromosome 1
  Distance between a terminus base of telomere on chromosomal short arm and 5'-terminus of this base sequence : 190476820
  Distance between 3'-terminus of neighbour sequence of sequence listing upward to telomere on chrosomal short arm and 5'-terminus of this base sequence : 11785
ctattccggttaattgcattccattccaatgcattccattccattccattccattccattgcaatcgagttgattccattccattcctttccattccattccattgccttgcattccactcgggttgattccattcctttctttccactccattacattcccttccatgattgattccattccattccattccatttcattccattgcaatccattccaatccattccattccattcctttccacttgagttgacttcattccattcctttccattctattccattcctttccactcgagttgattccattccattccaatccattgcattccattccatgccattccactcgggttgattccattcctttgcattccattccattccattccattccattccattccattccattccattccattccgttgcattccattccattacattcgaattgattctattcaactcccttactctccattacattccattccattcgggttgttccattccattccattccattccactccattccattgcactc

SEQ ID NO: 1634 - DNA, 256 bp, Homo sapiens
  AC019006.3_8473
  Located on chromosome 1
  Distance between a terminus base of telomere on chromosomal short arm and 5'-terminus of this base sequence : 190483623
  Distance between 3'-terminus of neighbour sequence of sequence listing upward to telomere on chrosomal short arm and 5'-terminus of this base sequence : 6252
tccattctattcgggttaattccattccattccattcgattgcaatcgtgttgattccattccattccattccattccattgcattcctttccattccattccattcgattccattcgattgcactcgggttgattccattccattgcattccattccattccattccattccattccattccattccgttccattccattccattacattcggattgattctattcaattcccttacactccattacattccatt

SEQ ID NO: 1635 - DNA, 128 bp, Homo sapiens
  AC019006.3_78698
  Located on chromosome 1
  Distance between a terminus base of telomere on chromosomal short arm and 5'-terminus of this base sequence : 190509352
  Distance between 3'-terminus of neighbour sequence of sequence listing upward to telomere on chrosomal short arm and 5'-terminus of this base sequence : 25473
tgcactcaggttgattccattccattgcattccattccattccattcaattccattcctttccattccattccattacattcggattgattctattcaactcccttactctccattacattcgattcc

SEQ ID NO: 1636 - DNA, 261 bp, Homo sapiens
  DISD22_0000887
  Located on chromosome 1
  Distance between a terminus base of telomere on chromosomal short arm and 5'-terminus of this base sequence : 190741622
  Distance between 3'-terminus of neighbour sequence of sequence listing upward to telomere on chrosomal short arm and 5'-terminus of this base sequence : 232142
tgaagtgaatttactctgtcatctctctgtctatgtatctatctatcgagtgggtgcaaaagtatttgtggtttttaccatgcttttcatggcgaaaaccgcagtctgtctattatctatctatctatctatctatctatctatctatctatctatctatctatcatccatctatctatctatctatctatctatctatctatctatcatctatctaatctgtctatatctgtcatttttatgcttgggttatagcctgaa

SEQ ID NO: 1637 - DNA, 353 bp, Homo sapiens
  chr1.fa.O7frz.218182941
  Located on chromosome 1
  Distance between a terminus base of telomere on chromosomal short arm and 5'-terminus of this base sequence : 190860682
  Distance between 3'-terminus of neighbour sequence of sequence listing upward to telomere on chrosomal short arm and 5'-terminus of this base sequence : 118799
gatcacaacttggtcacataacaagtctaaacaaatttaagaagacagagattatacaaagtctcttttcagactttcatggtataaaactagagataaacacacacacacacacacacacacacacacacacacacacacatacacacacacacaaacccctacaggtttactgtgttatgtaaaatgttcaatactccaatatgaaagtttaagtcaaaatgcctaaaaacaacaggtacaattaatgactaagaataagtaattaaaatagcagaaatataaattgagtttgagggaggagaagtatagagtatttttgtaggacaaaattcagcttgatcttagcataa

SEQ ID NO: 1638 - DNA, 166 bp, Homo sapiens
  D1S542
  Located on chromosome 1
  Distance between a terminus base of telomere on chromosomal short arm and 5'-terminus of this base sequence : 190929487
  Distance between 3'-terminus of neighbour sequence of sequence listing upward to telomere on chrosomal short arm and 5'-terminus of this base sequence : 68452
accatcagaccacgatcaatagatagacaaatagatgatagatagatagatagatagatagatagatagatagatagatagatagatgatagatatttgtatgcaggtaaatctacatgtatttaagtttattatacgaactgaattttatgcaattgtgggagct

SEQ ID NO: 1639 - DNA, 176 bp, Homo sapiens
  D1S2877
  Located on chromosome 1
  Distance between a terminus base of telomere on chromosomal short arm and 5'-terminus of this base sequence : 191092664
  Distance between 3'-terminus of neighbour sequence of sequence listing upward to telomere on chrosomal short arm and 5'-terminus of this base sequence : 163011
agacatttcattgaagtctatttattttctagaaatttattggaagtacacacacacacacacacacacacacacacacacacacacaaacatacacaaagacaaaatcaggtagaatgtacaaatgtgtcagggaaatatatagtctatggaattgctcttacgctagtggcttg

SEQ ID NO: 1640 - DNA, 240 bp, Homo sapiens
  D1S461
  Located on chromosome 1
  Distance between a terminus base of telomere on chromosomal short arm and 5'-terminus of this base sequence : 191166433
  Distance between 3'-terminus of neighbour sequence of sequence listing upward to telomere on chrosomal short arm and 5'-terminus of this base sequence : 73593
tgggctatcagaagcctctttcatttgatttattttacagacacccaaaatgtttaatttagatatactttttttttatttatttctaattgatgcataataattccatttggagtgtaataagttgtattcatcattttgcaggactagtgtgtgtgtgtgtgtgtgtgtgtgtgtgtgtgtgtgtgtgtgtttcttgagatggattctccctctgtcacccagacaggagtgcagtaa

SEQ ID NO: 1641 - DNA, 245 bp, Homo sapiens
  AL359435.3_448
  Located on chromosome 1
  Distance between a terminus base of telomere on chromosomal short arm and 5'-terminus of this base sequence : 191207817
  Distance between 3'-terminus of neighbour sequence of sequence listing upward to telomere on chrosomal short arm and 5'-terminus of this base sequence : 41144
ccatcctataagtgagtctgctattaagtaacaaaggggcagataggctatacagcatggatatgaagagcaaagggatgtttttttgtttttgtttgttttgtttgtttgtttgtttgtttgtttgcatggcaccagatttcatcataatactcagtggtatgctatttaaaacgtatacattgtttatttctagatattttatttaatatttttgaaccacacttgaccaggttaactgaagc

SEQ ID NO: 1642 - DNA, 190 bp, Homo sapiens
  D1S428
  Located on chromosome 1
  Distance between a terminus base of telomere on chromosomal short arm and 5'-terminus of this base sequence : 191213251
  Distance between 3'-terminus of neighbour sequence of sequence listing upward to telomere on chrosomal short arm and 5'-terminus of this base sequence : 5189
tggtggcctgtccatatctgcatatattgccatggatttttgcttcattctaatagaaaccatgcgtgtgtgtgtgtgtgtgtgtgtgtgtgtgtgtttacttttttaaaaaataataatttttctgtgtgtgtatgcatagatagaagcatgaaatgttatgtattatgttagcaacactaccccatga

SEQ ID NO: 1643 - DNA, 359 bp, Homo sapiens
  AL359435.3_152255
  Located on chromosome 1
  Distance between a terminus base of telomere on chromosomal short arm and 5'-terminus of this base sequence : 191256896
  Distance between 3'-terminus of neighbour sequence of sequence listing upward to telomere on chrosomal short arm and 5'-terminus of this base sequence : 43455
gcatgtaattccagctactcagaaggctgaggaaggagaaccacttgaacctgggaggcggaggttgcagtgagccgagatcacgccattgcactccaacttgggcgacagagcaagactctgtctcaaaacaaacaaacaaacaaacaaacaaacaaaaaacagagagagagagaaagttacctctcttcctttcaggtctttcaggtgatcctttcctcaatctcaggtagtttcccgccattaaactcctactgactagcaatacaaatacacagtggagatgctctgcagatctttaaaaatttctatatttaacgttcctaactctagtacttagtcctgtgaactctagttgc

SEQ ID NO: 1644 - DNA, 357 bp, Homo sapiens
  AC026892.11_103180
  Located on chromosome 1
  Distance between a terminus base of telomere on chromosomal short arm and 5'-terminus of this base sequence : 191303173
  Distance between 3'-terminus of neighbour sequence of sequence listing upward to telomere on chrosomal short arm and 5'-terminus of this base sequence : 45918
ggtggagattgcaatgaactgtgattatgccactgcacttcagcctgagtaacagagcaagaccctgtttcaatacatacatacatacatacatacatacatacatacatacatatatacatacatacacacatacatacatacatacatacacacatattataccatcagtcaatggtaaaatgaaactgagtttacaaggttcaccattaatttaagaaatttctaaatatgactgcataaatgtagatcttgtttattttctttatttttggtctcttgattctgctatgtatggaatttctccttagtctcacctacttattaaaatatgctttaataacaagtgagcctggt

SEQ ID NO: 1645 - DNA, 156 bp, Homo sapiens
  Z24294.1_90
  Located on chromosome 1
  Distance between a terminus base of telomere on chromosomal short arm and 5'-terminus of this base sequence : 191308223
  Distance between 3'-terminus of neighbour sequence of sequence listing upward to telomere on chrosomal short arm and 5'-terminus of this base sequence : 4693
tctgcaaatacttacctttgagatttaaaaaggcagggaggggtagaggtaaggattacagagaagcataaggacacttttggaggtgattgtggagatggtttcaggatgtgtgtgtgtgtgtgtgtgtgtgtggaacacttcttagatttgtta

SEQ ID NO: 1646 - DNA, 94 bp, Homo sapiens
  D1S492
  Located on chromosome 1
  Distance between a terminus base of telomere on chromosomal short arm and 5'-terminus of this base sequence : 191308314
  Distance between 3'-terminus of neighbour sequence of sequence listing upward to telomere on chrosomal short arm and 5'-terminus of this base sequence : -65
gtggagatggtttcaggatgtgtgtgtgtgtgtgtgtgtgtgtggaacacttcttagatttgttaaattgtgcactttaaatgtttgcagttta

SEQ ID NO: 1647 - DNA, 272 bp, Homo sapiens
  AC026892.11_119850
  Located on chromosome 1
  Distance between a terminus base of telomere on chromosomal short arm and 5'-terminus of this base sequence : 191319864
  Distance between 3'-terminus of neighbour sequence of sequence listing upward to telomere on chrosomal short arm and 5'-terminus of this base sequence : 11456
aaattctaggctcatgtaccatacaactgtttttcagattctctttgactttttatttatttatttatttatttatttatttatttttgaggcagaatctcactcagtcccccatgctggagtgcagtggcacaatcttggctcactgcaacctccacctcccgtgttcaagcaattagcatgcctcagcctcccaagtagctggaattacaggcgtgcaccaccacgtctgtctaatttttgtatttttaatagagatggcatttcaccat

SEQ ID NO: 1648 - DNA, 308 bp, Homo sapiens
  AL136371.8_129749
  Located on chromosome 1
  Distance between a terminus base of telomere on chromosomal short arm and 5'-terminus of this base sequence : 191327182
  Distance between 3'-terminus of neighbour sequence of sequence listing upward to telomere on chrosomal short arm and 5'-terminus of this base sequence : 7046
aactgtaggcaattgtaacataatagtatctgtgtaactaaacatatctaaatatacaaaaggtacaataaaaatatggtattacagtcttatgagattaccattgtaaatgcagtccctcattgattgaaatgtcattacagggcacatgactgtaattgattagcaaaagaagccaatgtaatatgtgattatatatatatatatatatatatatataatatatataaattcatgaagaatagacaatgctacagtagaaatactatgtttattatcaaaagtgataatttaatgaactcagtcac

SEQ ID NO: 1649 - DNA, 434 bp, Homo sapiens
  AL136371.8_125449
  Located on chromosome 1
  Distance between a terminus base of telomere on chromosomal short arm and 5'-terminus of this base sequence : 191331447
  Distance between 3'-terminus of neighbour sequence of sequence listing upward to telomere on chrosomal short arm and 5'-terminus of this base sequence : 3957
ctacatctttggcaacgagttttgcctgtttaagaacatgagccaaaaagccaaaattaatgtcatattatttttacaacatatttttgttctctatgactacttctttttacttaaaatgtttgttataaataaattgcattttcttgatttgtggagaaaaaattatcttaaaatcatgggaatacaaattcaaattttactaagttcttcaaacatattttggtcaaattgtgtgtgtgtgtgtgtgtgtgtatgtgtgtgttatctttgtcatgtaacttgttcttttagtatgccttttgattctggttcacccagacatgttaagtcaaaaagactgcatgggagttgcttttataagtaaggctcttttaaagctaggtatttccttaggtagggattctgtataatggatagttaggagtctgctt

SEQ ID NO: 1650 - DNA, 340 bp, Homo sapiens
  AL136371.8_103224
  Located on chromosome 1
  Distance between a terminus base of telomere on chromosomal short arm and 5'-terminus of this base sequence : 191353707
  Distance between 3'-terminus of neighbour sequence of sequence listing upward to telomere on chrosomal short arm and 5'-terminus of this base sequence : 21826
ggctatgctaacaggaaactacttactctgattctcaatgagccatgcaggttcttaggccacatgtttcacctatatactctgtatacacacacactatatatatacatatatatgtataatattatatatgtatattatatatgtatatatgtattatatacgtatattatatatgtatatatgtatataatattatatatatatatatatatatatagagagagagagagggagagagagggactttcccaaaaatttgtcatttttctctctaaatataatcgaattgcacagcatgcatttcaaagtactagtacaaattcagttcctaattgaa

SEQ ID NO: 1651 - DNA, 311 bp, Homo sapiens
  AC026892.11_170073
  Located on chromosome 1
  Distance between a terminus base of telomere on chromosomal short arm and 5'-terminus of this base sequence : 191370083
  Distance between 3'-terminus of neighbour sequence of sequence listing upward to telomere on chrosomal short arm and 5'-terminus of this base sequence : 16036
tcactgtggaactcactaatacagagagctcactgtgtatgtatagatagataggtagatagatagatagatagatagatagatagatagatagatagaaagatagacagatatagtttttctaagagaaaatatatagttaagaatatgttttttatctcttgctataagatctcccaatataaaatagtgttcaaatcagaaagagttacattcaaaaaattggctttagtttttcaattttcttactactcctatctatgtaccttattatcataacaattttctgctttgttctgttaggcattgtt

SEQ ID NO: 1652 - DNA, 218 bp, Homo sapiens
  AL136371.8_36178
  Located on chromosome 1
  Distance between a terminus base of telomere on chromosomal short arm and 5'-terminus of this base sequence : 191420897
  Distance between 3'-terminus of neighbour sequence of sequence listing upward to telomere on chrosomal short arm and 5'-terminus of this base sequence : 50503
tctttacattgcacataggaatatgtatgtaagtgtgtgtgtgtgtgtgtgtgtgtgtgtgtgtgtgtgtgtgtgtatttttgttggttgttctcagtctttggatctcctggtctttacctttaatgaagaaaattcatacttcttttgcctgtcatattgtcctaatgtgaacaatggaaatcctttagacctagaaattctaaagcaaattccag

SEQ ID NO: 1653 - DNA, 435 bp, Homo sapiens
  chr1.fa.O7frz.219446776
  Located on chromosome 1
  Distance between a terminus base of telomere on chromosomal short arm and 5'-terminus of this base sequence : 191777038
  Distance between 3'-terminus of neighbour sequence of sequence listing upward to telomere on chrosomal short arm and 5'-terminus of this base sequence : 355923
gatttgtgtaattgacaagcactatattcactgaaaaaaaaatatcaaggaatacttctaagatacctactacctgtcatgtacaaggtatactatatatatatatatatatatataaagagagagagagagtcttgctctgtcacccaggctgtagtgcagtggcgtgatctcagctcacagcaacctccgcctctgggttcaagtgactcttctgcctcaaccccctgagtagctgggactacaggcatgtgccaccacacccagctaatttttggtagatgatatttttaaaagacaaagttttcttactttcaaagatatttcaaagtagcaaagataccggcaattatactagagtattttagggaaaatgcagtgtggcattggaaaaaaaatatacatttaatccttagtacaattagttgaaatggc

SEQ ID NO: 1654 - DNA, 262 bp, Homo sapiens
  chr1.fa.O7frz.219793629
  Located on chromosome 1
  Distance between a terminus base of telomere on chromosomal short arm and 5'-terminus of this base sequence : 191816333
  Distance between 3'-terminus of neighbour sequence of sequence listing upward to telomere on chrosomal short arm and 5'-terminus of this base sequence : 38860
tactgcagtaaaccgtagctcagaaatctttgctatcatttcttcaggtcatctccagccagtaatttaaatgaaataaaagattcatagagctcataattagactatataatacacacacacacacacacacacacacacacagacgtgtgtatgtatattccatttatcactgcacaaaacaagattagagctatacttggtctgaactgcaatacatttctaaatatgtgatatcttctaaagacattgcatgctatct

SEQ ID NO: 1655 - DNA, 115 bp, Homo sapiens
  DISD22_0000899
  Located on chromosome 1
  Distance between a terminus base of telomere on chromosomal short arm and 5'-terminus of this base sequence : 191946751
  Distance between 3'-terminus of neighbour sequence of sequence listing upward to telomere on chrosomal short arm and 5'-terminus of this base sequence : 130156
actagatgagctacatacccagagtaaagaaaaacaaaacaaaacacacacacacacacacacacacacacacacacacacacacacaaagaaaccactagctttcaccagatct

SEQ ID NO: 1656 - DNA, 245 bp, Homo sapiens
  DISD22_0000904
  Located on chromosome 1
  Distance between a terminus base of telomere on chromosomal short arm and 5'-terminus of this base sequence : 192029059
  Distance between 3'-terminus of neighbour sequence of sequence listing upward to telomere on chrosomal short arm and 5'-terminus of this base sequence : 82193
catacctagaggcatgttgatcatattattaatataaattcaaaacatgttatcttaattagacaaaatatttaaactcaacactgtctagaaaatataaaaaatacatgatatttgaaaagtcaaatatatatatatatatatatatatatatatatatatatatgtatttctaaggtcaccttgtagataaaaacatttaaaaattaaagtatatttatattgaagtaactggcaacatttga

SEQ ID NO: 1657 - DNA, 105 bp, Homo sapiens
  D1S2823
  Located on chromosome 1
  Distance between a terminus base of telomere on chromosomal short arm and 5'-terminus of this base sequence : 192243548
  Distance between 3'-terminus of neighbour sequence of sequence listing upward to telomere on chrosomal short arm and 5'-terminus of this base sequence : 214244
tcaaccatgatgtatgtgtgtacatgcacgtgtgtgtgtgtgtgtgtgtgtgtgtgtattggacagtgtatggtaggtagaggaatgggacatgggacataataa

SEQ ID NO: 1658 - DNA, 145 bp, Homo sapiens
  HUMUT593
  Located on chromosome 1
  Distance between a terminus base of telomere on chromosomal short arm and 5'-terminus of this base sequence : 192339005
  Distance between 3'-terminus of neighbour sequence of sequence listing upward to telomere on chrosomal short arm and 5'-terminus of this base sequence : 95352
catcacactgggggttaggggttcaacatatgaatttgaagaaaacacaatcattcagtccataacaaagatgaaaatattttcacaagtttattttgtgtgtgtgtgtgtgtgtgtgtataaaagcaatataccttcacaaggc

SEQ ID NO: 1659 - DNA, 426 bp, Homo sapiens
  AL139135.5_81124
  Located on chromosome 1
  Distance between a terminus base of telomere on chromosomal short arm and 5'-terminus of this base sequence : 192476237
  Distance between 3'-terminus of neighbour sequence of sequence listing upward to telomere on chrosomal short arm and 5'-terminus of this base sequence : 137087
gctatgaatttaggaccagtacaaaaaaattatattttatattatagttttagtgacagtatttaaggcacaattattaacagtgtaaattcataatttcccaataatttatgggcaatttataccaatagtcataattttcatgagacatttttgaatttttaaaatggaaaattgattgattgataaataataatttaagtattctattaccttttataccaattaaacatttatttcatttcaaaaatattttaacttgttaatgttaagtgatatttattgagaatatagtgcttgttccactttgaaattattaatactattattattattattattattttatgttttgcaaacttatcaggacttatagtcctggggagggaagtataagattcattgactatctaaatattccatgcc

SEQ ID NO: 1660 - DNA, 256 bp, Homo sapiens
  DISO7_10000753
  Located on chromosome 1
  Distance between a terminus base of telomere on chromosomal short arm and 5'-terminus of this base sequence : 192605724
  Distance between 3'-terminus of neighbour sequence of sequence listing upward to telomere on chrosomal short arm and 5'-terminus of this base sequence : 129061
gcaatgtacctaaggccttgttattttatattatagatagataaatagatagatagatagatagatagatatagatagatagatgatagatagatagatagatagatagatagatagatagatagatagatagacagatagatagatatccctgctattgagcaaaagaaaattcaaaatcaactttgaattttgcagcattataaagtttgtcttatatgcaatcctttctaaaggcagaggatttagctacctt

SEQ ID NO: 1661 - DNA, 145 bp, Homo sapiens
  DISO7_10000754
  Located on chromosome 1
  Distance between a terminus base of telomere on chromosomal short arm and 5'-terminus of this base sequence : 192613198
  Distance between 3'-terminus of neighbour sequence of sequence listing upward to telomere on chrosomal short arm and 5'-terminus of this base sequence : 7218
ctatcatcatgatgtcttaaattccctatctcaacctttctctctctctctctctctctctgtctctgtctgtctctctctctctctctgtctctagctctatctcatctttttgttcttttgcaatcacctattacttccattc

SEQ ID NO: 1662 - DNA, 454 bp, Homo sapiens
  chr1.fa.O7frz.220425011
  Located on chromosome 1
  Distance between a terminus base of telomere on chromosomal short arm and 5'-terminus of this base sequence : 192729016
  Distance between 3'-terminus of neighbour sequence of sequence listing upward to telomere on chrosomal short arm and 5'-terminus of this base sequence : 115673
aattatttgcactcatgaattaacatagtgttatttaaaagtagacttgtattagctgtaaatgcatattgcaaattggcaaacgtgatggcagccatcagaaaaagtgtgtgtgtatgtgtgtgtgtgtgtgtgtatatactgtgtatgtatatatctatatacactttttgtgtaaatatataaataatatgctaagaaagaaaagaaaatggaaccatataaagtgtccagttaaaaccacagaaggaagaaaaggaatgagagacaaaaatagaaacaaaaagaagtcaacaaatagaatacaataacaaaaaatggtaggtatttacccaagtatatcaataatcactttaaatgtcagttatttaaatgtaccaattaaaaggcagagactgtcagagaggaatgaaaaaatagactcaactatatgttgtctgtaagaaacagaatt

SEQ ID NO: 1663 - DNA, 420 bp, Homo sapiens
  chr1.fa.O7frz.220496730
  Located on chromosome 1
  Distance between a terminus base of telomere on chromosomal short arm and 5'-terminus of this base sequence : 192798139
  Distance between 3'-terminus of neighbour sequence of sequence listing upward to telomere on chrosomal short arm and 5'-terminus of this base sequence : 68669
cttgactggtagcaatgattacagttcaaatcacaataaaaataaggagacacgatagactttatctagccccaattttacatagcaagaagaaactacacccgatatacaaaaatcatgcccagccacagcccctggtagggctctcataatttccaggcacatcatctagtattcttgatattttgaaattacatggtcataaagaagagattacatcacctcctttatctttatattcccatgactaaaaagatacagatagatagatagatagatagatagatagatagatacatacatacatacatacatacatacatacatacatacatagaaacataatcttcaaatagtaggcagcctttaaaatggctctcaataatctctgcctctttgtgttcatgtctttgtgtaacc

SEQ ID NO: 1664 - DNA, 105 bp, Homo sapiens
  DISD22_0000922
  Located on chromosome 1
  Distance between a terminus base of telomere on chromosomal short arm and 5'-terminus of this base sequence : 193094428
  Distance between 3'-terminus of neighbour sequence of sequence listing upward to telomere on chrosomal short arm and 5'-terminus of this base sequence : 295869
ccagcagtgacatttcctctcaaattttcttgctaatatagaaatcaattaattaaattaattaattaatttaggtggctaatttagaaatatctcttggtggcg

SEQ ID NO: 1665 - DNA, 144 bp, Homo sapiens
  DISD22_0000926
  Located on chromosome 1
  Distance between a terminus base of telomere on chromosomal short arm and 5'-terminus of this base sequence : 193277149
  Distance between 3'-terminus of neighbour sequence of sequence listing upward to telomere on chrosomal short arm and 5'-terminus of this base sequence : 182616
gatagtccaggttgctgaaagatttagatctaaagactgaaaattgggatatatattgagagagagagagagagagaacaaatggtaacctaaatttaataaaataataatagacaaattagggtaacaggcatatgagtactt

SEQ ID NO: 1666 - DNA, 237 bp, Homo sapiens
  DISD22_0000927
  Located on chromosome 1
  Distance between a terminus base of telomere on chromosomal short arm and 5'-terminus of this base sequence : 193427908
  Distance between 3'-terminus of neighbour sequence of sequence listing upward to telomere on chrosomal short arm and 5'-terminus of this base sequence : 150615
aatgaagtcatataacagaatgtgctttaaatattatgaatagtgcttgcgtgtgtgtgtgtgtgtgtgtgtgtgtttatacatgcgtattaggccgctgaaaagttttactgttctttccaggagagagactgccaacttttgaacctaattagaacaagtatattgcttcttcatatttttattaaggcaaagagagtctagttaaaaataattcaacttatcatggaaatgctg

SEQ ID NO: 1667 - DNA, 464 bp, Homo sapiens
  chr2.fa.O7frz.93929890
  Located on chromosome 1
  Distance between a terminus base of telomere on chromosomal short arm and 5'-terminus of this base sequence : 193879942
  Distance between 3'-terminus of neighbour sequence of sequence listing upward to telomere on chrosomal short arm and 5'-terminus of this base sequence : 451797
aaacctcagctaatagaaccactagatagacactataaaatatgtattttcaaagggactagagacaatttttaaaaattggagacatgagaagaagaaattacttgaaatacaaaattagccaggcatggtagtgcctgcctctaatcccagctactcgggaggctgaggcaggagaactgcttgaacccgggaggtggaggttgcagtgagccccattgcactccagcctgggcaacaagagcgaaactccatcacacacacacacacacacacacacacacacacacacacacgaaaaataaaaggtctcctgctgggacacagactagttagagaaaggaaaaataaacaaatgatagtatgtgtattaataaaagaactagcaacacccactgcttagttgtgataataaaaactgcacattaagataggcagaaaaacagaacagccttgatacggtt

SEQ ID NO: 1668 - DNA, 185 bp, Homo sapiens
  chr2.fa.O7frz.93462246
  Located on chromosome 1
  Distance between a terminus base of telomere on chromosomal short arm and 5'-terminus of this base sequence : 194194812
  Distance between 3'-terminus of neighbour sequence of sequence listing upward to telomere on chrosomal short arm and 5'-terminus of this base sequence : 314406
ttcgaatagaatctttgaatgaaattgaatggaatcagcatgaaatggaatctaaaggaatcatagaatggtatcgaatggaatcatcatcgaatggaatggaatggaatggaatggaatggaatcagcatcgaatggaatcaaaagcaatcattcaatggactctaatagaatcagcgaataga

SEQ ID NO: 1669 - DNA, 154 bp, Homo sapiens
  chr2.fa.O7frz.93677299
  Located on chromosome 1
  Distance between a terminus base of telomere on chromosomal short arm and 5'-terminus of this base sequence : 194311091
  Distance between 3'-terminus of neighbour sequence of sequence listing upward to telomere on chrosomal short arm and 5'-terminus of this base sequence : 116094
gcatgatttactgaagtcaaaggtatgtacatccaacaattttaccccttggggtgtatatatatatacacacacacacacacacacacacacacacacatatacgtacatctctacacccaacagaaatgtgttcactgtgctacaagagcta

SEQ ID NO: 1670 - DNA, 202 bp, Homo sapiens
  chr2.fa.O7frz.93583594
  Located on chromosome 1
  Distance between a terminus base of telomere on chromosomal short arm and 5'-terminus of this base sequence : 194471887
  Distance between 3'-terminus of neighbour sequence of sequence listing upward to telomere on chrosomal short arm and 5'-terminus of this base sequence : 160642
ttcgaatagaatctttgaatgaaattgaatggaatcagcatgaaatggaatctaaaggaatcatagaatggtatcgaatggaatcatcatcgaatggaatggaatggaatggaatggaatggaatcagcatcgaatggaatcgaaagcaatcattcaatggactctaatagaatcatcgaatagacttgaatgtaaccatca

SEQ ID NO: 1671 - DNA, 268 bp, Homo sapiens
  chr1.fa.O7frz.221699876
  Located on chromosome 1
  Distance between a terminus base of telomere on chromosomal short arm and 5'-terminus of this base sequence : 194680594
  Distance between 3'-terminus of neighbour sequence of sequence listing upward to telomere on chrosomal short arm and 5'-terminus of this base sequence : 208505
acagctgaactacaactagcagagattttttaatcctcttcctcatctctattcctaataagagataacagtgaagaaacagaaaaaaaaattcaaatgaggttttcccttgatgctgccttagtgcgtgtgtgtgtgtgtgtgtgtgtgtgtgtgtgtccttcttatggtaggcagaattccaagattgcctccaagtttctcaggattgtcattccttggtttataggacttacaaccatatatctttgagtgtaggcttaacatg

SEQ ID NO: 1672 - DNA, 189 bp, Homo sapiens
  D1S2625
  Located on chromosome 1
  Distance between a terminus base of telomere on chromosomal short arm and 5'-terminus of this base sequence : 194784548
  Distance between 3'-terminus of neighbour sequence of sequence listing upward to telomere on chrosomal short arm and 5'-terminus of this base sequence : 103686
tcctctgaactcccacagtgacttgattatgaaatataccactttcagccttctttttgcagttaagttttgtggagtgtgtgtgtgtgtgtgtgtgtgtgttgttgttgttgttgctgttgtttgttttgttttgagacagggtctcactatgacacctaggctgaagtgcggtgggatgattagagc

SEQ ID NO: 1673 - DNA, 398 bp, Homo sapiens
  chr1.fa.O7frz.222022801
  Located on chromosome 1
  Distance between a terminus base of telomere on chromosomal short arm and 5'-terminus of this base sequence : 194996395
  Distance between 3'-terminus of neighbour sequence of sequence listing upward to telomere on chrosomal short arm and 5'-terminus of this base sequence : 211658
gcattaagattaaatttcactgagtgtgtggcgctatgtttggaacaaagaagatgcacggaaatactccctgtgttgaactgaatttaactgaaacttaaaaattatcaaagaaaaagaataaattctagccttatccctgtatctattaaagactgaatatcaaaaaataaaatgtttagaattggtctagattcttccattgtcctgctgaatttcttggccagtgatattccaagtgtggttcctggaccagactatgggttactaaataatttatatataatttgtgtgtgtgtgcacgtgtgtgtgtgtgtgtgtgtgtgtgtgtaaaatcgcctcaggcatttttccacactggaagtcacctcacagccttaggtagcaaaactatgcct

SEQ ID NO: 1674 - DNA, 455 bp, Homo sapiens
  chr1.fa.O7frz.222101856
  Located on chromosome 1
  Distance between a terminus base of telomere on chromosomal short arm and 5'-terminus of this base sequence : 195075397
  Distance between 3'-terminus of neighbour sequence of sequence listing upward to telomere on chrosomal short arm and 5'-terminus of this base sequence : 78604
tgtagaaacagagcacttgaagcatccttttaacttctggtcagagatttgtggcaaagttgtcaaatcctaaaactgccttatctcaaaggtgaggggaaacctctggttcctgaagtgacagtgagggaaggagaaggaataggaactgaaacaggggaatcaaaaaaagaagacgaagaaccaaaaaggattaaagaataaagtccagcaaatgccccatcatgaaaagtcaaaggcaagatggacaaaatcaacctggtgaatgaaacagcacatatggacaactgttttccttttctctgctttttttctatctctgtgtgtgcctaggccacctgggctttataaaacacgtgtgtgtgtgtgtgtgtgtgtgtgtgtgtgtgtgtgtgtgtgtgtgtatgtgtgtgtgtgtaacttcatttttagtctgacatctcactaaactcaat

SEQ ID NO: 1675 - DNA, 257 bp, Homo sapiens
  AL136454.6_75258
  Located on chromosome 1
  Distance between a terminus base of telomere on chromosomal short arm and 5'-terminus of this base sequence : 195213142
  Distance between 3'-terminus of neighbour sequence of sequence listing upward to telomere on chrosomal short arm and 5'-terminus of this base sequence : 137290
atacgcttaatcaattggaatctaactggcatcggcattccaggctctggtccactctggagatatagaagaaagtggctaacaaggacacatacccacagctctgtttcacaaaatgcataaaatataataataataacagctcacacttacataacacttactgtgtgccaggcattgctcgaagcagtgtgtgtgtgtgtgtgtgtgtgaatgagtgtgtatcatataatcttgacaattctatgagaaagttg

SEQ ID NO: 1676 - DNA, 425 bp, Homo sapiens
  AL136454.6_117044
  Located on chromosome 1
  Distance between a terminus base of telomere on chromosomal short arm and 5'-terminus of this base sequence : 195254852
  Distance between 3'-terminus of neighbour sequence of sequence listing upward to telomere on chrosomal short arm and 5'-terminus of this base sequence : 41453
gtctggagtgaatcatagacataggatctagggaaagacctaactataaataaataaatacatatacataaatactaatctttttagatatataaagaaatatgtaacatataaatagaggcatcaatttacataaaattacaatagaaatgtttatatatacaatagtagagggctgtatgccattgtgtaatgatatttggccatatacgaaagaagcaaagaacactattcaataaataatgcaggcacacatgcacacatgcacacacacacacacacacacacacacaaaagatctctaccttaaaccatacacaaaagtaaattccaggtagattttaaaactaaatataaaaaccatcaaactctacagactttagaagaaaatatttaaaaattcttcgataacttcaaggtagaaa

SEQ ID NO: 1677 - DNA, 164 bp, Homo sapiens
  AL136454.6_125497
  Located on chromosome 1
  Distance between a terminus base of telomere on chromosomal short arm and 5'-terminus of this base sequence : 195263466
  Distance between 3'-terminus of neighbour sequence of sequence listing upward to telomere on chrosomal short arm and 5'-terminus of this base sequence : 8189
cattcctgagttacttcacttaaaataatagtctccaatctcacccaggtcgctgcaaatgccattaattcattcctttttattgctgaatagtattccatcaaatatatatatatatatatatatatatatatatatatataaacaagtggataaagaaactg

SEQ ID NO: 1678 - DNA, 297 bp, Homo sapiens
  AL136370.4_113722
  Located on chromosome 1
  Distance between a terminus base of telomere on chromosomal short arm and 5'-terminus of this base sequence : 195492651
  Distance between 3'-terminus of neighbour sequence of sequence listing upward to telomere on chrosomal short arm and 5'-terminus of this base sequence : 229021
tatgtttggattcaaccataacagaaaaagagaggtctagaaaagagacagagagagagagagagagagagagagagagagagagagagagagagagaaagtctaatacaatgaagttttaatagagcaatatttgttttaaggtttagttgtataaacagatgtgaaagccacctgtttgctctataagtgctatttgaaaattacaacaaaggaaaggacaaagtgcatttcagcagataacaggatataagcaaagatcacacaatagttaatagactagcaggactagaatcc

SEQ ID NO: 1679 - DNA, 266 bp, Homo sapiens
  HUMUT786B
  Located on chromosome 1
  Distance between a terminus base of telomere on chromosomal short arm and 5'-terminus of this base sequence : 195602151
  Distance between 3'-terminus of neighbour sequence of sequence listing upward to telomere on chrosomal short arm and 5'-terminus of this base sequence : 109203
attacactccagctgggcgacagagtgagactccacctcaaaaagaaagaaagaaagaaagagagagagagagagggagagagaaagaaagaaggaaagaaagaggaagaaagaaagaaagagaaagaaagaaggaaagaaggaaagaaaggaaagaaagaaagaaggaaagaaaaagaaagaaagaaagactgacaaaatacaaccatataaaatgctcaattaaaaccacaaacagctgggcgcagtggctcaggcctgtaatc

SEQ ID NO: 1680 - DNA, 379 bp, Homo sapiens
  chr1.fa.O7frz.222746963
  Located on chromosome 1
  Distance between a terminus base of telomere on chromosomal short arm and 5'-terminus of this base sequence : 195709780
  Distance between 3'-terminus of neighbour sequence of sequence listing upward to telomere on chrosomal short arm and 5'-terminus of this base sequence : 107363
gtggtatttggttacatgactaagtagtttgtgagattttggtgtgcccatcacccgaaccgtatatgctgaacctgatttgtagtcttttatccctcacccccctcccacagtttccccctgcatccccaaagtcaatttcgtcattctcatgcctttgcatcctcatagcttagctcccacttacaaatgagatcattcgatgtttggttttccattcctgagttacttcacttaggctgatagtctccagttccatccagattgcagcaaatggcattaatgccttcccttttatggctgagtagtattccatgatatatatatatatatatatatatatatccacatactacggtttctttatccgctagttgat

SEQ ID NO: 1681 - DNA, 284 bp, Homo sapiens
  chr1.fa.O7frz.222851400
  Located on chromosome 1
  Distance between a terminus base of telomere on chromosomal short arm and 5'-terminus of this base sequence : 195907439
  Distance between 3'-terminus of neighbour sequence of sequence listing upward to telomere on chrosomal short arm and 5'-terminus of this base sequence : 197280
cttaatatggtttgcagatgagtcacatagtgtattaggatacatttctttaccctttaattacttaatttttatgtaccaatcactaattaaaccccatactcactgacagaacattaaaacatctctcaatgtagtcatacatccaagaaatctatgagttcaatgtgtgtgtgtgtgtgtgtgtgtgtgtgtgtgtgtatgtgtgcacatgcgtgcatgcaggcttatcctttctgaaaactttcatcttttttccccggtcagaacttgctttctaggtt

SEQ ID NO: 1682 - DNA, 241 bp, Homo sapiens
  chr1.fa.O7frz.223256911
  Located on chromosome 1
  Distance between a terminus base of telomere on chromosomal short arm and 5'-terminus of this base sequence : 195936086
  Distance between 3'-terminus of neighbour sequence of sequence listing upward to telomere on chrosomal short arm and 5'-terminus of this base sequence : 28363
aatggtgtagaatgtacacttcacagctatccctcctggggaatgtgaaatatgtacatctatatacctatgtctctatctatcattgatctatctctatctatctattatctatctatctatcttccatctatctatcatctattatctattatctgtctttaaaaaatctatcatctatcatctgtctatttaatctattatccatttatcatctatctttcaatctgctatgtatcat

SEQ ID NO: 1683 - DNA, 191 bp, Homo sapiens
  chr1.fa.O7frz.223186699
  Located on chromosome 1
  Distance between a terminus base of telomere on chromosomal short arm and 5'-terminus of this base sequence : 196006125
  Distance between 3'-terminus of neighbour sequence of sequence listing upward to telomere on chrosomal short arm and 5'-terminus of this base sequence : 69798
gatagcctttgagaactctttaaggatgaataggaatttgccaaataatttagcagagaaaagtttttcaggaacaggacattgacaaaggtgcagagtcacgaatggtttgtgtgtgtgtgtgtgtgtgtgtgtgtatctattttgtaaagagaatggtagcaaaaattactgttctaagcgtaagattg

SEQ ID NO: 1684 - DNA, 462 bp, Homo sapiens
  chr1.fa.O7frz.222971624
  Located on chromosome 1
  Distance between a terminus base of telomere on chromosomal short arm and 5'-terminus of this base sequence : 196051373
  Distance between 3'-terminus of neighbour sequence of sequence listing upward to telomere on chrosomal short arm and 5'-terminus of this base sequence : 45057
cagtatcgtaggtatccatctagtgcatctctactggattgaggtgtaatctttccttgcctccctgctctttttctggtatttaccaattcagcacacatgaaactggaatttacaaggtgcgtttttgccagtgttcttcctaggtggagtcttgctactttagaaacactttatcccagggtgcatcagaccactgttcatgcctaatgtgtccagatacttcctaatacttcgatttctcgaaggtatacctatgaattttaagaaaagtactggctccaccctttctctggctgacatatgtctcgtgtcatatgaatatacctcagtatacagactcagtgttaaactcaactctgaggttggaaggagagagagagagtgtatgtgtgtgtgtgtgtgtgtgtgtgtgtctgtgtgtgtgtgtgtgtgtgtagctgctagctgtgattctcatta

SEQ ID NO: 1685 - DNA, 346 bp, Homo sapiens
  chr1.fa.O7frz.223370516
  Located on chromosome 1
  Distance between a terminus base of telomere on chromosomal short arm and 5'-terminus of this base sequence : 196336094
  Distance between 3'-terminus of neighbour sequence of sequence listing upward to telomere on chrosomal short arm and 5'-terminus of this base sequence : 284259
ctgagttggttctttaaggatcagccactgccttaagccactacacagtgcaggaaagataaaggggcttccacccattttgaccacagttaattcataaatcaattaatctgctcaagtagttgagagttgaccatatttatgtatctctattatactgttagactcccaaatattcttattaaaatgttggtctaataaactccaccctgactaacttcaaaacacacacacacacacacacacaagcgctgacttcattatcagcaaactacaggctttactttagtccctggagcaggtgacaatttgatttttaagtgtcttactgatactttgcattgat

SEQ ID NO: 1686 - DNA, 182 bp, Homo sapiens
  HUMUT2402
  Located on chromosome 1
  Distance between a terminus base of telomere on chromosomal short arm and 5'-terminus of this base sequence : 196455929
  Distance between 3'-terminus of neighbour sequence of sequence listing upward to telomere on chrosomal short arm and 5'-terminus of this base sequence : 119489
agtggaggagaagaaggaatgcatctgtttatctatctatctatctatctatctatctatctatctatctatctatctggagtatttttgttacctatgttcgctttgccttcactgtgatgtaagaggcactcagatgaccaacatttaccctttctgatgttttccttatgtgtttcctt

SEQ ID NO: 1687 - DNA, 192 bp, Homo sapiens
  G07788
  Located on chromosome 1
  Distance between a terminus base of telomere on chromosomal short arm and 5'-terminus of this base sequence : 196573652
  Distance between 3'-terminus of neighbour sequence of sequence listing upward to telomere on chrosomal short arm and 5'-terminus of this base sequence : 117541
ttgctaatcaaataacaatgggaaaagtcatgtactttgtagtgtgatagacaatttttagtgtctgcacacattgaaattatctatctatctatctatctatctatctatctttctatctatccatccatctatctatctctgtatctatatctctgtctctctctctatatatattttttgggggggatg

SEQ ID NO: 1688 - DNA, 201 bp, Homo sapiens
  D1S412
  Located on chromosome 1
  Distance between a terminus base of telomere on chromosomal short arm and 5'-terminus of this base sequence : 196581662
  Distance between 3'-terminus of neighbour sequence of sequence listing upward to telomere on chrosomal short arm and 5'-terminus of this base sequence : 7818
taggacttttcaacttccacagtcatttgagtccttccttctaataaattttacacacacacacacacacacacacacacacacacacacacacacatgctattggctctgcttctctagagaacactaatacttagcactaaccccaaatattatgtccactcattcatccatccattcattcattgattctgtgcctat

SEQ ID NO: 1689 - DNA, 196 bp, Homo sapiens
  Z23298.1_69
  Located on chromosome 1
  Distance between a terminus base of telomere on chromosomal short arm and 5'-terminus of this base sequence : 196581673
  Distance between 3'-terminus of neighbour sequence of sequence listing upward to telomere on chrosomal short arm and 5'-terminus of this base sequence : -190
aacttccacagtcatttgagtccttccttctaataaattttacacacacacacacacacacacacacacacacacacacacacacatgctattggctctgcttctctagagaacactaatacttagcactaaccccaaatattatgtccactcattcatccatccattcattcattgattctgtgcctatttctat

SEQ ID NO: 1690 - DNA, 295 bp, Homo sapiens
  AL356272.6_45879
  Located on chromosome 1
  Distance between a terminus base of telomere on chromosomal short arm and 5'-terminus of this base sequence : 196627845
  Distance between 3'-terminus of neighbour sequence of sequence listing upward to telomere on chrosomal short arm and 5'-terminus of this base sequence : 45976
tataaactttggaagtgccaagtagtgtacaatgcttgattgagtaaacactatataaataatatattttattatgaagaagataatcctccatgttttattctaaagctttaaagtttttttacgttaagtttataatccaattgataataatttctgcatagtatctgaggtggagaccttccttccttctttccttccttccttccttccttccttccttccttccattcttctttccttcctttctgaaatggagaagctatagtgcaggtgcaggttctattggatgtaa

SEQ ID NO: 1691 - DNA, 220 bp, Homo sapiens
  D1S1614
  Located on chromosome 1
  Distance between a terminus base of telomere on chromosomal short arm and 5'-terminus of this base sequence : 196628010
  Distance between 3'-terminus of neighbour sequence of sequence listing upward to telomere on chrosomal short arm and 5'-terminus of this base sequence : -130
atctgaggtggagaccttccttccttctttccttccttccttccttccttccttccttccttccattcttctttccttcctttctgaaatggagaagctatagtgcaggtgcaggttctattggatgtaaattccattttttattcattgacctaaaataccatctctttcacatgtaaagtatttatgtatgagggctgtttctctactctgtcttgtg

SEQ ID NO: 1692 - DNA, 268 bp, Homo sapiens
  DISD22_0000948
  Located on chromosome 1
  Distance between a terminus base of telomere on chromosomal short arm and 5'-terminus of this base sequence : 197079643
  Distance between 3'-terminus of neighbour sequence of sequence listing upward to telomere on chrosomal short arm and 5'-terminus of this base sequence : 451413
gttgcacctatgtaatgactcctttttgactacaaaattggacttagttttattttagacgatttcattgtctttctatttttacaatatctaacctgaaattttgtgtgtgtgtgtgtgtgtgtgtgtgtgtgtgagagagagagagagagagagagagagagagacagagagagagacagacagagagagagaatcaggaattagcttttgaaatctgtatagcacaaaattttaagtcgtaattagggtgcccaagacattctaa

SEQ ID NO: 1693 - DNA, 430 bp, Homo sapiens
  chr1.fa.O7frz.220725968
  Located on chromosome 1
  Distance between a terminus base of telomere on chromosomal short arm and 5'-terminus of this base sequence : 197477958
  Distance between 3'-terminus of neighbour sequence of sequence listing upward to telomere on chrosomal short arm and 5'-terminus of this base sequence : 398047
gcatttgagtcagtagactgagggcaaaaaatttacctcactaacatgcatgggcatcattcaatctgcaaagaacatgaatagaacaaaaagaggaagggtaaattcgctctctctgaattgggtcatctatcttctcctactcttggacatcagcactcctgttgtaaggcatgcagactcagagtaaattataccactttcctggttcttcatcttgcacacagaagatcatgggacttcttgggctctgtaatcatgtgagacaattcccataataaaaaaaaaaataaatcacaaacacacacatacaccacacacacacacacacacacacacacacacttccttctacacccaaagctgtaggttaattacttagtgtcttttataagactgtgaaagaaagatcagatactgctaatgctga

SEQ ID NO: 1694 - DNA, 189 bp, Homo sapiens
  Z23498.1_140
  Located on chromosome 1
  Distance between a terminus base of telomere on chromosomal short arm and 5'-terminus of this base sequence : 197692181
  Distance between 3'-terminus of neighbour sequence of sequence listing upward to telomere on chrosomal short arm and 5'-terminus of this base sequence : 213793
aagacagatgacatgctatcatccatggggtatagcaacagacctagaatatatatatactgtgataatcagaacagaaagaaaacaaaaactatgctgactgtacttagacagacagacacacacacacacacacacacacactcataatacataaatttaaaaatgtttgcaggaaatcatttaata

SEQ ID NO: 1695 - DNA, 159 bp, Homo sapiens
  D1S422
  Located on chromosome 1
  Distance between a terminus base of telomere on chromosomal short arm and 5'-terminus of this base sequence : 197692204
  Distance between 3'-terminus of neighbour sequence of sequence listing upward to telomere on chrosomal short arm and 5'-terminus of this base sequence : -166
catggggtatagcaacagacctagaatatatatatactgtgataatcagaacagaaagaaaacaaaaactatgctgactgtacttagacagacagacacacacacacacacacacacacactcataatacataaatttaaaaatgtttgcaggaaatca

SEQ ID NO: 1696 - DNA, 454 bp, Homo sapiens
  AL359835.9_137709
  Located on chromosome 1
  Distance between a terminus base of telomere on chromosomal short arm and 5'-terminus of this base sequence : 197808245
  Distance between 3'-terminus of neighbour sequence of sequence listing upward to telomere on chrosomal short arm and 5'-terminus of this base sequence : 115882
acctctgcactttcctcttaagtttaatgtgtatctgaaattgctgtaaaaaaaaaaaaaaatggccgggcgcattggctcatgcctgtaatcccagcactttgggatgccgaggcgggcggatcacttgagatcaagagtttgagatcagcctggccaacatggtgaaacctcatctctattaaaatatcaaaatattagccaggagtggtggcatgtgcctgtaatcccagctactcaagaggctgaggcaggagaaccgcttgaacctgggaggcggaggttgcaatgagccgagatcgttccactgcaccccagcctgggtgacagagcgagtctccatctcaaaataaataaataaataaataaataaataaataaataaataataaaattgctgtaaaaaagtctttatgaaaacaaacaaaaacacttgttcttaaatttgcaatgt

SEQ ID NO: 1697 - DNA, 320 bp, Homo sapiens
  chr1.fa.O7frz.221256958
  Located on chromosome 1
  Distance between a terminus base of telomere on chromosomal short arm and 5'-terminus of this base sequence : 197921400
  Distance between 3'-terminus of neighbour sequence of sequence listing upward to telomere on chrosomal short arm and 5'-terminus of this base sequence : 112701
cgttcatacttgttaccacaacacctatgcccatctacagttgaatgaataaaatacatatatatctacatatatatatggtgtgtgtatatacacacacacacacacacacacacacaatagaatactattcagccataaaacagaatgaaacactgtcatccgtgacaactaatgactgttttttatattggtggatattttaattttgttaagatgctaagtcagttgacagtccattgggaaaaagttctcttactctcaagggacatatagtttcatttttttaaaaaattgtcctatttgtatgaactggtatg

SEQ ID NO: 1698 - DNA, 314 bp, Homo sapiens
  chr1.fa.O7frz.221364030
  Located on chromosome 1
  Distance between a terminus base of telomere on chromosomal short arm and 5'-terminus of this base sequence : 198039961
  Distance between 3'-terminus of neighbour sequence of sequence listing upward to telomere on chrosomal short arm and 5'-terminus of this base sequence : 118241
tgttcatagaagttgaccaaactgaaatacaaatagaaaaagaaatcacaaacacacccacccacccacgcgcgcgcacacacacacacacacacacacacacacacacagaaacactgttgcttttgtactactctggctaacctgctgaggaaactgtcagacaaatccagaactgaaatattcgggaagaaaactaatttgggcttttgaaaaatatcatgttggggaactgttttagatggatgaacaacagattaaataaccaaatgcaataaataaactttgatggttgcatcctgttagaaagttta

SEQ ID NO: 1699 - DNA, 207 bp, Homo sapiens
  DID22N_0002189
  Located on chromosome 1
  Distance between a terminus base of telomere on chromosomal short arm and 5'-terminus of this base sequence : 198105783
  Distance between 3'-terminus of neighbour sequence of sequence listing upward to telomere on chrosomal short arm and 5'-terminus of this base sequence : 65508
gagttcattatgggattgtgggaatgtaattaaatgtaagatatttttgactttttccagaggggtgtgtgtgtgtgtgtgtgtgtgtgtgtgtgagagagagagagagagagagagtgagacagagacagagagagagaaactgagctagtccctttccctgaataagtgcccctccaccccaactcccttcccaagcactgctct

SEQ ID NO: 1700 - DNA, 219 bp, Homo sapiens
  DID22N_0002198
  Located on chromosome 1
  Distance between a terminus base of telomere on chromosomal short arm and 5'-terminus of this base sequence : 198595420
  Distance between 3'-terminus of neighbour sequence of sequence listing upward to telomere on chrosomal short arm and 5'-terminus of this base sequence : 489430
ttatgttcacgtcaaacatcaggtaattaaaaccaagaaacgttaacaatttacacaaagatacactaatttgagcttggatttaaacacagattagtcttttacaaagacttttacaagaatatatatatatatatatatttggagaaagagggagagttataaaatttaatcacattagaaaggtttattaaactcaataattatgcagaaatgtca

SEQ ID NO: 1701 - DNA, 255 bp, Homo sapiens
  D1S2757
  Located on chromosome 1
  Distance between a terminus base of telomere on chromosomal short arm and 5'-terminus of this base sequence : 198659835
  Distance between 3'-terminus of neighbour sequence of sequence listing upward to telomere on chrosomal short arm and 5'-terminus of this base sequence : 64196
ttttgtaatgactgaccagtgatgagtgtcttggcaatacatacatacacacacacacacacacacacacacacacacacacacacacagagcattaggccatttgcattactattaaggaatacatgacgctgggtaattcatagagaaaagaagcttaattggctcatggttcttcagggtgtacaggaaatgtagtgctggcatctgtttccggtgaggacctaaggaagcttacaaacatagcagaaggca

SEQ ID NO: 1702 - DNA, 452 bp, Homo sapiens
  chr1.fa.O7frz.224183149
  Located on chromosome 1
  Distance between a terminus base of telomere on chromosomal short arm and 5'-terminus of this base sequence : 198803844
  Distance between 3'-terminus of neighbour sequence of sequence listing upward to telomere on chrosomal short arm and 5'-terminus of this base sequence : 143754
cctggcctaattttattgttagataataatactattatgctcaataacatttatatgtggtttccattatataataacatttgagaagtgtgagtgggaaaatctcccaaaaaagataatcatctaaattttcttttgcaagatttaattgtattttattatatatatatattatatatatatatatataatatatatatatatatatatatagagagagagagagagagagacagagagacagagacagagagagatacgtatttttttaacttttaatttcaggggtacatgtgcaggtttgttacataggtaaacttatgtcgtgggggtttgttgtacagattatttcattacctagatattttgtaaaaaagctatttctccacgttacactactatctgcactgtttcccaataccacaaccctgaggtagaatttaatgtatcca

SEQ ID NO: 1703 - DNA, 442 bp, Homo sapiens
  chr1.fa.O7frz.224263952
  Located on chromosome 1
  Distance between a terminus base of telomere on chromosomal short arm and 5'-terminus of this base sequence : 198878142
  Distance between 3'-terminus of neighbour sequence of sequence listing upward to telomere on chrosomal short arm and 5'-terminus of this base sequence : 73846
tagttacactgcaagtccagactttacccctttgcaatatatccatgtaacaaaactgcgtttgtactctctaaatctatttttaaaaaagatctgaaagaacgattgccaaactaatcaaaagttaaaacaaagagcgggcaaaaagtatcattattttggacaaaggcaaaacatatacgtggtgcattcttcactagtcaactaaattgtacatacattaaatgtatttttaaaaatttataatataaaagttcacacacacacacacacacacacacacacacacacacaggcaatatttttcttcagtagcaaaagtggccaacatttgttgataatctactatactcttaactttgtagagatggtactcatttttcccttaaggcataaaagttaattaagtaagttgcccaaggcaaattaggcctcaaagtgc

SEQ ID NO: 1704 - DNA, 446 bp, Homo sapiens
  chr1.fa.O7frz.224352953
  Located on chromosome 1
  Distance between a terminus base of telomere on chromosomal short arm and 5'-terminus of this base sequence : 198967506
  Distance between 3'-terminus of neighbour sequence of sequence listing upward to telomere on chrosomal short arm and 5'-terminus of this base sequence : 88922
gtgcgtatcttgcaatattaactaattgtgattttgtttgcttgtttgctgttttctttttctattggtgagttttgtgtgtgtgtgtgtgtgtgtgtgtgtctagtctagtgtttgtgtgtattatttaattttccttttcctcttatattaggattatagcaaatggtggtataattaagcatcctggaaaaaaaaattagcatcctggttgagaccaaatagattatcctgcttgtaatcatttgcacactgtttaatttaatggaataaaaacttaagtcactctctttaactatttatgatttaaagtaaatttaaatttagtgagtaaaactattattcgaagtaaatttattttataaagtaaattatctaaattaaagaacttcattttaatctttttatatttatgttacctcgactataccaggtactaaaggcat

SEQ ID NO: 1705 - DNA, 188 bp, Homo sapiens
  D1S2794
  Located on chromosome 1
  Distance between a terminus base of telomere on chromosomal short arm and 5'-terminus of this base sequence : 199178715
  Distance between 3'-terminus of neighbour sequence of sequence listing upward to telomere on chrosomal short arm and 5'-terminus of this base sequence : 210763
caaatgttgtgaagcagatgtaataccttcacttaataatcaatgatatatgtaacttactgacatattcagaaagtgtgtgtgtgtgtgtgtgtgtgtctaatcagataactgtaagtgacagagtcaagactcaaatttcaaattctgcatgactccaatcttcactctattcacagcaccaccgc

SEQ ID NO: 1706 - DNA, 231 bp, Homo sapiens
  chr1.fa.O7frz.224715406
  Located on chromosome 1
  Distance between a terminus base of telomere on chromosomal short arm and 5'-terminus of this base sequence : 199209267
  Distance between 3'-terminus of neighbour sequence of sequence listing upward to telomere on chrosomal short arm and 5'-terminus of this base sequence : 30364
ttcctatttgacgagttatgtaacctttggaattcttagtcccttcattcttataagggtgactattctcacttcaccgtgtgtgtgtgtgtgtgtgtgtgtgtgtgtgtgtgtgtgtgtgtaaagttaggaaacatgtttttacattttattttatttatttatgtattttttttaagagacaaggtctttctccattgcccaggctctaatagagtggcatgatcctag

SEQ ID NO: 1707 - DNA, 474 bp, Homo sapiens
  chr1.fa.O7frz.224636008
  Located on chromosome 1
  Distance between a terminus base of telomere on chromosomal short arm and 5'-terminus of this base sequence : 199261046
  Distance between 3'-terminus of neighbour sequence of sequence listing upward to telomere on chrosomal short arm and 5'-terminus of this base sequence : 51548
gtatacctcaactgtgagcaataccagtcaggtaaagtcagtcataattatgtaaatactgaatactaatttaacaataaatgattctataacattggaaggatgggagagaagggagatgtgtgtgtgtgtgtgtgtgtgtgtgtgtgtgtgtgtgtgtgagatggtggaaatcaagatctaatattggaaaagcccaaaaaagcagtataatttttttaagaaaaaaactacaataagaactgctaagagttaaaggtagttgtctctgggggaaataaaatcaggggcaggcagagaaacaccaaaggcttgtggtttttcgctaccaatccaacagtataatttggtttcttttaaactatgtatatgcttttatttgattaaaagttaaaataaaaatctacatataaaagatatactgatggcaaatgaatatatgaaaagattctccaagtcatagacatgtaaatt

SEQ ID NO: 1708 - DNA, 480 bp, Homo sapiens
  AL360016.9_74469
  Located on chromosome 1
  Distance between a terminus base of telomere on chromosomal short arm and 5'-terminus of this base sequence : 199359970
  Distance between 3'-terminus of neighbour sequence of sequence listing upward to telomere on chrosomal short arm and 5'-terminus of this base sequence : 98450
aggataattccagataacagagactatgcaataatctgaaggcaattatttaataatttaatggtctcttaccatttctgcccccatgtaagtcatctctagtagttgatctttgttccagagctcccagaattgaccaggagtttattatgtctgcattattgtttggaagcttttcctttccaatcctcttcctccctcttttaactatacaagtgttactcttcaataaatcttctgcactcctaaatttatctcatagtctgtgacctaggaggcctaaacacacacacacacacacacacacacacacacacaaatgtgtacactgccagttgtacatatatgaattctagacttaatgtgtatggtagataagtttgtatgtcattagaactcttcattctacctctaatgtagttatattgtacctgtttattattataaatacataaatattgtcatctaagcagacactaa

SEQ ID NO: 1709 - DNA, 136 bp, Homo sapiens
  DISO7_10000756
  Located on chromosome 1
  Distance between a terminus base of telomere on chromosomal short arm and 5'-terminus of this base sequence : 199636413
  Distance between 3'-terminus of neighbour sequence of sequence listing upward to telomere on chrosomal short arm and 5'-terminus of this base sequence : 275963
aatatagcctcctggagtgtgaattttatttttaaagtttgtgtgtgtgtgtgtgtgtgtgcatatgtgcatgtgcacacatatattttccaagatggttttaataactatcttatctggtgcttatatgaaacag

SEQ ID NO: 1710 - DNA, 179 bp, Homo sapiens
  chr1.fa.O7frz.225166787
  Located on chromosome 1
  Distance between a terminus base of telomere on chromosomal short arm and 5'-terminus of this base sequence : 199735981
  Distance between 3'-terminus of neighbour sequence of sequence listing upward to telomere on chrosomal short arm and 5'-terminus of this base sequence : 99432
atccacttgactttattagcctacttaaacttattttattaagtggaatagttagaatgtttaaacatatatatatatatatatacacttatggtagatgatataacataatgatgtatggctgggaatataaataaaactctcttcatcacacaattgtgaattaaatgctcaactat

SEQ ID NO: 1711 - DNA, 377 bp, Homo sapiens
  HUMUT6620B
  Located on chromosome 1
  Distance between a terminus base of telomere on chromosomal short arm and 5'-terminus of this base sequence : 199772699
  Distance between 3'-terminus of neighbour sequence of sequence listing upward to telomere on chrosomal short arm and 5'-terminus of this base sequence : 36539
gcactgaatagaggtaacaaagtttgttggtgcatttaccttttgaaggatatcttggtttctttcagtttgggcaattatgaattaaactattttaaaccttaaaaaatgaacaaatttctgaaatcatgatgatgatgatgatgatgatgatgagtgagtaccatctattgtacactaacactgtgcttggcacagggctgtcctttatcatattttgacatttattcctcacaaaactcttaaggataagacttatatctccattttccagataaggaactgaaacacatcctttcagaaccaaaataaagataaatatttctggcccaatgtccaagctcttaacaagaaatgaaaaaggtaaatagggaact

SEQ ID NO: 1712 - DNA, 438 bp, Homo sapiens
  chr1.fa.O7frz.225495623
  Located on chromosome 1
  Distance between a terminus base of telomere on chromosomal short arm and 5'-terminus of this base sequence : 199965147
  Distance between 3'-terminus of neighbour sequence of sequence listing upward to telomere on chrosomal short arm and 5'-terminus of this base sequence : 192071
tcgaatggtatactttgatcaggtcaaacccatcaggccttctccttacagagtttaaatgggaaacatctgttttagtttccctcatatctccttcatacctgtatgtttctaaagccatatcccaggcttagtcatgaaacagaaataagaaaaagcaggaaccctaacactggtctacaagccttttttagaaatgcttggggcctgatgtgtttccgaattcagaattcgggggatttagaaaggtaattatgtaaatatattatatatttaattataccttcagtgggatttgaggtaatactcccaatgacatatattaatatttctgtgtgtatatacctgcacacacacacacacacacacacacactcacaagtgtaaaacacagagatgataagatacagcctctcatcagtacaagtcagtttctgc

SEQ ID NO: 1713 - DNA, 425 bp, Homo sapiens
  chr1.fa.O7frz.225807112
  Located on chromosome 1
  Distance between a terminus base of telomere on chromosomal short arm and 5'-terminus of this base sequence : 200293616
  Distance between 3'-terminus of neighbour sequence of sequence listing upward to telomere on chrosomal short arm and 5'-terminus of this base sequence : 328031
tctgagtaatgctttgaagtctgaagatgacattatatgcaagagtttctaaaaaattttgaatactatatatatatatatatatatatatatgtatatatatatatatgcttgagaaatgacagttttgtagaaagtgggagttttccaagatccagctaatgaaaagctttactctcacaatgaatcaatgagatacaggattttagtctctctttatatacatatcctatcatgtatatcttctaaaatttgttgtacagtctccataatatggccaacgttatcttacctatgatacctgcgtggctgctgtaggtattttattttgctttatacttaaaattacaaatttatctcaatttatctttgattttatagaaaatatacctttagtttttgttcatatcgtagcaataactttc

SEQ ID NO: 1714 - DNA, 442 bp, Homo sapiens
  chr1.fa.O7frz.225921621
  Located on chromosome 1
  Distance between a terminus base of telomere on chromosomal short arm and 5'-terminus of this base sequence : 200529093
  Distance between 3'-terminus of neighbour sequence of sequence listing upward to telomere on chrosomal short arm and 5'-terminus of this base sequence : 235052
cagtaggcagtactgttacgaggctgaaagccaaaaaagtttacattactgtttacagccatgttggccagaatcaagaagtgtgaaaactttcttagctagcgttttattataatgaaatactgtacatatttaattatgtaatataaatatacattttaaaaggtgtctttaaacagacatatacataaaacaaggttatgtattgaacacttgacaaaaaatgtgaccaaaggtttagaagtagtagtttagtattcactaatgcagagttgatggcaactttatagaacataaatagcacaaataatgagaactgactctgtgtgtgtgtgtgtgtgtgtgtgtgtgtgtgtgtgtgtgtgaatcagcacactgaggggtacgcaaaaaagtgctagacacagtccctgactttgtgttaacatttgaggaacagaca

SEQ ID NO: 1715 - DNA, 300 bp, Homo sapiens
  AL049744.8_90836
  Located on chromosome 1
  Distance between a terminus base of telomere on chromosomal short arm and 5'-terminus of this base sequence : 200684701
  Distance between 3'-terminus of neighbour sequence of sequence listing upward to telomere on chrosomal short arm and 5'-terminus of this base sequence : 155166
actacctcattgtagtcatctgattttttcgtctcttttacttcttcactttgatacctacttaaaactcttccttagcacatatttgttttcacaatgagagatccatctgtttttcccaaatgtattactgcatttctattcttgcttctcttgaacactaattgattcacacacacacacacacacacacacacccctcaaagactctacatttataaaacatttttcttttataatttttttccatttctcagtcacaagtacaagtaaaacctgaatattcaatactatgcttgc

SEQ ID NO: 1716 - DNA, 248 bp, Homo sapiens
  D1S2816
  Located on chromosome 1
  Distance between a terminus base of telomere on chromosomal short arm and 5'-terminus of this base sequence : 200684815
  Distance between 3'-terminus of neighbour sequence of sequence listing upward to telomere on chrosomal short arm and 5'-terminus of this base sequence : -186
tttcccaaatgtattactgcatttctattcttgcttctcttgaacactaattgattcacacacacacacacacacacacacacccctcaaagactctacatttataaaacatttttcttttataatttttttccatttctcagtcacaagtacaagtaaaacctgaatattcaatactatgcttgcaggtcctgctttctttaggaaaagagataccaagagaaggcactgggattgggtactccttt

SEQ ID NO: 1717 - DNA, 206 bp, Homo sapiens
  AL049744.8_78342
  Located on chromosome 1
  Distance between a terminus base of telomere on chromosomal short arm and 5'-terminus of this base sequence : 200697313
  Distance between 3'-terminus of neighbour sequence of sequence listing upward to telomere on chrosomal short arm and 5'-terminus of this base sequence : 12250
tcctcatggatacatatctaagactgggtttgttagataaatggtgtgtgtgtgtgtgtgtgtgtgtgtgtgtgtgtgttttattattattatactttaagttctgggatatatgtgcagaacgtgcaggtttgttacataagtatacgtgtgccatggtggtttgctgcacccatcaacccgtcatctaggttgtaagccttgca

SEQ ID NO: 1718 - DNA, 449 bp, Homo sapiens
  AL049744.8_24253
  Located on chromosome 1
  Distance between a terminus base of telomere on chromosomal short arm and 5'-terminus of this base sequence : 200751241
  Distance between 3'-terminus of neighbour sequence of sequence listing upward to telomere on chrosomal short arm and 5'-terminus of this base sequence : 53722
cacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaag

SEQ ID NO: 1719 - DNA, 422 bp, Homo sapiens
  AL049741.7_69961
  Located on chromosome 1
  Distance between a terminus base of telomere on chromosomal short arm and 5'-terminus of this base sequence : 200776805
  Distance between 3'-terminus of neighbour sequence of sequence listing upward to telomere on chrosomal short arm and 5'-terminus of this base sequence : 25115
agcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttc

SEQ ID NO: 1720 - DNA, 330 bp, Homo sapiens
  AL139418.4_71483
  Located on chromosome 1
  Distance between a terminus base of telomere on chromosomal short arm and 5'-terminus of this base sequence : 200943113
  Distance between 3'-terminus of neighbour sequence of sequence listing upward to telomere on chrosomal short arm and 5'-terminus of this base sequence : 165886
acagatgaaggcatagtgagatagagtaatttgtccataatcatgtagggattcacattaactcctgtgtgcttatccttgcctctttaaaatagaaaatgaagatgacagggatagatgatggtgatagagagagagataattgacagatattgaggtgtatgtatgtatgtatgtatgtatgtatatatagagagttttattttaatagatgactattagaaagattatacctttctacagttctttttctacactgtgggcataagagaaaaatataaacatagaattaaattagcaaaatgtgagtacatttggagtgcttgtagt

SEQ ID NO: 1721 - DNA, 277 bp, Homo sapiens
  chr1.fa.O7frz.227406412
  Located on chromosome 1
  Distance between a terminus base of telomere on chromosomal short arm and 5'-terminus of this base sequence : 201316022
  Distance between 3'-terminus of neighbour sequence of sequence listing upward to telomere on chrosomal short arm and 5'-terminus of this base sequence : 372579
tcctatgagtaccttttggaactgcatcctggtcatatccctgtagaacattttttgctgtgcttttgcaaagtagccaaggataccactggctcaaaatcagttttttatgttccctttcgtgtgtgtgtgtgtgtgtgtgtgtgtgtgtgtgtgtgtgtttgaagagaagtggatctcagatcatatgggtactgtaaatgggatagatgcagagtctcagggttttgatttcctggaggtaggatgtgaaaggacaggaagtcattagcttcat

SEQ ID NO: 1722 - DNA, 241 bp, Homo sapiens
  Z67047
  Located on chromosome 1
  Distance between a terminus base of telomere on chromosomal short arm and 5'-terminus of this base sequence : 201470674
  Distance between 3'-terminus of neighbour sequence of sequence listing upward to telomere on chrosomal short arm and 5'-terminus of this base sequence : 154375
gactatggcttttacatatttgcacagaaaaataaaacctttgtttctgtatcttctctttctcatcttctaatggtacttgtacttgtttgccttgactatgtcttgtatgataaaatttccaccagccatgcatacacacacacacacacacacacacacaccacagaagtactggtactgatcttcctgaatcgtgatctctttctgtgaaagtgtcactgtgagtaaacactgtggt

SEQ ID NO: 1723 - DNA, 462 bp, Homo sapiens
  chr1.fa.O7frz.227096306
  Located on chromosome 1
  Distance between a terminus base of telomere on chromosomal short arm and 5'-terminus of this base sequence : 201579705
  Distance between 3'-terminus of neighbour sequence of sequence listing upward to telomere on chrosomal short arm and 5'-terminus of this base sequence : 108790
gttgaggtaaatgcatactgacttgatatgcatgaggttattttaggcaatatttttcagtgttcttaaaaaagaggttggaggagtgggaaactgaaactatcaaaagcacccgaagatctttttcgaagtgcagaaatccagataccctggagactatcttccattgcctgttctgctccagtcctcacctgttccaacatacatagcataccagaatctcacagtattaatgctgcatttgaaaagtatcctgggtatttttatatgaccaacccaaggtgaaaatcaatgattatacacacacacacacacacacacacacacacacacacacacacacacacgtattactagcagcacttggttaccttttattttgttgatttgtggcacctagaatttgatatgttgtggtttactccatccataattatgatgaggtatctttaagtcttcctt

SEQ ID NO: 1724 - DNA, 223 bp, Homo sapiens
  DISO7_10000759
  Located on chromosome 1
  Distance between a terminus base of telomere on chromosomal short arm and 5'-terminus of this base sequence : 201696453
  Distance between 3'-terminus of neighbour sequence of sequence listing upward to telomere on chrosomal short arm and 5'-terminus of this base sequence : 116286
tttagaggcagtgaggtaagctataaaatacagactcaaatcttacctgaaaatgatgtttactctcaaatgggtgcacaaaaacaacaataaaggtggggggaagactgtgtgtgtgtgtgtgtgtgtgtgtgtgtgtgtgtgtgtgtattgagagagaaaggaagagtaggggagagggggagagaggaagagaaatgcatgctaacaacttatgaatcta

SEQ ID NO: 1725 - DNA, 180 bp, Homo sapiens
  chr1.fa.O7frz.226787317
  Located on chromosome 1
  Distance between a terminus base of telomere on chromosomal short arm and 5'-terminus of this base sequence : 201949562
  Distance between 3'-terminus of neighbour sequence of sequence listing upward to telomere on chrosomal short arm and 5'-terminus of this base sequence : 252886
aatagaaggtgacattggaatctcaagccactcaccaaggccctaattcccagagagagagagagagagagagagagaaagcaagccactcatacataaactagtgagtttttttttgaaagaaaggatctctcagcccggataaagtccagaagggtgaagatttctagccaaatagta

SEQ ID NO: 1726 - DNA, 443 bp, Homo sapiens
  AL136136.7_130743
  Located on chromosome 1
  Distance between a terminus base of telomere on chromosomal short arm and 5'-terminus of this base sequence : 202001016
  Distance between 3'-terminus of neighbour sequence of sequence listing upward to telomere on chrosomal short arm and 5'-terminus of this base sequence : 51274
acctgagtataatcctgaggtaagaaaaagcaattcagattatgaaacattctacatcagcaagacaattagctggattcttcaaaaataccaatgttatgaaagacaataaaagacagggggagtttcctaggtgggaggagactaaaaagagacatgatggctaaaagtcatgtccttgattggattctggataccaaactcacacacacacacacacacacacacacacacacacacacacttcataacatagctagaaagaacattttgatgacagatgggggaatttgaatgtggacttacgtttgaaaatgttattgtgtaatattacatttactgagtgtgataatcatattgtggttttgaaggagaatgtccttgttcttaggaaacacgtatgaggaacttagggtaaaaaatcgtgattacaacgtactttc

SEQ ID NO: 1727 - DNA, 333 bp, Homo sapiens
  AL136136.7_89035
  Located on chromosome 1
  Distance between a terminus base of telomere on chromosomal short arm and 5'-terminus of this base sequence : 202042769
  Distance between 3'-terminus of neighbour sequence of sequence listing upward to telomere on chrosomal short arm and 5'-terminus of this base sequence : 41310
cactaagccatttatgagtgatccaggctcatgatccaaatacctcccaccaggcctactccaacattgggtatcccatttcaacatgagatttggaggggacaaacatccaaaccataccattaatatacattaataatctgtgtattaggattctctgaagaaacaaacccaattgtgtgtgtgtgtgtgtgtgtgtatacctatatatcctaaaaactttttattataatgtatcaattcacacaattatagaggtgaaaaagtcccacaataagtcatctacaagctggaggccgggtaaggccagtggtgtagttcaaaggcgtgaca

SEQ ID NO: 1728 - DNA, 310 bp, Homo sapiens
  AL136136.7_72148
  Located on chromosome 1
  Distance between a terminus base of telomere on chromosomal short arm and 5'-terminus of this base sequence : 202059780
  Distance between 3'-terminus of neighbour sequence of sequence listing upward to telomere on chrosomal short arm and 5'-terminus of this base sequence : 16678
cactctaatcttcaagtctagcatcttcaaatctctctctcccccatcttcattgtgtgtgtgtgtgtgtgtgtgcgcgtgtgtgtgtgtaatctttctctttctccctcttagaagaatatatgtgattgcatttaaggtccacccagataatccagtataaaattttcacctcaagattattaattcaatcacatatacaatggctttgccataaaaaatgacattcacagattccagagattaggacacggatatcttttgaaggccattttgcagcctaccacaatgaggatatgcttgatgtatt

SEQ ID NO: 1729 - DNA, 455 bp, Homo sapiens
  chr1.fa.O7frz.227701641
  Located on chromosome 1
  Distance between a terminus base of telomere on chromosomal short arm and 5'-terminus of this base sequence : 202163462
  Distance between 3'-terminus of neighbour sequence of sequence listing upward to telomere on chrosomal short arm and 5'-terminus of this base sequence : 103372
ctttgtcaaatcttaacgttaaacttattcttaggttcgtattctttggtttgccctttgggtgatgtgactcccaagcatgacacagttgattcatgagctgagaggtttgcttctgaaatattgacagatgactctacacattctttaaaataaataaatatatatatatagagagagagagagagagagagtatgctaattgctgaaatctcatagtactggttttcactttttaaaaattatttttaaatttttattttttattttcatagatttttggggaactggtggtgtttggttacatgaataagttctttagtggtgatttctgagattttgatgcacccataacccaagcagtatacactttacccagtgtgcagtcttttgtgcctcaccaccctcccaccctttcctccgagttcccaaagtccattgtatcattcttatgc

SEQ ID NO: 1730 - DNA, 351 bp, Homo sapiens
  AL158213.5_111979
  Located on chromosome 1
  Distance between a terminus base of telomere on chromosomal short arm and 5'-terminus of this base sequence : 202293182
  Distance between 3'-terminus of neighbour sequence of sequence listing upward to telomere on chrosomal short arm and 5'-terminus of this base sequence : 129265
ctcctgttaccgtattcttgttagataggagggattgttatgtgtccctccacctgggttctctatcctttctctgcctgtattctcagaaatcttaattcctatcattatctgttcccagtcctagatttataaccattgtgcacttctgagtgccttttctcatcatttaaatatgctcaggtcactgttattttaaacatatttacatgtatatacatgcacacacacctgttcctcattcattcattcattcattcattcattcaagaaacttattttccagtggggaagtcaaataaaatgctaaaagcaagtagaatatatgatatgccagatgttgataaatca

SEQ ID NO: 1731 - DNA, 139 bp, Homo sapiens
  D1S2840
  Located on chromosome 1
  Distance between a terminus base of telomere on chromosomal short arm and 5'-terminus of this base sequence : 202360719
  Distance between 3'-terminus of neighbour sequence of sequence listing upward to telomere on chrosomal short arm and 5'-terminus of this base sequence : 67186
ccaacataatttctgggctgactcatgagtatgaaggaaagaatggaaattaagtcctattccctgaagttgtgtgtgtgtgtgtgtgtgtgtgtgtgtgtgtgtgtttatatcgaactgaggtgtaagatgacttgtc

SEQ ID NO: 1732 - DNA, 248 bp, Homo sapiens
  D1S413
  Located on chromosome 1
  Distance between a terminus base of telomere on chromosomal short arm and 5'-terminus of this base sequence : 202531514
  Distance between 3'-terminus of neighbour sequence of sequence listing upward to telomere on chrosomal short arm and 5'-terminus of this base sequence : 170656
gccaagcctgagatcaaaattacacacagagatatacacacactgacaaaaggatttatatctatttatgtgcagtttaattttcacgatattagattctacctaatatctgccacattgataacaactactttttaaatttctcaaagaaatggaaggtttaatttcagtttaaaaataaaccagttatttaaccaatacacacacacacacacacacacacacacacaatcccaatctgttcaagt

SEQ ID NO: 1733 - DNA, 230 bp, Homo sapiens
  Z67221
  Located on chromosome 1
  Distance between a terminus base of telomere on chromosomal short arm and 5'-terminus of this base sequence : 202559551
  Distance between 3'-terminus of neighbour sequence of sequence listing upward to telomere on chrosomal short arm and 5'-terminus of this base sequence : 27789
tctaagcccataaggatacagcatttacctgaccagaaaaattggttctacaatggacatataccccaattgtagtcattgtagtctgggcaattttaagtggcattttgcagaaagagattctcacttctgttttttgttgttgggtgtgtgtgtgtgtgtgtgtgtgtgtgtgtgtgtgtgtgtacatgtgtgtttgctggactgaaaattggaaaggctggggtttg

SEQ ID NO: 1734 - DNA, 261 bp, Homo sapiens
  AL157402.11_76197
  Located on chromosome 1
  Distance between a terminus base of telomere on chromosomal short arm and 5'-terminus of this base sequence : 202591902
  Distance between 3'-terminus of neighbour sequence of sequence listing upward to telomere on chrosomal short arm and 5'-terminus of this base sequence : 32121
ttaaacctaaatctgatcctcaacacatagacaccctacaacattagaaaaataaatgaatgaataaataaataaataaataaataaataaataaataaacagtaaatatggaggaatggggagaatctgatttctagagttaccacattattagatttaaatgtcaagttttcaataaaagaggaaagtattgcccattcaaaggaaaaaataaattaacaaaaactgcccctggaaaagacctgatgtctgatctactg

SEQ ID NO: 1735 - DNA, 269 bp, Homo sapiens
  AL136321.5_80814
  Located on chromosome 1
  Distance between a terminus base of telomere on chromosomal short arm and 5'-terminus of this base sequence : 202899898
  Distance between 3'-terminus of neighbour sequence of sequence listing upward to telomere on chrosomal short arm and 5'-terminus of this base sequence : 307735
atctccataacattggtctgagcaacgacttcttggctattaccccaaaagcaaaaacaacaaaaacaaaaatagacaagtgggatggcattaaactaagttgtttctgcagagcaaagaaaacaattatgagagtgaagagacacataagtgatatatagatatataataatgtgtgtgtgtgtatatatatatatatatatatattctcatccatggactggaagagagtatttccaaactatatatctggtaacaggttaagatcc

SEQ ID NO: 1736 - DNA, 167 bp, Homo sapiens
  G10049
  Located on chromosome 1
  Distance between a terminus base of telomere on chromosomal short arm and 5'-terminus of this base sequence : 202930949
  Distance between 3'-terminus of neighbour sequence of sequence listing upward to telomere on chrosomal short arm and 5'-terminus of this base sequence : 30782
aaatggtcaagaaagagttgagccagactgacttgactatctatctgtctgtctatctatctatctatctatctatctatctatctatctatctatctgtcatttatctatctgtctattggcttatctatcaaataatcatctgattgtattggcaaatattaatg

SEQ ID NO: 1737 - DNA, 263 bp, Homo sapiens
  AL136321.5_123035
  Located on chromosome 1
  Distance between a terminus base of telomere on chromosomal short arm and 5'-terminus of this base sequence : 202942192
  Distance between 3'-terminus of neighbour sequence of sequence listing upward to telomere on chrosomal short arm and 5'-terminus of this base sequence : 11076
tgtaaagctgaagatttcatactacctagatatttctctgttattgacttgcctcctaagcttccatgtgactattattttttcctttcttatcaatttatttccaccaaaacacacacacacacacacacacacacacacacacagagagagagagagagagaggcatattaagttaatagcttctctgccatctcatcttagtttaaaaaaagttaacagtccatattttagacatgattatcatgattatcagctcaatt

SEQ ID NO: 1738 - DNA, 410 bp, Homo sapiens
  AL136321.5_149982
  Located on chromosome 1
  Distance between a terminus base of telomere on chromosomal short arm and 5'-terminus of this base sequence : 202969010
  Distance between 3'-terminus of neighbour sequence of sequence listing upward to telomere on chrosomal short arm and 5'-terminus of this base sequence : 26555
aaatgaaggtattctgaggtattcctgcctcagcctcctcagtagctagcaccacaggtgcacatcaccatgcccagctaagttttatatttttagcagagatggagttttgccatgttggccattctggtctcaacctcctgacctccagtgatccactcatctcagcctcccaaactgctgggattataggcatgagccaccgtgcctggccaacctagtttctaatatatatatctaatatatatatatatatatatatatatatatatatatatatatatatatatataaaatgcataaatatttttaagtatattagaaattatttcagatctagcaaataacaaaaactgttctgttgtttatggaataaatgagtttctatagtgagtttcactacctgacat

SEQ ID NO: 1739 - DNA, 159 bp, Homo sapiens
  Z67014
  Located on chromosome 1
  Distance between a terminus base of telomere on chromosomal short arm and 5'-terminus of this base sequence : 203072026
  Distance between 3'-terminus of neighbour sequence of sequence listing upward to telomere on chrosomal short arm and 5'-terminus of this base sequence : 102606
gtcaacttgcttgaaactttctgggaaaacacacacacacacacacacatacacacacacacacatacacacacacacacacacacacacttcacatgattctttgtacttccagtctcagcatgcttttccttccttggtggctcaagtctaggctga

SEQ ID NO: 1740 - DNA, 372 bp, Homo sapiens
  chr1.fa.O7frz.228659889
  Located on chromosome 1
  Distance between a terminus base of telomere on chromosomal short arm and 5'-terminus of this base sequence : 203146833
  Distance between 3'-terminus of neighbour sequence of sequence listing upward to telomere on chrosomal short arm and 5'-terminus of this base sequence : 74648
aggatctcaactgtcatctagatagtatctctgatttgaaaggaaaattgaagaaggaaagaagaaagaaaaagagaggaagaaaagaagaaagaacagagaggaagaagagtaggagtgggagagaaagggaaagagtagtaagaaataaaggaaattgagacattttctctcttgtgctgaccacaaccatggagaaaaaggcaattagactatcttatatcttcattgaattgaaatctcttcttcattgaaaatggtcagtatgaaagagaattctatgcagttgtatttatttatttatttatttatttatttatttatttatttatttattttgagatgcagtctcgctctgtcaccaggctgtag

SEQ ID NO: 1741 - DNA, 275 bp, Homo sapiens
  D1S1726
  Located on chromosome 1
  Distance between a terminus base of telomere on chromosomal short arm and 5'-terminus of this base sequence : 203411473
  Distance between 3'-terminus of neighbour sequence of sequence listing upward to telomere on chrosomal short arm and 5'-terminus of this base sequence : 264268
tgccagttgacctcaaggggaaactctgaaatgttctctcaaaagtctaggatttgtataatttctttgatgcctggctttgctttattatatgatgagcagatgtgtattattctgatatacagtattaactaagttacagttttagttgattaaataagtaaagggaaacatgttggttaatctacatagacacacacacacacacacacacacacacacacacacacacactcaaaatctgatctaagcaatcaaggtgaggagcaactgga

SEQ ID NO: 1742 - DNA, 324 bp, Homo sapiens
  chr1.fa.O7frz.228992159
  Located on chromosome 1
  Distance between a terminus base of telomere on chromosomal short arm and 5'-terminus of this base sequence : 203504835
  Distance between 3'-terminus of neighbour sequence of sequence listing upward to telomere on chrosomal short arm and 5'-terminus of this base sequence : 93087
gttgacatcaataaagataggaagtaagatagataaagggtatgaaggaaacgaaaagttgatgacagaacaagccctcaaggcagagttgtctgtgagtgcccagaatatgtttcctgtgtaattctcaggatgttcctctttctccgattctctaccttttgcttctgactatctatgtttacccacccaggcctgctctaataaccaaagtagtcagccagccttgtgtgcctctgttgtttgtgtgtgtgtgtgtgtgtgtgtgtgtgtgtgtgattttctcagggttttattattgttgtgttgtccatctaccttcag

SEQ ID NO: 1743 - DNA, 137 bp, Homo sapiens
  D1S1632
  Located on chromosome 1
  Distance between a terminus base of telomere on chromosomal short arm and 5'-terminus of this base sequence : 203667786
  Distance between 3'-terminus of neighbour sequence of sequence listing upward to telomere on chrosomal short arm and 5'-terminus of this base sequence : 162627
gcaagccaagattgtgccactgcattccagcctgggggatagagccagactctgtctaaaaataataataataataataataataataataataataaataagaaaagaagaagtcagagagattaagggtgcaggg

SEQ ID NO: 1744 - DNA, 469 bp, Homo sapiens
  chr1.fa.O7frz.229256528
  Located on chromosome 1
  Distance between a terminus base of telomere on chromosomal short arm and 5'-terminus of this base sequence : 203786914
  Distance between 3'-terminus of neighbour sequence of sequence listing upward to telomere on chrosomal short arm and 5'-terminus of this base sequence : 118991
agaaagtggttgcagtgtaattcaggtaaagaagagccaacttaaatgttactgaagaaggaaggaaggaaggaaggaaggaaggaaggaaggaaggaaggaaggaaggaaggaaatattaaaaaccataaacaaaaaaaactttccagaaataaaagaaaaagtgaatctacacattgaaaagttatagcagatacctaggaaaaggcctaacaataagcattgtatttatttgtagatctaagaccaaaacaaggatgaggctctgaataatgtcatatgtgagtatggtttgttctcacaaaacagaaagaatgcaactaaaaaaatattggctttctcacttgtatatttattagatgtgagtcaaaatacatcatttaaaactgacagatcttacagcaaatggtaaaaaatataagtaaaaagttaaccactggaacaaaagttccaaatcctaagaattgaa

SEQ ID NO: 1745 - DNA, 448 bp, Homo sapiens
  chr1.fa.O7frz.229356270
  Located on chromosome 1
  Distance between a terminus base of telomere on chromosomal short arm and 5'-terminus of this base sequence : 203903739
  Distance between 3'-terminus of neighbour sequence of sequence listing upward to telomere on chrosomal short arm and 5'-terminus of this base sequence : 116356
ggattatcataaagttatctgcagtattcaattataaatagtcttttagcactattatatatatatatatatatatatatatatatatatatatatcctaaatatgtgtgtgtgtttaattttcaagtttggtttgcttaaaactatgttattactgttaggtttcactgcattattgtctaagattatggcctacggtccacatgacacctgctttgtgtactctatttagatttttttgtaacttggtatatgatcaatcttttaaaacaggcgttcccaacccccaggcagtggaccagtattggtccgtggcctgttagcaactgggctgcacagcaggaggtgagcggcaggcaaggagcattagcgcatgagctccgcctcctgccagatcagccacagaaattagattctcataggagggtgaaccatattgtgaactgag

SEQ ID NO: 1746 - DNA, 152 bp, Homo sapiens
  D1S2817
  Located on chromosome 1
  Distance between a terminus base of telomere on chromosomal short arm and 5'-terminus of this base sequence : 204212831
  Distance between 3'-terminus of neighbour sequence of sequence listing upward to telomere on chrosomal short arm and 5'-terminus of this base sequence : 308644
aggaagaccccttgatgagatggctctagaagacatacgtgtgtgtgtgtgtgtgtgtgtgtgtgtgtgtcagggtcttgctctgtcacccagcctggaatgcagtggcacagtcatgtcttacttcagcctcaacctcctgggttcaagca

SEQ ID NO: 1747 - DNA, 117 bp, Homo sapiens
  Z66965
  Located on chromosome 1
  Distance between a terminus base of telomere on chromosomal short arm and 5'-terminus of this base sequence : 204248936
  Distance between 3'-terminus of neighbour sequence of sequence listing upward to telomere on chrosomal short arm and 5'-terminus of this base sequence : 35953
cgccaccatcatcccagcactgtttctctctcacacacacacacacacacacacacacacacacacacacacagaacaacactcaaggccaggatctcctaaagccttgtgccgtgg

SEQ ID NO: 1748 - DNA, 165 bp, Homo sapiens
  D1S2622
  Located on chromosome 1
  Distance between a terminus base of telomere on chromosomal short arm and 5'-terminus of this base sequence : 204250181
  Distance between 3'-terminus of neighbour sequence of sequence listing upward to telomere on chrosomal short arm and 5'-terminus of this base sequence : 1128
aaactggtaggccattgatagaatttgtgtgtgtgtgtgtgtgtgtgtgtgtgtattataaaggtgactcaacatttaaaatcaagagaatccacataaaatatgaattccagtttctttctaaaaaattagaaggtcgggttacactaggttcttatgttgcag

SEQ ID NO: 1749 - DNA, 218 bp, Homo sapiens
  AC073085.1_99106
  Located on chromosome 1
  Distance between a terminus base of telomere on chromosomal short arm and 5'-terminus of this base sequence : 204296096
  Distance between 3'-terminus of neighbour sequence of sequence listing upward to telomere on chrosomal short arm and 5'-terminus of this base sequence : 45750
atacctaatgctaaacgacaagttaatgggtgcagcacaccaacatggcacatgcatacatatgtaacaaacctgcacgttgtgcacatgtaccctaaaacttaaagtataataaaaataaaaaataaaataaataaataaataaataaataaataaataaataagagaccagaagacaaggacatagaaggggcaagagaatgagctgaaagcatgc

SEQ ID NO: 1750 - DNA, 403 bp, Homo sapiens
  HUMUT5429
  Located on chromosome 1
  Distance between a terminus base of telomere on chromosomal short arm and 5'-terminus of this base sequence : 204350144
  Distance between 3'-terminus of neighbour sequence of sequence listing upward to telomere on chrosomal short arm and 5'-terminus of this base sequence : 53830
cctggcctttctttttaaaaaaatatattattgccactgagccattttgaagtatctttcttctttccttcctttattccttccttccttccttccttctttccttccttccttccttctttccttcctctttctctttctttctttctttctttctttctttctttctttctttcttttctttcctttctttcttcccttccttccttccttccttccttccttctttctttctttctttctttctttctttctttctttctttctttctctttctttctttctttctttctttctttctttctttctttctttctttctttctttctttcttcttctttctttcttcttctttctttctccttctttctctcttttttgaaacagagttttgctctgtcac

SEQ ID NO: 1751 - DNA, 354 bp, Homo sapiens
  AL358153.3_65939
  Located on chromosome 1
  Distance between a terminus base of telomere on chromosomal short arm and 5'-terminus of this base sequence : 204431665
  Distance between 3'-terminus of neighbour sequence of sequence listing upward to telomere on chrosomal short arm and 5'-terminus of this base sequence : 81118
tgtaattccagctacttggaaggctgaggtaggagaatcgcttgaacccaggaggcagaggtcgcagcaagccgagatcacgccattgtacaccagcctgggcaacaagagcaaaactctgtctcaataaataaataaataaataaataaagaaagaaagaaagaaagaaagaaggaaggaaggaaggaaggaaggagagcccaagaagttaagtgactcatgccccaagtccagctctctttctgctgaaatatacagccttcaaaaacaaaagcaggcaacggttgttttaagcatgccaaatattcgtttttggctcagctgccagtgtgaagacagtttcatacatttga

SEQ ID NO: 1752 - DNA, 101 bp, Homo sapiens
  DISD22_0000976
  Located on chromosome 1
  Distance between a terminus base of telomere on chromosomal short arm and 5'-terminus of this base sequence : 204693559
  Distance between 3'-terminus of neighbour sequence of sequence listing upward to telomere on chrosomal short arm and 5'-terminus of this base sequence : 261540
gtagaatctgcttgtgcctgcatgtgtgtgtgtgtgtgtgagagagagagagagaggagagagaagaaagaaagccacagttaacacttatttggcactaa

SEQ ID NO: 1753 - DNA, 418 bp, Homo sapiens
  AC025349.2_65040
  Located on chromosome 1
  Distance between a terminus base of telomere on chromosomal short arm and 5'-terminus of this base sequence : 204906278
  Distance between 3'-terminus of neighbour sequence of sequence listing upward to telomere on chrosomal short arm and 5'-terminus of this base sequence : 212618
aggtcagaagttcaagaccagcgtgaccaacatggtgaaaccccgtctctactaaaaatagaaaaattagctgggcatggtggcgagtgcctgtaatcccaactactcaggaggctgaggcaggataatcgcttgaacccaggaagtggaggttgcagtgagccgagatggtgccattgcattccagcctgggcaacagagcaagactctgtctcaataaataaataaataaataaataaataaataaataaataaagctgctaatacttattgagctcctacactgtgtgtcaagcactttacacatactgtatcatttaaatcctcatgacagccttttgaggtggaaaggttacttattccaattttactgatgaggaaagtgtccggggacttaggaactcttccagagttacc

SEQ ID NO: 1754 - DNA, 364 bp, Homo sapiens
  chr1.fa.O7frz.230176435
  Located on chromosome 1
  Distance between a terminus base of telomere on chromosomal short arm and 5'-terminus of this base sequence : 204984587
  Distance between 3'-terminus of neighbour sequence of sequence listing upward to telomere on chrosomal short arm and 5'-terminus of this base sequence : 77891
ctcaaactctgttcagattcatcagtttttcaacagattcatcagtttttcaaactgaaaatttcctttatcattctgtctccctctctctctctctctcgctctacacacacacacacacacacacacacacacacacacgtaaattgttctaccacatttcaaagaaggttgcatatatcatgcccctttaccccttaatacttcaatatatatttcctaagaacaaggcaattcatttccataacgacagtacaggtaatttaatgtcagtataatactgtatcatttatgttcccattttatcattaatttatttcgctgtcatatccctagtcttctttaaactgaagcagttctttag

SEQ ID NO: 1755 - DNA, 101 bp, Homo sapiens
  DISO7_10000763
  Located on chromosome 1
  Distance between a terminus base of telomere on chromosomal short arm and 5'-terminus of this base sequence : 205235320
  Distance between 3'-terminus of neighbour sequence of sequence listing upward to telomere on chrosomal short arm and 5'-terminus of this base sequence : 250369
acttctcacctagtctaatagccctgggacctctctcctctacacacacacacacacacacacacacacacacacaatcagaccacacctgtctcattcct

SEQ ID NO: 1756 - DNA, 222 bp, Homo sapiens
  DISO7_00010052
  Located on chromosome 1
  Distance between a terminus base of telomere on chromosomal short arm and 5'-terminus of this base sequence : 205270527
  Distance between 3'-terminus of neighbour sequence of sequence listing upward to telomere on chrosomal short arm and 5'-terminus of this base sequence : 35106
gtcaaaccatggaggcttttgggatactatttcccagcaaaaactgagtgtggatggaaatacacaacacacacacacagacagacagacagacagacacacacacacacacacacacacacacacacacactggttttgctcagagcccaccctgcccctcgctagctcagcgcccccaggggatctgagcagatggggttgtctgtcaccgtctgttctg

SEQ ID NO: 1757 - DNA, 202 bp, Homo sapiens
  D1S2716
  Located on chromosome 1
  Distance between a terminus base of telomere on chromosomal short arm and 5'-terminus of this base sequence : 205302282
  Distance between 3'-terminus of neighbour sequence of sequence listing upward to telomere on chrosomal short arm and 5'-terminus of this base sequence : 31533
gggtcctaaagatagaaaaatgtccagatggcaaatgagactcacagaaagttgtctaggcctgccagtcccaaagcaggtacttagaggaatgcggggagagggatgaggggaaatgggtgtgtgtgtgtgtgtgtgtgtgtgtcctctaccccagaccccacacttgtgtgtgcacctctgtccagtggacttggcagcc

SEQ ID NO: 1758 - DNA, 132 bp, Homo sapiens
  D1S2738
  Located on chromosome 1
  Distance between a terminus base of telomere on chromosomal short arm and 5'-terminus of this base sequence : 205389041
  Distance between 3'-terminus of neighbour sequence of sequence listing upward to telomere on chrosomal short arm and 5'-terminus of this base sequence : 86557
gtcacatttcagggcaggacttgcgatcttaagactaaattgcctggtgcctagacgggtgtgtgtgtgtgtgtgtgtgtgtgtgtgtgtgtgtgtgtgtgtgtgtgtgtgtgtcgtatgtatgcatgtgtt

SEQ ID NO: 1759 - DNA, 226 bp, Homo sapiens
  D1S477
  Located on chromosome 1
  Distance between a terminus base of telomere on chromosomal short arm and 5'-terminus of this base sequence : 205496018
  Distance between 3'-terminus of neighbour sequence of sequence listing upward to telomere on chrosomal short arm and 5'-terminus of this base sequence : 106845
cagtacaggtcaaccaagacgtatgtattaagacaggccttaggagagagtgaggggcagggggtaataaggtggaaggagacaaaagaaaccgaccctggcccttccaccacacacacacacacacacacacacacacacacacacacctcacacttccttctacctgtggcttctgtccccccacctactccctagcccccattcctgagtggccccttgtaga

SEQ ID NO: 1760 - DNA, 238 bp, Homo sapiens
  Z98266.1_10875
  Located on chromosome 1
  Distance between a terminus base of telomere on chromosomal short arm and 5'-terminus of this base sequence : 205500515
  Distance between 3'-terminus of neighbour sequence of sequence listing upward to telomere on chrosomal short arm and 5'-terminus of this base sequence : 4271
aaggtgaagattccttgcttcagggagctcccagcttggttggggagacccaggccctaccttctgggaggagtgcacacacacacacacacacacacacacacagtgtacagaagccacattccaaggagcccacaagccagtgcagagtcagccgctggattgagtgctgacatggttatgctggcaagtttggagtgctcagagctgggtgcggtcatctttaggagaagctgat

SEQ ID NO: 1761 - DNA, 439 bp, Homo sapiens
  AL390790.10_15270
  Located on chromosome 1
  Distance between a terminus base of telomere on chromosomal short arm and 5'-terminus of this base sequence : 205526829
  Distance between 3'-terminus of neighbour sequence of sequence listing upward to telomere on chrosomal short arm and 5'-terminus of this base sequence : 26076
ttaaagtgatcaagatcaggaaattggtggctataagaatgggaagaaaggctagatgtgaacatttttgtgtaagagccagcctggacttggggatggatagatggatggataaatggatggatggatgcatggatggacagatggacggacagacggacggatggatggacagatggatggacggatggacggacggacggatggacggacggacggacggatggatggatggatggatggatggatggatggacggacggacgtacggacggacggatggatggatggatggataggatcatggccattgtcttccattttcctaataccagacacaaacaagagagatggcaaggtaggtgggaagcttcccctcagggaatagggaggagtttttcttcagtggagagataacatacctgctaggacattaact

SEQ ID NO: 1762 - DNA, 383 bp, Homo sapiens
  AL390790.10_75297
  Located on chromosome 1
  Distance between a terminus base of telomere on chromosomal short arm and 5'-terminus of this base sequence : 205574995
  Distance between 3'-terminus of neighbour sequence of sequence listing upward to telomere on chrosomal short arm and 5'-terminus of this base sequence : 47727
aaactccgtttaagttatgtcaacctgttctctttcacagcacactgctgttttcctctgggtttctctttttacaatttgagacccaggcactgcatatgtatatctatatctgtacatacatgtgtctgtgtctatgcatatatgcatgtatgtatccacctatctctatctatctaccttcctcccatctatctacctatctcttttctatctgctatctatctatccatctatccatctgtcacctatctctatctcctatctatctatctatctatctatctatctatctatctatctatctatcatctatctatctatccagtgatctaatgtctgtttaatacttttctcctcttgtttatgaaggtaggaaacag

SEQ ID NO: 1763 - DNA, 171 bp, Homo sapiens
  D1S1723
  Located on chromosome 1
  Distance between a terminus base of telomere on chromosomal short arm and 5'-terminus of this base sequence : 205645291
  Distance between 3'-terminus of neighbour sequence of sequence listing upward to telomere on chrosomal short arm and 5'-terminus of this base sequence : 69913
aactgtgtccagcagcaactggctggtaaaaatagaacagacccactgccccctcctgctgcccctcctccctcccacccttcacacacacacacacacacacacacacacacacacacacacacacctcacagggcagatgcgtgctgcaatgcacacaacaggcacata

SEQ ID NO: 1764 - DNA, 267 bp, Homo sapiens
  D1S306
  Located on chromosome 1
  Distance between a terminus base of telomere on chromosomal short arm and 5'-terminus of this base sequence : 205659391
  Distance between 3'-terminus of neighbour sequence of sequence listing upward to telomere on chrosomal short arm and 5'-terminus of this base sequence : 13929
ccagagggagcattggtgagccttggtgcatgtgtgtgcatgtgtgtgcgcgtgcctgtgtgtgtgtgtgtgtgtgtgtgtgtgtgtgtgtgaagagagagagagaaacagagagagaaagggaaagaacgtgtgggtgacttgtttgtgactgactatatgcctgagatcgcttgggtgtgaaattttcaaagtggctgattgtatgtgaatgtccctcctccctccacccacatgataaacaatcaaaagtgtttccagtcccag

SEQ ID NO: 1765 - DNA, 319 bp, Homo sapiens
  AL157898.7_87947
  Located on chromosome 1
  Distance between a terminus base of telomere on chromosomal short arm and 5'-terminus of this base sequence : 205686881
  Distance between 3'-terminus of neighbour sequence of sequence listing upward to telomere on chrosomal short arm and 5'-terminus of this base sequence : 27223
ctgtaaaggcatttagtttgctggatgtcttgcctctcaaccccatctgttcactaacactcccctatttcgtttttgttgttgttgttgttgttgttttgagatggagtctcactgccgtcacacaggctggagtgcagtggtgctatctccgctcgctgcaacctccacctccagagttcaatcgattctccttcctcagccttccgagtagctgggattacagtcgtgcacaaccacacccagttaatttttgtagttttagtagagacggggtttcgccttgttggccaggctggtctcaaactcctgacctcag

SEQ ID NO: 1766 - DNA, 237 bp, Homo sapiens
  AL355503.3_109988
  Located on chromosome 1
  Distance between a terminus base of telomere on chromosomal short arm and 5'-terminus of this base sequence : 205740188
  Distance between 3'-terminus of neighbour sequence of sequence listing upward to telomere on chrosomal short arm and 5'-terminus of this base sequence : 52988
actctttgaggacaggattagatcttggtcaaaatctgtatgctcagtgcctagggtagcatctagttcatgcaaggaaggaaaggagagaggaaggaaggaaggaaggaaggaaggacggaaggaaggaaggaaggaaggaaggaacgaaggaaggaaagggggggagagggagggagggaggagagtcagataatacagagaggccataccatgaattcttagtcatacctgacc

SEQ ID NO: 1767 - DNA, 416 bp, Homo sapiens
  chr1.fa.O7frz.231118344
  Located on chromosome 1
  Distance between a terminus base of telomere on chromosomal short arm and 5'-terminus of this base sequence : 205855189
  Distance between 3'-terminus of neighbour sequence of sequence listing upward to telomere on chrosomal short arm and 5'-terminus of this base sequence : 114764
cagaaaacaaggttccttctaccagggtaaaactaaaatgtgggctgggtgcagtggctcacggctgtaatcccagcactttgggaggccgaggcgggtggatcacctgaggtcaggagttcgagacaacctggccaacatggtgaaacctcgtctctactaaaaatacaaaaattagccaggcatggtggcaggtgcctgtaatcccagctactcgggaggctgaggcaggagaattgcttgaacccaggaggcggaggttgcagtgagccgagatcgcaccactgcactccagcctgggcgacagactgagactctgtctcaaaacaacaacaacaacaacaacaacaacaacaaaagcaaaaaacactaaaatgtgaagcaacaccaaagaagtggaaagtagtttgcaagaa

SEQ ID NO: 1768 - DNA, 320 bp, Homo sapiens
  AC068053.2_120752
  Located on chromosome 1
  Distance between a terminus base of telomere on chromosomal short arm and 5'-terminus of this base sequence : 205930428
  Distance between 3'-terminus of neighbour sequence of sequence listing upward to telomere on chrosomal short arm and 5'-terminus of this base sequence : 74823
ctttaacatactcctatgccagacctgccactattattgtgaccacagaaggaaacttttggggctaagagtgaatcattttctgatcaatcacaaagaaagccaaagtagtggggagaaagaaagagaaagaaagaaagaaagaaagaaagaaagaaagaaagaaagaaagaaagaaagaaaaagaaagaaagaaagaaggaaagaaagaaagagaattgctcattagttctttgcccttttccagacacctggagaaggaactataaaaaatgtgggatgtgctggagaagaaaacctattggtctggagaaggaatt

SEQ ID NO: 1769 - DNA, 145 bp, Homo sapiens
  D1S2764
  Located on chromosome 1
  Distance between a terminus base of telomere on chromosomal short arm and 5'-terminus of this base sequence : 206070203
  Distance between 3'-terminus of neighbour sequence of sequence listing upward to telomere on chrosomal short arm and 5'-terminus of this base sequence : 139455
gagctggaggtgcaagcaaggagagtgtttctttcttatgggagtgtgtgtgtgtgtttatgtgtgtgtgtgtgtgacagacagagagagagagagagagagagagagagagagagacagagagattggggaatcttatcagatc

SEQ ID NO: 1770 - DNA, 350 bp, Homo sapiens
  AL157898.7_21050
  Located on chromosome 1
  Distance between a terminus base of telomere on chromosomal short arm and 5'-terminus of this base sequence : 206082518
  Distance between 3'-terminus of neighbour sequence of sequence listing upward to telomere on chrosomal short arm and 5'-terminus of this base sequence : 12170
gtttacattgtagcaggatgaataaatatttagacaaaaagaagttcttaaatatcagggcagaaaaattctgcaagaaaatactacatacaggggaaagagcgtgggctttagtgtcaaaaacttgggtttgaaccttcactccaccccttcctcgatgggtgacccagtcaagtggtataatttctttgagctttggcttccttccttccttctttccttcttttcttttctttcttttcctttatttctctctctctctctttctttctttctttctttctctttctttcctttctctttctttcttcttcttttttttttttttctgacagagtcttgctcttcac

SEQ ID NO: 1771 - DNA, 345 bp, Homo sapiens
  chr1.fa.O7frz.231023129
  Located on chromosome 1
  Distance between a terminus base of telomere on chromosomal short arm and 5'-terminus of this base sequence : 206251501
  Distance between 3'-terminus of neighbour sequence of sequence listing upward to telomere on chrosomal short arm and 5'-terminus of this base sequence : 168633
agaatcatatgaggcctagaagtcgaggtcgccttgagctgtgatcgtgccactgtattctagcctgggtgaccgggagtgtgatgctgtctcaacaagaaagaagaaaaagagagagagagagagagagggagggagagagagagagagagagagagaaagaaagaaaaggaaagaaaggaaagaaaaagaaaaaggaaagaaaagaaagaaaaagaaaagaaagaaagagaaaagaaagaaaaagaaaagaaagagagaggctgggcacagtggctcacgcctgtaatcccagcactttgggaggccgaggcgggcagatcacgaggtcaggagatcaagacc

SEQ ID NO: 1772 - DNA, 92 bp, Homo sapiens
  HUMUT995
  Located on chromosome 1
  Distance between a terminus base of telomere on chromosomal short arm and 5'-terminus of this base sequence : 206295394
  Distance between 3'-terminus of neighbour sequence of sequence listing upward to telomere on chrosomal short arm and 5'-terminus of this base sequence : 43548
gggcaacagagtaagaccccatctcaaaaaagaaagaaagaaagaaagaaagaaagaaagaaagagcgagcaagcacaggggctatgggaaa

SEQ ID NO: 1773 - DNA, 235 bp, Homo sapiens
  D1S2615
  Located on chromosome 1
  Distance between a terminus base of telomere on chromosomal short arm and 5'-terminus of this base sequence : 206296065
  Distance between 3'-terminus of neighbour sequence of sequence listing upward to telomere on chrosomal short arm and 5'-terminus of this base sequence : 579
acagcgcctggctataattatttatttactcttgtcctgggttcttttcttcccatcccaccttttctctcatctttttatttctttctctcaagagtaaacaccctctaaacacacacacacacacacacacacacacacacactttctcacctggttctcattcattcattcaaacatttattcagatactactatttatatatagcatcctgccaggcactacaacattgtc

SEQ ID NO: 1774 - DNA, 455 bp, Homo sapiens
  chr1.fa.O7frz.232520998
  Located on chromosome 1
  Distance between a terminus base of telomere on chromosomal short arm and 5'-terminus of this base sequence : 206532246
  Distance between 3'-terminus of neighbour sequence of sequence listing upward to telomere on chrosomal short arm and 5'-terminus of this base sequence : 235946
caagtccatgaagaggttagaaaatccctagtttaaatattgtctacagaagccccctgctaaaacacacacacacacacacacacacacacacgttctctcagaaaggctgtacatcagtgcaacagtgacaaccctgggaatgctacacaagtaacaccaggagccaaccattttccacactctaactgtctaatagagatcatatagttactaagtcaaaatatgagtctgcaccaccgaatacagacacagcttttgctgaacttacatcattaagtacattcccagagaaaaccctagacatcttctgctaatcagagccattaatcaacacaaatgtcctcaaataatgtttgcagaagaagaaacaaagtaataagcatagcaaatttggagaataaaaatatttcaaaactagggatccatgtgggacaaatattaaacagggtcct

SEQ ID NO: 1775 - DNA, 107 bp, Homo sapiens
  D1S1727
  Located on chromosome 1
  Distance between a terminus base of telomere on chromosomal short arm and 5'-terminus of this base sequence : 206762121
  Distance between 3'-terminus of neighbour sequence of sequence listing upward to telomere on chrosomal short arm and 5'-terminus of this base sequence : 229420
tctggctagggtaggggtaaatggtgtttgggtgcacctgggtgtgtgtgtgtgtgtgtgtgtgtgtgtgtgcgcgcgcgcgcgttggtgagttgagttgctgggtt

SEQ ID NO: 1776 - DNA, 254 bp, Homo sapiens
  AC018896.3_136227
  Located on chromosome 1
  Distance between a terminus base of telomere on chromosomal short arm and 5'-terminus of this base sequence : 206809983
  Distance between 3'-terminus of neighbour sequence of sequence listing upward to telomere on chrosomal short arm and 5'-terminus of this base sequence : 47755
ccaggtctactcattatcacctacaatgcaaatttgaattttgcttttttaatttacttcccctgcagtcttcccatatctcacctagttccatttacacttcaatttgtctttgaaacttgccttttattttattttattttattttattttattttattttattttatgctgttgttcttctgtcttagctttttttcttttcatggatttttgttcctgtttcagagaggtcatgatttcttgtaccttac

SEQ ID NO: 1777 - DNA, 407 bp, Homo sapiens
  AC018896.3_63634
  Located on chromosome 1
  Distance between a terminus base of telomere on chromosomal short arm and 5'-terminus of this base sequence : 206898326
  Distance between 3'-terminus of neighbour sequence of sequence listing upward to telomere on chrosomal short arm and 5'-terminus of this base sequence : 88089
cattacaagtcagtttccgaagagttacaatgtgtgtctccatgacttggagaagtttttgttgttgttgttgttgttgttgttgtttaaaaaaaaaaaaaacagtgtctcactgtatctcccaggctggagtacagtggtgcagtctcagctcactgcatgcaacctccgtctcccaagttcaagctattctcatgcatcagcctcccaagtagctggaactataggtgcccaccaccatgcccagctaatttttgtatttttagtagggatggggtttcgccatgttggccaggctggtctcaaactcttggcctcaaatgatctgcctgcctcggcctcccaaagtgctgggattacaggcatgagccaccgcgcatggccgacctggagaactcctaaggtac

SEQ ID NO: 1778 - DNA, 480 bp, Homo sapiens
  AL359453.6_42128
  Located on chromosome 1
  Distance between a terminus base of telomere on chromosomal short arm and 5'-terminus of this base sequence : 207080381
  Distance between 3'-terminus of neighbour sequence of sequence listing upward to telomere on chrosomal short arm and 5'-terminus of this base sequence : 181648
cagttgtcctaatgaagtccatgggagcagaaagatccaatccaggatcactatacccaatttttgtgtatctctagttagactttccttgacttatatgaccttggttttttgggggtattttgttttgttttgttttgttttgttttgttttgttgttgcccaggctgaagtgcagtagtatgatcttagctcactgtatcctctgcctcttgtgctcagaggatcctcccacctcagcatcttgagtagctgggactacggtgggcaccaccatgccttgctaattttgggtttttttgttttgttttgttttgttttgtttttttggtagagacggggttttatgacattgcccaggctaatcttgaacccctgggctcaagagatttgctctccttagcctcccaaagtgctgagattacgggcatgagccatcacgcctggctgaccttgatatttttgaagatagcaggccag

SEQ ID NO: 1779 - DNA, 234 bp, Homo sapiens
  D1S1647
  Located on chromosome 1
  Distance between a terminus base of telomere on chromosomal short arm and 5'-terminus of this base sequence : 207135876
  Distance between 3'-terminus of neighbour sequence of sequence listing upward to telomere on chrosomal short arm and 5'-terminus of this base sequence : 55015
accagcctcctacaactcctgtccacatagaggccccttccccagggacagccacagtgagtcatggccactgagaagggtctctggtagtatcaaggaatttcctaaatggagtcaggccaaggagaagcctagattggcgttcaaaagaaccgtaagatagatagatagatagatagatagatagatagatagatagatagatagatagatatcaaggttccaagcttcaag

SEQ ID NO: 1780 - DNA, 195 bp, Homo sapiens
  HUMUT5790
  Located on chromosome 1
  Distance between a terminus base of telomere on chromosomal short arm and 5'-terminus of this base sequence : 207135980
  Distance between 3'-terminus of neighbour sequence of sequence listing upward to telomere on chrosomal short arm and 5'-terminus of this base sequence : -130
ctaaatggagtcaggccaaggagaagcctagattggcgttcaaaagaaccgtaagatagatagatagatagatagatagatagatagatagatagatagatagatagatatcaaggttccaagcttcaagtaaccaagagtatatacggttatttcttggaagacaccaggtttaagtgacaaaggtgttgaggc

SEQ ID NO: 1781 - DNA, 248 bp, Homo sapiens
  D1S2655
  Located on chromosome 1
  Distance between a terminus base of telomere on chromosomal short arm and 5'-terminus of this base sequence : 207143356
  Distance between 3'-terminus of neighbour sequence of sequence listing upward to telomere on chrosomal short arm and 5'-terminus of this base sequence : 7181
agggtccccaaagagccttcttttcccacacaactttactgtccatggctcattccaggaatgaagagagatgctcaaagagacacacacacacacacattccaggaatgaagagaaatgctcaaagacacacacacacacacacacacacacacacacacacacatacacacacacacacacacacacacacacgatcattggccactgtgatgccttccctgtcaggaagcaggatgtgctgccat

SEQ ID NO: 1782 - DNA, 303 bp, Homo sapiens
  Z67374
  Located on chromosome 1
  Distance between a terminus base of telomere on chromosomal short arm and 5'-terminus of this base sequence : 207143390
  Distance between 3'-terminus of neighbour sequence of sequence listing upward to telomere on chrosomal short arm and 5'-terminus of this base sequence : -214
tttactgtccatggctcattccaggaatgaagagagatgctcaaagagacacacacacacacacattccaggaatgaagagaaatgctcaaagacacacacacacacacacacacacacacacacacacacatacacacacacacacacacacacacacacgatcattggccactgtgatgccttccctgtcaggaagcaggatgtgctgccattttgttggtccagaaggctcaaaaaacaggaactgctgcaagtttgtgccagtagagagcctcgcttggggtgaggcagatgtgaagct

SEQ ID NO: 1783 - DNA, 110 bp, Homo sapiens
  D1S1724
  Located on chromosome 1
  Distance between a terminus base of telomere on chromosomal short arm and 5'-terminus of this base sequence : 207165554
  Distance between 3'-terminus of neighbour sequence of sequence listing upward to telomere on chrosomal short arm and 5'-terminus of this base sequence : 21861
aggctatatccagggacacccacccaagcatagattgggaaggaaccaaggtctggtgtgagtgtgtgtgtgtgtgtgtgtgtgtgtgtgtacagcgagaccccaaagct

SEQ ID NO: 1784 - DNA, 101 bp, Homo sapiens
  DISD22_0000988
  Located on chromosome 1
  Distance between a terminus base of telomere on chromosomal short arm and 5'-terminus of this base sequence : 207285625
  Distance between 3'-terminus of neighbour sequence of sequence listing upward to telomere on chrosomal short arm and 5'-terminus of this base sequence : 119961
tgccaatacgttctcactgactgtgattctgctgtgaacacacacacacacacaaacacacacacaagccccttctgtgtatgatcaggacaagtagttca

SEQ ID NO: 1785 - DNA, 300 bp, Homo sapiens
  Z66811
  Located on chromosome 1
  Distance between a terminus base of telomere on chromosomal short arm and 5'-terminus of this base sequence : 207606214
  Distance between 3'-terminus of neighbour sequence of sequence listing upward to telomere on chrosomal short arm and 5'-terminus of this base sequence : 320488
tactgttgctgctgctatgacaatagccaggatggggtagtcacaggccactcacacttagaccccatgaccacccatgtgtcctcccactggtggttaaggcaaataaccaaggtcaatttatacacatctgagttctctcaacccaaaaccaggcccccagtggagacagaaatctcctaccttttcaggaggcttaacaccttcttttctccctcttctcctacacaccacacacacacacacacacacacacacgcgtacacacacacaggcagcagtcttccattagcaccactg

SEQ ID NO: 1786 - DNA, 343 bp, Homo sapiens
  chr1.fa.O7frz.234531184
  Located on chromosome 1
  Distance between a terminus base of telomere on chromosomal short arm and 5'-terminus of this base sequence : 207623173
  Distance between 3'-terminus of neighbour sequence of sequence listing upward to telomere on chrosomal short arm and 5'-terminus of this base sequence : 16659
aacaattaaactcctgtccaaccaggtctcaaagccctgtggcttgcccttgccttgctggagatttgactgaggcccagcagggcccagcacatttccaagggtagatgagacgcactaggccctcatgccagggacacaggcaggcagaaaaggggtattgttgtcctctcccccacactgagggatgaggcatctctgctcaacacacacacacacacacacacacacacacacacacacaccccatgccaaaatgccaaggaaggagtcaggagcagaacctggctcaggacaggatgggggctgccatggggaccagattctaggtgattcagcactc

SEQ ID NO: 1787 - DNA, 134 bp, Homo sapiens
  D1S504
  Located on chromosome 1
  Distance between a terminus base of telomere on chromosomal short arm and 5'-terminus of this base sequence : 207777159
  Distance between 3'-terminus of neighbour sequence of sequence listing upward to telomere on chrosomal short arm and 5'-terminus of this base sequence : 153643
tgtggaaagacaagatgctatctcacctttatgactgttagattggcatgccttttgcaacaggtaaagtgtgcatgggtgggtacacacacacacacacacacacacacacacacggctccatgtaaccttgc

SEQ ID NO: 1788 - DNA, 303 bp, Homo sapiens
  chr1.fa.O7frz.234282552
  Located on chromosome 1
  Distance between a terminus base of telomere on chromosomal short arm and 5'-terminus of this base sequence : 207872123
  Distance between 3'-terminus of neighbour sequence of sequence listing upward to telomere on chrosomal short arm and 5'-terminus of this base sequence : 94830
tcgtgatatcagaatttaggatagtctagattattcattcatcaaaaaataaataaataaatatatatatatatatatatatatatattaagagcctaccatgtgctagacggacattgtgaataggcagacaaggccactgacctcaaggggtttccagtccaggagaggaagcacttcagaggttccaactatttgcaaattcactgttatagaaaccatctgaaaaggatttgttattaacacttaaatagctaccatttgttgagagcttattatgtcagtactagatgccttacaatt

SEQ ID NO: 1789 - DNA, 101 bp, Homo sapiens
  DISD22_0000997
  Located on chromosome 1
  Distance between a terminus base of telomere on chromosomal short arm and 5'-terminus of this base sequence : 207996254
  Distance between 3'-terminus of neighbour sequence of sequence listing upward to telomere on chrosomal short arm and 5'-terminus of this base sequence : 123828
tttatgtgtcggagttcggctggtgtgtgtgtgtgtgtgggtgtgtgtgtgtgtgtgtgtgtgtgtgtgtgtgttcctatatgaggtgtggatacagctgg

SEQ ID NO: 1790 - DNA, 357 bp, Homo sapiens
  HUMUT8081B
  Located on chromosome 1
  Distance between a terminus base of telomere on chromosomal short arm and 5'-terminus of this base sequence : 208368737
  Distance between 3'-terminus of neighbour sequence of sequence listing upward to telomere on chrosomal short arm and 5'-terminus of this base sequence : 372382
gcctgagaaccgtttctttctttcttttcttctgtttctttctttctctttctttctttctttctttctttctttctttctttctttctttctttctttctttctttctttcttccttccttccttccttccttccttccttcctttctctctttcttctttcctttctctctttctttctctttcttttcttttctttccttccttccttccttccgtccttccttccttccttccttccttccttccttccttccttccttccttccttccttctttcttttctttttttctcttttattttttgagatggagtttctctcttgttgcaatggtgcgatctcggctcaccacaac

SEQ ID NO: 1791 - DNA, 233 bp, Homo sapiens
  AC073251.1_88692
  Located on chromosome 1
  Distance between a terminus base of telomere on chromosomal short arm and 5'-terminus of this base sequence : 208618072
  Distance between 3'-terminus of neighbour sequence of sequence listing upward to telomere on chrosomal short arm and 5'-terminus of this base sequence : 248978
acacctgctaatccaagatttattaatttaatcacatctgcaatgcccttttcctttcctttctttctttctttctttctttctttctttctttctttctttctttctttctttccttccttccttccttcttttttttattgagacaaggtctcgctttgtcacccaggctgcagtgcagtggcacaatctcagttcagggcaacctccaccttccaggttcaagtgattct

SEQ ID NO: 1792 - DNA, 266 bp, Homo sapiens
  D1S2717
  Located on chromosome 1
  Distance between a terminus base of telomere on chromosomal short arm and 5'-terminus of this base sequence : 208675303
  Distance between 3'-terminus of neighbour sequence of sequence listing upward to telomere on chrosomal short arm and 5'-terminus of this base sequence : 56998
atgctctaatctctctggggaggtgaaacagttcattgtgggaacaaagcctctttcccatctctgtagccttgggttggaaggctgggggcaaggtgaaatcagactggggtttgagtcctggctctgcttctgagccctgtgatttctggcaaataacagaacttttttcgttttctttgtgtgcgtgtgcgtgtgtgtgtgtgtgtgtgtgtgtttgtgttttagatgggggtctcactatattgcacaggctggtcttgaac

SEQ ID NO: 1793 - DNA, 234 bp, Homo sapiens
  D1S2668
  Located on chromosome 1
  Distance between a terminus base of telomere on chromosomal short arm and 5'-terminus of this base sequence : 208696114
  Distance between 3'-terminus of neighbour sequence of sequence listing upward to telomere on chrosomal short arm and 5'-terminus of this base sequence : 20545
aatcacttgaacctgggaggcggaggttgcagtgagccgagatcgtgcccttgcactccagcctaggtgacagagtgagactctgtctcaaaaaaaaaaaaatgcatttgtatacatacaaacatgcacagacacatgcacacatgcgtgcacacacacacacacacacacacacactttctctctctcgctgtcgctctccaactctgttgggctcagaaacagccagtcagt

SEQ ID NO: 1794 - DNA, 191 bp, Homo sapiens
  D1S510
  Located on chromosome 1
  Distance between a terminus base of telomere on chromosomal short arm and 5'-terminus of this base sequence : 208895108
  Distance between 3'-terminus of neighbour sequence of sequence listing upward to telomere on chrosomal short arm and 5'-terminus of this base sequence : 198760
aacccgaggtgtctgtggacacttgtatgtcccctcctaccttcctgctcctgtctgaatagggggttccttggagaaggagaataaattgttttgtaaacacacacacacacacacacacacacacacacacacacacacacacacccgtcctcccctacaccttatatacaggtcacattttgttccct

SEQ ID NO: 1795 - DNA, 185 bp, Homo sapiens
  D1S2683
  Located on chromosome 1
  Distance between a terminus base of telomere on chromosomal short arm and 5'-terminus of this base sequence : 208997477
  Distance between 3'-terminus of neighbour sequence of sequence listing upward to telomere on chrosomal short arm and 5'-terminus of this base sequence : 102178
tgccttgtcttcaagagccaggaaatattcatttaatatcttctacatataatcacaccacctttacctaggtgatcacttaggtacacacacacacacacacacacacacacacacacacgttgtctagagtctcccttctggacctctgcctgccccagatccttccagattcctgtcactgc

SEQ ID NO: 1796 - DNA, 287 bp, Homo sapiens
  AL359090.5_24138
  Located on chromosome 1
  Distance between a terminus base of telomere on chromosomal short arm and 5'-terminus of this base sequence : 209049216
  Distance between 3'-terminus of neighbour sequence of sequence listing upward to telomere on chrosomal short arm and 5'-terminus of this base sequence : 51554
ctggtgctactgttcattgagtgcccagataagttactgcgccagcctcatcctcacagggggcctgccaagccaaccttctcctcccattgtgcccaggacaaaaccaaggctcaaggaattgttacttgctccaggccacaagctgttaatggtggagtcacagtttgaactcggatcttaccccacagcacacttcatgcatgcatgcattcattcattcattcattcattcattcattcttatactcaataaatatttatttctctttacattccatcttgcc

SEQ ID NO: 1797 - DNA, 478 bp, Homo sapiens
  AL359090.5_63461
  Located on chromosome 1
  Distance between a terminus base of telomere on chromosomal short arm and 5'-terminus of this base sequence : 209088797
  Distance between 3'-terminus of neighbour sequence of sequence listing upward to telomere on chrosomal short arm and 5'-terminus of this base sequence : 39294
gtgatgctttacagtgagcttctgtctggaggctttgtaaagcccctagggctgggaagaaattacttttatgtgtgaagtattatatcagcaccattttctctaagattcccatatgtgttaatattcctagactgccaggaaatgtaggttttatttatttatttatttatttatttatttatttattttactacctctaaggctgcaatgtcatcagttctaaagccataccagagttttctagaggacttcataggtgtcatttccacatgtaaaatgtagtctttattccttaatagtggcttatcatataacaaaaattctttgcttggccaaatttcaggcgggcttctgaatcttctcctaggcccatctgtgcacttccttgtaaaatccagttttagcaaagagccctgctaagtcaatttagcaagaaccccctaccctcaacatctgaataccttgacatctgacc

SEQ ID NO: 1798 - DNA, 227 bp, Homo sapiens
  D1S2760
  Located on chromosome 1
  Distance between a terminus base of telomere on chromosomal short arm and 5'-terminus of this base sequence : 209217401
  Distance between 3'-terminus of neighbour sequence of sequence listing upward to telomere on chrosomal short arm and 5'-terminus of this base sequence : 128126
atacattcttacctcaggggtttccagcattcatgcatatggtttaaaactgctcacatctttatgacatatttcttacttcagaactccttaaggatgtatacacatagtttattactgttcacacttttatagcaaacacagtcagcacattgctctgtgtgtgtgtgtgtgtgggtgtctgtgtgtgatggagtctcgctccttcacccaggctggagtgcagt

SEQ ID NO: 1799 - DNA, 317 bp, Homo sapiens
  AL359837.13_58710
  Located on chromosome 1
  Distance between a terminus base of telomere on chromosomal short arm and 5'-terminus of this base sequence : 209297236
  Distance between 3'-terminus of neighbour sequence of sequence listing upward to telomere on chrosomal short arm and 5'-terminus of this base sequence : 79608
gatccatgagcacagaatatctttccatttgtttatatcttttttagtttttttattgatgctttatacttttcaatgtacagatctttcatctccttgattatttctcccaagtattttattttattttattttattttattttatttttgatgatatcacaaataagattgtgtttgttatttctttttcagctaggtcattatttgtgtataaaaatgctactaattggggccaggcgtggtggctcatgcctgtaatcccagcactttgggatgccgaggtgggtggatcacctgaggtcaggagttcaagac

SEQ ID NO: 1800 - DNA, 480 bp, Homo sapiens
  AL359837.13_171363
  Located on chromosome 1
  Distance between a terminus base of telomere on chromosomal short arm and 5'-terminus of this base sequence : 209356644
  Distance between 3'-terminus of neighbour sequence of sequence listing upward to telomere on chrosomal short arm and 5'-terminus of this base sequence : 59091
cttaaatcaagtgcgaggaactgagtttccttggaccacagtgacgagaattctgccttcctgttgccagcctggtataatctgggttcacctttactccaagggtgttgtcctttgtggtccttgcttatggaagggatggatgtctctccactttcttcaaaccctgagttttgatttctttctttctctctttctctctttctttctttctttctttctttctttctttctttctttctttctctctttcttctttttttgagacagagtctcgctctgttgcccagctggagtgcaatggcgcagtctcagctcactgcagcctccaccccctggattcaagcgctcctcccacctcagcctcctgaatagctgggattacaggcacctgccaccacacctgactaattttatttttagtagagatggggttttaccacgttggctgggctggtcttgaactcctgaactcaagtg

SEQ ID NO: 1801 - DNA, 304 bp, Homo sapiens
  D1S1678
  Located on chromosome 1
  Distance between a terminus base of telomere on chromosomal short arm and 5'-terminus of this base sequence : 209461832
  Distance between 3'-terminus of neighbour sequence of sequence listing upward to telomere on chrosomal short arm and 5'-terminus of this base sequence : 104708
actttctcacatgaccacaggagagagtagtgcaaggagaaaagggggaagaacccttataaaaccatcagatctcatgagaactcactcaatatcatgagaactgcatgggggaaacagtccccatgatccaaacacctcccatcaggtctctccctagacatgtggagattatggggattacaattcaagatgagatttgggtagggacacagtcaaaccatataatttcccttccttccttccttccttccttccttccttccttccttccttcctttctttttttgacagagtctcgctg

SEQ ID NO: 1802 - DNA, 277 bp, Homo sapiens
  AL390207.5_48156
  Located on chromosome 1
  Distance between a terminus base of telomere on chromosomal short arm and 5'-terminus of this base sequence : 209461897
  Distance between 3'-terminus of neighbour sequence of sequence listing upward to telomere on chrosomal short arm and 5'-terminus of this base sequence : -239
catcagatctcatgagaactcactcaatatcatgagaactgcatgggggaaacagtccccatgatccaaacacctcccatcaggtctctccctagacatgtggagattatggggattacaattcaagatgagatttgggtagggacacagtcaaaccatataatttcccttccttccttccttccttccttccttccttccttccttccttcctttctttttttgacagagtctcgctgtgttgcccaggctggagtacagtagcatgacctcagct

SEQ ID NO: 1803 - DNA, 199 bp, Homo sapiens
  chr1.fa.O7frz.234646305
  Located on chromosome 1
  Distance between a terminus base of telomere on chromosomal short arm and 5'-terminus of this base sequence : 209603365
  Distance between 3'-terminus of neighbour sequence of sequence listing upward to telomere on chrosomal short arm and 5'-terminus of this base sequence : 141191
gaaacagtacttaacatggcagaacatgtcaccttcaggtagttctattctcttttcttcctgtatggatggatgtgtgtgtgtgtgtgtgtgtgtgtgtgtgtgtgtgtgtgtgtgtgtgtagggggattgggagacctcagatatacatgagctgaattaatcatgttctccagtacttagtataccatgcatccac

SEQ ID NO: 1804 - DNA, 338 bp, Homo sapiens
  chr1.fa.O7frz.235542701
  Located on chromosome 1
  Distance between a terminus base of telomere on chromosomal short arm and 5'-terminus of this base sequence : 209842226
  Distance between 3'-terminus of neighbour sequence of sequence listing upward to telomere on chrosomal short arm and 5'-terminus of this base sequence : 238662
tagttagcagtggttaactggttctcaaacttgagtttaaagtacgtaaggatcacctgggatgtttgtttaaaatacttacattctctggttccacacccagagtaatttattctgaaggtctaggatagggccatataatgtatattttaacaagccttttagagcaggtggtttaggcattattatgttttgccaaatccagttgggtgctggttgtgagggggtgtgtgtgtgtgtgtgtgtgtgtgtgtatggtttgccctattggctacatcagcagttacttccccagattgtgtttgcttttgcagccagtagctggtttgaaattcaag

SEQ ID NO: 1805 - DNA, 152 bp, Homo sapiens
  Z23292.1_191
  Located on chromosome 1
  Distance between a terminus base of telomere on chromosomal short arm and 5'-terminus of this base sequence : 210366283
  Distance between 3'-terminus of neighbour sequence of sequence listing upward to telomere on chrosomal short arm and 5'-terminus of this base sequence : 523719
ttccacttcaccatttgacttcaggatcagggacaaactggaggggtgagggaagaagagagacttcacccctgtccacctgcaccacacacacacacacacacacacacacacacatacacacatttagatttattctagatccagttcct

SEQ ID NO: 1806 - DNA, 199 bp, Homo sapiens
  D1S456
  Located on chromosome 1
  Distance between a terminus base of telomere on chromosomal short arm and 5'-terminus of this base sequence : 210366301
  Distance between 3'-terminus of neighbour sequence of sequence listing upward to telomere on chrosomal short arm and 5'-terminus of this base sequence : -134
cttcaggatcagggacaaactggaggggtgagggaagaagagagacttcacccctgtccacctgcaccacacacacacacacacacacacacacacacatacacacatttagatttattctagatccagttcctcctggacactgaggtgttaaaccctagtcaggtaaaaagaacatcaaggtaaggaggtatgtggc

SEQ ID NO: 1807 - DNA, 269 bp, Homo sapiens
  chr1.fa.O7frz.235616805
  Located on chromosome 1
  Distance between a terminus base of telomere on chromosomal short arm and 5'-terminus of this base sequence : 210447378
  Distance between 3'-terminus of neighbour sequence of sequence listing upward to telomere on chrosomal short arm and 5'-terminus of this base sequence : 80878
tacagaaacttgcaaggatagtacaaacacctcccacattccttccactccagttcctcagttggtacctggtaccacatttgaggagtgtgtgtgtgtgtgtgtgtgtaccctaccattgtctctttctgaatgatttgagagcaaattgcagacatgaagcccctgggctccccagtaagtattctgcctaccaaaggacactctcctacataaccaccatatgatcctccagataaggaaatccacgctgattcattgcttccaac

SEQ ID NO: 1808 - DNA, 177 bp, Homo sapiens
  D1S249
  Located on chromosome 1
  Distance between a terminus base of telomere on chromosomal short arm and 5'-terminus of this base sequence : 210571061
  Distance between 3'-terminus of neighbour sequence of sequence listing upward to telomere on chrosomal short arm and 5'-terminus of this base sequence : 123414
tggcatgtctttgaaggaattatgtctttttagaggaaactgacaggtaattttaaaaagtatagatccaaggttaataaactcacttctctctcacacacacacacacacacacacacacacacacacacacacacactagagaataagagaatgagccagtctcatctacaacca

SEQ ID NO: 1809 - DNA, 461 bp, Homo sapiens
  chr1.fa.O7frz.236267010
  Located on chromosome 1
  Distance between a terminus base of telomere on chromosomal short arm and 5'-terminus of this base sequence : 210958887
  Distance between 3'-terminus of neighbour sequence of sequence listing upward to telomere on chrosomal short arm and 5'-terminus of this base sequence : 387649
aaggacttcagagcttgtctactgccaaccctcattttacccaatgaggaaagtgaagctattagggggcgagggacacgtggaaggtcacacagcacacaggaggtgattcacatgtagatttcagcacctgctcctgccacgctggactggttcacctcctaggctgaccctgcctctcccctgttcacacacactctcgcacacacacacacacacacacacacacacaggtgctttgttctggccaggggttcctagggtcacctcttggttgcagccactgtgaccccaactggtctaacctctctcttcccctcccacttccttcctgtggttcctgcaggagatgttcgggagcatgtttcacgcagagaccctgaccgccctgtgagggctcagccagtcctcatgctgcctacagagtgcctggcacttgggacttccataaaggatgagcc

SEQ ID NO: 1810 - DNA, 225 bp, Homo sapiens
  DISO7_00002143
  Located on chromosome 1
  Distance between a terminus base of telomere on chromosomal short arm and 5'-terminus of this base sequence : 211085101
  Distance between 3'-terminus of neighbour sequence of sequence listing upward to telomere on chrosomal short arm and 5'-terminus of this base sequence : 125753
gtaacccagtccatggcttcctgccactgcagtgggcccagggctggcttagtgctggaatgcaagtggctgtggcttggagcctcccctctggctgagggaaaaaaattgctgacaaatctgcttggaatatctgagtttttccaacgcggaaagaaaacacacacacacacacacacacacacacacacacacacacacgccagtcttatcataagcctggca

SEQ ID NO: 1811 - DNA, 442 bp, Homo sapiens
  U16720.1_2859
  Located on chromosome 1
  Distance between a terminus base of telomere on chromosomal short arm and 5'-terminus of this base sequence : 211357001
  Distance between 3'-terminus of neighbour sequence of sequence listing upward to telomere on chrosomal short arm and 5'-terminus of this base sequence : 271675
acatagaatgaaaccttggattaaattggccttagagtttcttttagttgtaagcttctgtggctggagtctaaagtttaaaagatggggtggaagaagttgaaataacaaggaaaagaagtcaggattccatggaggctggataggaggtcccttactttcctcttacctatccctacttccccttcccaaagaagccttagtagtgttgtcttggatttgtgtgtgtgtgtgtgtgtgtgtgtgtgtgtgtgtgtgtgtgtgtagaaggtaaggggagccagttgggttgcggcgaggagtgttgctctacctggggaaggaccggggcagtgacatcaggacttcttcagatatctggaaagtctctggggatcctttgattgagccttcaccttccccttccacaggggctttgcctgccattccagtttagactgta

SEQ ID NO: 1812 - DNA, 267 bp, Homo sapiens
  D1S2772
  Located on chromosome 1
  Distance between a terminus base of telomere on chromosomal short arm and 5'-terminus of this base sequence : 211391919
  Distance between 3'-terminus of neighbour sequence of sequence listing upward to telomere on chrosomal short arm and 5'-terminus of this base sequence : 34476
gcactactgcactccagcctgagaaacagagcgagactccatctaaacaaaaataaacaacaacaaaaaacaaaccataccaaacaaaagatattgactgatgtgatgtgaagctctgagagtagaattaaccgtgcatgtagagtgactgtggccttgaaggaaggatagaattcagaaaattagggagaggtatgaagggaattgtgtgtgtgcgtgtgtgtgtgtgtgtgtgtgtgtgcccatgtgcacgcatggtggggtgag

SEQ ID NO: 1813 - DNA, 323 bp, Homo sapiens
  AC068122.3_140163
  Located on chromosome 1
  Distance between a terminus base of telomere on chromosomal short arm and 5'-terminus of this base sequence : 211422195
  Distance between 3'-terminus of neighbour sequence of sequence listing upward to telomere on chrosomal short arm and 5'-terminus of this base sequence : 30009
tttcaaatgaggacagtgagaccttgggagggagcatgactagttagtggcagagttaggaacagacccccaaatatatgcccccatcttcagattctttctcctctcaaggttgggaagtagctcatgtggaataagaaaaggagtcaataaggattcaggttccttcccttcctttcccttcccttcccttcccttcccttcccttcccttcccttcccttcccttcccttcccttcctctctccttcccttcctttctcactcccaccttccttttttctgcagtgttcctttttctagtaccacagtctttgatagtgc

SEQ ID NO: 1814 - DNA, 223 bp, Homo sapiens
  D1S2735
  Located on chromosome 1
  Distance between a terminus base of telomere on chromosomal short arm and 5'-terminus of this base sequence : 211502199
  Distance between 3'-terminus of neighbour sequence of sequence listing upward to telomere on chrosomal short arm and 5'-terminus of this base sequence : 79681
ttccaaaacctgaccttcacacactcttccgatgaccccatcatccacccatctgctgaagcctagaactcatcttcatgttaaagaatcaagaataaattttaagtgtgtgtgtgtgtgtgtgtgtgtgtgtgtgtgtgtctgtgcatgctgggtcccagcatcaaatgtatgtatgtatgtatgtattattattatcattagtcaaggtaaaaaggtttga

SEQ ID NO: 1815 - DNA, 424 bp, Homo sapiens
  AC068122.3_49701
  Located on chromosome 1
  Distance between a terminus base of telomere on chromosomal short arm and 5'-terminus of this base sequence : 211502267
  Distance between 3'-terminus of neighbour sequence of sequence listing upward to telomere on chrosomal short arm and 5'-terminus of this base sequence : -155
ctcatcttcatgttaaagaatcaagaataaattttaagtgtgtgtgtgtgtgtgtgtgtgtgtgtgtgtgtgtctgtgcatgctgggtcccagcatcaaatgtatgtatgtatgtatgtattattattatcattagtcaaggtaaaaaggtttgaaagctcacactgcatgacactgccttgctttattatagagctctacacagggctccaggcaaagtggtctacagtttgtgcctcatgcgctaggccctagggagacccactccagcatttgcaggacctggagtaggagtacaaattaaagcccaaatactatatatctgaatatttttaagttataaatcaagctaataaactgttaaataaaattcgctttacttccctagcttgactaatgcaccctccttggatgtccactctac

SEQ ID NO: 1816 - DNA, 191 bp, Homo sapiens
  AJ005577.1_4069
  Located on chromosome 1
  Distance between a terminus base of telomere on chromosomal short arm and 5'-terminus of this base sequence : 211639212
  Distance between 3'-terminus of neighbour sequence of sequence listing upward to telomere on chrosomal short arm and 5'-terminus of this base sequence : 136521
gaacttcaaggaatgctaactcttgcctctgcttctggatggcaccattcctgcagaatcctgtcagtcagttcttctcacttcagtggttatatatatatatatatatatagccagttagtcaaggaatatatatatctcagcaggtggaaacagccgaccagcatgagaccaggaattatctcatgttc

SEQ ID NO: 1817 - DNA, 225 bp, Homo sapiens
  D1S2727
  Located on chromosome 1
  Distance between a terminus base of telomere on chromosomal short arm and 5'-terminus of this base sequence : 211647490
  Distance between 3'-terminus of neighbour sequence of sequence listing upward to telomere on chrosomal short arm and 5'-terminus of this base sequence : 8087
gttggtgacacccctacatatcatctcctcttcaccttttgtgctgtgtgtgttgtggggtgtgtgtgtgtgtgtgtgtgtgtgtgttgttggggaggggtgttttcgtaatgaaagagagaaatagacatgtttaacatcacaaagagatcttttctatctgccagagccccatctggtacttctacactcttctcttgggagaggaaactgaggctttaagga

SEQ ID NO: 1818 - DNA, 250 bp, Homo sapiens
  AJ005577.1_16470
  Located on chromosome 1
  Distance between a terminus base of telomere on chromosomal short arm and 5'-terminus of this base sequence : 211651663
  Distance between 3'-terminus of neighbour sequence of sequence listing upward to telomere on chrosomal short arm and 5'-terminus of this base sequence : 3948
attaactatgtagcaccttatggattttgaccatggttatgcacgttgtcccttacagaccaagttagcaggctttgtgtatgtgtgtgttgagtgtgtgtgtgtgtgtgtgtgtctgtgtgttttctttttacccttaattttcatttttaaaccccagtttgcccaagctctaaggaaatttctggaggaacaggaaataacagacctcaaagtgtggacaagccagttgaagaggaccatacagact

SEQ ID NO: 1819 - DNA, 448 bp, Homo sapiens
  chr1.fa.O7frz.237716995
  Located on chromosome 1
  Distance between a terminus base of telomere on chromosomal short arm and 5'-terminus of this base sequence : 211785671
  Distance between 3'-terminus of neighbour sequence of sequence listing upward to telomere on chrosomal short arm and 5'-terminus of this base sequence : 133758
tacctatgtatcaaacctgcacattgtgcacatgtaccctagaacttatagtataataataataataataataataataataataataataaaaacaaaaaaactaaatatgcaacgacaggtgaatggataagcaaattgttttgtatccatactagagaatggctgattttaatgtatgtgatgccaatgagtttgcaggattcctaaacatttgaaaattggctttctgtgagctggtatatgctgactgtagcacaccactggatataaataatgtatatatgaaaaaaaaaaaagagcaatgggcagtgcagctgagagaaggctgtctgccaagaggcaggggctggagagaagttctacagggtcatgctggaggggctatgtgtggaatgaggtatttgggaataggatgttgtgccagatagtggtttgtggctagaat

SEQ ID NO: 1820 - DNA, 399 bp, Homo sapiens
  chr1.fa.O7frz.237834936
  Located on chromosome 1
  Distance between a terminus base of telomere on chromosomal short arm and 5'-terminus of this base sequence : 211904270
  Distance between 3'-terminus of neighbour sequence of sequence listing upward to telomere on chrosomal short arm and 5'-terminus of this base sequence : 118151
ctatgtaacaaacctgcatgttctgcacatgtattccagaacttaaagaatatatatttatatatgtataaatatatatgaatatataaatataaatatatatataagctccccacgtgattctaatgtgtggccagtcttgcaaacctcaggctatttattctaaagggtttgtaacaagccttcctcttaaaatccaccccaccaccattcagcgttttggggtctgtttgtttttattgttatcccaccccacaccgccccgaggcgcgcgcgcgcgcgcgcacacacacacacacacacacacacacacatacacacacgcacactggtgaatttctctctacagtcagtctggagtaatcccaaagtggtgtctttcgtaaataaggagaaccc

SEQ ID NO: 1821 - DNA, 177 bp, Homo sapiens
  Z67644
  Located on chromosome 1
  Distance between a terminus base of telomere on chromosomal short arm and 5'-terminus of this base sequence : 211981734
  Distance between 3'-terminus of neighbour sequence of sequence listing upward to telomere on chrosomal short arm and 5'-terminus of this base sequence : 77065
cagcactgacttttctgtagacagggccatccttagggcatgcaaggccccagcaaactgggtatgtgtgtgtgtgtgtgtgtgtgtgtgtgtgtgtgtatattctttgtctatgaaaacaatttgatttaaaaatgcattacacaactcatggtcccatgtgaggtatagtcattt

SEQ ID NO: 1822 - DNA, 305 bp, Homo sapiens
  chr1.fa.O7frz.237961983
  Located on chromosome 1
  Distance between a terminus base of telomere on chromosomal short arm and 5'-terminus of this base sequence : 212031062
  Distance between 3'-terminus of neighbour sequence of sequence listing upward to telomere on chrosomal short arm and 5'-terminus of this base sequence : 49151
ttctacaagaatcaaagctcaaattctcccacacccctaaaatgacctagtagatttccactttctcttttatgttgccctaataatttctcttatacattctgattatatatatttatagggatatctagatagatgatagatagatagatatatagatagataggcaggatggatggacagataggatagatagatcgatctaaacacacacacacacacacatacacacacacacacacacacacgtatttcagcacttagggttgttttcagtggaataattcatccagttaacctaggac

SEQ ID NO: 1823 - DNA, 126 bp, Homo sapiens
  D1S2796
  Located on chromosome 1
  Distance between a terminus base of telomere on chromosomal short arm and 5'-terminus of this base sequence : 212192586
  Distance between 3'-terminus of neighbour sequence of sequence listing upward to telomere on chrosomal short arm and 5'-terminus of this base sequence : 161219
aggctgatggcttagtctgttttgttctggttctttttttgttttgttttgtgtgtgtgtgtgtgtgtgtgctttttttgagagagagggtcttactcttttgcccaggtggagtagagtggtgca

SEQ ID NO: 1824 - DNA, 103 bp, Homo sapiens
  DISO7_10000765
  Located on chromosome 1
  Distance between a terminus base of telomere on chromosomal short arm and 5'-terminus of this base sequence : 212250401
  Distance between 3'-terminus of neighbour sequence of sequence listing upward to telomere on chrosomal short arm and 5'-terminus of this base sequence : 57689
tgttgtgttccaaattagtgtatgtatatatatatatatatatatagcatttttgttttaataaaaggactgccaaaatgcacatgccaatttggactctgct

SEQ ID NO: 1825 - DNA, 477 bp, Homo sapiens
  chr1.fa.O7frz.238206760
  Located on chromosome 1
  Distance between a terminus base of telomere on chromosomal short arm and 5'-terminus of this base sequence : 212314185
  Distance between 3'-terminus of neighbour sequence of sequence listing upward to telomere on chrosomal short arm and 5'-terminus of this base sequence : 63681
aatccatttggtttaaacttcttgtcaaaaaaccaagtctactagacaggatcaaaagcaacaaatcttgtatttataaaaaacatgcctcaagttaaatggcatagtattacacacacacacacacacacacacacacacacacatattaagggaatacgcaaacaaaaaatggcagaaataatatgggaaaagacagaacttaagaaagaaattgtcaagcaggtctacaaaatgattgttttattttggtgccaggtacagtccacaatgaagtcaagatattaagaagtaaagtggaccaggagaagttagagcagaaatatctcttttcaatagtgagagcagaaaaagaagtagaaaagctgggaacaataggtaaagtttaggctaggccttagacttctcctatattgtaatccctctggtttgccacatatgcatgctgtcaggaagttgatgaggtatgtacagcac

SEQ ID NO: 1826 - DNA, 386 bp, Homo sapiens
  chr1.fa.O7frz.239361935
  Located on chromosome 1
  Distance between a terminus base of telomere on chromosomal short arm and 5'-terminus of this base sequence : 212428342
  Distance between 3'-terminus of neighbour sequence of sequence listing upward to telomere on chrosomal short arm and 5'-terminus of this base sequence : 113680
gtctataaatgtcagttgcctaacagtatcgggaggctacgattcagttatttgctaatgtttgattagtgctaacaagtgccaggcactatttcaggctctaataagacagtgggtgagccagatagataatgtccctgctctcatggagatgacattctactggggatattaaggggttagaaactatctatttatctatcatctatctatctatctatctatctatctatctatctatctatctatctatctaatcatctacctctcctatctctatctatccatctatctctaccaatctatcatctatttatcaattgtggggtacttacaaggtagtgaggctctgctcccatccagttacctgtaatcagaacagtgtt

SEQ ID NO: 1827 - DNA, 133 bp, Homo sapiens
  DISD22_0001052
  Located on chromosome 1
  Distance between a terminus base of telomere on chromosomal short arm and 5'-terminus of this base sequence : 212549462
  Distance between 3'-terminus of neighbour sequence of sequence listing upward to telomere on chrosomal short arm and 5'-terminus of this base sequence : 120734
ctctttggtggaggaagccctgctcctccgcccagaagcagggagactttgagaacgtgtgtgtgtgtgtgtgtgtgtgtgtgtgtgtgtgtgtgtgtgtgattacatttttactccttctcctcagggataa

SEQ ID NO: 1828 - DNA, 145 bp, Homo sapiens
  DISD22_0001061
  Located on chromosome 1
  Distance between a terminus base of telomere on chromosomal short arm and 5'-terminus of this base sequence : 213012283
  Distance between 3'-terminus of neighbour sequence of sequence listing upward to telomere on chrosomal short arm and 5'-terminus of this base sequence : 462688
cgggacagctctaagagggaaagggactgaaagtcaaaagaaaggtattttaatggcaaactgtggtttttgaaaattgcttttaagtttcttttaaagttttctctctctctgtctctctccagagcttagtaagttgtctgca

SEQ ID NO: 1829 - DNA, 300 bp, Homo sapiens
  chr1.fa.O7frz.276638725
  Located on chromosome 1
  Distance between a terminus base of telomere on chromosomal short arm and 5'-terminus of this base sequence : 213084350
  Distance between 3'-terminus of neighbour sequence of sequence listing upward to telomere on chrosomal short arm and 5'-terminus of this base sequence : 71922
atgttcagctaatgtttgacagagatttccttgaattccaggagctgaaaacaaacaccctccactccccccaaaaggtggggggggggagagagagagagagagaaagagcgagagagagagagagagagaacaacccacctctcccagtcttttcagattgggtctgtgctgggacattcttttcccatttaaccaggcttgctctgagcctagggatcagccataggtgaaagcttacagtcttctcaggatgtttctgagtgtgtatctttcctaggcatactgtgactttctaaa

SEQ ID NO: 1830 - DNA, 319 bp, Homo sapiens
  AF198096.2_85611
  Located on chromosome 1
  Distance between a terminus base of telomere on chromosomal short arm and 5'-terminus of this base sequence : 213466304
  Distance between 3'-terminus of neighbour sequence of sequence listing upward to telomere on chrosomal short arm and 5'-terminus of this base sequence : 381654
ggatggaatgatctagaatgtaatggaatggaatggactcaaatggaatagaatggaatagaatggactcgaatataatggaatgaaattggctcgaatggaatggaatggacttgaatggaatggaatcgaatggaatggaatggaatggaatggaatggaatggaatggaatggaatggaatggaatggaatggaatggaatggactcgaatggaatggaaaggaatggactcaaatggaatagaatttaatggaattacaaaccacagtgatataacacacatgcatgaagatttctaacatgccatcctaaatta

SEQ ID NO: 1831 - DNA, 164 bp, Homo sapiens
  D1S2811
  Located on chromosome 1
  Distance between a terminus base of telomere on chromosomal short arm and 5'-terminus of this base sequence : 213550947
  Distance between 3'-terminus of neighbour sequence of sequence listing upward to telomere on chrosomal short arm and 5'-terminus of this base sequence : 84324
ccactgcactccaacctgggcattacagcatgtatctcttctcttaaaacacacactctttgacgacacacacattttcacacacacacacacacacacacacacacacacacacagagagagagagagagagagagaatttgaggccttcagtcagaaactac

SEQ ID NO: 1832 - DNA, 420 bp, Homo sapiens
  chr1.fa.O7frz.277075494
  Located on chromosome 1
  Distance between a terminus base of telomere on chromosomal short arm and 5'-terminus of this base sequence : 213704974
  Distance between 3'-terminus of neighbour sequence of sequence listing upward to telomere on chrosomal short arm and 5'-terminus of this base sequence : 153863
catccaaatagtaaatgtatcgtcaagataaaccttcagcaagcactgcagtcacaactggttaagacttccaacccaacctcttccactatatatatatatatatatatatatatatatatatatatatatatatatatatatatatatatataatcttcatgggtgcttccacttctttctcacactcttttgctggaagctatacctatgttgaagtatgctgttatcaataccaaaacaaatacatttcccagcaaggattctggtatactggcttccctgctctagctgaaaatggggaccctcggactatggaccacccctaacctcaggaacctgtgaatatgaccttatgtacaaaaagaatgactattactttatgtggcaacacatgggattaacaattaaggattctga

SEQ ID NO: 1833 - DNA, 101 bp, Homo sapiens
  DISO7_10000833
  Located on chromosome 1
  Distance between a terminus base of telomere on chromosomal short arm and 5'-terminus of this base sequence : 213739025
  Distance between 3'-terminus of neighbour sequence of sequence listing upward to telomere on chrosomal short arm and 5'-terminus of this base sequence : 33631
cctctcacatgcatgcacgtatacacacacacacacacacacacacacgcacgcacgcacacacggtattttacaaggacagcaagctcaatgcctttgtc

SEQ ID NO: 1834 - DNA, 324 bp, Homo sapiens
  HUMUT2436
  Located on chromosome 1
  Distance between a terminus base of telomere on chromosomal short arm and 5'-terminus of this base sequence : 213891071
  Distance between 3'-terminus of neighbour sequence of sequence listing upward to telomere on chrosomal short arm and 5'-terminus of this base sequence : 151945
agcccacagtaaatattgttgacaggctgctgtgactaagttagcacacaaaacttgtaactataaagacatgatacttctgacttggtacaaacccacaaaagaatctcagtaaaaattctggagatatatatatatgtttatacatttatatttgcatctgtgtgtaatctatctatctatctatctatctatctatctatctatctatcatctatctatctatctatctatctacctacctatgtgaatacatgtatataagtggcacatagaatttctcccaacttagattaggatttcgagtgaccaacctagaatcag

SEQ ID NO: 1835 - DNA, 181 bp, Homo sapiens
  D1S1609
  Located on chromosome 1
  Distance between a terminus base of telomere on chromosomal short arm and 5'-terminus of this base sequence : 213891213
  Distance between 3'-terminus of neighbour sequence of sequence listing upward to telomere on chrosomal short arm and 5'-terminus of this base sequence : -182
atacatttatatttgcatctgtgtgtaatctatctatctatctatctatctatctatctatctatctatcatctatctatctatctatctatctacctacctatgtgaatacatgtatataagtggcacatagaatttctcccaacttagattaggatttcgagtgaccaacctagaatca

SEQ ID NO: 1836 - DNA, 470 bp, Homo sapiens
  chr1.fa.O7frz.280013670
  Located on chromosome 1
  Distance between a terminus base of telomere on chromosomal short arm and 5'-terminus of this base sequence : 213986934
  Distance between 3'-terminus of neighbour sequence of sequence listing upward to telomere on chrosomal short arm and 5'-terminus of this base sequence : 95540
acacatagatacatgcatccacacatagacacacagggagacacgcacacatccacacacaaaaatatacacatccacatccagactacacacacacacacacacacacacacacacacacacacacagaactgtcatgccctgatttgttttcttctcagctgctcttgatgttcatttttatttgatttaaccacaaaaaatgtggtgtgtctgggatttccaatgctgtgaacaggactgaagaagtggcatgtgctcagttagatcatcctccaattggtccacaagtgtgtgtaatcgggagttaatagtgttgaattacaccttgctttttgatagtacttaagttttttaaacatttttgcagttatcatttcattttaaattttacaaataaaccctgtggctccagtagtgaaatattgtcccttttttaacagatttgaagacttgtcagtaaggctcag

SEQ ID NO: 1837 - DNA, 385 bp, Homo sapiens
  AL358177.4_139466
  Located on chromosome 1
  Distance between a terminus base of telomere on chromosomal short arm and 5'-terminus of this base sequence : 214058655
  Distance between 3'-terminus of neighbour sequence of sequence listing upward to telomere on chrosomal short arm and 5'-terminus of this base sequence : 71251
gtgacatagtgaaacctcatctttacaaaaaaagccaaaaaacaaaaaacaaaaattagacaggtgtggtggtgtgcacctgtagccccagctactcagcgggctgaggtgggaggatcgcttgagtctgggatgttggggctgcagtgagctgagatggagccactgcactccagcctggcgacagagcaagaccctgtctccaaaaataaaataaataaataaataaataaataaataaataaataaatgctaaacacagattgtctggacgtgtggctcatcactttttaggtactcatggtcccatcactaaagatgcaacataatcagaatcagacttgtaagagattgaacgaagctcctgattagaattaagtcctca

SEQ ID NO: 1838 - DNA, 399 bp, Homo sapiens
  AL358177.4_45226
  Located on chromosome 1
  Distance between a terminus base of telomere on chromosomal short arm and 5'-terminus of this base sequence : 214127598
  Distance between 3'-terminus of neighbour sequence of sequence listing upward to telomere on chrosomal short arm and 5'-terminus of this base sequence : 68558
ttaacgagatttaagattgcctaaaaggaagacagaagagtaaacctgtataagttcaagtttattctgaaaaagtttttggttaatattacaagttgatgttctatccatccatccatccatccatccatccatccacccacccatccatccatttatccacccatctatcctccatcatccatccacctaccccactcacccatccatgcatccagccatcaatccatccatccatccatttatccacccatccatcctccatcattgtccacttaccccatccatccacccatctatccattcatccaacaagttttattcaaccaacatgtcattcaaaaacattttctgcatgcatcgtgccggttattgtgtgcacaataggttacagaaaca

SEQ ID NO: 1839 - DNA, 356 bp, Homo sapiens
  AC024998.3_130974
  Located on chromosome 1
  Distance between a terminus base of telomere on chromosomal short arm and 5'-terminus of this base sequence : 214257700
  Distance between 3'-terminus of neighbour sequence of sequence listing upward to telomere on chrosomal short arm and 5'-terminus of this base sequence : 129703
ttgaataagcattaaaccagaatgtgatgtgtgaatataatggaatggaatggattcgaaagaaatggaatggaatggaatggagtggaatggaatggacccgaatggaatggaacagaatggaatggaatggaacgcactcgaatggaatgaaatggaatggaatggaatggaatggaacggacatgaatggaatggaatggaatggaatggaatggaatggaatggaatggaatggacacgaatggaacagaatggaacggaatagactcgaatgggatggaatggaattgaatggactctaatggaatggacatgaatggaatggaatggactcaattagaatgcagttgaat

SEQ ID NO: 1840 - DNA, 262 bp, Homo sapiens
  AC068290.3_134442
  Located on chromosome 1
  Distance between a terminus base of telomere on chromosomal short arm and 5'-terminus of this base sequence : 214418398
  Distance between 3'-terminus of neighbour sequence of sequence listing upward to telomere on chrosomal short arm and 5'-terminus of this base sequence : 160342
acctatgtaactttggcttatgagcattatattcttacctactgaaaaacaagtatagggagctttttaattaattaattaatttatttatttatttatttatttatttatttttaatttttgagacagggtctccctctgtcgcccaggctggaatgcagcggcgtgatcacagctcactgaagccttgatttcctgtattttttgtggagatgtgatttctccatgttgcccaggctggtcttaagtttaaactcctagg

SEQ ID NO: 1841 - DNA, 342 bp, Homo sapiens
  AC068290.3_40336
  Located on chromosome 1
  Distance between a terminus base of telomere on chromosomal short arm and 5'-terminus of this base sequence : 214500228
  Distance between 3'-terminus of neighbour sequence of sequence listing upward to telomere on chrosomal short arm and 5'-terminus of this base sequence : 81568
acaatgtcaggagttcaagactagcctggccaacatggtgaaatctcgtctctactaaaaatacaaaattagctgggtgtggaggcacttgaacccaggaggcagaatttttggtgagccaagatcacgccactgcattctagcctgggcaacagagcaagattccatctaaaaataaataaataaataaataaataaataaataaataaataaataaatgaatgaataataaaatttttccaagtatagtcacaagacaaaaaggagtgactcatgaaaggagagaggacttaaatactcttaagtactggctgtgggttagcacaagaaaggagtaaatg

SEQ ID NO: 1842 - DNA, 153 bp, Homo sapiens
  D1S2763
  Located on chromosome 1
  Distance between a terminus base of telomere on chromosomal short arm and 5'-terminus of this base sequence : 214565355
  Distance between 3'-terminus of neighbour sequence of sequence listing upward to telomere on chrosomal short arm and 5'-terminus of this base sequence : 64785
acttttgaatgttttcggagatttttagcaaaatgaggcatgtaataatgttttatgacctaacaacacacacacacacacacacacacccatattgaaaataaatcacaaaagatttcctaggtttcagaaatgatggtaaaactctgtctc

SEQ ID NO: 1843 - DNA, 156 bp, Homo sapiens
  Z66875
  Located on chromosome 1
  Distance between a terminus base of telomere on chromosomal short arm and 5'-terminus of this base sequence : 214572639
  Distance between 3'-terminus of neighbour sequence of sequence listing upward to telomere on chrosomal short arm and 5'-terminus of this base sequence : 7131
gatgtgtgacaatgaaaggactctgtgtgcgtgtgtgtgtgtgtgtgtgtgtgtgtgtgagatttagatggagtcttgctctgtcgcccaggatgaagtgcagtggcgcgatctcggctcactgcaaactctgcctcccgggttgacgccattctc

SEQ ID NO: 1844 - DNA, 112 bp, Homo sapiens
  DISO7_10000803
  Located on chromosome 1
  Distance between a terminus base of telomere on chromosomal short arm and 5'-terminus of this base sequence : 214848282
  Distance between 3'-terminus of neighbour sequence of sequence listing upward to telomere on chrosomal short arm and 5'-terminus of this base sequence : 275487
tagctgagccctcctctctctctctgtgtgtgtgtgtgtgtgtgtgtgtgtgtgtgtgtgtgtgtgtccgtgtcctcttctgttctccgcccctactgaaggaaggagatag

SEQ ID NO: 1845 - DNA, 134 bp, Homo sapiens
  DISO7_10000809
  Located on chromosome 1
  Distance between a terminus base of telomere on chromosomal short arm and 5'-terminus of this base sequence : 214982720
  Distance between 3'-terminus of neighbour sequence of sequence listing upward to telomere on chrosomal short arm and 5'-terminus of this base sequence : 134326
ggtgaaagcttcttcattccatgtgtctgtatgtgtgtatgtgtgtgtgtgtatatgtgtgtgtgtacggtatgtgtgtgtatgtgtgtgtgtgtgtgcatacatatatgtgcacagacagatctttataactg

SEQ ID NO: 1846 - DNA, 191 bp, Homo sapiens
  chr1.fa.O7frz.258844125
  Located on chromosome 1
  Distance between a terminus base of telomere on chromosomal short arm and 5'-terminus of this base sequence : 215222089
  Distance between 3'-terminus of neighbour sequence of sequence listing upward to telomere on chrosomal short arm and 5'-terminus of this base sequence : 239235
tgcctcaatcagtagaatgtagtggatgtgacactgtgggacttctaaagctaggtcataaaacgtgatatgacttccatttggctctctctctctctctctctctctctctcatatgacactcacttttgagacccagccaccatgttgtggggaagccacgggtggtagttttagccaacagcattaga

SEQ ID NO: 1847 - DNA, 304 bp, Homo sapiens
  chr1.fa.O7frz.259215238
  Located on chromosome 1
  Distance between a terminus base of telomere on chromosomal short arm and 5'-terminus of this base sequence : 215440047
  Distance between 3'-terminus of neighbour sequence of sequence listing upward to telomere on chrosomal short arm and 5'-terminus of this base sequence : 217767
caatgaggatgtattacttgagtccaggagtttaagatcagcctaggcaacatggcgagaccctgtctccacaaaaaatacaaaaattagctgtgcacgatggcactggcacacacctacttgggaggctgatgtgggaggatcacttgagcctgggaggttgaggcttcagtgagctgtgatcatgccactccactccagcctggtcaacagagtgagatcttatctcaaatatatatatatatatatgttttgtggagtcagaccacatgggttttaatctctgatttgactcttgctagtt

SEQ ID NO: 1848 - DNA, 299 bp, Homo sapiens
  AC022922.2_15470
  Located on chromosome 1
  Distance between a terminus base of telomere on chromosomal short arm and 5'-terminus of this base sequence : 215464663
  Distance between 3'-terminus of neighbour sequence of sequence listing upward to telomere on chrosomal short arm and 5'-terminus of this base sequence : 24312
aataaagcgtaaagtctaggttgaggtttgtttatctatctgtctatctatctacctatctatctatctatctatctatctatctatctatcaatcatctatctatgcctgtggacatccagttgttcagctagactgtgaactcttgaggctgtgtctcctgatttttatatccttgtaatggtataatgctctccacataacagatacgtgtcaaatatttgtaaactgaatgacttattttcagtttatgtttcaatcatgcctcccatcacctccactcaattacctgtgagtag

SEQ ID NO: 1849 - DNA, 319 bp, Homo sapiens
  AL359476.9_5688
  Located on chromosome 1
  Distance between a terminus base of telomere on chromosomal short arm and 5'-terminus of this base sequence : 215771680
  Distance between 3'-terminus of neighbour sequence of sequence listing upward to telomere on chrosomal short arm and 5'-terminus of this base sequence : 306718
atttaggttgattacatgccttagctattgtgaatagtgaaaactagccattcttttatttatttatttatttatttatttatttatttatttattgagacagtgtttcactccattgccacactagagtgcagtggcacaatctcagctcactgcaacctccacctcccaggttcaagtgattctcctgcctcagcctcccaagtagctgggactacaggtgtgcaccatcacacccagctaatttttgtatttttagtaaagaagggttttcaccatgttggccaggatggtctcgatctcttgacctcatgatccg

SEQ ID NO: 1850 - DNA, 311 bp, Homo sapiens
  AL359476.9_71898
  Located on chromosome 1
  Distance between a terminus base of telomere on chromosomal short arm and 5'-terminus of this base sequence : 215899200
  Distance between 3'-terminus of neighbour sequence of sequence listing upward to telomere on chrosomal short arm and 5'-terminus of this base sequence : 127201
ctgagctaggtgaggatacaagggcctgactattccacccctcaagggctcctctgatgggcagcactggctctgcatgcccactgggctgccagagatgagtgtggcagatccacatcgcagcttacccacccctcctgcactctcttgcagcctctcttttcttcatgggtgttgctccctcataaataaataaatatatatatatacacacacacacacacacatagttgctgttgttgttgttgttgttgtttttgaggcagggtcttgctctgtcgcccaggctggagttcagtggcacaatcaca

SEQ ID NO: 1851 - DNA, 247 bp, Homo sapiens
  Z23695.1_194
  Located on chromosome 1
  Distance between a terminus base of telomere on chromosomal short arm and 5'-terminus of this base sequence : 216016943
  Distance between 3'-terminus of neighbour sequence of sequence listing upward to telomere on chrosomal short arm and 5'-terminus of this base sequence : 117432
aattatgcacagacttcattagaggggaaaagaatgtcatgttttatttctccatattcattcaagtaagtattctaagaattttaaatcaaatgggttgagaaacaacatataaatgataataaaatttggtagatgctgtggtgactaattgcctcccctcatcactcaacacacacacacacacacacacacacacacacacacacacacacagcaccaaggtttaaacacagattccaaattc

SEQ ID NO: 1852 - DNA, 251 bp, Homo sapiens
  D1S439
  Located on chromosome 1
  Distance between a terminus base of telomere on chromosomal short arm and 5'-terminus of this base sequence : 216016950
  Distance between 3'-terminus of neighbour sequence of sequence listing upward to telomere on chrosomal short arm and 5'-terminus of this base sequence : -240
cacagacttcattagaggggaaaagaatgtcatgttttatttctccatattcattcaagtaagtattctaagaattttaaatcaaatgggttgagaaacaacatataaatgataataaaatttggtagatgctgtggtgactaattgcctcccctcatcactcaacacacacacacacacacacacacacacacacacacacacacacagcaccaaggtttaaacacagattccaaattcaccatttcaac

SEQ ID NO: 1853 - DNA, 171 bp, Homo sapiens
  Z67039
  Located on chromosome 1
  Distance between a terminus base of telomere on chromosomal short arm and 5'-terminus of this base sequence : 216098249
  Distance between 3'-terminus of neighbour sequence of sequence listing upward to telomere on chrosomal short arm and 5'-terminus of this base sequence : 81048
gccactcttcgctgctttggaaagattgactatattatgactatattataatctatgccagaggactatatatacatacatacacacacacacacacacacacacacacacacatatatgtttttgtttgtttgtttgttttttgagacagagtccagcctggaatgcagt

SEQ ID NO: 1854 - DNA, 396 bp, Homo sapiens
  AC027430.2_123676
  Located on chromosome 1
  Distance between a terminus base of telomere on chromosomal short arm and 5'-terminus of this base sequence : 216148192
  Distance between 3'-terminus of neighbour sequence of sequence listing upward to telomere on chrosomal short arm and 5'-terminus of this base sequence : 49772
ccatgccaggctaattaaaatatatatatatttttgtagacatagggttttgctatgttgctcaggctggtctcgaactcctaggctcttcctgcctcggcctcccaaagtgctgggattacaggtgtaagccaccacacccagccttaaattaatttttatatgatatgatatgatatgatatgatatgatatagggggttcaatttcattgttttgcatgaggaaatccagttaccccacaccatttgttgaaaagattatttttcctcattgaattgtcttgccactcttgttgaaaatcaattaaccatatctgacagtgtatttctggactctcaattatatgccattaatttctatccttattacagtatcctgctgtcttgactattgt

SEQ ID NO: 1855 - DNA, 383 bp, Homo sapiens
  chr1.fa.O7frz.259898526
  Located on chromosome 1
  Distance between a terminus base of telomere on chromosomal short arm and 5'-terminus of this base sequence : 216370523
  Distance between 3'-terminus of neighbour sequence of sequence listing upward to telomere on chrosomal short arm and 5'-terminus of this base sequence : 221935
ctggacttgcttaagatcctacctgcccaaatctggtaaatctagaattcccaggggatttttctgctaagtctggtgcttctagctgttacagggacaaagatcttgagaacaagaagaaaagatatagagaacccaaacagatgtttggataccagtagtgctggtgaggtgtgtatgttgggtaacccctaggcctagagtgctggggacaatcacacatggacacctacctacctacctacctacctacacacacacacacacacacacacacacacacacacacgaagcacaggaagcatgaatgagtggaaagcccaagaacatgggagcatcccacagacagccaagtgactttctcaaccttctaagagacttgg

SEQ ID NO: 1856 - DNA, 346 bp, Homo sapiens
  AC058782.9_79733
  Located on chromosome 1
  Distance between a terminus base of telomere on chromosomal short arm and 5'-terminus of this base sequence : 216387318
  Distance between 3'-terminus of neighbour sequence of sequence listing upward to telomere on chrosomal short arm and 5'-terminus of this base sequence : 16412
atgccttaaatcctagcactttgagagtccaaggcagaaggattgcttgaggccaggagttcaagaccagcctgggcaacatagcaagaccccatctctacaaaaacatttttaaattaggtgtggtggtgtgcacttagctactcaggaggctaagacaggaggatcacttgaacccaggagtttaaggctgcagtgagctatgattgtgccactgcactccagtctgggtgacagagtgagaccctatttctaaataataataataataataataataataataataatataatggatgttgagtaaaaccaatttgatgaatatctggagcagtgagaactct

SEQ ID NO: 1857 - DNA, 385 bp, Homo sapiens
  chr1.fa.O7frz.259985429
  Located on chromosome 1
  Distance between a terminus base of telomere on chromosomal short arm and 5'-terminus of this base sequence : 216457453
  Distance between 3'-terminus of neighbour sequence of sequence listing upward to telomere on chrosomal short arm and 5'-terminus of this base sequence : 69789
agtctatcgttggactttaccttgtgatcttgtgagtcaattctccttaataaacttcctttcatatatacatacatcctattagttctgtccctttagttctgtccctaatacaaggtgttgatcaaaagcaagttctagaatgttcaggctgactctgggcacagtgcctatgggttagtcctcctacaaaaggagcagcaccagttcagtaaaattgctacagagagagagagagagagagagagagagagagagagagagagaatgttccatagtgtagggaaaagaaagagagatcagactgttactgtgtctatgtagaaaggaaagacataagagactccattttgaaaaagacctgtactttaaacagttgctttgc

SEQ ID NO: 1858 - DNA, 291 bp, Homo sapiens
  AL133288.12_30539
  Located on chromosome 1
  Distance between a terminus base of telomere on chromosomal short arm and 5'-terminus of this base sequence : 216497459
  Distance between 3'-terminus of neighbour sequence of sequence listing upward to telomere on chrosomal short arm and 5'-terminus of this base sequence : 39621
tactccaacctggtgacacagcaagactccatctcaaaaataaataaataaataaataaataaaaataaaaagtcaggggcggaagctgaagtaggaggatcacttgagcccaggagttcaagtccagcctgagcaatatagcaaaacactgtttctgaaaaaaaatttttaaataaaataatataaaaggtccggggtcattgggcaattgaattaggattcagctttgaataagtttactgaatttatttgaaaaacccaacattctgtaactcacctatctggaatac

SEQ ID NO: 1859 - DNA, 110 bp, Homo sapiens
  D1S479
  Located on chromosome 1
  Distance between a terminus base of telomere on chromosomal short arm and 5'-terminus of this base sequence : 216513867
  Distance between 3'-terminus of neighbour sequence of sequence listing upward to telomere on chrosomal short arm and 5'-terminus of this base sequence : 16117
ggggagatttggactggaccttttggttactcattttgtgtgtgtgtgtgtgtgtgtgtgtgtgtgtgaatgcaatgtatgcatttcaggaggggatggtggcaatgggt

SEQ ID NO: 1860 - DNA, 273 bp, Homo sapiens
  AC044825.2_8214
  Located on chromosome 1
  Distance between a terminus base of telomere on chromosomal short arm and 5'-terminus of this base sequence : 216598264
  Distance between 3'-terminus of neighbour sequence of sequence listing upward to telomere on chrosomal short arm and 5'-terminus of this base sequence : 84287
ttgaagccaggagttcaagaccagcctaggcaacagagggagatctcatctccactaaaaaataataataataataataatagtaataaaataattagtcacagtggtgtgtgcccctattcccagttgttcaggaggctgaggtgggtggattgcttgagcccaggaattccaggctactgtgattgtgccactgcactccagcctgggcaacagaccaagacccaatctcttaaaaaaaagttagttcttcagtcacataatttgcactaa

SEQ ID NO: 1861 - DNA, 322 bp, Homo sapiens
  chr1.fa.O7frz.262040527
  Located on chromosome 1
  Distance between a terminus base of telomere on chromosomal short arm and 5'-terminus of this base sequence : 216617101
  Distance between 3'-terminus of neighbour sequence of sequence listing upward to telomere on chrosomal short arm and 5'-terminus of this base sequence : 18564
ggagtaatttggaatccagtagggtgatgtaagtgaaggtgctttgaaacctcccaaagctctcgcccaggtaaggaggtttgtggtccttgtcaccatttacccaggaaagcttcaaagcagcagcggcggcggcggcggcggcggcggcagcagaatttccctccttccctcctgttactctcccagcctcctctccctcctatcactctcctaagttcagagctgaccccactcctctgctacccatggtggtagccaggcctgtgcctctcctagcatcagaagctgccccaggctcccaggactggagctcagatct

SEQ ID NO: 1862 - DNA, 262 bp, Homo sapiens
  D1S1644
  Located on chromosome 1
  Distance between a terminus base of telomere on chromosomal short arm and 5'-terminus of this base sequence : 216888221
  Distance between 3'-terminus of neighbour sequence of sequence listing upward to telomere on chrosomal short arm and 5'-terminus of this base sequence : 270798
atacctatggaggtgcaccactgctagtcagggttctctagagagagagaaccaacaggggatgattagatagatagatagatagatagatagatagatagatagatacatacatacatacatacatacatacatacatatacagacagaggagaagggatttattagggaattggctcacatgattctggaagctgagaagtcccatgacaggccatctgcaagctggagaccctgggatgctggtattgtggctcaatcc

SEQ ID NO: 1863 - DNA, 95 bp, Homo sapiens
  Z66645
  Located on chromosome 1
  Distance between a terminus base of telomere on chromosomal short arm and 5'-terminus of this base sequence : 217025025
  Distance between 3'-terminus of neighbour sequence of sequence listing upward to telomere on chrosomal short arm and 5'-terminus of this base sequence : 136542
ccaaatctcgtcaggtcaattgatagttgtgtgtgtgtgtgtgtgtgtgtgtgtgtgtgtgtgtgtgtatggtaggtgttcctgcaaaggctttt

SEQ ID NO: 1864 - DNA, 390 bp, Homo sapiens
  chr1.fa.O7frz.261064981
  Located on chromosome 1
  Distance between a terminus base of telomere on chromosomal short arm and 5'-terminus of this base sequence : 217231143
  Distance between 3'-terminus of neighbour sequence of sequence listing upward to telomere on chrosomal short arm and 5'-terminus of this base sequence : 206023
aggtgacatttaagctaagtcttaaaaagatgaggaaaatgtgtgtgtgtgtgtgtgtgtgtgtgtgcgcgcgcgcgtgcgaagtggaggttggtatttcaggattgagaaaagcataagcaaaagcctagaagcaaaaaagcaccaacagcacagccaacagcacagccaacagcacagccaacagcttggctcagctcagcactaagggcctggcacggagcagtttgccccagagggaggcaaaaagagggaaaattgtctgtaaggaatttaaaacaatactgaaactgatgggctttttaccatgaccatgagctggcgattctgatttaaacataatccaacacctcccccaacaaccttttgtctaattctgaacaattgctg

SEQ ID NO: 1865 - DNA, 416 bp, Homo sapiens
  AC073252.1_167399
  Located on chromosome 1
  Distance between a terminus base of telomere on chromosomal short arm and 5'-terminus of this base sequence : 217310660
  Distance between 3'-terminus of neighbour sequence of sequence listing upward to telomere on chrosomal short arm and 5'-terminus of this base sequence : 79127
caaagtaggaagtttgcttgacgccaggagttcaagaccagcctaggcaacatagcgagaccctgtctgtacaaaaatttaaaaattagccaggcatgatggcgtgcacctgtagtctcagctacttgggaggctgaggcaggaggatcacttgagcccaggagttgaagctgcaaaaagccatgattgcaccactgcactccagcctgagtgacagagtgagaccctatctcaaaagaaaagaaaagaaaagaaaagaaaaggaatgtggtgtcaagactttgttttaattgaaaccaagtcatttgctgtcagtttaagatgctgactctatatggctttgcactaaacctcttctccagggatcccctcctacacactgaaaaggctgcctttgctttaaatcctaaagaatg

SEQ ID NO: 1866 - DNA, 416 bp, Homo sapiens; identical to SEQ ID NO: 1865
  AL359732.6_135331
  Located on chromosome 1
  Distance between a terminus base of telomere on chromosomal short arm and 5'-terminus of this base sequence : 217310660
  Distance between 3'-terminus of neighbour sequence of sequence listing upward to telomere on chrosomal short arm and 5'-terminus of this base sequence : -416

SEQ ID NO: 1867 - DNA, 342 bp, Homo sapiens
  chr1.fa.O7frz.260296811
  Located on chromosome 1
  Distance between a terminus base of telomere on chromosomal short arm and 5'-terminus of this base sequence : 217359579
  Distance between 3'-terminus of neighbour sequence of sequence listing upward to telomere on chrosomal short arm and 5'-terminus of this base sequence : 48503
gagctaaactccatcaagaaagaaagaaagacaggaaggaaggaaggaaggaaggatggatggaaggaaggaaggaaggaaggaaggtaggtcagtcaggagggaagtcaggaaggaaggaaggaaggaaggaagaaagaaaggaagaaaggaagaagcccctctaaaaaatggaaatggcaaggaagtagatttttttccctagagcctccaacaagagcaaggccctggtttggcccagtgaaactgattacagacttctgacctccagagctgtaagggaatatatgtgtgttgttttgagccactcagtttatggtcatttgttatagcaatcatagg

SEQ ID NO: 1868 - DNA, 451 bp, Homo sapiens
  chr1.fa.O7frz.260396360
  Located on chromosome 1
  Distance between a terminus base of telomere on chromosomal short arm and 5'-terminus of this base sequence : 217459120
  Distance between 3'-terminus of neighbour sequence of sequence listing upward to telomere on chrosomal short arm and 5'-terminus of this base sequence : 99199
acaaaggtccgctaaagaggggtcgaggccttctgtttaatgtgagagggccaggggtgggggcttgaagagccttaggtgcctcagcatcctttgaggagttgtaccctgagagagagagagagagagagagagagagagagagagagagagagagagagagagagtgagagagagagagtgagagagagagagtgagagagagagagtgtgtgtgtatgtgtagaagggaggcaggaaggtaggtgtttccgggtcatttggaaaagcccagtcccttatctctccctacctctgcaccgtccactggaattttccatttcccagaggtgtgtttcctgagagacagagaggctgtagcgcccctctctgcctttctgaagacagcagggttggtctgcctcttacctctcactatttcatagaatctctagaaggatcagtatctgcg

SEQ ID NO: 1869 - DNA, 339 bp, Homo sapiens
  AL353689.5_173517
  Located on chromosome 1
  Distance between a terminus base of telomere on chromosomal short arm and 5'-terminus of this base sequence : 217521372
  Distance between 3'-terminus of neighbour sequence of sequence listing upward to telomere on chrosomal short arm and 5'-terminus of this base sequence : 61801
tctgaggcaggagaatcacttgaatctgggaggtggaggttgctggaggagccaagatcacgccactgcactccggcctgggcgtgcactcactctgcagagtgagactccgtctcaacaacaacaacaacaacaacaacaacaacaacaacaacaaccccccagcaattctgcttggtggtggggggatcacaaattttacatgtgttaaacaataccttaactctataatggaaatgcaatgaaaaaaaatcacacattaaaagcagtaaaaaattcaagttttgtgacttttccaaaggatcaatttgttaagtaaagccaaatagtttaattcca

SEQ ID NO: 1870 - DNA, 236 bp, Homo sapiens
  DISD22_0001074
  Located on chromosome 1
  Distance between a terminus base of telomere on chromosomal short arm and 5'-terminus of this base sequence : 217863869
  Distance between 3'-terminus of neighbour sequence of sequence listing upward to telomere on chrosomal short arm and 5'-terminus of this base sequence : 342158
tcggaaattcaggtctgcagaaagaaagaaagagcatcaaagaagaaatacatgaaggttgaataaactcttatttttcttattcttaattgatctaacaaataaccatttgtccaaagaataatggcaacaatatattcaagtacggatgtgtgtgtgtgtgtgtgtgtgtgtgtgtgtgtgtgtgtgtgtgttgatgcttatatataaatgaaatgaatgatagcaacaataca

SEQ ID NO: 1871 - DNA, 101 bp, Homo sapiens
  DID22N_0002526
  Located on chromosome 1
  Distance between a terminus base of telomere on chromosomal short arm and 5'-terminus of this base sequence : 218201639
  Distance between 3'-terminus of neighbour sequence of sequence listing upward to telomere on chrosomal short arm and 5'-terminus of this base sequence : 337534
ttgctccaaagttgtggtcttgtaccccctctacacacacatgcacacacacacacacacacacacacacacggtgaccattgtctacctagaacaagcag

SEQ ID NO: 1872 - DNA, 284 bp, Homo sapiens
  AL365178.7_170830
  Located on chromosome 1
  Distance between a terminus base of telomere on chromosomal short arm and 5'-terminus of this base sequence : 218285109
  Distance between 3'-terminus of neighbour sequence of sequence listing upward to telomere on chrosomal short arm and 5'-terminus of this base sequence : 83369
gatcatgccactgaactctaacctgggcaagactcgatctcaaaataaataaataaataaataaataaataaaagagccaaaatgggaatttggagagtcctggaggccaggagaaaaaacaggtaccccagcatctgctggtccaccccattatccctgtttgcctatatggccttcctgcaagtttgtgattgactggagagaaaacaacccaaatgggaaaagatcctcccctctcccagtcctgcaccatccaagccagtgtttaccaaggttgcaaata

SEQ ID NO: 1873 - DNA, 301 bp, Homo sapiens
  AL035091.2_9619
  Located on chromosome 1
  Distance between a terminus base of telomere on chromosomal short arm and 5'-terminus of this base sequence : 218311004
  Distance between 3'-terminus of neighbour sequence of sequence listing upward to telomere on chrosomal short arm and 5'-terminus of this base sequence : 25611
caaattgctttaccatgtctaccttcagtttccttatatgcaaagtaggaaatgtcagctgtctattcaaaatgttattgtgaggatcaagtgaagtaatacaatacttctaacatatatatatatatatatagagagagagagagagagagagaattttaaaattacaaaatactttgttacacatatatctctggtcaccttcagagcaaccctaattattattattttcattttttagataaggaaataaaaaactcagaaagattgaaattcacttgaaaacagtgaatagtgctat

SEQ ID NO: 1874 - DNA, 205 bp, Homo sapiens
  D1S2692
  Located on chromosome 1
  Distance between a terminus base of telomere on chromosomal short arm and 5'-terminus of this base sequence : 218317496
  Distance between 3'-terminus of neighbour sequence of sequence listing upward to telomere on chrosomal short arm and 5'-terminus of this base sequence : 6191
gctaacaaaaacccacatcttctaccaaaccatatccctttttaaagttaggatttttgtttaagttttcctctccctagtaactatgtccaggtatacctggaaacacacacacacacacacacacacacacacacacacacacacacacacacacacacgcatgcacttatttcccccaaggtcttgtgccatttgcttatag

SEQ ID NO: 1875 - DNA, 167 bp, Homo sapiens
  D1S2685
  Located on chromosome 1
  Distance between a terminus base of telomere on chromosomal short arm and 5'-terminus of this base sequence : 218366534
  Distance between 3'-terminus of neighbour sequence of sequence listing upward to telomere on chrosomal short arm and 5'-terminus of this base sequence : 48833
tgagccatctccaagggccttttattctgggaaggggtgtgtgtgtgtgtgtgtgtgtgtgtgtgtgtgtgtgtgtgtgtgtctgtctgtctggttcagggctgcttactttcctcctgtattgcagatgctgatagattgaaaggtcgtgctagatgaaggtgctg

SEQ ID NO: 1876 - DNA, 227 bp, Homo sapiens
  DISO7_10000769
  Located on chromosome 1
  Distance between a terminus base of telomere on chromosomal short arm and 5'-terminus of this base sequence : 218568686
  Distance between 3'-terminus of neighbour sequence of sequence listing upward to telomere on chrosomal short arm and 5'-terminus of this base sequence : 201985
gataacacttcctgttagcagctaaaatatctgcatcaaatctaatgttagaatttaagttagaaataaggctggggtataatggtctctctcgcactctctctctctctctctctctctctctctctgtgtgtgtgtgagagagagagagagagagagagagacagacagacagacagagagacagagagaaagagagagagattttcttactccgaaccagctga

SEQ ID NO: 1877 - DNA, 143 bp, Homo sapiens
  DISO7_10000768
  Located on chromosome 1
  Distance between a terminus base of telomere on chromosomal short arm and 5'-terminus of this base sequence : 218580221
  Distance between 3'-terminus of neighbour sequence of sequence listing upward to telomere on chrosomal short arm and 5'-terminus of this base sequence : 11308
actgacttcgaattgaggcagtctctttcttgctcttattctttcctctctctctctctctctctctctctcacacacacacacacacacacacacacacacacatgcaactcacagatttctttaagagtgcagtgagtgga

SEQ ID NO: 1878 - DNA, 101 bp, Homo sapiens
  DISO7_10000767
  Located on chromosome 1
  Distance between a terminus base of telomere on chromosomal short arm and 5'-terminus of this base sequence : 218674094
  Distance between 3'-terminus of neighbour sequence of sequence listing upward to telomere on chrosomal short arm and 5'-terminus of this base sequence : 93730
tccagggttgtcttgtcctgctgccatggacaccgggtttggggatggtgtgtgtgtgtgtgtgtgtgtgtgcacgtgcacacatatggcaggtggtgact

SEQ ID NO: 1879 - DNA, 225 bp, Homo sapiens
  D1S2891
  Located on chromosome 1
  Distance between a terminus base of telomere on chromosomal short arm and 5'-terminus of this base sequence : 218761022
  Distance between 3'-terminus of neighbour sequence of sequence listing upward to telomere on chrosomal short arm and 5'-terminus of this base sequence : 86827
ccaagagttttcttagcaaatcaccttgttcatctccctgtgaccaggcaggactgaacccctcccaggcaggagagtgataggggtgtgtgtgtgtgtgtgtgtgtgtgtgtgtgtgtgtgtgtgtattacagtcatctaccaaacttccatgggctccctcactgataagcctttcttatatccaaacaaaatttttcttggttccaactccgaataagcagt

SEQ ID NO: 1880 - DNA, 255 bp, Homo sapiens
  chr1.fa.O7frz.239479913
  Located on chromosome 1
  Distance between a terminus base of telomere on chromosomal short arm and 5'-terminus of this base sequence : 218790683
  Distance between 3'-terminus of neighbour sequence of sequence listing upward to telomere on chrosomal short arm and 5'-terminus of this base sequence : 29436
atgtactgaggttgctaaggtctattgtaagaacaaatctatccatgaaattgtgaagaaggaaaaataaatttgtgcattacatatatatatatatatatatatatatatatatatatatatatatatatatatatagtgtttggtactatctgtggttttgggcatccactgcggggggcggggtcttagaatctatccccagcagataagcagggatagatcacattcgttaattctaagcttcagactcct

SEQ ID NO: 1881 - DNA, 431 bp, Homo sapiens
  chr1.fa.O7frz.239096263
  Located on chromosome 1
  Distance between a terminus base of telomere on chromosomal short arm and 5'-terminus of this base sequence : 218962356
  Distance between 3'-terminus of neighbour sequence of sequence listing upward to telomere on chrosomal short arm and 5'-terminus of this base sequence : 171418
gctacctagctaaatagctacctagctaaatagatagatagatagatagatagatagatagatagatgatagatagatagatagatagatagatagatagatagatagatagataggaatttgagttcctgtcatgtgccagacatgattttaggcaatgagaatagagtgctgaatgagacaaaaattctgcccttatggaatttctattcacatgacagagacaggcaataaacaatgtaataaaatgttaaatatatataattactatgaaaaaaccctgaatagtacacgatgacagatagtgaagggatgaagcagggatggagcaacattttaacatgatctcagactgttacatttattacctgcacctcctgtgaggccctgaagagcactgtacagcactgttctgcagtactatgcatcat

SEQ ID NO: 1882 - DNA, 350 bp, Homo sapiens
  chr1.fa.O7frz.239007449
  Located on chromosome 1
  Distance between a terminus base of telomere on chromosomal short arm and 5'-terminus of this base sequence : 219051171
  Distance between 3'-terminus of neighbour sequence of sequence listing upward to telomere on chrosomal short arm and 5'-terminus of this base sequence : 88384
tgaacctaaggtggaggttgcagtgagccaagatcatgccactgcactccagcctgggtgatggagtaagaccctgtctcacacacacacacacacacacacacacacacacacacacacacaccataaaaacccctcacaatggtatactattgtatgcgcattagaatggctacaattttaaaagactggcaaatctaattgttgatgaggttgtggagcaacaagaattcacatgcattattggtgggattgtaaagtggtaaaatcacttaaaaaaataaaccgtgaatttctaaaatgatcacaaatataaataccatacaactcagcaaccttattcttagata

SEQ ID NO: 1883 - DNA, 123 bp, Homo sapiens
  HUMUT7642
  Located on chromosome 1
  Distance between a terminus base of telomere on chromosomal short arm and 5'-terminus of this base sequence : 219146604
  Distance between 3'-terminus of neighbour sequence of sequence listing upward to telomere on chrosomal short arm and 5'-terminus of this base sequence : 95083
cctacccatctcctattgtctatcatctatctatctatctatctatctatctatctatctatctatctatccatccatccgttcatctcatatgtatgttcttggggcttctttctctattct

SEQ ID NO: 1884 - DNA, 334 bp, Homo sapiens
  chr1.fa.O7frz.238585040
  Located on chromosome 1
  Distance between a terminus base of telomere on chromosomal short arm and 5'-terminus of this base sequence : 219482778
  Distance between 3'-terminus of neighbour sequence of sequence listing upward to telomere on chrosomal short arm and 5'-terminus of this base sequence : 336051
ccactgatggcatagaaacaagaagaacctcctgatgtgaaaaggaaaaaaaaatgtttaccaaggacttctgcttctgactataatggaaaaaccaaaattagatttgtcttcctgccttaaacaaaataattataacaacaaaaccagactaaatacacacacacacacacacacacacacacacacatacacacacacacgtacacacacacacacagattttcaggccgggcgtggtggctcatgcctgtaatcccagcactttgggaggccaaggagggcagatcacctgaggttgggagtttgagaccagtttgaccaacatggagaa

SEQ ID NO: 1885 - DNA, 101 bp, Homo sapiens
  DISO7_10008381
  Located on chromosome 1
  Distance between a terminus base of telomere on chromosomal short arm and 5'-terminus of this base sequence : 219510867
  Distance between 3'-terminus of neighbour sequence of sequence listing upward to telomere on chrosomal short arm and 5'-terminus of this base sequence : 27755
agcggatgaagacaaagagttgagtccacacacacacacacacacaaaattacacgaaggaaaaattttggttgggccttctcttcttccaatcttcagct

SEQ ID NO: 1886 - DNA, 279 bp, Homo sapiens
  chr1.fa.O7frz.242414727
  Located on chromosome 1
  Distance between a terminus base of telomere on chromosomal short arm and 5'-terminus of this base sequence : 219689855
  Distance between 3'-terminus of neighbour sequence of sequence listing upward to telomere on chrosomal short arm and 5'-terminus of this base sequence : 178887
ttgtaaagtgcaatgctatctcatgcctggcatatgtaaatcacatatttctacatattggatgcttgttgactaatgagtggatgggtgggtgggtggatggatggatggatggatggatggatggatggatggatggagggacggatagaaatggagattccgtgagccataattacgaaggtcacacatgatcatagtggacagataaagatatgcaataaaagaagcatggaaaaaacaaagagcacttctgtttactagatgaagacctggaat

SEQ ID NO: 1887 - DNA, 326 bp, Homo sapiens
  AL035408.5_53242
  Located on chromosome 1
  Distance between a terminus base of telomere on chromosomal short arm and 5'-terminus of this base sequence : 219823368
  Distance between 3'-terminus of neighbour sequence of sequence listing upward to telomere on chrosomal short arm and 5'-terminus of this base sequence : 133234
gacttactctgtactaaatgccaggataagcctctggctgggcctcgactgtgaccctccggcctctttctacagctctgcctggatggactggcctatctctgctggattcccgaagtgcattgtgtagagacagcaactcaggtcaggctaaaagctcaagcaagcaagcgcgcacacacacgcgcgcacacacacacacacacacacaaacactcagcttccttaggacaagataaaatcttagcattcccctctccccgattaggtaggtctctgggaggactaaggcttcaggtgcaaggctcagataacctgcagtgtct

SEQ ID NO: 1888 - DNA, 168 bp, Homo sapiens
  AL035408.5_57942
  Located on chromosome 1
  Distance between a terminus base of telomere on chromosomal short arm and 5'-terminus of this base sequence : 219828195
  Distance between 3'-terminus of neighbour sequence of sequence listing upward to telomere on chrosomal short arm and 5'-terminus of this base sequence : 4501
tacgctttgatagatttagcactgatttcattctctttacaattcagtgtgattgggtgtgcgtgtgtgtgtgtgtgtgtgtgtgtgtgtgtgtgtgtgttactccatgtttctcctttttaaggaaggagaaggtgtggaacaagagaaagttcctaagtctgaagg

SEQ ID NO: 1889 - DNA, 243 bp, Homo sapiens
  D1S245
  Located on chromosome 1
  Distance between a terminus base of telomere on chromosomal short arm and 5'-terminus of this base sequence : 219828197
  Distance between 3'-terminus of neighbour sequence of sequence listing upward to telomere on chrosomal short arm and 5'-terminus of this base sequence : -166
cgctttgatagatttagcactgatttcattctctttacaattcagtgtgattgggtgtgcgtgtgtgtgtgtgtgtgtgtgtgtgtgtgtgtgtgtgttactccatgtttctcctttttaaggaaggagaaggtgtggaacaagagaaagttcctaagtctgaaggaagtccaacccagttatgaagggaatgccatccacaagccttttttataattggcccctgcctcaggtaaaggggtc

SEQ ID NO: 1890 - DNA, 239 bp, Homo sapiens
  AL023754.1_27779
  Located on chromosome 1
  Distance between a terminus base of telomere on chromosomal short arm and 5'-terminus of this base sequence : 219888305
  Distance between 3'-terminus of neighbour sequence of sequence listing upward to telomere on chrosomal short arm and 5'-terminus of this base sequence : 59865
gacattcaatacgctcaaataaatgatcaaaaaccccatgcaaaaagtaggattgtagccctgcttgcatgcttgtacatatacatgactgtgcttttttttttctaaaggcatgcatcacacacacacacacacacacacacacacacacacacacacatctaaagagcaggttctgaaagtggggatggtagacaggaaaactaaaatctggtgggattagaccatcctgagtgatt

SEQ ID NO: 1891 - DNA, 254 bp, Homo sapiens
  AL023754.1_46914
  Located on chromosome 1
  Distance between a terminus base of telomere on chromosomal short arm and 5'-terminus of this base sequence : 219907360
  Distance between 3'-terminus of neighbour sequence of sequence listing upward to telomere on chrosomal short arm and 5'-terminus of this base sequence : 18816
attacattaagtggcctcaattttgtgaatatgtaaaatggaacagattcagtagtgttttcataagatcactcacccttgtattctgttttttcacacagggaagaaaagaatggtgtttcagttcacacaagaagctgtgcctgacttgggcccagtcactagagcatgttgcagacaagaatgacatccatcatagtgtgtgtgtgtgtgtgtgtgtgtgtgtgtgtgtgtgtcgagtgtggtagctagta

SEQ ID NO: 1892 - DNA, 193 bp, Homo sapiens
  D1S471
  Located on chromosome 1
  Distance between a terminus base of telomere on chromosomal short arm and 5'-terminus of this base sequence : 219939000
  Distance between 3'-terminus of neighbour sequence of sequence listing upward to telomere on chrosomal short arm and 5'-terminus of this base sequence : 31386
ccattaaaattgatgatatcgattcatatttatcgacaagaagagatgttcaaatatattgccaagtgagaaaaatagcctaatctaatcttctgtgtgtgcctgcatgcctgtgtgtgtgtgtgtgtgtgtgtgtgtgtgtgtgtgtgtgtgtagagagagagagaactaaggatgggcactgtgttactgg

SEQ ID NO: 1893 - DNA, 398 bp, Homo sapiens
  AL023754.1_99049
  Located on chromosome 1
  Distance between a terminus base of telomere on chromosomal short arm and 5'-terminus of this base sequence : 219959531
  Distance between 3'-terminus of neighbour sequence of sequence listing upward to telomere on chrosomal short arm and 5'-terminus of this base sequence : 20338
cagttgcctagcagagtagatgctgttgaatgaatgatgaagtaaatgatgaatgaattataaagactaaaatctcaacttaatgaaataaatgtgctctgggctccaaagcatgctcccctgcccacatctctgtctctctcctctctctgtctctctgtcctctctctctctctctctctctctctctctctcgtgggtcttgctattcaaagtagttcctggaccagcaacatcagcagtcacctgggagcaaggttccaaggagacctatatacaaattaaacctcgagaagcactgctgtgtggtcctgagtggaggcaggctggtagacaaaatgatctctcaaggcccctcattgctttacatgtctctcaacatgatctcagataaagac

SEQ ID NO: 1894 - DNA, 181 bp, Homo sapiens
  D1S491
  Located on chromosome 1
  Distance between a terminus base of telomere on chromosomal short arm and 5'-terminus of this base sequence : 219964961
  Distance between 3'-terminus of neighbour sequence of sequence listing upward to telomere on chrosomal short arm and 5'-terminus of this base sequence : 5032
atctccctggcaatgattttgaatcaccacagttttcaagaaatctgaaaatcctatttcttttggttggacagccatcaaagatacatgtcagtcattccatccatctctctttctctctcagtcacacacacacacacacacacacacacacactcaactttcacaattcttgctgaca

SEQ ID NO: 1895 - DNA, 422 bp, Homo sapiens
  AL031316.2_1565
  Located on chromosome 1
  Distance between a terminus base of telomere on chromosomal short arm and 5'-terminus of this base sequence : 220019882
  Distance between 3'-terminus of neighbour sequence of sequence listing upward to telomere on chrosomal short arm and 5'-terminus of this base sequence : 54740
cgcaaagattatgtcatactaatttcaatatccccaatgcctgtacaatgcttgtttcatcatagatgctctaaaattatgtaaagagaaagaaagagagagaggaaggaaggaaggaaggaaggaaggaaggaaggaaggaaggaaggaaggaaggaaaaaaagggaaggaaggaaggaaggaaaaaagaaggaaaagaaggaaggaaggaaggtaggttggttttcaatattcgcttgagttcctctcccggagcccccagccagaagctctagcacatcgtgagtcacggagcctccattttcattcttctcaggctgccttttccttccccaccactcacacacctggatggctctgtgcacagtcagaaagccagtgctcagggaatgcaaactaattatagaagcttccagaactg

SEQ ID NO: 1896 - DNA, 237 bp, Homo sapiens
  AL031316.2_11602
  Located on chromosome 1
  Distance between a terminus base of telomere on chromosomal short arm and 5'-terminus of this base sequence : 220029988
  Distance between 3'-terminus of neighbour sequence of sequence listing upward to telomere on chrosomal short arm and 5'-terminus of this base sequence : 9684
ctcctacacttcgcacagttgaccattttttattctctctctctctctctctctctctctctctctctctctcctctctctgtctctctcctggaactcatgtccagcctcctctgtcatggccctccaaaccacattccccactcaccagagagctcttcctgggtgattatctgatctgtgagagcttcaatcagtctgcattgatctcatgatataaactgagcaccttagcat

SEQ ID NO: 1897 - DNA, 424 bp, Homo sapiens
  AL031316.2_86622
  Located on chromosome 1
  Distance between a terminus base of telomere on chromosomal short arm and 5'-terminus of this base sequence : 220104784
  Distance between 3'-terminus of neighbour sequence of sequence listing upward to telomere on chrosomal short arm and 5'-terminus of this base sequence : 74559
gcatgtctgaattctaactcaagaaaatgaaaaaagaaggataccacctggaaggtgtacacttttcttctgccacagctggctgcaattgttatctttattcaaagggaacatgtgtccaactaaaaatcagaagttctatttgtgtaaaagacactgatattgataaacaactagcaatctctcccacatcacccatgctaaaaaacacataagactagaaaaaagtataccctccaggccatcccacatgtgaaacacacacacacacacacacacacacacacacacacaaaagactcattccctctcacattcaaggtccatcacaaaaaacaaagtccttccatccggcagtgcgtgcaggggacagtggggtaggagaaagaatggaaagagaatacctaaatagcatttgtgaaac

SEQ ID NO: 1898 - DNA, 219 bp, Homo sapiens
  AL022398.1_8448
  Located on chromosome 1
  Distance between a terminus base of telomere on chromosomal short arm and 5'-terminus of this base sequence : 220124323
  Distance between 3'-terminus of neighbour sequence of sequence listing upward to telomere on chrosomal short arm and 5'-terminus of this base sequence : 19115
ttggtagctcaaacctgtaatcccagctactcgggaggttgaggcagaagaatcactagaacttgggaggcaaaagttgcagtgagccgagatcatgccattgcactccagcctgggcaacagagcaagactctgcctcggaaaacacacacacacacacacacacacacacacaagtaagttaaaatttaaatcaggtctgaaggtaggcagtatagg

SEQ ID NO: 1899 - DNA, 382 bp, Homo sapiens
  AL022398.1_75719
  Located on chromosome 1
  Distance between a terminus base of telomere on chromosomal short arm and 5'-terminus of this base sequence : 220191659
  Distance between 3'-terminus of neighbour sequence of sequence listing upward to telomere on chrosomal short arm and 5'-terminus of this base sequence : 67117
agaacaagaaaccacagtgagtcctatcattgcccagagccactgcaaagcatgtgcttaccctttctcatagacacaaacacacacacacacacacacacacacacacacacacacacacaacttttgcatgactgccccatcatcccaaccccgatttacagagactgcagcaggaaacactgcccttaggaccaggcaagacaggtgcctaagggaaataaagccatgtgcaaacacaatatattaaaaggaggaaccttatctcaagcactggtaccggcactcatcaagacgacaatgctctaatgaagggctgaagataaagcctgctgaaaatatgcaccaaagtgcagatggtaactctggatagcagaatttc

SEQ ID NO: 1900 - DNA, 187 bp, Homo sapiens
  AL022398.1_103297
  Located on chromosome 1
  Distance between a terminus base of telomere on chromosomal short arm and 5'-terminus of this base sequence : 220219284
  Distance between 3'-terminus of neighbour sequence of sequence listing upward to telomere on chrosomal short arm and 5'-terminus of this base sequence : 27243
ggaaactgtctactttaaggctactaggaaagcacacacacacacacacacacacacacacaaaatccttccctagaatcttcccaaatcagaagctgaggtgtctgactttcaccattagagagtcatacctttggatatacatggcttcctctcaacatatcttgaaactatgtgaccttgttat

SEQ ID NO: 1901 - DNA, 314 bp, Homo sapiens
  AL022399.2_34517
  Located on chromosome 1
  Distance between a terminus base of telomere on chromosomal short arm and 5'-terminus of this base sequence : 220332543
  Distance between 3'-terminus of neighbour sequence of sequence listing upward to telomere on chrosomal short arm and 5'-terminus of this base sequence : 113072
caatgtgtagacaaattccaactcagagttccaagaggtaagccaagctctgtgtggcagcaaggcttatcaagagcgaggctaaggggtgaagtgagtgtgtgtgtgtgtgtgtgtgtgagagagagagagagagagagagagagagaccactgctgtgctcaggattcctctctcctttttgctttttgccaactagctgtttctccacagcggagatctgagacgagtatgtggctgattcgggcaaaacaaaacaaaataaaaccaaacgaaaccaaaacagacttactattaccaaatctgagagtcag

SEQ ID NO: 1902 - DNA, 427 bp, Homo sapiens
  AL022397.1_65766
  Located on chromosome 1
  Distance between a terminus base of telomere on chromosomal short arm and 5'-terminus of this base sequence : 220425917
  Distance between 3'-terminus of neighbour sequence of sequence listing upward to telomere on chrosomal short arm and 5'-terminus of this base sequence : 93060
ctcacaagaacagtttcttgagagaggtttaggaaccagacatggtgaacttggctcagtaataaaactaattagtatgggaaggcagtgttttgtttgttttgttttgttttgttttgttttgttttgttgagacaggttctcactcatttgcccaggctggagtgcagtggcacaatgatggctcactgcaaccttgacctcctgggctcaagcaatcttccaccttggtctcctgagtaactaggactacaggcgtgcaccaccatgcctgtctttttttttttttttttttttggtagagattgggggtttctccacgttgcccaggatggggcagttttcaatatagcttgctatctgtatctgttgatagtatcatatggtttttcttcttcagccatatgtgatggatagattacattca

SEQ ID NO: 1903 - DNA, 417 bp, Homo sapiens
  chr1.fa.O7frz.243232859
  Located on chromosome 1
  Distance between a terminus base of telomere on chromosomal short arm and 5'-terminus of this base sequence : 220527313
  Distance between 3'-terminus of neighbour sequence of sequence listing upward to telomere on chrosomal short arm and 5'-terminus of this base sequence : 100969
ttattctgctcaggatctgatggccaccaccaggctgcccatctgggctctctccccacgccaagtccacctcttcatatctttcttcccatcctggcatggacatcctgttcaccctgctggtgtgccacgtgccactcctctgtgaggacaccctcctcaccctgcttggacataattgattttttttaacttttattttaagctcaggggtacatgtgcaggtttgttgtataggtaaacttgtgtcataggggtttattgtacagattatttcatcacccttaattggttttgtaagttaatgacccctcgacagtccctctataaagtctaagatgatgatgattttatatattgtgtgtgtgtgtgtgtgtgtgtgtgtgtgtgtgtgtagccactaacttatattgacca

SEQ ID NO: 1904 - DNA, 381 bp, Homo sapiens
  chr1.fa.O7frz.243361556
  Located on chromosome 1
  Distance between a terminus base of telomere on chromosomal short arm and 5'-terminus of this base sequence : 220610637
  Distance between 3'-terminus of neighbour sequence of sequence listing upward to telomere on chrosomal short arm and 5'-terminus of this base sequence : 82907
gactagtgagcaaccagtatctctgactggagcaagaaaagagatgactccaggagggatgactcaaaagagactgtgtgtgtgtgtatgtgtgtgtgtgtgtgtgtgtgcgcgcgcgcgcgcgcgcgtgtctgtgcagaaggaagaaatagagtagggaggaggaggagggaaaagaagaaagagcaggagaaataaaaaaggaagaaaagaaaaaagaatatgtttgaacacattgaaaggagttttatgctctatcagtgaattaatgatagatatacagaaaattaagtgaacaagaaactgacaattattaatcccagatgaaaaaaagggtttacaaaaaaatgtataattgtagttcactacatgtctcgttgt

SEQ ID NO: 1905 - DNA, 419 bp, Homo sapiens
  AL035414.30_5520
  Located on chromosome 1
  Distance between a terminus base of telomere on chromosomal short arm and 5'-terminus of this base sequence : 220618730
  Distance between 3'-terminus of neighbour sequence of sequence listing upward to telomere on chrosomal short arm and 5'-terminus of this base sequence : 7712
actttagaaaggattccttgttagtcctaccattaaacaattaaattgtcagagatgaattctgtgcatgtgtgtgcagagcttgcctgtgtgtgcaggatgtgtaatttcccactcaggtgatgtctgctgcaggttgtctttctctctctttctctctctctctctctctctctctgtccctttcccaccccaattgtgtgcttttccctttacattgttgaaaataaatacatcttcctgatggtataagcttttattatgaactttgatatgcctacacattctatactacacagaaagtagtaatataaaatgaaatgttcaaaaattaatttgtctccaggtatttctctgccagaacatgattccttagttcccctctcctgacactagttattgatacagtcggtttactc

SEQ ID NO: 1906 - DNA, 311 bp, Homo sapiens
  AL035414.30_108666
  Located on chromosome 1
  Distance between a terminus base of telomere on chromosomal short arm and 5'-terminus of this base sequence : 220721974
  Distance between 3'-terminus of neighbour sequence of sequence listing upward to telomere on chrosomal short arm and 5'-terminus of this base sequence : 102825
atcatgccactgtgcttagcctgggtgacacagtgagactgtctctaatacatacatatatatatatatatatatatatatatatatacacacacacataaattttggctatttttatttgatgtttctgattgcctgtgtttaaatctgcctttatctcctttgtgttcgccggtgaatttaaagtgcatatgtagacaggggttaagtgtaaatcacactgaacctatattaacaacagcatcttttagaaataatataggagctgttatcacatccctgtccctgagtttgacactacctgagttgag

SEQ ID NO: 1907 - DNA, 400 bp, Homo sapiens
  AL035414.30_130476
  Located on chromosome 1
  Distance between a terminus base of telomere on chromosomal short arm and 5'-terminus of this base sequence : 220743542
  Distance between 3'-terminus of neighbour sequence of sequence listing upward to telomere on chrosomal short arm and 5'-terminus of this base sequence : 21257
cctgttgatttagaggtttgtatactgtttgtgcttttcagactttttgaagccatttattattcacagagcacctggtagtcccttcttgctacatcccaggcactgtgctaggggctggtgagtcagagatcatggtccctgctatctgagggtccactccacagaagagacaggcatattatgcaatgggtagagaactgtctgatgtatactctgatgggagactgtgggaactcctaggaaaagacctgacccctttgacaggcaggatgcacatgtgtggtgtatgtgtgcgtgtgtgtgtgtgtgtgtgtgtgtgttggatgcaggatggagtaagttcacagggaggaggaagcttgattggggttatgtctgtatcaccttgaatagtgat

SEQ ID NO: 1908 - DNA, 479 bp, Homo sapiens
  chr1.fa.O7frz.243583540
  Located on chromosome 1
  Distance between a terminus base of telomere on chromosomal short arm and 5'-terminus of this base sequence : 220832911
  Distance between 3'-terminus of neighbour sequence of sequence listing upward to telomere on chrosomal short arm and 5'-terminus of this base sequence : 88969
tccttccacaatcctaactatcccaggaaactattggacactcccatgaatcagttttagattcttacagacaaattggccaatggcatgtaccacttgaaattccacccactgtgaggctttttccttgtttgctgtcctttggggccatctcacatataaggttgcagctgttcatttccagcagattccatcatatcttgggcagtcatcagtgaacagagctgtttcccctcctctaccaagtcctcttggggccttaggtgtgggatgagagaaggatagccacatagcaggagtcagcatattgggaggaggagttctcttttcctgcaacttaattgtgacctcaggattctccgtgtttgtgtgtgtgtgtgtgtgtgtatacacatgtgtatgtatccattgataatggaatgcttcctgatattgtggctaggtggatcagataactctagttgataatggaccactca

SEQ ID NO: 1909 - DNA, 322 bp, Homo sapiens
  chr1.fa.O7frz.238667769
  Located on chromosome 1
  Distance between a terminus base of telomere on chromosomal short arm and 5'-terminus of this base sequence : 221046463
  Distance between 3'-terminus of neighbour sequence of sequence listing upward to telomere on chrosomal short arm and 5'-terminus of this base sequence : 213073
cagagaacttaagctgtatcaaacattatatactgatactataactgaaactataactatcatgaatttatatatatatatatatatagtcttactcttctcatgctgctaataaagacataccctagactgggtaatttataaaggaaagaggtttaattgactcacacagttctacatggctggggaggcctcacaatcatggcagaaggtgatggaggagcaaagtcatgtcttacatggcagcagtcaagagaacttgtgcaagggaactcccatttataaaaccatcagatccgtcagacttattcactaccatgag

SEQ ID NO: 1910 - DNA, 457 bp, Homo sapiens
  AL358977.8_16293
  Located on chromosome 1
  Distance between a terminus base of telomere on chromosomal short arm and 5'-terminus of this base sequence : 221241765
  Distance between 3'-terminus of neighbour sequence of sequence listing upward to telomere on chrosomal short arm and 5'-terminus of this base sequence : 194980
acctacatgtttacagtgccacatgagactacactcagactcatggacttttttcctttttcaattactaactgctttagtcctctaaacgtggattcttctttttttttttttttaaaccaatactgggtctaactctgtggcccaagctggagtgcagtggcacactcatagctcactgtaacctctaactcctgatctcaagtgatccttcctccttggcctctcaagtagctaggactacagaaacatgccaccatgcctggcttatttattatttatttatttatttatttatttatttatttatttatttatttatttatggtagagatgaggtttcactatgtttcccaggctggtctccaactcttggactcaagtgatcctcccacctcagccttccaaagtgccgggattacaggtgcctggctctaaacatggattcgttaaaagc

SEQ ID NO: 1911 - DNA, 184 bp, Homo sapiens
  chr1.fa.O7frz.244099361
  Located on chromosome 1
  Distance between a terminus base of telomere on chromosomal short arm and 5'-terminus of this base sequence : 221302196
  Distance between 3'-terminus of neighbour sequence of sequence listing upward to telomere on chrosomal short arm and 5'-terminus of this base sequence : 59974
ggagcatcttcaattagtatgtctgtctgtctcacacacacacacacacacacacacacacacacacacacagccctcagaagtcacactcagctcccctagaattgattttaaaagccagtcctaattctgatggctctgtccatggttctagcaggcaaggttctgaaatcttgcaatacag

SEQ ID NO: 1912 - DNA, 133 bp, Homo sapiens
  D1S2812
  Located on chromosome 1
  Distance between a terminus base of telomere on chromosomal short arm and 5'-terminus of this base sequence : 221323087
  Distance between 3'-terminus of neighbour sequence of sequence listing upward to telomere on chrosomal short arm and 5'-terminus of this base sequence : 20707
aacataaggagggcctgatacacaagtacacacgggcacacacacacacacacacacacacacacacacacagacacatacaaagacacacacacagagcagcagcaacattgctggcagacacaacagtcca

SEQ ID NO: 1913 - DNA, 182 bp, Homo sapiens
  chr1.fa.O7frz.243861421
  Located on chromosome 1
  Distance between a terminus base of telomere on chromosomal short arm and 5'-terminus of this base sequence : 221722104
  Distance between 3'-terminus of neighbour sequence of sequence listing upward to telomere on chrosomal short arm and 5'-terminus of this base sequence : 398884
aaaggatatagcaggactttagattcaggcaatatttcaaattagaaaactttaaaaccctcctactataaatatcaaaaaattctggagatgtgtgtgtgtgtgtgtgtgtgtgtgtgtgtgtgtatacaaccttttaaataaattgctgaactccagtgaaatcaagtaaattcctcagg

SEQ ID NO: 1914 - DNA, 243 bp, Homo sapiens
  D1S2810
  Located on chromosome 1
  Distance between a terminus base of telomere on chromosomal short arm and 5'-terminus of this base sequence : 221809652
  Distance between 3'-terminus of neighbour sequence of sequence listing upward to telomere on chrosomal short arm and 5'-terminus of this base sequence : 87366
tcagttcctggttaccgttattctgctctctgcttctattaacgagttcaacttttttagattccacatataagcaaaatcatgcagtatttatctttctgtgccaggcttatttcatttggcataatgttctccaggctcacccatgatacacacacacacacacacacacacacacacacacacacacacagagtttatcgttcattttctccgactaacttgtaaggctcataagaacgg

SEQ ID NO: 1915 - DNA, 344 bp, Homo sapiens
  AC053507.3_48854
  Located on chromosome 1
  Distance between a terminus base of telomere on chromosomal short arm and 5'-terminus of this base sequence : 222043978
  Distance between 3'-terminus of neighbour sequence of sequence listing upward to telomere on chrosomal short arm and 5'-terminus of this base sequence : 234083
ctgaatcagtggatgtcatctaataataataataataataataataataataataataataataaagcttttaatttctcagtgcttagtattgacctgcttcttctccagaattcttcatattagtagatttacaacccaagcctgatctggggatcattcttgattattctctctcaccattcccctgccattactaccacacatgcatttttagtgacagttattataggtttggtctcttgaaagctcttgtttttctttttagcttacaaagactaaaaagtgaatcttcaaattcccagcctcccttacagctagtaatagccatttagcacaatttc

SEQ ID NO: 1916 - DNA, 114 bp, Homo sapiens
  DISO7_10000781
  Located on chromosome 1
  Distance between a terminus base of telomere on chromosomal short arm and 5'-terminus of this base sequence : 222327312
  Distance between 3'-terminus of neighbour sequence of sequence listing upward to telomere on chrosomal short arm and 5'-terminus of this base sequence : 282990
catacacagagacactctatccccatcccgcaacacacacacacacacacacacacacacacacagagtctagaaaggaccaccaaacaccaaagtgttaatagctacttccga

SEQ ID NO: 1917 - DNA, 114 bp, Homo sapiens
  DISO7_10000783
  Located on chromosome 1
  Distance between a terminus base of telomere on chromosomal short arm and 5'-terminus of this base sequence : 222397585
  Distance between 3'-terminus of neighbour sequence of sequence listing upward to telomere on chrosomal short arm and 5'-terminus of this base sequence : 70159
tcaatagcaatcatggtggggtgtgtgtgtgtgtgtgtgtgtgtgtgtgtgtgtgtgtgtgtgtgtgtgtttgtgtgtgtccatgtcctctgtctggccaggagcttcctaaga

SEQ ID NO: 1918 - DNA, 465 bp, Homo sapiens
  AL359917.5_63657
  Located on chromosome 1
  Distance between a terminus base of telomere on chromosomal short arm and 5'-terminus of this base sequence : 222466818
  Distance between 3'-terminus of neighbour sequence of sequence listing upward to telomere on chrosomal short arm and 5'-terminus of this base sequence : 69119
acctagctaaaacatccgaaagtttagaactaagtttatttcctgtgcaaatcagaatgttaatataacttttatagagcccccaaatatacattaaaatataaaattatcattatttatttatttatttatttatttatttatttatttatttatatttgagacagagtctagctctgtcacccaggctggagtgtagtggtgcgatcttggctcactgcaacctctacctcccgggttcaagcaattctcctgcctcagcctcccaagtagctgggattacaggtgcacaccaccacgcccagctgatttttgtatttttagtagagatggggtttcaccatattggccaggctggtctcaaactcttgacctcaagtgatccacctgccttggcctcccaaagtgctgagattacaggcgtgagccactgtgcccagctatggtcatacctttgatctagaa

SEQ ID NO: 1919 - DNA, 141 bp, Homo sapiens
  D1S2780
  Located on chromosome 1
  Distance between a terminus base of telomere on chromosomal short arm and 5'-terminus of this base sequence : 222518439
  Distance between 3'-terminus of neighbour sequence of sequence listing upward to telomere on chrosomal short arm and 5'-terminus of this base sequence : 51156
gtctgtgttctaagtattaaaaacccaactcaaaccagcttacacacacacacacacacacacacagatttattcacagaggtattgctagtttacattacaacataatttagagactaaaatacagttgtcagggttgga

SEQ ID NO: 1920 - DNA, 96 bp, Homo sapiens
  D1S425
  Located on chromosome 1
  Distance between a terminus base of telomere on chromosomal short arm and 5'-terminus of this base sequence : 222534286
  Distance between 3'-terminus of neighbour sequence of sequence listing upward to telomere on chrosomal short arm and 5'-terminus of this base sequence : 15706
ctaaaacaaaacactcagaaccacacacacacacacacacacacacacacacacacacaaattgacaccagttgtatgtgaagccttgtgctaggt

SEQ ID NO: 1921 - DNA, 465 bp, Homo sapiens
  AL357036.7_12766
  Located on chromosome 1
  Distance between a terminus base of telomere on chromosomal short arm and 5'-terminus of this base sequence : 222561723
  Distance between 3'-terminus of neighbour sequence of sequence listing upward to telomere on chrosomal short arm and 5'-terminus of this base sequence : 27341
acatgaagccatttaactgaaggaggccgggcatggtggctcatgcctgtaatcctagcactttgggaggccgatgggggtggatcactggaggtcaggagttcaagaccagcctgaccaacatgatgaaactccacctttactaaaaatacaaaattagccgggtgtggtggcacatgcctgtaatcccagatacttgggaggctgaggcaggagaatcacttgaacctgggaggcggaggttgcagtgagctgagatcgcaccattgcactccaccccaggcaacaagagcaaaactccatctctaaataaataaataaataaataaataaataaataaataaaataattaaatttaactgaattaaaagtaaattaattcagttcctcaatcacactagccatattttaagtactcaatagctacatgtggccagtggctgtagcggttagtgcaaatttag

SEQ ID NO: 1922 - DNA, 418 bp, Homo sapiens
  AL357036.7_83350
  Located on chromosome 1
  Distance between a terminus base of telomere on chromosomal short arm and 5'-terminus of this base sequence : 222673293
  Distance between 3'-terminus of neighbour sequence of sequence listing upward to telomere on chrosomal short arm and 5'-terminus of this base sequence : 111105
tttattcacctgagccatttaggaggttaagctggtttggactggttttttgtttgtttgtttgtttgtttgtttgtttgttttttgagacaaagtctcactctgttgcccaggctggaatgcagtggcgtgatcttggctcactgcaacctccacctcccaggttcaagcaattctcatgcctcaacttcccaagtaactgggattacaggcgtgtaccaccacgcccagctaatttttgtatttttagtagagacagggtttcgccatgtcggccaggttggtctcgaactcctaacctcaagtgatctgcccgcattggcttcccaaagtgctgagattacaggcatgagccaccatgcccagcctggcttggacttttaagaaagtcggttttaatttactgtggttgcagttg

SEQ ID NO: 1923 - DNA, 446 bp, Homo sapiens
  chr1.fa.O7frz.245185029
  Located on chromosome 1
  Distance between a terminus base of telomere on chromosomal short arm and 5'-terminus of this base sequence : 222793606
  Distance between 3'-terminus of neighbour sequence of sequence listing upward to telomere on chrosomal short arm and 5'-terminus of this base sequence : 119895
ctcttcatgtcgtaaatcaagttggagggagacaattttaaggtcctctaccatctatggccacttcaatttcggattcatctttgatgggcatgtgactctggaatagggcaactctaaaagtttgagtaaatactagaactaaacaactaaacaagggagccaggattccacactaaatccagacaaaactattttaggcacccacacaagctcccagccctgttctgactctaccctgtgtaccccatcgtcttgctgcttcttttcctcaatccctgacattctttgcttttgtttgtttgtttgtttgtttgtttttgagacagggtctcactctgtcatccgggctgtagtacggtggtgtggtggtgcaatcatagctcactgcagcctcaaactcctgggctcaagcgactccctaataattgagctaactttgcaca

SEQ ID NO: 1924 - DNA, 480 bp, Homo sapiens
  chr1.fa.O7frz.245429049
  Located on chromosome 1
  Distance between a terminus base of telomere on chromosomal short arm and 5'-terminus of this base sequence : 222855193
  Distance between 3'-terminus of neighbour sequence of sequence listing upward to telomere on chrosomal short arm and 5'-terminus of this base sequence : 61141
tgcaatagaaagcaaggacatcgggccgggcgcggtggctcacacctgtaatcccagcactttgggaggcgaagtgggcagatcacgagatcaggagtttgagacaagcctggccgatatggtgaaacctcgtctctactaaaaatacaaaaattagccaggcgtgttgccatgcgcctgtagtcccagctactcaggaggctgaggcaggagaatcgcttgaacctgggaggcggaggttgtagtgcgccgagatcgcgccactgactccagcctgggcgacagtgactccgtctcagaaaaaaaaaagaaagaaagaaagaaagcaagaacaccccaaattcctgaaggtcacggaattcagttcccattaggcagagtggaaagacctcatcacacacagagcattaagtagagtccacagaagggtatggtcatggtggtggggctaaataagccctagactacctgttgctctgg

SEQ ID NO: 1925 - DNA, 275 bp, Homo sapiens
  chr1.fa.O7frz.245300658
  Located on chromosome 1
  Distance between a terminus base of telomere on chromosomal short arm and 5'-terminus of this base sequence : 222894703
  Distance between 3'-terminus of neighbour sequence of sequence listing upward to telomere on chrosomal short arm and 5'-terminus of this base sequence : 39030
agccaagagtttctgttaagatttaggttgtataggccgggtgcctatatatccatatatacatatgtgtgtgtgtgtgtgtgtgtgtgtgtgtgtgtgtgtgtgtatctatatatatatctccaggaagagagaaatgtaataatttataggcaatatagaatacattgttctgtggtagcagaactctttcctatggagtgttgaggatgacttggaaaaagcagaatttggccttgctggttgggggacttagattatgaagcacctactgg

SEQ ID NO: 1926 - DNA, 165 bp, Homo sapiens
  D1S505
  Located on chromosome 1
  Distance between a terminus base of telomere on chromosomal short arm and 5'-terminus of this base sequence : 223185975
  Distance between 3'-terminus of neighbour sequence of sequence listing upward to telomere on chrosomal short arm and 5'-terminus of this base sequence : 290997
cctcacccatgacactgtgagccagattataagcctttgtaaaatcctctacctccttgtccatgcctttttctctttttctttttcttttcgtgtgtgtgtgtgtgtgtgtgtgtgtgtgtgtgtgtgtgtgtgtgtgtgtatctgggcaagagcaagccttcc

SEQ ID NO: 1927 - DNA, 453 bp, Homo sapiens
  AL353112.7_74656
  Located on chromosome 1
  Distance between a terminus base of telomere on chromosomal short arm and 5'-terminus of this base sequence : 223242798
  Distance between 3'-terminus of neighbour sequence of sequence listing upward to telomere on chrosomal short arm and 5'-terminus of this base sequence : 56658
ttgtagaaacatcgcttcagtctccacctttatcttcacatgcattcttcttgtgtacatgtctgtctccaaatttctgttttataaggacaccagtcatattggattagggcccaccctactgacttcattttaattagattacctctgtaaaaaccctatcttttcatgccactgcactccagcctgggcgacagagcgagactttgtctcaacaacaacaacaacaacaacaacaacaacaaaacctatctccaaataagtgtactagggattcatgcagaacccctagtttttttgtggaaacatagttcaacccataacagtctcatttccatgttacatttaatttacagcctttataaccattttgaagtatattgtttacttgtttgtgttcatttcctgtgtccccacactatatccaacataagctacatgaggacagaagtc

SEQ ID NO: 1928 - DNA, 196 bp, Homo sapiens
  D1S2703
  Located on chromosome 1
  Distance between a terminus base of telomere on chromosomal short arm and 5'-terminus of this base sequence : 223407095
  Distance between 3'-terminus of neighbour sequence of sequence listing upward to telomere on chrosomal short arm and 5'-terminus of this base sequence : 163844
catttaccccagtgttgcagaaatacatagtactcgtgtgtgtgtgtgtgtgtgtgtgtgtgagagagagagagagagaaagagagaaagtcgtgtccttttctccctgagaagcatacaatgggggagaaatgctgaggattggtgctttcactcttccaggcacaggcgagcatctatcccgacttggagagct

SEQ ID NO: 1929 - DNA, 130 bp, Homo sapiens
  D1S217
  Located on chromosome 1
  Distance between a terminus base of telomere on chromosomal short arm and 5'-terminus of this base sequence : 223448392
  Distance between 3'-terminus of neighbour sequence of sequence listing upward to telomere on chrosomal short arm and 5'-terminus of this base sequence : 41101
gcacatttccggtaaaagaaatattggcacaaaattacagagactagaattaacagtgtatatgcatgtggagatgtgtctgtgtgtgtgtgtgtgtgtgtgtgtacgtctgtgacagggttggttataa

SEQ ID NO: 1930 - DNA, 365 bp, Homo sapiens
  AC027742.2_134268
  Located on chromosome 1
  Distance between a terminus base of telomere on chromosomal short arm and 5'-terminus of this base sequence : 223635197
  Distance between 3'-terminus of neighbour sequence of sequence listing upward to telomere on chrosomal short arm and 5'-terminus of this base sequence : 186675
gctgtatcctaacatttcaagaactgcgatattgaaaaaagcattggatctactagatgtggttctattaaatggaaccaaacccaacaggtacatttgaaagtgagagtgtttggatcagtacaaagaagagctttttctttttttttttcttttctctctttctctttctctctccttccttccttccttccttccttccttccttccttcctttctttctttctttctttctttctttctttctttctttctttctttctttttttttctttctctctttcttcttcctctttttgtttttttgagttgggatctttctctgttacccaggctggagtgcagtgctgtaatcatggcttatt

SEQ ID NO: 1931 - DNA, 430 bp, Homo sapiens
  AC025707.3_11096
  Located on chromosome 1
  Distance between a terminus base of telomere on chromosomal short arm and 5'-terminus of this base sequence : 223873609
  Distance between 3'-terminus of neighbour sequence of sequence listing upward to telomere on chrosomal short arm and 5'-terminus of this base sequence : 238047
cctgtaatcctagcactttgaaaggctgaggcgggaggatcacgaggtcagaagttcgagaccagcctgaccaacatggtgaaatccgttctctactaaaaatacaaaaattagcaggtgtggtggcatgcctgtaatctcagctactcaggaggctgaggcaggagaatcgcttgaacctgggagatggaggttgtagtgagccgagatcgcgccactgcactccagcctgggcgacacagcgagactccatcgcaaataataataataataataataataataataataaattaaacaacaacaacaacaaaaaagccagttttgcaccatttgcaagatcaatatttctgatctataaacatgtctgctctttggattctcctttgaacaggtgataacatctgtctggttcacctatgtaatgagt

SEQ ID NO: 1932 - DNA, 459 bp, Homo sapiens
  AC026064.3_26073
  Located on chromosome 1
  Distance between a terminus base of telomere on chromosomal short arm and 5'-terminus of this base sequence : 224005215
  Distance between 3'-terminus of neighbour sequence of sequence listing upward to telomere on chrosomal short arm and 5'-terminus of this base sequence : 131176
agccagtctatgtcttgattgtagtttagtccatttgcattcaatgttattatttataagtaaggacttacaccattttgttattttttttctggtggtttagtggtctttcttctttctttccttcctgtcttcctctagtgaaggtgataggatttagtttcttgctttttatttttttgtatgtacattatatgttatttatttatttatttatttatttatttattttttattgataattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcacgctgccttcaagcatctgtttaacaaagcac

SEQ ID NO: 1933 - DNA, 346 bp, Homo sapiens
  AC026064.3_102777
  Located on chromosome 1
  Distance between a terminus base of telomere on chromosomal short arm and 5'-terminus of this base sequence : 224052617
  Distance between 3'-terminus of neighbour sequence of sequence listing upward to telomere on chrosomal short arm and 5'-terminus of this base sequence : 46943
tccttggttaggtgtattcctaagtatgtatgtatgtatgtatgtatgtatgtatgtattttttgtagtcgttgcaaaaggtgttgtgttcttgatttgattctcagcttggtcactgttggtgtataagtgctgctggtttgtgtacattgattttatatcctgaaactttattgaattcatttatcagatctaagaactttttggatgagtctttagggttttctaggtatatgatctgtctgttttgtctgctatataagtagttactcctgcttactttcggctttcatttgcagggaatacctttttccatcccttttccttaaatttatgtgcgtccgta

SEQ ID NO: 1934 - DNA, 373 bp, Homo sapiens
  chr1.fa.O7frz.246472342
  Located on chromosome 1
  Distance between a terminus base of telomere on chromosomal short arm and 5'-terminus of this base sequence : 224171761
  Distance between 3'-terminus of neighbour sequence of sequence listing upward to telomere on chrosomal short arm and 5'-terminus of this base sequence : 118798
gtcatattctgaggatgactacagagaaaaatagagcaaggtaggtagggcatgcagtgtgtgtgtgtgtgtgtgtgtgtgtgtgtgtgttggaggggaggtctgtgggttatttttacacagagtgattgagggggcctcattaataatgtgacattggagtagacacagaaaggaaatgaggaaatagatttcaggcacagggagcggggaatgcaaaagtcctgcagtaggcatgtgcttggtgttatctgagaagctacagaaagccagcatggctggggcagagtgagccaaggggaggatcatggtgggggtgaggtcagagagggagcctgccaggtgaggggtcttataggagccgtaatagatt

SEQ ID NO: 1935 - DNA, 224 bp, Homo sapiens
  DISO7_00000160
  Located on chromosome 1
  Distance between a terminus base of telomere on chromosomal short arm and 5'-terminus of this base sequence : 224265625
  Distance between 3'-terminus of neighbour sequence of sequence listing upward to telomere on chrosomal short arm and 5'-terminus of this base sequence : 93491
tgccagtagcttgcattccaccaagaagaaggatctgtcagcaccaagggtggtcctgaaaggatggggaatctggggtgtgaggggtgctgaggctagctcaagagtcaggaacacatacacacacacacacacacacacacacacacacacacacagacactttgagttagggcaatcagaatcccggaaggctagcagatgatctgaaatgctggaggtca

SEQ ID NO: 1936 - DNA, 236 bp, Homo sapiens
  DISD22_0001096
  Located on chromosome 1
  Distance between a terminus base of telomere on chromosomal short arm and 5'-terminus of this base sequence : 224523761
  Distance between 3'-terminus of neighbour sequence of sequence listing upward to telomere on chrosomal short arm and 5'-terminus of this base sequence : 257912
agttatcaggcaatgggctgaaagatgggcagtaagatggaattcacatatattttttgtgggcatgtgttttgccttattcttgtgacaaaaggtagtggtgtgtgtgtgtgtgtgtgtgtgtgtgtgtgtgtgtgtgtgtgtctggagcagcaatgagggggagaagataacattacaaaatgtaaatttttgtgacgaattagaaaaacttctaggaccttcttgatttgcta

SEQ ID NO: 1937 - DNA, 458 bp, Homo sapiens
  chr1.fa.O7frz.246897623
  Located on chromosome 1
  Distance between a terminus base of telomere on chromosomal short arm and 5'-terminus of this base sequence : 224668763
  Distance between 3'-terminus of neighbour sequence of sequence listing upward to telomere on chrosomal short arm and 5'-terminus of this base sequence : 144766
agttatctcattcctattgcctgtggcatcggctgccctgtaattgagaagtcaagtgagtttgttgttgttgttgttgttgttgtttgttgttgttgtttttgagacggagccgctctgtagcccaggctggagtgtagtggcttgatctcggctcactgcaagctccacctcctgggttcacgccattcttctgcctcagcctccccagtggctgggactacaggcgcccaccaccacgcccggctaattttttgtagttttagtagagatggggtttcacagtgttagccaggatggtcttgagaagtcaggtgagtttcttatgtgaaagtgaagtctctgtgcatgcttttccaggagaatgcttccctgatcctctccaactggaaacagcctggaattgctggcaatgttgctcctaagctcagagtgtccaggatagctactgatactaa

SEQ ID NO: 1938 - DNA, 320 bp, Homo sapiens
  AL359648.9_105724
  Located on chromosome 1
  Distance between a terminus base of telomere on chromosomal short arm and 5'-terminus of this base sequence : 224672696
  Distance between 3'-terminus of neighbour sequence of sequence listing upward to telomere on chrosomal short arm and 5'-terminus of this base sequence : 3475
cacttgaggtcaagagtttgagaccagcctggccaacatggtgaaacccagcctctactctaaaaaataaataaataaataaataaataaataaataaataaaaagctttatgaaaagctcaataaataaaactgaagaaatgtctaaggaaggtttttttttttttaaatggaagaatttagagaacatagaagagccatctagtactaattccagaggcccaacatttgattaataggaattcttgaaacagagaatacagttgactgttgaacaacacgggtttgaactgcatgggtccacttaggtgaggattttc

SEQ ID NO: 1939 - DNA, 201 bp, Homo sapiens
  D1S2646
  Located on chromosome 1
  Distance between a terminus base of telomere on chromosomal short arm and 5'-terminus of this base sequence : 224818842
  Distance between 3'-terminus of neighbour sequence of sequence listing upward to telomere on chrosomal short arm and 5'-terminus of this base sequence : 145826
agcttaaattgagcaggaaaaagtcacacaggataaccgggcacatgttttacatcctcttttcccagcaccctgcaggggcatgcgcacacacacatgcacacacacacacacacacacacacacttattcttctatttattttcctccactattcatattcattggcatcatcctttcctcccagtgatgatctactcc

SEQ ID NO: 1940 - DNA, 187 bp, Homo sapiens
  AC011700.5_95026
  Located on chromosome 1
  Distance between a terminus base of telomere on chromosomal short arm and 5'-terminus of this base sequence : 224860521
  Distance between 3'-terminus of neighbour sequence of sequence listing upward to telomere on chrosomal short arm and 5'-terminus of this base sequence : 41478
cttcacaggcagattgaaatagggagccacgcagccacgctcagaagcacattgctgccacctctgaagcacttctccctcacttcctccatcccaaatactagacacatacacacacacacacacacacacacacacaaatacatacacaaacaataagtccaaatttcttgagtgctgactatgt

SEQ ID NO: 1941 - DNA, 264 bp, Homo sapiens
  AC011700.5_21655
  Located on chromosome 1
  Distance between a terminus base of telomere on chromosomal short arm and 5'-terminus of this base sequence : 224933891
  Distance between 3'-terminus of neighbour sequence of sequence listing upward to telomere on chrosomal short arm and 5'-terminus of this base sequence : 73183
ggttcatgtaaggctaatgtctagggctaagaccccattgcaccccagagatctcttaacttcattttgaaccaggtagttgtgatagtgggttctttctgtctctctctctctcttacacacacacacacacacacacagacacacacacacagagtaaagtgacatgcgtgccaattttggtgaatatttaaagatttaatgccaggtttcaaaactcctgtaagtccacactaagctctttagttcaagatgccagtttat

SEQ ID NO: 1942 - DNA, 155 bp, Homo sapiens
  AC011700.5_8553
  Located on chromosome 1
  Distance between a terminus base of telomere on chromosomal short arm and 5'-terminus of this base sequence : 224947027
  Distance between 3'-terminus of neighbour sequence of sequence listing upward to telomere on chrosomal short arm and 5'-terminus of this base sequence : 12872
gtaagctacctatttgtctttgctctctaagactaatatattttttgccaaatgtgtgataaatgaagtttgggtggtgtgtgtgtgtgtgtgtgtgtgtgtgtgtttgctaaatacattaaaagtgagaattcttcgtgtactgctccactatt

SEQ ID NO: 1943 - DNA, 364 bp, Homo sapiens
  DISO7_00010352
  Located on chromosome 1
  Distance between a terminus base of telomere on chromosomal short arm and 5'-terminus of this base sequence : 225044719
  Distance between 3'-terminus of neighbour sequence of sequence listing upward to telomere on chrosomal short arm and 5'-terminus of this base sequence : 97537
ctgccagtaaccatggtgggtgggcacaggaaagtcacttcccttgctctccactgtttccccagctatgaaaccaaaatgggatttctggggcctttcccatcaaagacatctatgatattccctctttaacctcatgtgtttctccctccatcctcccccctccttcattatcttcctttttctcatttcttaaaaatcttctttcccttaccttgcctccccctgcacatcctctgtcactcctctcccttttctgcaccacagccttacactctctctctctctctctctgtttcatcgtcattctcttggtaccaccaccccaagcccctggaacacatgctgctggaattaacatcgg

SEQ ID NO: 1944 - DNA, 168 bp, Homo sapiens
  Z23491.1_90
  Located on chromosome 1
  Distance between a terminus base of telomere on chromosomal short arm and 5'-terminus of this base sequence : 225293431
  Distance between 3'-terminus of neighbour sequence of sequence listing upward to telomere on chrosomal short arm and 5'-terminus of this base sequence : 248348
aattctgtcaccaaagtcctccatggcttcgcatgtaagttggggaggggggagcggaagagaactgatggtgagtgtgtgtgtgtgtgtgtgtgtgtgtgtgtgtgtgtgtgttttaagtgacaataatttatagttcttacaagacactaattatttggctggtac

SEQ ID NO: 1945 - DNA, 174 bp, Homo sapiens
  D1S419
  Located on chromosome 1
  Distance between a terminus base of telomere on chromosomal short arm and 5'-terminus of this base sequence : 225293460
  Distance between 3'-terminus of neighbour sequence of sequence listing upward to telomere on chrosomal short arm and 5'-terminus of this base sequence : -139
cgcatgtaagttggggaggggggagcggaagagaactgatggtgagtgtgtgtgtgtgtgtgtgtgtgtgtgtgtgtgtgtgtgttttaagtgacaataatttatagttcttacaagacactaattatttggctggtacccaatgtacagtcctggatccagacaggaccagct

SEQ ID NO: 1946 - DNA, 144 bp, Homo sapiens
  D1S2827
  Located on chromosome 1
  Distance between a terminus base of telomere on chromosomal short arm and 5'-terminus of this base sequence : 225534141
  Distance between 3'-terminus of neighbour sequence of sequence listing upward to telomere on chrosomal short arm and 5'-terminus of this base sequence : 240507
aattttgcgtgtgtgtgcgtgcatgcctgtacacacatgtatgcatgcgtgtgtgtgtgtgtgtgtgtgtgtgtgtgtgtgtgtgtgacagagaagagagagagtcaagatatgtggtgtagctttttgacagaggccagaagt

SEQ ID NO: 1947 - DNA, 313 bp, Homo sapiens
  AL358452.3_53470
  Located on chromosome 1
  Distance between a terminus base of telomere on chromosomal short arm and 5'-terminus of this base sequence : 225643183
  Distance between 3'-terminus of neighbour sequence of sequence listing upward to telomere on chrosomal short arm and 5'-terminus of this base sequence : 108898
tcattcctgagttacttcacttagaataatggtctccagttccatcaaggtttctgcaaatgccattattttgttcctttgaatggctgatacacacacacacacacacacacacacacacacacacacacacacaccaaatttttttatccactcattgattgatgggcgtttgggctggttccatgttttcacaattgtgaactgtgctgctataaacatgcatgtgtaagtatcttttcatataatgacttcttttcctcttggtagatacccaggagtaggattgatgaatcaaatggtaaatctactt

SEQ ID NO: 1948 - DNA, 119 bp, Homo sapiens
  Z66866
  Located on chromosome 1
  Distance between a terminus base of telomere on chromosomal short arm and 5'-terminus of this base sequence : 225771490
  Distance between 3'-terminus of neighbour sequence of sequence listing upward to telomere on chrosomal short arm and 5'-terminus of this base sequence : 127994
tgttttccatgttttctacaaagcatatgcactcttttataatcagtcaaatacgtgtgtgtgtgtgtgtgtgtgtgtcaactacactttaaaaatgatatggagttaggccactggag

SEQ ID NO: 1949 - DNA, 337 bp, Homo sapiens
  chr1.fa.O7frz.248700439
  Located on chromosome 1
  Distance between a terminus base of telomere on chromosomal short arm and 5'-terminus of this base sequence : 225868865
  Distance between 3'-terminus of neighbour sequence of sequence listing upward to telomere on chrosomal short arm and 5'-terminus of this base sequence : 97256
ttcacttgagtaggtcaatgagctatgcccctgcaacacccacccacacacacacacacacacacttctccccctcatgtgacaagctctggtttcagtgctgctgtgaccctcttccaagcacccgtcttgtgaacaggtaagataccctttgaacatcagacccaaactggcaaaaggattttaggctatactctgaatggagagaaataggcagaggtgccaaggaatgagagtgtcttttgtatttcatcaacatttttcaagaccatacagtatacagtatagctaagtttaagttttgcttgttatttaattactggtttgaagatccttt

SEQ ID NO: 1950 - DNA, 360 bp, Homo sapiens
  chr1.fa.O7frz.248519445
  Located on chromosome 1
  Distance between a terminus base of telomere on chromosomal short arm and 5'-terminus of this base sequence : 226005387
  Distance between 3'-terminus of neighbour sequence of sequence listing upward to telomere on chrosomal short arm and 5'-terminus of this base sequence : 136185
ttggaattagcaatgaacatagtatgtctattattcagcaaagaatgcttcagcacatactacacacacacacacacacacacacacacacacacacacacacacacacagacacgtgtacaggtgcatgcataaacccttctcttctccaccatgaattgactgaaaggtgacaccatagctaaccagggaaacagtccagtcctgcttataaaaaagtaagatactctcattgtgaaaaccagctgattcctctaacaccagagatgagaaagactgcaaactctacaagggtttggaaagtgcctctttttaggtagctctttgcaaaaagttctcttatccactgtatttgttcca

SEQ ID NO: 1951 - DNA, 358 bp, Homo sapiens
  chr1.fa.O7frz.248421562
  Located on chromosome 1
  Distance between a terminus base of telomere on chromosomal short arm and 5'-terminus of this base sequence : 226144277
  Distance between 3'-terminus of neighbour sequence of sequence listing upward to telomere on chrosomal short arm and 5'-terminus of this base sequence : 138530
gcatgtcctaaatatgtcagttaggttgaattggttggtagaattgtacaagtctatacccttgctgaatgtttttccgaagttgttttattagctattgagggcaagatattgaaatacacaactattacctttgaaatgtctattactcttttgagttctgtctatatttgcttcatgtgtttagggattctgttgttaggcatctatctatctatctatctatctatctatctatctatcatctatctaattgatatgttgactcttttatcatcatggaatgctctcctttgcctttagtaatatatgtcaccttaaaataaattatttttatattaatacagccactccagtt

SEQ ID NO: 1952 - DNA, 167 bp, Homo sapiens
  D1S2629
  Located on chromosome 1
  Distance between a terminus base of telomere on chromosomal short arm and 5'-terminus of this base sequence : 226227644
  Distance between 3'-terminus of neighbour sequence of sequence listing upward to telomere on chrosomal short arm and 5'-terminus of this base sequence : 83009
caattccattcatgttactgtcaatgacaggattttttttcttttttatggctgaatagtattccatggtgtgtgtgtgtgtgtgtgtgtgtgtgtgtgtgtgtgtgtgtatatatatatatatatatatgccacattttcttcatccacttatctgctgttggaca

SEQ ID NO: 1953 - DNA, 384 bp, Homo sapiens
  AL357895.5_136209
  Located on chromosome 1
  Distance between a terminus base of telomere on chromosomal short arm and 5'-terminus of this base sequence : 226263952
  Distance between 3'-terminus of neighbour sequence of sequence listing upward to telomere on chrosomal short arm and 5'-terminus of this base sequence : 36141
ctttccatcagaatgataattcacacccactgttttaaatcccctccaataatatccatttttaacagttttcttctgtcaggtcatttagatagatagatagatagatagatagatagatagatagatagatagatagattttcttcttctgcctttaaaaatgtatagttattaataaatgataaattccaaatactgccaggaaaaaaggggattgtttgcgagcagccaattttaccagcctggtcataattacactgtatatatgtaccactggtacctgagtcaaataaatactcagaggggccacctctgcacctcatttctctgcagtgcctttaacgctaggcaacgctgagtgttgcttcaatgtccatctaat

SEQ ID NO: 1954 - DNA, 367 bp, Homo sapiens
  chr1.fa.O7frz.247994145
  Located on chromosome 1
  Distance between a terminus base of telomere on chromosomal short arm and 5'-terminus of this base sequence : 226491805
  Distance between 3'-terminus of neighbour sequence of sequence listing upward to telomere on chrosomal short arm and 5'-terminus of this base sequence : 227469
gtcttcagagtctttgttcgtaaatttcctatgagcaagtgcttgaatttctgtacacacacacacacacacacacacacacacacacagccctccgcaaaaacaaacaataatgcaaaaacatagggcagttcctatccttaagacatttatcttaacaaactgactatattttcagaggcatagctctgctagaaacacctgtactcagggtggatgctgcgttgttaaacagtggtaggttttttttcccccaaaatgaaggagcaatttgcctcaaagattaattcaattctccatctgtcaggagacaaaagtacttgcagttttaaagtgacagttttttcagtttcaggccatagtatta

SEQ ID NO: 1955 - DNA, 255 bp, Homo sapiens
  G07856
  Located on chromosome 1
  Distance between a terminus base of telomere on chromosomal short arm and 5'-terminus of this base sequence : 226600955
  Distance between 3'-terminus of neighbour sequence of sequence listing upward to telomere on chrosomal short arm and 5'-terminus of this base sequence : 108783
agacttacagcactggctgcactggttttcaggcattttggctcaactgtattgtaccaccagtttccttggttctccagcttgcagatgacacactgtgggacttggcatccataatcatgtgagccaattgccacaataaatcccctcctatctatctatctatctatctatctatctatctatctatctatcatctatctaatcatctatctaatccatctatctatcctattgtttcctttcctaggagca

SEQ ID NO: 1956 - DNA, 303 bp, Homo sapiens
  D1S1602
  Located on chromosome 1
  Distance between a terminus base of telomere on chromosomal short arm and 5'-terminus of this base sequence : 226601065
  Distance between 3'-terminus of neighbour sequence of sequence listing upward to telomere on chrosomal short arm and 5'-terminus of this base sequence : -145
tccataatcatgtgagccaattgccacaataaatcccctcctatctatctatctatctatctatctatctatctatctatctatcatctatctaatcatctatctaatccatctatctatcctattgtttcctttcctaggagcactctaacagtcaatttggaatttcttccattgtttcaaggtcttttccaagtcaattcaggatcttcccaaatcccatgttttcttctgggttctagaactttaagaggcccaagatcttggtgtggctattttgacatctgccttggaagtatttgc

SEQ ID NO: 1957 - DNA, 184 bp, Homo sapiens
  D1S237
  Located on chromosome 1
  Distance between a terminus base of telomere on chromosomal short arm and 5'-terminus of this base sequence : 226865338
  Distance between 3'-terminus of neighbour sequence of sequence listing upward to telomere on chrosomal short arm and 5'-terminus of this base sequence : 263970
tacaccgaggtaagtggttgcggggtaagtgtgtgtgtgtgtgtgtgtgtgtgtgtgtgtgtgtgtgtgtgtgtctgctttaacatggaaataaacttgagacttcaagtgccctgtatttatatgtgtaccaggccatgcagtacctaagtacatgatagagccaagattcaaacctggacct

SEQ ID NO: 1958 - DNA, 202 bp, Homo sapiens
  DISD22_0001107
  Located on chromosome 1
  Distance between a terminus base of telomere on chromosomal short arm and 5'-terminus of this base sequence : 227044892
  Distance between 3'-terminus of neighbour sequence of sequence listing upward to telomere on chrosomal short arm and 5'-terminus of this base sequence : 179370
tcacggcaggaagtaattctcaataaatcttaaaatgcaggatgccttcatgtgtgcatgcgtgtctctctctctctctctctctgtgtgtgtgtgtgtgtgtgtgtgtttgtctctataatacacttcaagacaaagcttttgaagtggaagaaacttcaaagttgggcaccaagcttttgaagtggatctcacctgaaac

SEQ ID NO: 1959 - DNA, 349 bp, Homo sapiens
  AL138782.6_10820
  Located on chromosome 1
  Distance between a terminus base of telomere on chromosomal short arm and 5'-terminus of this base sequence : 227138763
  Distance between 3'-terminus of neighbour sequence of sequence listing upward to telomere on chrosomal short arm and 5'-terminus of this base sequence : 93669
ataggcatctatgtatctttccatccctctccaaattatcaaccccaaattgcccttacataccaagatatttatttatttttgttttgttttgttttgttttgttttgtttgagacaaggtctttctctgttgtaaggcttgagtgtagtggcgtgatcatagctcactgcatcattgacctcctgaactcaaacaatcctcagcaattctcccacctcagcctcctgagtagctgggactacaagcatgtgccatcacacccagctaatttttaaaagacttttttgtagaaacagggtctcaccacagtgcccaggctggtctagaactcctggactaagcaattc

SEQ ID NO: 1960 - DNA, 472 bp, Homo sapiens
  AC021209.4_159303
  Located on chromosome 1
  Distance between a terminus base of telomere on chromosomal short arm and 5'-terminus of this base sequence : 227224489
  Distance between 3'-terminus of neighbour sequence of sequence listing upward to telomere on chrosomal short arm and 5'-terminus of this base sequence : 85377
acttctatgcatgaaggattgtgagggcaaagagaagcagctacaaagaggtttttaaaaaataagatagggagtggaggtgattaggcacatggctggaaatccttgttctctaaggacaggaaacacactgtaggactgcgaaacacacaaataccagagtggctgctgcctgctccgccatggggctgtttgcattggagatgcgaggagggttccattaagcaggggtgccctatagcaatatgaaggtcccagcatatttatgtgcttccccttccccttcccctccccccatccctccctcactccctcccttcctccctccctccctccctccctccctctcttacttccttccttccttccttccttccttccttccttccttccgacaggagatagagctttattgtggaaaagctgagtttgcagaagactgaaacagcaacaatgtttagcctagtccatc

SEQ ID NO: 1961 - DNA, 141 bp, Homo sapiens
  chr1.fa.O7frz.249727641
  Located on chromosome 1
  Distance between a terminus base of telomere on chromosomal short arm and 5'-terminus of this base sequence : 227570316
  Distance between 3'-terminus of neighbour sequence of sequence listing upward to telomere on chrosomal short arm and 5'-terminus of this base sequence : 345355
tagttagaatggtacctagaacgagtttcaagagctgggggactctattacaaatataataccttctcaggtcacctagaaaaaacactgtttgttttgttttgttttgttttgtttttgtaacattgctgtaaggaattg

SEQ ID NO: 1962 - DNA, 459 bp, Homo sapiens
  chr1.fa.O7frz.249823378
  Located on chromosome 1
  Distance between a terminus base of telomere on chromosomal short arm and 5'-terminus of this base sequence : 227665869
  Distance between 3'-terminus of neighbour sequence of sequence listing upward to telomere on chrosomal short arm and 5'-terminus of this base sequence : 95412
acaatctgccattcacttaagtctggtttgccagcaagcccaaggatggactccccactagtaccatcaggctcagggaatttggctagcaccgggcacctcagacttctgccagctaattggctttggggaagccgctgacctactctccactgagtggcttttgtgaacctggaacctagcctgcttctcatcattgatcaaccttggccaagccagctggcttgttcctttgcagacagcttgccttagggaagctggttggtggctcctcaacctactaagtgagggagagagagagagagagagagagagagagaaagcgagagaggacgaactacagaacagtctctcaaaaaatgaccagtgctcagtgtcagttacggggacttagagatgaacaaaatcgtgcctcatacctgatatattagtaggtggagtagaagtctgcatagcctt

SEQ ID NO: 1963 - DNA, 435 bp, Homo sapiens
  chr1.fa.O7frz.249970237
  Located on chromosome 1
  Distance between a terminus base of telomere on chromosomal short arm and 5'-terminus of this base sequence : 227729155
  Distance between 3'-terminus of neighbour sequence of sequence listing upward to telomere on chrosomal short arm and 5'-terminus of this base sequence : 62827
agcttgataaaggttacctttaattaagttttgtctctgtcaactttgtccttctttgcctgtctagagtagcaaacagtgttccagtgactctgtgagaagtagcctgattttcaggaaaaggtaatttaagaataagtgaaggtctttgttactaattctgtataaatgtaattttttttttgcttttttttttaagtgcaaggaaaaaatagacaatggctttttttaatggcatgttttcaaagctggatagatgtgtgtgtgtgtgtgtatgtttgtgtgtgtatgtttctgtgtgtttgtgtgtgtgcaggagtgggatttttgttgaatgtgggggtgggaagagagagagctgggatgccaaaggaggaagtgtagagccaaaaaagaatgggtgaatgggggataaacttcagtcttgcctaactc

SEQ ID NO: 1964 - DNA, 458 bp, Homo sapiens
  chr1.fa.O7frz.250053688
  Located on chromosome 1
  Distance between a terminus base of telomere on chromosomal short arm and 5'-terminus of this base sequence : 227946319
  Distance between 3'-terminus of neighbour sequence of sequence listing upward to telomere on chrosomal short arm and 5'-terminus of this base sequence : 216729
atcattcaaatagagttgatcaagataatcaacatgagtcaaaattacaaagaagacctagaaaatagagaactctagttgtgtgtgaatgtatgggagtgtgtgtgtgtgtgtgtgtgtgtgtgtgtgtgtgtgcgcatatttttctgtagggacaattgtgtgcctgcatttgctggccatggcacagcctttcacattcattataagaattagatgagaatatttaatgacgtctttttatctttcaagttcaccataaaagaaacaagccagaatagattgttactgatgtacaaagaaagagacttatatcatcttgtggtggtttgtaggatttggaaaatacattcccgagacaaatgaaatctaaggacagtccccaaacacttacttcaacacaatgctttcacttattacactgctgccttttctagctacagaatgtcaatatgatc

SEQ ID NO: 1965 - DNA, 202 bp, Homo sapiens
  D1S229
  Located on chromosome 1
  Distance between a terminus base of telomere on chromosomal short arm and 5'-terminus of this base sequence : 227946390
  Distance between 3'-terminus of neighbour sequence of sequence listing upward to telomere on chrosomal short arm and 5'-terminus of this base sequence : -387
actctagttgtgtgtgaatgtatgggagtgtgtgtgtgtgtgtgtgtgtgtgtgtgtgtgtgtgcgcatatttttctgtagggacaattgtgtgcctgcatttgctggccatggcacagcctttcacattcattataagaattagatgagaatatttaatgacgtctttttatctttcaagttcaccataaaagaaacaagc

SEQ ID NO: 1966 - DNA, 124 bp, Homo sapiens
  Z66862
  Located on chromosome 1
  Distance between a terminus base of telomere on chromosomal short arm and 5'-terminus of this base sequence : 228002281
  Distance between 3'-terminus of neighbour sequence of sequence listing upward to telomere on chrosomal short arm and 5'-terminus of this base sequence : 55689
agcataacccagcacttcaaagtagaaaatgctcctaaatgtgtgtgtgtgtgtgtgtgtgtgtgtgtgtgtgtgtgtatgaaaatgattactcctcttccctcatccactccaacctccatag

SEQ ID NO: 1967 - DNA, 197 bp, Homo sapiens
  D1S490
  Located on chromosome 1
  Distance between a terminus base of telomere on chromosomal short arm and 5'-terminus of this base sequence : 228003326
  Distance between 3'-terminus of neighbour sequence of sequence listing upward to telomere on chrosomal short arm and 5'-terminus of this base sequence : 921
tccttacaaatgggagactacacaaacaaagtttccaaggaggatacatacacacacacacacacacacacacacacacatatacatatagatagatgcctaagatataatgtgaactaaattttaaaagtagacttttatctacacatatcatctttattttacttaatatttgtagtggactttctcaaaccctt

SEQ ID NO: 1968 - DNA, 475 bp, Homo sapiens
  AL357634.3_74912
  Located on chromosome 1
  Distance between a terminus base of telomere on chromosomal short arm and 5'-terminus of this base sequence : 228086725
  Distance between 3'-terminus of neighbour sequence of sequence listing upward to telomere on chrosomal short arm and 5'-terminus of this base sequence : 83202
ttcaagcatctaaattcctcagtttctcagagaataggccaggacccagaagaaaaaagtcaactttgagtaataaaatcaaaatgatattgaacactagatagatagatagatagatagatagatagatagatagatagaaaaaagggaataaatgcctctgagaattcctagtgcctgaaagctcaaaacaaatgtacaggaatcttcttgagattgtggagaagatattccttagaaataactactttatatccattattctattttgaaatatatcaaactttcatgggtagtcttttttttttagtatgttaaatatttttagtgaccacaaaatataatcataagggatcttatggatttgtgcttttttccccccaaaaaaagtcttaagttcttccattccaaattatctatccagggggattttcaggagttaacaatgtgtaaaatgttccttgttcaagacaaa

SEQ ID NO: 1969 - DNA, 123 bp, Homo sapiens
  D1S227
  Located on chromosome 1
  Distance between a terminus base of telomere on chromosomal short arm and 5'-terminus of this base sequence : 228147118
  Distance between 3'-terminus of neighbour sequence of sequence listing upward to telomere on chrosomal short arm and 5'-terminus of this base sequence : 59918
agctgtgtcgggtcttgaagaatacacacacacacacacacacacacacacacacactcatttatcaggcagaaggaacacatgagcagatacaaaaagaaatgcaacattctgaaatcgctc

SEQ ID NO: 1970 - DNA, 178 bp, Homo sapiens
  D1S2860
  Located on chromosome 1
  Distance between a terminus base of telomere on chromosomal short arm and 5'-terminus of this base sequence : 228413018
  Distance between 3'-terminus of neighbour sequence of sequence listing upward to telomere on chrosomal short arm and 5'-terminus of this base sequence : 265777
gccattctgatgaggtcttagacagaaattaggaatatctgtgtgtgcatgtgtgtgtgtgtgtgtgtgtgtgtgtgtgtgtgtgtgtgttattaagtgtatgcccctttaaggcttttaattgtgattctctttacattttatcttttccttattggaatagttcctgcatttctaa

SEQ ID NO: 1971 - DNA, 189 bp, Homo sapiens
  DISO7_10000785
  Located on chromosome 1
  Distance between a terminus base of telomere on chromosomal short arm and 5'-terminus of this base sequence : 228501115
  Distance between 3'-terminus of neighbour sequence of sequence listing upward to telomere on chrosomal short arm and 5'-terminus of this base sequence : 87919
aaggcaaggtgaaatctgtagaaagttgaaaaaagagacagaagaagtttatttaaaattattaccttggggtgtgtgtgtgtgtgtgtgtgtatttgcacgtgtgagagagagaggaagatgaagaaagagagaaagagggatgggagaggaaaagaaagaatttctccctgtttgtccttcatctcc

SEQ ID NO: 1972 - DNA, 189 bp, Homo sapiens
  D1S1553
  Located on chromosome 1
  Distance between a terminus base of telomere on chromosomal short arm and 5'-terminus of this base sequence : 228582462
  Distance between 3'-terminus of neighbour sequence of sequence listing upward to telomere on chrosomal short arm and 5'-terminus of this base sequence : 81158
caatggatatttatttggtctggaagaaaagagggaaagaaatccagatatgagtgtgtgtgtgtgtgtgtgtgtgtgtgtgtgtattgttgtgggggacacagcaagaaatcgatatgcacagcacctggggtggagcaagatggcagaatagaagaccaccaattgccaccccctccaggacaccaa

SEQ ID NO: 1973 - DNA, 137 bp, Homo sapiens
  DISO7_10000787
  Located on chromosome 1
  Distance between a terminus base of telomere on chromosomal short arm and 5'-terminus of this base sequence : 228637261
  Distance between 3'-terminus of neighbour sequence of sequence listing upward to telomere on chrosomal short arm and 5'-terminus of this base sequence : 54610
catggtattcagttgttggaagaaataaagggaacgcacctcctcccaagcccagttacacaaacacacacacacacacacacacacacactttatttaattttatacaaaataacgatgcagaaccttgaaggctt

SEQ ID NO: 1974 - DNA, 120 bp, Homo sapiens
  DISO7_10000788
  Located on chromosome 1
  Distance between a terminus base of telomere on chromosomal short arm and 5'-terminus of this base sequence : 228666082
  Distance between 3'-terminus of neighbour sequence of sequence listing upward to telomere on chrosomal short arm and 5'-terminus of this base sequence : 28684
cctatgaacccattagcacacacaagaaagagagacagagatcaagagacacaaaaatccagagggagagagagagagagagagagagagaggtctatacccctcactctcccacatcag

SEQ ID NO: 1975 - DNA, 372 bp, Homo sapiens
  AL354659.2_6128
  Located on chromosome 1
  Distance between a terminus base of telomere on chromosomal short arm and 5'-terminus of this base sequence : 228762669
  Distance between 3'-terminus of neighbour sequence of sequence listing upward to telomere on chrosomal short arm and 5'-terminus of this base sequence : 96467
taatcaccaaatgattctccagatttggatctaatttttttttgcttattttgaaaacaaaatcaaaatatgaagcttttcctcgtttagattggttcatgatggtttttaaatctggtaagctctaagctccttgggaataggtctgatatatgtatgtatgtatgtatgtatgtatgtatgtatttatttatttttgccattgtgtacacactgcctaacataaggcatgaaacagaatcatagtggaatcttaataaataattatgaaataagattaaaatagctcccatttcttgattgcctagtgaaagtggaacattgcattaagcattttacattcttcatgtgtgcaccaactatggaaagtat

SEQ ID NO: 1976 - DNA, 228 bp, Homo sapiens
  AL357975.4_121983
  Located on chromosome 1
  Distance between a terminus base of telomere on chromosomal short arm and 5'-terminus of this base sequence : 229062194
  Distance between 3'-terminus of neighbour sequence of sequence listing upward to telomere on chrosomal short arm and 5'-terminus of this base sequence : 299153
acagacctaatcacaggactacagaatgcttcccttcccccacaccttaccaccatgcctctaaaggcctattttaactgttctttttttcttttcttttcttttcttttcttttcttttcttttcttttctttctttattctcttctcttctcttttctttctttttggacagagtcttgctctggagtgcaatagtgcagtggcgtgatctttgttcactgaaacc

SEQ ID NO: 1977 - DNA, 157 bp, Homo sapiens
  D1S2621
  Located on chromosome 1
  Distance between a terminus base of telomere on chromosomal short arm and 5'-terminus of this base sequence : 229281173
  Distance between 3'-terminus of neighbour sequence of sequence listing upward to telomere on chrosomal short arm and 5'-terminus of this base sequence : 218751
aagccttagttttaccctatggaactatagaaacaagtgaatttctgtgtactcttccaatatgtttacacacacacacacacacacacacacacattttactctttgaataaaacattactgacattgttcgttcattctgctaggtgtgccagac

SEQ ID NO: 1978 - DNA, 410 bp, Homo sapiens
  chr1.fa.O7frz.251449748
  Located on chromosome 1
  Distance between a terminus base of telomere on chromosomal short arm and 5'-terminus of this base sequence : 229344698
  Distance between 3'-terminus of neighbour sequence of sequence listing upward to telomere on chrosomal short arm and 5'-terminus of this base sequence : 63368
gaagatggtaggttactgtttctaaaaagtatgtatattccttatatatggatacacacacacacacacacacacacacacacatactgtattcactggggattggttccaggacccccatggatactaaaaatctgcatgttctgcagtggccctgtggaatctgcctttatggaaacttccctctacatccgcaggtttccgcatccagtgactactatattttccatccacatttggttgcagatgcaggatgcagggacacggagggctgactgtatttactggaaaaaaatgtgtgtatacgtgtacttgtgcagttcaaaccagggttgttcaagggtcacctatatatacatataaacataaaaacctgaaagaatattcactgtgatgttaacaatggctat

SEQ ID NO: 1979 - DNA, 187 bp, Homo sapiens
  DISO7_10285108
  Located on chromosome 1
  Distance between a terminus base of telomere on chromosomal short arm and 5'-terminus of this base sequence : 229520224
  Distance between 3'-terminus of neighbour sequence of sequence listing upward to telomere on chrosomal short arm and 5'-terminus of this base sequence : 175116
agggagcacagcactaatggggttaatgaaaattgcctctttttcctaaccctaaacacatgtgcacacacacacacacacacacacacacgcacacacggttcagctttcatttctcatattgcccaagagggtgtaaaataaaaagaggtcagccaaaaaactgtctgttaaattagacttgcaa

SEQ ID NO: 1980 - DNA, 295 bp, Homo sapiens
  chr1.fa.O7frz.251867244
  Located on chromosome 1
  Distance between a terminus base of telomere on chromosomal short arm and 5'-terminus of this base sequence : 229664161
  Distance between 3'-terminus of neighbour sequence of sequence listing upward to telomere on chrosomal short arm and 5'-terminus of this base sequence : 143750
ataatcaagtcaacattctggtataatatacatctgtgaaatctcttataaaaacaataaaatacacatttacttgttaaaattattcttactgttctatatgctactaatgaactaattatccctaaaattcttttgtctttcagaattgttttctttagaatacatacatacatttatgtatgtatacatatagacatatgtgtgtgtgtgtgtgtgtgtgtgtgtgtattttactgttgtttatcaaaggtctccccaaaaggcctgtgtttatgattacagaaagcagaat

SEQ ID NO: 1981 - DNA, 185 bp, Homo sapiens
  Z67489
  Located on chromosome 1
  Distance between a terminus base of telomere on chromosomal short arm and 5'-terminus of this base sequence : 229794350
  Distance between 3'-terminus of neighbour sequence of sequence listing upward to telomere on chrosomal short arm and 5'-terminus of this base sequence : 129894
tcccttgctttacttcttgccttattactttctaacttatcaaagaatttatttttttctgaattctccaaatagacaaaaagattgacaagagaaggggctacacacacacacacacacacacacacacacacgcttgcacatacatgacatacatggatcatggtatcctagtatcatggacg

SEQ ID NO: 1982 - DNA, 469 bp, Homo sapiens
  chr1.fa.O7frz.252208787
  Located on chromosome 1
  Distance between a terminus base of telomere on chromosomal short arm and 5'-terminus of this base sequence : 229852266
  Distance between 3'-terminus of neighbour sequence of sequence listing upward to telomere on chrosomal short arm and 5'-terminus of this base sequence : 57731
ggttaggtttagatggttgaatttaaagggcctgagagacatcctagtggagattttgagtaggaaattagatgtactaggttttattcgctgaatgtttgcatcccctcaaaattcatgtgttgaagccctaatccccaaagtgatggtatttgaagatggaacttttggagataataaggtcaggagggagactccattaaggggttagtgcccttataagaaaagatactatagagctttctctctctctctctctttctctctcccatgtgaggatacggtgagaaggcagccattgacaagccaggaggcaggccctcaccagacacaggatcttctggtaccttgatctcaggcttcccagcagccataactgcaagaaataagtgattgttgttcaagacacccagtctgtggtatttgttatagcagcccacactgactaagacattaggactcagttgag

SEQ ID NO: 1983 - DNA, 152 bp, Homo sapiens
  chr1.fa.O7frz.252114620
  Located on chromosome 1
  Distance between a terminus base of telomere on chromosomal short arm and 5'-terminus of this base sequence : 230045007
  Distance between 3'-terminus of neighbour sequence of sequence listing upward to telomere on chrosomal short arm and 5'-terminus of this base sequence : 192272
taaagcctgtatgtttagctctagttactatatttatgtggttgccattaaacaaagtgtgtgtgtgtgtgtgtgtgtgtgtgtgtgtgtgtaggagggttagtgaaaatgacctccattttgaacatgttgctgttaagtatttctgagac

SEQ ID NO: 1984 - DNA, 146 bp, Homo sapiens
  D1S2616
  Located on chromosome 1
  Distance between a terminus base of telomere on chromosomal short arm and 5'-terminus of this base sequence : 230179476
  Distance between 3'-terminus of neighbour sequence of sequence listing upward to telomere on chrosomal short arm and 5'-terminus of this base sequence : 134317
actgaaatgagagcacattgtattagtcagcattctgcacagaaacagaaccagtagaagacctacgtgtgtgtgtgtgtgtgtaatttattatggaacatgatgtttgtaattaggaggctgagaagtctcaccatctgctctct

SEQ ID NO: 1985 - DNA, 196 bp, Homo sapiens
  Z66734
  Located on chromosome 1
  Distance between a terminus base of telomere on chromosomal short arm and 5'-terminus of this base sequence : 230322521
  Distance between 3'-terminus of neighbour sequence of sequence listing upward to telomere on chrosomal short arm and 5'-terminus of this base sequence : 142899
agctgaagcattttgtgcaatgtgtatatattgtttatatatatatgtgtgtgtgtgtgtgtgtgtgtgtgtgtgtgtgtgtttctctctctctgaatgatgcaacagatgaaaactaaccaatagagaggatatggtttgatgcttaagaatgagccaaacaacaaacgggaaactgtgtactgtctgcgtgaca

SEQ ID NO: 1986 - DNA, 455 bp, Homo sapiens
  chr1.fa.O7frz.252580063
  Located on chromosome 1
  Distance between a terminus base of telomere on chromosomal short arm and 5'-terminus of this base sequence : 230430596
  Distance between 3'-terminus of neighbour sequence of sequence listing upward to telomere on chrosomal short arm and 5'-terminus of this base sequence : 107879
tagcctttactatgtagcaggtctatttaaagcctttatatgtaagaattcatttaatcatcacaagattacaatgtatgtccggttgtctgggaatattttacagatgagaaaatatccaaaaaggatatggaacttgcccaagtacacacagctcataagtgatggggctggggtttgaattgaggaaagtctggctcttgagtcagtactcttacccactgtactttattccctctctaaagtcagtgaaattctttcttatctttctcaatattgagcaaaacttttgtcacataaaaatcactaaacaacaacaacaacaacaacaacaacaaaacgtttcatggattgggaaagaagggcggacaccctgccatcttgtctacttgccttttggcctaggactgggttttatggcctctccagtgctgacatttggaccttgataattc

SEQ ID NO: 1987 - DNA, 156 bp, Homo sapiens
  G07831
  Located on chromosome 1
  Distance between a terminus base of telomere on chromosomal short arm and 5'-terminus of this base sequence : 230622639
  Distance between 3'-terminus of neighbour sequence of sequence listing upward to telomere on chrosomal short arm and 5'-terminus of this base sequence : 191588
caaagaggacatgtgtttgtgtgtgtaaaacatacaagatacgtaaataaatatatataattcatgtatatgggttcctatatattcatctgctatctatctatctatctatctatctatagatgtgaagtatacccatactacccattgctggta

SEQ ID NO: 1988 - DNA, 103 bp, Homo sapiens
  DISD22_0001114
  Located on chromosome 1
  Distance between a terminus base of telomere on chromosomal short arm and 5'-terminus of this base sequence : 230892775
  Distance between 3'-terminus of neighbour sequence of sequence listing upward to telomere on chrosomal short arm and 5'-terminus of this base sequence : 269980
ttccctgattgccttctgcatacacacacacacacacacacacacacacacacacacacacacacaggtgcccccaaagcatcctgagcttacctttgtcatt

SEQ ID NO: 1989 - DNA, 416 bp, Homo sapiens
  chr1.fa.O7frz.253211539
  Located on chromosome 1
  Distance between a terminus base of telomere on chromosomal short arm and 5'-terminus of this base sequence : 231050678
  Distance between 3'-terminus of neighbour sequence of sequence listing upward to telomere on chrosomal short arm and 5'-terminus of this base sequence : 157800
tactggaagttctagccagagaaattggacaggagaaagaaataagtatctaaatcagaaagaaagaagtaaaattatctctctttgctgatgacatgatcttatacatagaaaattctaaagactgtagacacacacacacacacacacacacacacacacaaacagagagagagagaaactgttagaactaagacaaattcagggagtagtggttctcccagcatgcagccggagatctgagaacggacagactgcctcctcaagtgggtccctgacccccaagtagcctaactgggaggcacccccaagtaggggcagactgacacctcacacggctgggtactcctctgagaaaaaacttccagaggaacgatcaggcagcaacatttgctgttcaccagtatctgctgttc

SEQ ID NO: 1990 - DNA, 255 bp, Homo sapiens
  D1S2758
  Located on chromosome 1
  Distance between a terminus base of telomere on chromosomal short arm and 5'-terminus of this base sequence : 231056176
  Distance between 3'-terminus of neighbour sequence of sequence listing upward to telomere on chrosomal short arm and 5'-terminus of this base sequence : 5082
acagagattcactctagttgcctcaggaaacgaaagtttattgtgagaatctgcatggtaataaagaaaatgggaatgtcatccaggaagctagccttcagtgcaattaaaaacacacacacacacacacacacacacacacacaaccaggctcccatgagaaaaactgaaatggttgttcttggtggctcacgccagtaatcccaacactttgggagcctgcagcaggaggattccttgagcccaggatattga

SEQ ID NO: 1991 - DNA, 345 bp, Homo sapiens
  AL365363.9_2426
  Located on chromosome 1
  Distance between a terminus base of telomere on chromosomal short arm and 5'-terminus of this base sequence : 231089001
  Distance between 3'-terminus of neighbour sequence of sequence listing upward to telomere on chrosomal short arm and 5'-terminus of this base sequence : 32570
tacttgagcatcttcctttcaggttgggattttagttacaattctggggcaacatgcttttacatctgttctaatatctgtctccctgattaaactgtgagctccccgaagatcacatcttgtgatctcatgcgaaggccatatctcatttctcaacgtatcccagcccctagcatagcaccaggcatataacagattctcagtaagtacagagtaaatgaagtgggaatgaaagaataattcataggtggatggatggaaagatagatagatagatggatagatagatagatagatagatagatagatagatagatagatgatagaacctctttcctacttcca

SEQ ID NO: 1992 - DNA, 312 bp, Homo sapiens
  chr1.fa.O7frz.253441299
  Located on chromosome 1
  Distance between a terminus base of telomere on chromosomal short arm and 5'-terminus of this base sequence : 231235354
  Distance between 3'-terminus of neighbour sequence of sequence listing upward to telomere on chrosomal short arm and 5'-terminus of this base sequence : 146008
acagattggaagatccttaaagagccctctatccaaccattttgtctttagtcagttttgtcttatatttaaactatcaatttttaaattgagaatgaagctctcacttagtccccacaaaagatcttcatctgaaaaaaatctgcttaaggtgcaaaacaatgtgtataattaggctaccaatcatgtttaaaaaggaggagagaaaatatgtatgtgtgtgtgtgtgtgtgtgtgtatctgtatttacttgaataataaatgaaaatcgctcaacagatacagaagaaactgttaacagtggctactgac

SEQ ID NO: 1993 - DNA, 401 bp, Homo sapiens
  chr1.fa.O7frz.253647046
  Located on chromosome 1
  Distance between a terminus base of telomere on chromosomal short arm and 5'-terminus of this base sequence : 231519781
  Distance between 3'-terminus of neighbour sequence of sequence listing upward to telomere on chrosomal short arm and 5'-terminus of this base sequence : 284115
ctagtacttcaaaggtaggcttaagtatcaccacttcaagaaaatgcctcatgtatatctcagtcacactgaatggaagttaatgatttgtctgtaaaccagaagttcctacagcagggtccaccaaccttatttggtttgtagcaccaatgactggcacaaagtatgcaatcattcacagatgggttcgatttgatatcttctaaattttctaaaaaagggagaggagcttagtgggctttatatcaccattccggtatagcacaaagtgagagcgctgtactacaaagccaaatgtgcttcaggttggaaatgcaaaaataaaataaaataaaataaaataaaataaaacacaaggcacaccctttcaaaatgaaatgtacgaaattctgaaagcctat

SEQ ID NO: 1994 - DNA, 131 bp, Homo sapiens
  D1S2880
  Located on chromosome 1
  Distance between a terminus base of telomere on chromosomal short arm and 5'-terminus of this base sequence : 231612650
  Distance between 3'-terminus of neighbour sequence of sequence listing upward to telomere on chrosomal short arm and 5'-terminus of this base sequence : 92468
catcatttgcttgctgcagtgtgtgtgtgtgtgtgtgtgtgtgtgtgtgtgtgtgtgtgtgtgtgtgagatgagtgacagctgagactatcccagtgattctaaaccaccatggggccgattagaaccacg

SEQ ID NO: 1995 - DNA, 261 bp, Homo sapiens
  Z67347
  Located on chromosome 1
  Distance between a terminus base of telomere on chromosomal short arm and 5'-terminus of this base sequence : 231726215
  Distance between 3'-terminus of neighbour sequence of sequence listing upward to telomere on chrosomal short arm and 5'-terminus of this base sequence : 113434
atttggcatgactttaaacatttggtatcagtaagtatatacatatatgtaagatatgtacacatgtgtgtacaaacacacacacacacacacacacacacaccccttgatattttataagttccatgtgagtacttagttgctttgatattgcttggaattgctggcatcagggagaagcactctgtctttcattacaaagatataattataagaactactgatgatttgtaaccaaggaaggactgacagtgacaagtc

SEQ ID NO: 1996 - DNA, 444 bp, Homo sapiens
  chr1.fa.O7frz.255811426
  Located on chromosome 1
  Distance between a terminus base of telomere on chromosomal short arm and 5'-terminus of this base sequence : 231913214
  Distance between 3'-terminus of neighbour sequence of sequence listing upward to telomere on chrosomal short arm and 5'-terminus of this base sequence : 186738
ggacctatgacttgcttctaaccaatgcaatagggaaaaggtgatggaatttcactgtcatgattatatcatattatattatattatattatattatattatattatattatattatattatactatcttgctagcagacttgctctagagactatacttgctggcttaagaaagtaaatagccatgttggagaagtccacttggcaaggacctatgtacagtctctaagaggtaagggtggcccctagctgacagccaccaagaagccagggtcctcagtactaacagctaaaaagaaatgaattctgccagtaacctgggttagctcagaagtagattcctccctagtcaagtatccagatgagaaccatcctggacaacacgttgattgcagccttacgagacctgagcagaagacccagttaagtcaggcttggaatact

SEQ ID NO: 1997 - DNA, 428 bp, Homo sapiens
  AL359353.6_126759
  Located on chromosome 1
  Distance between a terminus base of telomere on chromosomal short arm and 5'-terminus of this base sequence : 231999142
  Distance between 3'-terminus of neighbour sequence of sequence listing upward to telomere on chrosomal short arm and 5'-terminus of this base sequence : 85484
agtgactttgcatcttaatgtctcctttaccctccctttagagcaggctgatttggagaaagaatacctggcgagtactgcaaaacaggacagccatcaaagattcttccctgatgacatctcagtttcttttttctttttcttttcttctcttttctcttttcttttctctttctttctttctttctttctttctttctttctttctttctttctttctttctttctttcttcctctctttctctctttctttctttcttcctctctttctttctctttctttctttctttctttcttctttctttctttctttctttctttctttctttctttctttctttctttctttctttctttcttctttctttctttttctctctctgtcacctaggctggagtgcagtggtgtgatctgagctcactgca

SEQ ID NO: 1998 - DNA, 428 bp, Homo sapiens; identical to SEQ ID NO: 1997
  AC025710.4_26176
  Located on chromosome 1
  Distance between a terminus base of telomere on chromosomal short arm and 5'-terminus of this base sequence : 231999142
  Distance between 3'-terminus of neighbour sequence of sequence listing upward to telomere on chrosomal short arm and 5'-terminus of this base sequence : -428

SEQ ID NO: 1999 - DNA, 231 bp, Homo sapiens
  D1S2641
  Located on chromosome 1
  Distance between a terminus base of telomere on chromosomal short arm and 5'-terminus of this base sequence : 232282130
  Distance between 3'-terminus of neighbour sequence of sequence listing upward to telomere on chrosomal short arm and 5'-terminus of this base sequence : 282560
tgcaagtagggtcagtttagcagtaaaaaagaagtttcatgttattttactaatttgagcctcataggaaccctgaaaaatactctttgtaattattctcatttttgagatgaggaaactgaggctcagaaaaattaaggaatgtggtcaaagtatcaagcacacacacacacacacacacacacacacacacacacacacacacatatacacacagagtaaataaatggc

SEQ ID NO: 2000 - DNA, 139 bp, Homo sapiens
  D1S1626
  Located on chromosome 1
  Distance between a terminus base of telomere on chromosomal short arm and 5'-terminus of this base sequence : 232436538
  Distance between 3'-terminus of neighbour sequence of sequence listing upward to telomere on chrosomal short arm and 5'-terminus of this base sequence : 154177
tgaggcatttgtttttcaggccattcatttaatgctcaatgcatattattattattattattattattattattattattattattttttgccatgggccacataatctatcagatttgtctccttgactaagtcagga

SEQ ID NO: 2001 - DNA, 180 bp, Homo sapiens
  Z67678
  Located on chromosome 1
  Distance between a terminus base of telomere on chromosomal short arm and 5'-terminus of this base sequence : 232526329
  Distance between 3'-terminus of neighbour sequence of sequence listing upward to telomere on chrosomal short arm and 5'-terminus of this base sequence : 89652
gatggctgcaatatgttgaaaggattttcaacctcatatacagaatatggttaactgtttcctctttctcttactcgtacacacacacacacacacacacacacacaatgacttgaggtaagatttgttataattatactgtgtatgttcagtgagaaattgttctgagatgaagtcctg

SEQ ID NO: 2002 - DNA, 268 bp, Homo sapiens
  DISD22_0001128
  Located on chromosome 1
  Distance between a terminus base of telomere on chromosomal short arm and 5'-terminus of this base sequence : 232843052
  Distance between 3'-terminus of neighbour sequence of sequence listing upward to telomere on chrosomal short arm and 5'-terminus of this base sequence : 316543
ctatactgtgccagggccatgggccaaaaaagctattggccaggccttgcctcttttccccaccactttcaaatgataaacacacacacacacacacacacacacacacacacacacacacacacacacacagagagagagagagagagagagggagagagagagaatatttctgcttttacctattttagttgtaggacttttctgaagaaggttaatttgaacaaaaagttttttgacaaaaacttattcaagaaagcagagatca

SEQ ID NO: 2003 - DNA, 233 bp, Homo sapiens
  D1S2859
  Located on chromosome 1
  Distance between a terminus base of telomere on chromosomal short arm and 5'-terminus of this base sequence : 232921009
  Distance between 3'-terminus of neighbour sequence of sequence listing upward to telomere on chrosomal short arm and 5'-terminus of this base sequence : 77689
agggcttgactaccatcccctaccccacccaccccccttcacacaaacacacacacacacacacacacacacacacacacacacacacactacactaccaccatcaggaagccttcctggcttgatgccaatttaaattacaaatacatgttcatttgtgcatgcttggctctcaaattctacaaatcagaacaggattaagataagtcttgagaggagcaactcaaggtgtg

SEQ ID NO: 2004 - DNA, 414 bp, Homo sapiens
  chr1.fa.O7frz.255523476
  Located on chromosome 1
  Distance between a terminus base of telomere on chromosomal short arm and 5'-terminus of this base sequence : 233029547
  Distance between 3'-terminus of neighbour sequence of sequence listing upward to telomere on chrosomal short arm and 5'-terminus of this base sequence : 108305
cagcaaagtcaatatttcatctgggagctaaaattaagtcatcacccctcctgtgagcaacactactcctgaaataaaaattttacaacattaggttggaggaggatcacttagcatttgaaaacacttcccctgtgaccttgagcttttatcgcttgggagccaaaataaaatctctcaggcaagatttatgaataaataattaaccatgaaaataaaagcagcacagaaaaagaagtaggtcctttccatttacagccaaagttggtgtgtgtgtgtgtgtgtgtgtgtgtgtgtgtgtgtgtgtgtgtgtgactttctcttttatgcacatggtgttttcaagaaaaaaaaaatccaagatataaaagcctgacatcaccacaggagccgtaaaacattcggacagattct

SEQ ID NO: 2005 - DNA, 76 bp, Homo sapiens
  D1S2821
  Located on chromosome 1
  Distance between a terminus base of telomere on chromosomal short arm and 5'-terminus of this base sequence : 233297719
  Distance between 3'-terminus of neighbour sequence of sequence listing upward to telomere on chrosomal short arm and 5'-terminus of this base sequence : 267758
aagtttctagaggtgaaaaatacattgagattacacacacacacacacacacacactcaatggaatgaatggctgg

SEQ ID NO: 2006 - DNA, 443 bp, Homo sapiens
  chr1.fa.O7frz.256027602
  Located on chromosome 1
  Distance between a terminus base of telomere on chromosomal short arm and 5'-terminus of this base sequence : 233301112
  Distance between 3'-terminus of neighbour sequence of sequence listing upward to telomere on chrosomal short arm and 5'-terminus of this base sequence : 3317
agacaaattactgatacatggaacaacattgatgaatcccacagacattaccaaattaaagaagccaagcacaaaaagaagagtacatattataattattccatttatatatgaagttccagaagcaaaactaagctgtggtgagagtgcttatctctggctggggtgtgtgtgtgtgtgtgtgtgtgtgtgtgtgtgtgtgtgtgtgtgtgtgtgtgtatgtatgtcaacttctttttggcctggatggctacatgtacatattcactggggacgggggacaggctggagacccgatccctttggcatgtttggaaatgctcagaacaagtaagctggatggaagctgggcccctgtccctttaaagtgagcccctggtatgagagagagacagagagagagagagagagagagagaggtaatagacaagaaggagccttct

SEQ ID NO: 2007 - DNA, 238 bp, Homo sapiens
  DISO7_10000791
  Located on chromosome 1
  Distance between a terminus base of telomere on chromosomal short arm and 5'-terminus of this base sequence : 233358843
  Distance between 3'-terminus of neighbour sequence of sequence listing upward to telomere on chrosomal short arm and 5'-terminus of this base sequence : 57288
cagtgaatttccatacaggcttttagtattacccacttctttctctctctctctctctctctctctctcttgctccctccccccgcctttctcctctgtctctttcgctctcctctctctctctctctctctctctctctctctctctcggtctctctctcacacacacagacacacacacacgcacacacacacacatacacagagagagagagagctcagatattctagcctacaa

SEQ ID NO: 2008 - DNA, 152 bp, Homo sapiens
  DISO7_10000792
  Located on chromosome 1
  Distance between a terminus base of telomere on chromosomal short arm and 5'-terminus of this base sequence : 233566421
  Distance between 3'-terminus of neighbour sequence of sequence listing upward to telomere on chrosomal short arm and 5'-terminus of this base sequence : 207340
attcatgggccagagaaccaatttttggtatattacatatggtgtgtgtgtgtgtgtgtgtgtgtgtgtgtgtgtatttaaatataccttcttagtttaaaaattcaatggtgtaaaataaaataataacattagagtccaatttgacttca

SEQ ID NO: 2009 - DNA, 267 bp, Homo sapiens
  chr1.fa.O7frz.256523210
  Located on chromosome 1
  Distance between a terminus base of telomere on chromosomal short arm and 5'-terminus of this base sequence : 233599694
  Distance between 3'-terminus of neighbour sequence of sequence listing upward to telomere on chrosomal short arm and 5'-terminus of this base sequence : 33121
taaatatcaaggtcctttccacctaagggaaggaaattttgtaataaaacaaatagtattaaggaggacacccaagactggttagaatcatccagttgagcaagaaattaaaaagaatatatatatatatatatatacacacacacacacacacacctattgttatttagcatgatttagtgtggagacagtattggatccagagacagaagaggagttgaatcctggcttaatcattgctggctatgtggccttaggtaaataact

SEQ ID NO: 2010 - DNA, 231 bp, Homo sapiens
  D1S2871
  Located on chromosome 1
  Distance between a terminus base of telomere on chromosomal short arm and 5'-terminus of this base sequence : 233840499
  Distance between 3'-terminus of neighbour sequence of sequence listing upward to telomere on chrosomal short arm and 5'-terminus of this base sequence : 240538
cgagacatttgcatcatcattcagtgagacctgtaaacacagcatctgcctttgaccacatccatctggaagaacctgagagataatccattttatgaaattttccctaccctgaaatgggagaatggtaggtaaagtagtggcaatcccttcttccttttccttccgtgtgtgtgtgtgtgtgtgtgtgtgtgtgtgtgtgtgtgtgtgatgtaaagaatgcacacttca

SEQ ID NO: 2011 - DNA, 159 bp, Homo sapiens
  D1S2894
  Located on chromosome 1
  Distance between a terminus base of telomere on chromosomal short arm and 5'-terminus of this base sequence : 234002791
  Distance between 3'-terminus of neighbour sequence of sequence listing upward to telomere on chrosomal short arm and 5'-terminus of this base sequence : 162061
attgcactgactctgtaggttgctatgggtagtatggacattttaataatattgattcttccaatccatgaacatggaatatctttccatttgtgtgtgtgtgtgtgtgtgtgtgtgtgtgtcctcttcaatttctttcatcagtgttttatagttttt

SEQ ID NO: 2012 - DNA, 329 bp, Homo sapiens
  AC068484.1_147935
  Located on chromosome 1
  Distance between a terminus base of telomere on chromosomal short arm and 5'-terminus of this base sequence : 234043226
  Distance between 3'-terminus of neighbour sequence of sequence listing upward to telomere on chrosomal short arm and 5'-terminus of this base sequence : 40276
cgagacatctaaatagttccaaatccatgtcaacacttgagagtgtaagtctttttaattttagtcattttaatgaatttatagaggtatttcaatgtgatttgaatttgccttttctgagtaacaaataatgtaaaacatctctttaggtaaagattgattgcccatttgtattgtttgtttgtttgtttgttttgagaccaaggtctcactctgtcccccaggatggagtacagtggcgcaaccatggctcactgctgcctcgacctccctggacgcatgtgattcttccagctcagcctcacaagtagctgagactacaggtgcat

SEQ ID NO: 2013 - DNA, 347 bp, Homo sapiens
  HUMUT7354
  Located on chromosome 1
  Distance between a terminus base of telomere on chromosomal short arm and 5'-terminus of this base sequence : 234203572
  Distance between 3'-terminus of neighbour sequence of sequence listing upward to telomere on chrosomal short arm and 5'-terminus of this base sequence : 160017
caagcctgggtgacagagtgaaactccattttgaaggaaagaaagaaagaagaaagaaagagaaagaaagaaaagaaagaaagaaagaaagaaaggaagaaagaaagaaagaaggaaggaaggaaggaaaaaggaaaagaaagaaagagagagagagaaagaaagagaaagaaagaaagaaggaaagaaagaaagaaagaaagaaagaaagaaagaaagaaagaaagaaagaaagaaagaaagaaagaaagaaaagagagggagggagggaggaaggaagaaagagagaaagaaagaaggaaaagtgcaacactcttcagtgtttcccaggaagaagtttgggtata

SEQ ID NO: 2014 - DNA, 415 bp, Homo sapiens
  chr1.fa.O7frz.255142155
  Located on chromosome 1
  Distance between a terminus base of telomere on chromosomal short arm and 5'-terminus of this base sequence : 234297807
  Distance between 3'-terminus of neighbour sequence of sequence listing upward to telomere on chrosomal short arm and 5'-terminus of this base sequence : 93888
caaatcattctacaggtaattgactacattgtctaaagatattaaaattaatttgagtagagatgaagatgtggaagtaatcagaatgcacacacacacacacacacacacacacacacgtatatatatgatgtttgaagacatagatataagaagtcccccaagaagcttttaagagaagagaggggggtaagagctgaactctgaagaatactaacatttgagggatatacaaagaaaggaaggaaactaagaaatttccagaagaaagtaagaatatgatgtttctatggatgaagacagaaagaatgttttaagaagggaatggctgactgagtgtaaataatatttataatcttattcattcaacaaatatttattgagtatctattataggcagagactattctaagca

SEQ ID NO: 2015 - DNA, 252 bp, Homo sapiens
  D1S2689
  Located on chromosome 1
  Distance between a terminus base of telomere on chromosomal short arm and 5'-terminus of this base sequence : 234366428
  Distance between 3'-terminus of neighbour sequence of sequence listing upward to telomere on chrosomal short arm and 5'-terminus of this base sequence : 68206
ttcatgtcaaagcaatgaggggtatgtgcatgtgtgtgtgtgtgtgtgtgtgtgtgtgtgtgcatatgtgtgtgtaagcatctcacttaactccctttgggcccatcccttctccctgtgtattccgagtattgataagagcagaatatgtaagttgctgctgaggaggccttgaagaggcagtatgcaaagtcacttagaagcagaacctaagccatggttgagtcagactactcacattggctaaattgt

SEQ ID NO: 2016 - DNA, 101 bp, Homo sapiens
  DISO7_10000799
  Located on chromosome 1
  Distance between a terminus base of telomere on chromosomal short arm and 5'-terminus of this base sequence : 234560016
  Distance between 3'-terminus of neighbour sequence of sequence listing upward to telomere on chrosomal short arm and 5'-terminus of this base sequence : 193336
ttacacagattcaactgcattcttacattctgtttgtacacacacacacacacacacacacgtacacacacacacgccccatacttggcatttcactgtaa

SEQ ID NO: 2017 - DNA, 182 bp, Homo sapiens
  DISO7_10000798
  Located on chromosome 1
  Distance between a terminus base of telomere on chromosomal short arm and 5'-terminus of this base sequence : 234616087
  Distance between 3'-terminus of neighbour sequence of sequence listing upward to telomere on chrosomal short arm and 5'-terminus of this base sequence : 55970
accttgttgtttgttactcacagaatatatatatatatatatatatatataattatgttatgaattagttttcaaaagtgttttgataactgtggtttaatataatttattggtcttattttgtgcacttaaaaatattcttctggaaaagcctccatatgccccaccagactgtcagagga

SEQ ID NO: 2018 - DNA, 417 bp, Homo sapiens
  chr1.fa.O7frz.257046189
  Located on chromosome 1
  Distance between a terminus base of telomere on chromosomal short arm and 5'-terminus of this base sequence : 234709968
  Distance between 3'-terminus of neighbour sequence of sequence listing upward to telomere on chrosomal short arm and 5'-terminus of this base sequence : 93699
tttatttgtgcatacaggctagtttgcaatgtatattccagtgggtcacagtcaaaaaggtttgaaaaacactactttcaatacactccaccttgtcatgatactcaaaaacatacgtactttcaataatgtagctggtgcttataggcacaggttgtagagtgagaatgtatactttgaatcccgactctgccatcctctagctgtgtaactctgggtaagttccttaacctctctgtgtctcaggtttccatatatatatatatatatatatatatatatatatatatatatatatatatatatatatatatatgctatgtgattaatattcaaccagttccccgaagaatgaaaacatattgcttcatacagaggcaattctctaaattcctagagccatgttaatatctgaaa

SEQ ID NO: 2019 - DNA, 116 bp, Homo sapiens
  DISD22_0001136
  Located on chromosome 1
  Distance between a terminus base of telomere on chromosomal short arm and 5'-terminus of this base sequence : 234780532
  Distance between 3'-terminus of neighbour sequence of sequence listing upward to telomere on chrosomal short arm and 5'-terminus of this base sequence : 70147
acctcatatgtcatatgagtagagggtgtgtgtgtgtgtgtgtgtgtgtgtgtgtgtgtgtcagaaataaaggggaaaggacatacagtgagttttctaggcagaaggaacagctt

SEQ ID NO: 2020 - DNA, 207 bp, Homo sapiens
  AL136378.7_127022
  Located on chromosome 1
  Distance between a terminus base of telomere on chromosomal short arm and 5'-terminus of this base sequence : 235026449
  Distance between 3'-terminus of neighbour sequence of sequence listing upward to telomere on chrosomal short arm and 5'-terminus of this base sequence : 245801
tgtctggaaatgtgactattcagattaaatgcttaatgtgtgtgtgttgactaaataaatctcaaccagaaccttctcagatattttgttgaacgtgggacctttgtttttttttgttgttttgttttgttttgtttttgttgttgttgttgttgttgtttaccagcaggggacccctgttttgtctatgtcaagaacaaagaccag

SEQ ID NO: 2021 - DNA, 104 bp, Homo sapiens
  Z67475
  Located on chromosome 1
  Distance between a terminus base of telomere on chromosomal short arm and 5'-terminus of this base sequence : 235306307
  Distance between 3'-terminus of neighbour sequence of sequence listing upward to telomere on chrosomal short arm and 5'-terminus of this base sequence : 279651
taaagcagaagaatgggctagggtgtgtgtgtgtgtgtgtgtgtgtgtgtttggtgttggaattctaggtagggttcctaggtaaggcttcactgagagggtga

SEQ ID NO: 2022 - DNA, 168 bp, Homo sapiens
  DISO7_10000802
  Located on chromosome 1
  Distance between a terminus base of telomere on chromosomal short arm and 5'-terminus of this base sequence : 235411579
  Distance between 3'-terminus of neighbour sequence of sequence listing upward to telomere on chrosomal short arm and 5'-terminus of this base sequence : 105168
caatactgcattatacgcgcgcgcgcgcacacacacacacacacacacacacacgcacacacccctgagaaattacagactagctactaagaaatttttaaaaggtttacatttcacctggtttataattcccctgggagggaaatttctcccaggaatgttaacctt

SEQ ID NO: 2023 - DNA, 208 bp, Homo sapiens
  DISO7_10000816
  Located on chromosome 1
  Distance between a terminus base of telomere on chromosomal short arm and 5'-terminus of this base sequence : 235737781
  Distance between 3'-terminus of neighbour sequence of sequence listing upward to telomere on chrosomal short arm and 5'-terminus of this base sequence : 326034
gagtgagctcacaggctgcgccgtgtgtgtgtgtgtgtgtgtgtgtgtgtgtgtgtgtgtgtgtgtgagagagagagacagagacagagacagagacagagacagacagagacagagacagacagacagacacagaacagctcctcggctcacaaggccaggcctgggaggctgagcccagcccaggggcgtctgctgagcccagatc

SEQ ID NO: 2024 - DNA, 292 bp, Homo sapiens
  chr1.fa.O7frz.262445888
  Located on chromosome 1
  Distance between a terminus base of telomere on chromosomal short arm and 5'-terminus of this base sequence : 235823721
  Distance between 3'-terminus of neighbour sequence of sequence listing upward to telomere on chrosomal short arm and 5'-terminus of this base sequence : 85732
aaagaatttggaaacatatccttcctgtttgatgttcaaaggtccttttctgaagttatgatggtagatattttatatatatatatatatatatataatatctactacatatctatatctatctatctatctatctatctatctatctatcatctatctatcatctatctatatcttttcctgtctcaacaaaataaaagcacttggcagtcctctgttagtccccagatgctctctgatacttgaaaagcccattaaatccaaacctagaaacgaaggatttgttaagatc

SEQ ID NO: 2025 - DNA, 434 bp, Homo sapiens
  chr1.fa.O7frz.262529326
  Located on chromosome 1
  Distance between a terminus base of telomere on chromosomal short arm and 5'-terminus of this base sequence : 235909862
  Distance between 3'-terminus of neighbour sequence of sequence listing upward to telomere on chrosomal short arm and 5'-terminus of this base sequence : 85849
ccattcttgaattgctataaatacccaagactgggtaatttgtaagaaaaaaaagaattaattggctcacagttctgcaggctgtgcaagaaacatgcagcatctgcttctggagaggactcaggaagcttccaatcatggcaaaaggtgaagcaggagcaagagagaatgggggaggtgccacacacttttaaacaaccagatctctcgagaactcactcgctatcatgaggactgcacctgcaccaagaggatggtgctaaaccattcatgagcaatccacccctgtgatccaattacctcccaccaggccccacctccaatactacatagagattgcaattctttccttccttccttcctttctttctttctttctttctttctttctttctttctttctagatagggcctcactctgttactcagtttgg

SEQ ID NO: 2026 - DNA, 410 bp, Homo sapiens
  chr1.fa.O7frz.262649550
  Located on chromosome 1
  Distance between a terminus base of telomere on chromosomal short arm and 5'-terminus of this base sequence : 236018505
  Distance between 3'-terminus of neighbour sequence of sequence listing upward to telomere on chrosomal short arm and 5'-terminus of this base sequence : 108209
ctagatgttcagcatttctgttactcttgcctcattcctgctgttgcaagtttccctgagatatcatttcccttctgtctgaaggacatcctttagcaattcttttagagcagctctgccatcagtgcatcttcttagttttcctttattcagaatgtgtctatttcacctgcattcctgaaagatatttttggaaaattgagaattctgggttgatggttcttttcttttagcacttgaaaaaatgttccacttattctggccttcatgattaaaaaaatatttaattgacaaataaagattgaatatatttaagctgtacaacatcatgattttacacacacacacacacacacacacacacacacacacacacacaggtgagaaattaacagtcattcaaactgttc

SEQ ID NO: 2027 - DNA, 145 bp, Homo sapiens
  DISO7_10000819
  Located on chromosome 1
  Distance between a terminus base of telomere on chromosomal short arm and 5'-terminus of this base sequence : 236225762
  Distance between 3'-terminus of neighbour sequence of sequence listing upward to telomere on chrosomal short arm and 5'-terminus of this base sequence : 206847
gtctccatgcaccctagcggttgccgggtgcggccgaatctgagccgtgtgtgtgtgtgtgtgtgtgtgtgtgtgcgcgcgcgcgccggcacagaacgagaaaaactgctcgttacagaaatcggggtagaaactgctcaggtga

SEQ ID NO: 2028 - DNA, 101 bp, Homo sapiens
  DISO7_10000820
  Located on chromosome 1
  Distance between a terminus base of telomere on chromosomal short arm and 5'-terminus of this base sequence : 236247118
  Distance between 3'-terminus of neighbour sequence of sequence listing upward to telomere on chrosomal short arm and 5'-terminus of this base sequence : 21211
cctttatcaccagcctgtgtgggccccctcttatgtacacacacacacacacacacacacacacacacacacacacactcccaagtaccttgcctgttaaa

SEQ ID NO: 2029 - DNA, 119 bp, Homo sapiens
  DISO7_10000822
  Located on chromosome 1
  Distance between a terminus base of telomere on chromosomal short arm and 5'-terminus of this base sequence : 236314916
  Distance between 3'-terminus of neighbour sequence of sequence listing upward to telomere on chrosomal short arm and 5'-terminus of this base sequence : 67697
gattgctcagctcatgtgtctcattatcattatcattatcattatcattatcattatcattatcattatcattaaaaggcctggtgtctgaaaggggtctctcccattagaatgcttgg

SEQ ID NO: 2030 - DNA, 407 bp, Homo sapiens
  AL096776.12_44973
  Located on chromosome 1
  Distance between a terminus base of telomere on chromosomal short arm and 5'-terminus of this base sequence : 236437839
  Distance between 3'-terminus of neighbour sequence of sequence listing upward to telomere on chrosomal short arm and 5'-terminus of this base sequence : 122804
gcctcgtttcttatcctattagaaatgcttctagtgctttaatgtttttccattaagcaagacgctgcctttgggacctttaggacatatatacatacatatatatatatatatatatacatatatatatatatatatgtatatatatacacatacacacacatatattaacaaaatatatatatatacatatatatacatatatatatacatatatatatacatatgtatatatatatatatatatagtgtgtgtgtgtgtgtgtgtgtgtgtgtgtgtgtgtgtgtgtgtgtataaaatacccaaagcagaatggtctcgcaagatggccgaataggaacagctccggtctacagctcccagcgtgagcgacacagaagatgggtgatttctgcatttccatctg

SEQ ID NO: 2031 - DNA, 247 bp, Homo sapiens
  AL078624.24_3355
  Located on chromosome 1
  Distance between a terminus base of telomere on chromosomal short arm and 5'-terminus of this base sequence : 236486949
  Distance between 3'-terminus of neighbour sequence of sequence listing upward to telomere on chrosomal short arm and 5'-terminus of this base sequence : 48703
gaatgacagaaagtgaaacagagaggtttcaaatagaatagggccaaacaccctgtaggtggaggaaaagagagatgtgagaaacaaaataatgagcagacatggagagtgagaaaatgcagaaatggataaaaaagaaagagagaaggaaagagatatctaaggagagagagagagagagagagagagagaaatgacttgggcactgtacacatggactccaggaagattaggagtggtcaagcct

SEQ ID NO: 2032 - DNA, 197 bp, Homo sapiens
  AL078624.24_19985
  Located on chromosome 1
  Distance between a terminus base of telomere on chromosomal short arm and 5'-terminus of this base sequence : 236503663
  Distance between 3'-terminus of neighbour sequence of sequence listing upward to telomere on chrosomal short arm and 5'-terminus of this base sequence : 16467
aataggtcattgcaagttgtatactttttttgtaaatagtttgcatttcattaaaaatttaaacaaataaaaagagaattcacacacacacacacacacacacacacaagacagagagggcgagagagagcaagagagtgagaaagctagagagagagaatgtttacataaatgatctcgtttaatttcctgacaac

SEQ ID NO: 2033 - DNA, 256 bp, Homo sapiens
  Z67360
  Located on chromosome 1
  Distance between a terminus base of telomere on chromosomal short arm and 5'-terminus of this base sequence : 236521928
  Distance between 3'-terminus of neighbour sequence of sequence listing upward to telomere on chrosomal short arm and 5'-terminus of this base sequence : 18068
cacggaaaattgattaggctaatcagatcagtagaactaaaattagaagaggaacagaagaaaagtcctttgaccagacaggattagatgggttacctaaagtggcaatgacagtcatctgtaagtctacatcctgttcttagatgccaaagcagacccaatgttaggaccgtgtgtgagtgtgagtgtgtgtgtgtgtgtgtgtgtgtgtgtgtgtgtgtgtagtaggggtctgtagagtagcgagatgggaacc

SEQ ID NO: 2034 - DNA, 345 bp, Homo sapiens
  AL078624.24_76544
  Located on chromosome 1
  Distance between a terminus base of telomere on chromosomal short arm and 5'-terminus of this base sequence : 236560051
  Distance between 3'-terminus of neighbour sequence of sequence listing upward to telomere on chrosomal short arm and 5'-terminus of this base sequence : 37867
actttatggtagccaaataacttcagttgataaaggaaagctctgcttgacagaagaatgcaggtaataaatgcagaaggaatgatagaattaggaaggtcatggacttgaattttctcattgttaattagaaattaaaattcctatttgttatcaaatagtatttaaaaaggaaaagtcagaacaggtgtcttaattcgtttgtattgctataaaggaatacctgagccaggataatgtgtgtgtgtgtgtatatatatatatatatatatatatatatatatatatatatatatgtaaagaggtttatttggccctcagttctgcagactgtactagaagcat

SEQ ID NO: 2035 - DNA, 466 bp, Homo sapiens
  chr1.fa.O7frz.263257396
  Located on chromosome 1
  Distance between a terminus base of telomere on chromosomal short arm and 5'-terminus of this base sequence : 236792059
  Distance between 3'-terminus of neighbour sequence of sequence listing upward to telomere on chrosomal short arm and 5'-terminus of this base sequence : 231663
tgacaaactatctggataccatggcccagacaagttgacttataaaattaaccatcacaggtcccataggcagcatctgcatcaccaatggagcctgttcaaaacacagaagctgagtgcagtggcaggcacctgtaatcccagctacacaggaagctgaggcaggacgatcacttgaggccaggaatccaagatcagcctgggcaacatagcagaacctcgtctggaaaaaaatttaagtatatggaaggatgtttgtgggttatatgaaaaagaaagaaagaagatagagaaggaaggaaggaaggaaggaaggaaggaaggaaggaaggaaggaaggaaggaacgaaggaaagaaggaagggaggaaggaaaaaagggaggaaggaaggaaggaaagaaggaaggaaggaaaaaaagtataaaaggaaggctttgtcctggatcagtggctttcaagtcctct

SEQ ID NO: 2036 - DNA, 406 bp, Homo sapiens
  chr1.fa.O7frz.263249497
  Located on chromosome 1
  Distance between a terminus base of telomere on chromosomal short arm and 5'-terminus of this base sequence : 236800088
  Distance between 3'-terminus of neighbour sequence of sequence listing upward to telomere on chrosomal short arm and 5'-terminus of this base sequence : 7563
gataggatgatagatggaatgatagatagatgatatatacatagatgatagatacatagatagatgatagatacctagatagatgatagatacatagatgatagatacatagatacatagacagatgatggaatgatagatgatagatagatagatagatagatagatagatagatgatagatgatagatgatagatagattagatagatagatagttgatagatgatagattggtagatgataattagattgatagatagatagatgatagatagatagatgctataacatctgtgtgaaggcttttgtgtggtcagaagtttttaactcatttgggtaaataccaaggaacacaattgctgcatcatatgggaggaatatgtttagttttgtaagaaatcacca

SEQ ID NO: 2037 - DNA, 100 bp, Homo sapiens
  DISO7_10000824
  Located on chromosome 1
  Distance between a terminus base of telomere on chromosomal short arm and 5'-terminus of this base sequence : 236941475
  Distance between 3'-terminus of neighbour sequence of sequence listing upward to telomere on chrosomal short arm and 5'-terminus of this base sequence : 140981
tgcacatatacatacaaatggcatgtacacacacacacacacacacacacacacagacacacatacacaggcacggatatgcctatcaatactgggtata

SEQ ID NO: 2038 - DNA, 406 bp, Homo sapiens
  AL162595.8_66745
  Located on chromosome 1
  Distance between a terminus base of telomere on chromosomal short arm and 5'-terminus of this base sequence : 237074115
  Distance between 3'-terminus of neighbour sequence of sequence listing upward to telomere on chrosomal short arm and 5'-terminus of this base sequence : 132540
caattgtagctaagctcaggaggttcctggaggccggcgagacagcatggaagcttctcacccctttccccatatctcaccctgttcatctcttcatctgtgtcctttctaatatccttttattattattattattattattattattattattattattattttgagacagaatgttgctctgttgcccaggctggagtgcaatggcgcgatctcagctcactgcaacctctgcctcccgaatagctgggattacaggtgtgtgctgggctcaagcaattctctcacctcagcctcccaaatagctgggattacaggcgtgggccacaacacccggctaatttttgtatttttagtagagacggggtttcatcatgttgaccagactggtcttgaactcctgact

SEQ ID NO: 2039 - DNA, 406 bp, Homo sapiens; identical to SEQ ID NO: 2038
  AL160004.5_91282
  Located on chromosome 1
  Distance between a terminus base of telomere on chromosomal short arm and 5'-terminus of this base sequence : 237074115
  Distance between 3'-terminus of neighbour sequence of sequence listing upward to telomere on chrosomal short arm and 5'-terminus of this base sequence : -406

SEQ ID NO: 2040 - DNA, 401 bp, Homo sapiens
  chr1.fa.O7frz.264083225
  Located on chromosome 1
  Distance between a terminus base of telomere on chromosomal short arm and 5'-terminus of this base sequence : 237128902
  Distance between 3'-terminus of neighbour sequence of sequence listing upward to telomere on chrosomal short arm and 5'-terminus of this base sequence : 54381
ctgaagtcaggagttcaagaccagcctcgtcgacatggcgaaactctgtctctactaaaaatacaaaaattagcgaggcctgtggcggctgcctataatcccagctactcgggaggctgaggcaggggagtcgtttgaatccaggaggcggaggttgtggttaactgagatcatgccattgcactccagcctgggcaacaagagggaaactccatctctctctctctctctcagacacacacacacacacacacacacacacacacacacacacacagattaatcagtcataaaactactcatatgtccctcccagcatagctgttaataatctctgaatgaaatttacggttcactctgcaccagcctgtgtactactaatccactcctagaggtatctt

SEQ ID NO: 2041 - DNA, 104 bp, Homo sapiens
  DISO7_10000825
  Located on chromosome 1
  Distance between a terminus base of telomere on chromosomal short arm and 5'-terminus of this base sequence : 237177884
  Distance between 3'-terminus of neighbour sequence of sequence listing upward to telomere on chrosomal short arm and 5'-terminus of this base sequence : 48581
aggttacccagttggtgcctgtccctctctctctctctctctctctctctctctctctctctctctctctctctcctttttccctaagacaaggacagttctaa

SEQ ID NO: 2042 - DNA, 132 bp, Homo sapiens
  D1S1617
  Located on chromosome 1
  Distance between a terminus base of telomere on chromosomal short arm and 5'-terminus of this base sequence : 237310840
  Distance between 3'-terminus of neighbour sequence of sequence listing upward to telomere on chrosomal short arm and 5'-terminus of this base sequence : 132852
agagcaagactccatcgcaaaataataataataataataataataataataataataataataataaataaaataaaagttgaaatgctcccatattcaaaactttttgagcaccaacatgaagccacaagt

SEQ ID NO: 2043 - DNA, 296 bp, Homo sapiens
  AL121990.13_136034
  Located on chromosome 1
  Distance between a terminus base of telomere on chromosomal short arm and 5'-terminus of this base sequence : 237364356
  Distance between 3'-terminus of neighbour sequence of sequence listing upward to telomere on chrosomal short arm and 5'-terminus of this base sequence : 53384
aaatcagttacaataaagcacgtcttaaatccatatactcctgctggaaatctcaacccaagccatcaatgcctgttcgggtgagcagaacttcttttcattcatcatcatctatctatctatctatctatctatctatctatctatctatctatctatacagatagatatatatagatatacagatatgtgtgtgtatatatattatacatacattatgttttgcatttaacacttgcactttgtgataccccccacccccatcaggaagaatgacttaatgactgaatctttcc

SEQ ID NO: 2044 - DNA, 186 bp, Homo sapiens
  D1S2847
  Located on chromosome 1
  Distance between a terminus base of telomere on chromosomal short arm and 5'-terminus of this base sequence : 237524287
  Distance between 3'-terminus of neighbour sequence of sequence listing upward to telomere on chrosomal short arm and 5'-terminus of this base sequence : 159635
ggctcggttcagatgcattacagtgacaacaccggcacttcctccctcacccttccatgaggggataactatccactttcctgagttcagtgtgtgtgtgtgtgtgtgtgtgtgtgtgtctgtgtgtgtgtctgtgtgtgtgtgtgttttaattcattctggaagaactgagaacaaactgggtga

SEQ ID NO: 2045 - DNA, 314 bp, Homo sapiens
  chr1.fa.O7frz.264614452
  Located on chromosome 1
  Distance between a terminus base of telomere on chromosomal short arm and 5'-terminus of this base sequence : 237607218
  Distance between 3'-terminus of neighbour sequence of sequence listing upward to telomere on chrosomal short arm and 5'-terminus of this base sequence : 82745
cacttctagttcaggatttcatagtcctgaggggcaaacccaacggcagcattgagcctgacttgggcttggtgctttcttagaaggagtttagtttccagctgggcacaggcacacctatagtcccagctaataaaggatcttttgaggccaagagtttgagtccagcctgggcgacatagcgatacccagtctcaaataaataaataaataaataaataaataaataaataaatagataaataaataagtttttatttaaaaataaggagtttagcttcctaataatgaggtatttctagcttccactttgg

SEQ ID NO: 2046 - DNA, 138 bp, Homo sapiens
  D1S2631
  Located on chromosome 1
  Distance between a terminus base of telomere on chromosomal short arm and 5'-terminus of this base sequence : 237949756
  Distance between 3'-terminus of neighbour sequence of sequence listing upward to telomere on chrosomal short arm and 5'-terminus of this base sequence : 342224
ggccctttaagtggacagatctaggaaatatgtatgtatatttgtttaaatatgcatacatatgagcatagatgtgtgtgtgtgtgtgtgtgtgtgtgtgtgtgtctgtatgaaataatgagttcataccgctatctc

SEQ ID NO: 2047 - DNA, 338 bp, Homo sapiens
  AL078646.29_81293
  Located on chromosome 1
  Distance between a terminus base of telomere on chromosomal short arm and 5'-terminus of this base sequence : 238073851
  Distance between 3'-terminus of neighbour sequence of sequence listing upward to telomere on chrosomal short arm and 5'-terminus of this base sequence : 123957
tctatatctgagtctggttctgatacttgctgtgtctctttaaactgtgcgtgcgtgcgtgtgtgtgtgtgtgtgtgtgtgtgtgtgcgcgcgtgtgtgtgtgtgtttaacctcttagtgtgccttgtaattttatgttgaaagctggatgtgatggacttggtgcacggaaccctggtaaacaggcctttagttgtgtggtgttaaggtgtagtgggaggggaagcttgctatagtcctatgatttggtctcattcttttagggaacctttgtgtctgggctgtgagcctcacatttgcttctcagcttccccctctccacatccttaggtgatact

SEQ ID NO: 2048 - DNA, 295 bp, Homo sapiens
  AC024008.2_26047
  Located on chromosome 1
  Distance between a terminus base of telomere on chromosomal short arm and 5'-terminus of this base sequence : 238293417
  Distance between 3'-terminus of neighbour sequence of sequence listing upward to telomere on chrosomal short arm and 5'-terminus of this base sequence : 219228
catcttcactgagtaggctgaggaggaggaggaggaagaggagtggttggtcttgctgtctcaggggtggaggtggaagaaaatctgtgtataagtggacccacccagtgcaaacctgtgttgttcaagagtcaactgtatatattttcgcatgcataatttttttaaagattgcatgcaatatcacaacgactaataaaaagtcctccttttgtttttaaatccacaaccaccacctgccttcccagtccaagtttcagggtaacatacagtaagtcattaacaggttcttgga

SEQ ID NO: 2049 - DNA, 302 bp, Homo sapiens
  AL359975.6_20886
  Located on chromosome 1
  Distance between a terminus base of telomere on chromosomal short arm and 5'-terminus of this base sequence : 238332785
  Distance between 3'-terminus of neighbour sequence of sequence listing upward to telomere on chrosomal short arm and 5'-terminus of this base sequence : 39073
taagccaaggtgagacaataaataaataaataaatattaaaaataaaaagaagggaatccccgcagcccttcttactgcctttaggaggtacttattttaacccccaagtttcaggttagacatttccctactccttttacctggaaaataactacttaatccatgggtcatagatttaagtgcttcccttggggcctccctaactcttaggccagcttggagctctgggtctctgctcccagaagacccaacctttggtgagcaattacacaaaaacagtacttacatgtgctaccagtca

SEQ ID NO: 2050 - DNA, 258 bp, Homo sapiens
  AC005386.1_86778
  Located on chromosome 1
  Distance between a terminus base of telomere on chromosomal short arm and 5'-terminus of this base sequence : 238397888
  Distance between 3'-terminus of neighbour sequence of sequence listing upward to telomere on chrosomal short arm and 5'-terminus of this base sequence : 64801
tcctgagtttaactgaggtcaggagcaattttgcaaccccctggctataatctaaagtaatgctgtggagaagctagaggttggaaattgcttttttccccatggggtcagcaatatcaaaatcccggaggaaagaaggtgtgtgtgtgttgtgtgtgtgtgtgtgtgtaagtgaatgtgtatgtgtgtgagcatgtgtgtgtgtgtgatgggctgaacaaaattaatatgttgaagtcctaactcctagtaccggag

SEQ ID NO: 2051 - DNA, 237 bp, Homo sapiens
  Z66895
  Located on chromosome 1
  Distance between a terminus base of telomere on chromosomal short arm and 5'-terminus of this base sequence : 238397999
  Distance between 3'-terminus of neighbour sequence of sequence listing upward to telomere on chrosomal short arm and 5'-terminus of this base sequence : -147
caatatcaaaatcccggaggaaagaaggtgtgtgtgtgttgtgtgtgtgtgtgtgtgtaagtgaatgtgtatgtgtgtgagcatgtgtgtgtgtgtgatgggctgaacaaaattaatatgttgaagtcctaactcctagtaccggagaatgtgactgtattcacagataaggtccttcaagtggtaattaaattaaaatgaggtcattaggataggccctcatccaacatgactggt

SEQ ID NO: 2052 - DNA, 352 bp, Homo sapiens
  AC005386.1_120902
  Located on chromosome 1
  Distance between a terminus base of telomere on chromosomal short arm and 5'-terminus of this base sequence : 238432027
  Distance between 3'-terminus of neighbour sequence of sequence listing upward to telomere on chrosomal short arm and 5'-terminus of this base sequence : 33791
ctcactggataagtccatactaaggtatgataccagatccttccagcagaatttgatgggtcagataaaaataataggagattataatacaaaacaagaaaaaatagatatatttcttatgtattatatctatctatctatctatctatctatctatatgaatctctgcactttgggaggccaagaggaggattgcttgaggccaggagtagttcaagaccaccctgagcaacaagcaagaccccatctctctctctctatatatatataaggagaaataaatatatatttggcttttacctcatttctggtacaaagtatctaaacccttgtaatttcctaagtgacagag

SEQ ID NO: 2053 - DNA, 242 bp, Homo sapiens
  AC005386.1_122333
  Located on chromosome 1
  Distance between a terminus base of telomere on chromosomal short arm and 5'-terminus of this base sequence : 238433493
  Distance between 3'-terminus of neighbour sequence of sequence listing upward to telomere on chrosomal short arm and 5'-terminus of this base sequence : 1114
tggaaaccttagttcaatgaaagaagacagacaaagacaactgcatattgtgttgttagaatttaaacaacagagagagagagagagagactctctaaaattaaatgatatttatttcagagtaagcatgcaataagaatacagtaggcatatttgggaaggtaaaggaagacaagggctttaaaagaaaaaaaaaatgaagaggattacataagttattttgaaacaattatccttggcta

SEQ ID NO: 2054 - DNA, 261 bp, Homo sapiens
  D1S2805
  Located on chromosome 1
  Distance between a terminus base of telomere on chromosomal short arm and 5'-terminus of this base sequence : 238438052
  Distance between 3'-terminus of neighbour sequence of sequence listing upward to telomere on chrosomal short arm and 5'-terminus of this base sequence : 4317
cagttgtctggggatgggagggaggtcagggtgggtcataagagagagattacaaagaggcgcaggaaacttttaggaatatagatatgttcatttatcttgattgtgatggctccatgggtatatatgtgtgtgtgtgtgtgtgtgtgtgtgtctgtgtgtgtttttatgtcaaaacttatcaaaatgtacatttaaaatacagttattcttcaatagcatgagggttggtgctaggacctcctgtggatactaaaatct

SEQ ID NO: 2055 - DNA, 104 bp, Homo sapiens
  D1S2833
  Located on chromosome 1
  Distance between a terminus base of telomere on chromosomal short arm and 5'-terminus of this base sequence : 238493194
  Distance between 3'-terminus of neighbour sequence of sequence listing upward to telomere on chrosomal short arm and 5'-terminus of this base sequence : 54881
ctgagccccagattgacactgacctagtgtgtgtgtgtgtgtgtgtgtgtgtgtgtgtgtgtgtgtgtgtgtgtacatacatacacattttatgtggtattcat

SEQ ID NO: 2056 - DNA, 367 bp, Homo sapiens
  AL158214.30_77117
  Located on chromosome 1
  Distance between a terminus base of telomere on chromosomal short arm and 5'-terminus of this base sequence : 238506976
  Distance between 3'-terminus of neighbour sequence of sequence listing upward to telomere on chrosomal short arm and 5'-terminus of this base sequence : 13678
gtaaattgatgtttccatcttcagaaaccaaaacttgccagtaccccacaaatggcagacttcaaatatgggaaacttactaactccctcttttggctctctgccatttgggcaatgtttacatctttgactctgcatcctgtgtcacagatgaagcgtgagccatttcatgtgctgctgttgttgacctttttatttttatttatttatttatttatttatttatttatttatttatttttgagacaatgtctcgctctgttacccaggctggagtgcagtcctgcaatctcagctcactgctacctctacctcctgggctcaagtgattctctcaccccaaaccttgagtagctggaactacagc

SEQ ID NO: 2057 - DNA, 308 bp, Homo sapiens
  AL357044.9_12675
  Located on chromosome 1
  Distance between a terminus base of telomere on chromosomal short arm and 5'-terminus of this base sequence : 238650235
  Distance between 3'-terminus of neighbour sequence of sequence listing upward to telomere on chrosomal short arm and 5'-terminus of this base sequence : 142892
ccttcagtcctgtgttagtcaggattcttcagagaaatagaatcactagggaaccaaatatatatacatacaattaaacacacacacacctatctatctatctatctatctatctatctatctatctatctatctatctatctatctatctatctacatcacacagttgacccttgagcaacacaggcttgaacttatatggggattttcttccatctctaccacccctgagacagcaagaccaactcctcctcctccttctcagcctactcaacatgaagataataaggatgaagacctttacaatg

SEQ ID NO: 2058 - DNA, 153 bp, Homo sapiens
  D1S1656
  Located on chromosome 1
  Distance between a terminus base of telomere on chromosomal short arm and 5'-terminus of this base sequence : 238650266
  Distance between 3'-terminus of neighbour sequence of sequence listing upward to telomere on chrosomal short arm and 5'-terminus of this base sequence : -277
gagaaatagaatcactagggaaccaaatatatatacatacaattaaacacacacacacctatctatctatctatctatctatctatctatctatctatctatctatctatctatctatctatctacatcacacagttgacccttgagcaacac

SEQ ID NO: 2059 - DNA, 453 bp, Homo sapiens
  AL357044.9_39388
  Located on chromosome 1
  Distance between a terminus base of telomere on chromosomal short arm and 5'-terminus of this base sequence : 238676693
  Distance between 3'-terminus of neighbour sequence of sequence listing upward to telomere on chrosomal short arm and 5'-terminus of this base sequence : 26274
taatctatgttccataggccacttcgaggtatgaatacttgattaaaaaaaaaaaaaaggcagggggctgggcacagtggctcacgcctgtaatcccagcactttgggaggttgaggcagttggatcgtgaggtcaggagctcgagaccagctcatagcgaaactttgtctctactaaaaatacaaaaaattagtcaaatgtggtggtatgcacctgtaatcccagctactcgggaggctgaggcaggagaaccccttgaacctgggaggtggaggttgcagtgagctgaggtttgccactgcactccagcctgggcaacagtgggagactccatctcaaaaatataaataaataaataaataaataaataaataaataaataaataataaaattaaattaaattaaaataaaaaggtgagggctgtgacccttggttatcagcatgatagct

SEQ ID NO: 2060 - DNA, 362 bp, Homo sapiens
  M1_238697465
  Located on chromosome 1
  Distance between a terminus base of telomere on chromosomal short arm and 5'-terminus of this base sequence : 238697327
  Distance between 3'-terminus of neighbour sequence of sequence listing upward to telomere on chrosomal short arm and 5'-terminus of this base sequence : 20181
tccacaaaaatcagaaggttcttttggaactgtacaacacaaagagtgaactcaaatgtaaatgatggatttcagttgatagtaatgtgtcaatattggttcatcaattgcaataaatataccacatcagtgttaatatgtgtgtgtgtgtgtgtgtgtgtgtgtgcgcgcgcttgcatgagtgtgtgtgtgttagtgataggagaaactgtggaggaagagagggggaaaatgggatatatgagacccgtctctgcttgctgttcaatttttctgtacaactaaaactgtaactttgttctgattacttttaaattgaaatccatttccttaaaaatcactatcactgttttctcatgcct

SEQ ID NO: 2061 - DNA, 200 bp, Homo sapiens
  DISD22_0001143
  Located on chromosome 1
  Distance between a terminus base of telomere on chromosomal short arm and 5'-terminus of this base sequence : 238923706
  Distance between 3'-terminus of neighbour sequence of sequence listing upward to telomere on chrosomal short arm and 5'-terminus of this base sequence : 226017
ggtaagacctggagtacgtaaacaaacaaacaaaacaagcagataaaacaacagagagagaaagaaagagaaaagggagggagggagggagggaagaaggaaggaaggaaggaagaaaggaaagaaggaagaaaggaagaaggaaggaaggaaggaagaagagtccattcgtttttctcacttaggtagaatttccatcc

SEQ ID NO: 2062 - DNA, 360 bp, Homo sapiens
  AL117352.12_87790
  Located on chromosome 1
  Distance between a terminus base of telomere on chromosomal short arm and 5'-terminus of this base sequence : 239252475
  Distance between 3'-terminus of neighbour sequence of sequence listing upward to telomere on chrosomal short arm and 5'-terminus of this base sequence : 328569
gcacgagaattgtttgaacctacgaggtggaggttgcagtgagccgagatcgcgtcactgcactccagcctgggcgacagagcaagaccctgtctccaaaaaataaataaataaattatatatatatatatatatatatatatatatatatatatatatatatatatatataaaatttgtgtgtatacatatgcatacctacacacgtctaagtggctttatttttatatggacccacataagtttgttgttaacaccaaacagccaccttcatgggatccatgtgcagaggctggagcccagcttctccacatgacgtgagtcacccgaattgttgggtttgtagattggtctcactga

SEQ ID NO: 2063 - DNA, 324 bp, Homo sapiens
  AL356745.6_13924
  Located on chromosome 1
  Distance between a terminus base of telomere on chromosomal short arm and 5'-terminus of this base sequence : 239352347
  Distance between 3'-terminus of neighbour sequence of sequence listing upward to telomere on chrosomal short arm and 5'-terminus of this base sequence : 99512
tcaggagcttgagactagtcaggccaacatggtgaaatctcatctctattaaaaatacaaaaattagccgtgcatggtggcacatgcctgtattcccagctacttgagaggctgaggaaggagaattgcttaaactcgggaggcagaggtttcagtaagctgagatggtgccattacactccagagtgagactctgtctcaaaacaaaacaaaacaaaacaaaacaaaacaaaacaaaacaaaacaaaagacttagaaaacatgaggcctgaaaccataaaactactagaagaaaacatagaggaaacgcttcatgacattggt

SEQ ID NO: 2064 - DNA, 409 bp, Homo sapiens
  AL358784.4_109003
  Located on chromosome 1
  Distance between a terminus base of telomere on chromosomal short arm and 5'-terminus of this base sequence : 239353005
  Distance between 3'-terminus of neighbour sequence of sequence listing upward to telomere on chrosomal short arm and 5'-terminus of this base sequence : 334
gcaaattaaagccagagtgaggccaggtgcagtggctcattcctgtaatcccagcactatgggaggctgaggtggaaggatctcttgagcccaggagttcaagaccagcctgggcaacataacgagaacctgtctctacataaaataaaataaataaaataaaataaaataaaataaataaaataaaataaaataaataaaatagatgaaagataacaagtgttggcaaggatgtggagaaaagggaatctttgtacactgttgatgggaatataaatcaggacagccattttggaaaacagtatgaaacttccttgaaaaatctcagaactactatatgatccagcagtctcactactgtgtatatacccagaggaacttaaatcagtatgttaaagagatgcctgca

SEQ ID NO: 2065 - DNA, 395 bp, Homo sapiens
  chr1.fa.O7frz.266589156
  Located on chromosome 1
  Distance between a terminus base of telomere on chromosomal short arm and 5'-terminus of this base sequence : 239386098
  Distance between 3'-terminus of neighbour sequence of sequence listing upward to telomere on chrosomal short arm and 5'-terminus of this base sequence : 32684
gtgacttgatttgttcctattaagatttctcggccgggcgcggtggctcacgcctgtaatcccagcacttcgggaggccgaggcaggcggattaaaggtcaagagattgagaccatcctggccaacatggtgaaacaccgtctttactaaaaatacaaaaaaaattagctgggcgtggtggcgtgtgcctgtagtcccatctgaggctgaggcaggggaatcgcttgaaccgggaggcggagcttgcagtgagccgacatcgccccactgcactccagcctggcgacagagcgagactccgtctcaacaaacaaacaaacaaacaaacaaacaaacaaacaaagatttctaagagaataaaccttctgtgtccctcctaggaattctgtatggtt

SEQ ID NO: 2066 - DNA, 261 bp, Homo sapiens
  D1S251
  Located on chromosome 1
  Distance between a terminus base of telomere on chromosomal short arm and 5'-terminus of this base sequence : 239472102
  Distance between 3'-terminus of neighbour sequence of sequence listing upward to telomere on chrosomal short arm and 5'-terminus of this base sequence : 85609
gtctccagcctgccacctgcctatcttgggacttctcaacctctgtaatcctgtgagccaattccttataattaaacacacacacacacacacacacacacacacacactctctctctctctctctctctctctctctctattggttctggttctgtttctctggagaactctgggtaatacaatatctttggcttatctccttgtgtacctatgtaagaatttctctaggaagattatgaaggagtgaagttgcttggtc

SEQ ID NO: 2067 - DNA, 173 bp, Homo sapiens
  D1S1621
  Located on chromosome 1
  Distance between a terminus base of telomere on chromosomal short arm and 5'-terminus of this base sequence : 239708524
  Distance between 3'-terminus of neighbour sequence of sequence listing upward to telomere on chrosomal short arm and 5'-terminus of this base sequence : 236161
tataaccactgcatcctgaccacttcctggctgatggtgattgtaggacacatccctgtttcagagatgttaaaatgtaaaataataataataataataataataataataataataataatataagatataacctgtttcctaaagttgtgatgacatttaaaggtgagaaa

SEQ ID NO: 2068 - DNA, 197 bp, Homo sapiens
  D1S2709
  Located on chromosome 1
  Distance between a terminus base of telomere on chromosomal short arm and 5'-terminus of this base sequence : 239788359
  Distance between 3'-terminus of neighbour sequence of sequence listing upward to telomere on chrosomal short arm and 5'-terminus of this base sequence : 79662
atcaatcagtatctaatagcatcatgacctctacagatttgtgtgtcatctgttgtgtgtgtgtgtgtgtgtgtgtgtgtgtgtgtgcatctttttataagtccccatactcttccattgatctgtttgtttctttctgaattaataccacactataattgctatagcattagaggacattctgatatgtggtatga

SEQ ID NO: 2069 - DNA, 424 bp, Homo sapiens
  chr1.fa.O7frz.267161093
  Located on chromosome 1
  Distance between a terminus base of telomere on chromosomal short arm and 5'-terminus of this base sequence : 239941463
  Distance between 3'-terminus of neighbour sequence of sequence listing upward to telomere on chrosomal short arm and 5'-terminus of this base sequence : 152907
tcagatagctcatgcttaagactccaactcccagatggcttatgaataagagttttttgtttgtttgtttgtttgtttttttgacagagttttgctcttgttgcccaggctgtggagttcagtggtgtgatctcggctcactgcaacctccagttcccaggttcaagtgattctcctgcctcagcctcccaagtagctgggattacaggcacccaccaccacgcgaggctaatttttgtatttttagcagagatggggtttcaccatgttggccaggctggtctcgaactcctgatctcatgatccacctgcctcagcctcccaaagtgctgggattacagacgtgagccaccgcacccggccatgaataagaatttttaaggacagggaggcagagattgtgagcaaagttgtaaatcaatat

SEQ ID NO: 2070 - DNA, 442 bp, Homo sapiens
  chr1.fa.O7frz.268936826
  Located on chromosome 1
  Distance between a terminus base of telomere on chromosomal short arm and 5'-terminus of this base sequence : 240116507
  Distance between 3'-terminus of neighbour sequence of sequence listing upward to telomere on chrosomal short arm and 5'-terminus of this base sequence : 174620
gaaggtctgttgcttattaaattattgtatgggggccaggcactgtggctcaagcctgtaatcccagcactttggccaggagtttgagaccagcctggccaatgtggcaaaaccctgtcctactaaaaatacaaaaattagccgggtgtagtggcgggcacctgtaatgccagctacttgggaggctgaggcaggagaagtgcttgagcctgggaggcggaggttgcagtgagccaagatcataccatgcactccagcctgggtgacaagagtgagactccgtctctctctctctctttctctctctctctctttctctctctctctctctctctatatatatatatttgtgtgtttgtgtgtgtgtgtttatttcttgtgcttaatagtaccagtgtggttataaaaggtcctttttcttaacagatgctgagatattgtc

SEQ ID NO: 2071 - DNA, 331 bp, Homo sapiens
  AL122003.17_7132
  Located on chromosome 1
  Distance between a terminus base of telomere on chromosomal short arm and 5'-terminus of this base sequence : 240379222
  Distance between 3'-terminus of neighbour sequence of sequence listing upward to telomere on chrosomal short arm and 5'-terminus of this base sequence : 262273
attcatctattctagcctccatttatttggttgtctcattgcctatgctatttcttatttcattgtggtgtgtgtgtgtgtgtgtgtgtgtgtgtgtgtgtgtgtgtgttatgctgttatgatggctttgtggtttgtcaattcagctaggctagggtacattccccagaatttcccagtatgtgagaggggtgggctataccagatactctctcataaagggtggaagggaagacgcaggcattctgtagcatgcacgcactttctcctaggtgcttctgtgaagagacttcacagatataaataaagtccttaatcagttgactttaaa

SEQ ID NO: 2072 - DNA, 333 bp, Homo sapiens
  AL122003.17_30491
  Located on chromosome 1
  Distance between a terminus base of telomere on chromosomal short arm and 5'-terminus of this base sequence : 240402530
  Distance between 3'-terminus of neighbour sequence of sequence listing upward to telomere on chrosomal short arm and 5'-terminus of this base sequence : 22977
cctgtaattccagctactcaggaggctgagacaggagaattgcttgaacccgggaggtggagattgcagtcaattgagatcgcactccagtctgggtgacagagtgagactctgtctcaaataaataaataaataaataaataaataaataaataaataaataaataaaataatccctgctcaatatctctggatcaggctgatgacacagtcaccaattaagtggaagattctaaattgctgctactaccctgaaaaatgtagccatccacaggaccctaaatgtccccattaaaatgtaagatatagagctatcagatggcatcacataat

SEQ ID NO: 2073 - DNA, 108 bp, Homo sapiens
  AL122003_65892
  Located on chromosome 1
  Distance between a terminus base of telomere on chromosomal short arm and 5'-terminus of this base sequence : 240438030
  Distance between 3'-terminus of neighbour sequence of sequence listing upward to telomere on chrosomal short arm and 5'-terminus of this base sequence : 35167
tttcagtgacttatgtcagattattattattattattattattattgagacagaatgtcgctctgttgcccaggctggagtgcagtggtgcaatcttgattcactgta

SEQ ID NO: 2074 - DNA, 235 bp, Homo sapiens
  Z67285
  Located on chromosome 1
  Distance between a terminus base of telomere on chromosomal short arm and 5'-terminus of this base sequence : 240589348
  Distance between 3'-terminus of neighbour sequence of sequence listing upward to telomere on chrosomal short arm and 5'-terminus of this base sequence : 151210
aaccatgttaatgctgaaacaagtcattttcatccatacacacacacacacaaacacacacacacacacacacacacacacatgcacgcatcttgtcttagtcactttaggctgctctttaaaaaataccataaaccaggtggcttataaacaacagaaatatgttgctccagttctggaggctggaagtccgagatgagggtgtcagcatgctcaggttctattaagggcctct

SEQ ID NO: 2075 - DNA, 450 bp, Homo sapiens
  AL133380.5_90088
  Located on chromosome 1
  Distance between a terminus base of telomere on chromosomal short arm and 5'-terminus of this base sequence : 240885907
  Distance between 3'-terminus of neighbour sequence of sequence listing upward to telomere on chrosomal short arm and 5'-terminus of this base sequence : 296324
aaatccaatgaaacaggttaactatgaaaaacacaaaaactagccggcatggtggtgcttgcttgtaatcccagctactcaggaggctgaggcaagagaatcacttgcacctgggagccagaggtggcagtgagccaagattgtgccactgcatgccagcctggacaatagagtgaatgagactctatctctagataaataaataaataaataaataagaaaaatgactccttggagagttttacactggaatttctatttaatttaaatgaatcataatgatttactttcaatattctatatttgtattcagtattcagtattaaaagattgaagagatggaaatcgttgaaaaacttcaagcacggttactaacacagaaaataaaattggtctttatacttgaccatttaggcagactctttggtactttgatcaaattaaagatgc

SEQ ID NO: 2076 - DNA, 242 bp, Homo sapiens
  chr1.fa.O7frz.268609816
  Located on chromosome 1
  Distance between a terminus base of telomere on chromosomal short arm and 5'-terminus of this base sequence : 241121835
  Distance between 3'-terminus of neighbour sequence of sequence listing upward to telomere on chrosomal short arm and 5'-terminus of this base sequence : 235478
tttgcttcaatagtctttagacacaactttaatgtgtttaatgtctatatggtgtccatgctgtagagatgccataacttatttaaccattctctattttggaatatttagattgttctgagtcttcattatttcatctataccgtgtgtgtgtgtgtgtgtgtgtgtgtgtcccacatgtgtatgcactatattatacaactacatgtatgtatatatagataccgtctatgaccagtctt

SEQ ID NO: 2077 - DNA, 355 bp, Homo sapiens
  AL356357.15_67538
  Located on chromosome 1
  Distance between a terminus base of telomere on chromosomal short arm and 5'-terminus of this base sequence : 241170984
  Distance between 3'-terminus of neighbour sequence of sequence listing upward to telomere on chrosomal short arm and 5'-terminus of this base sequence : 48907
tacggttcactgtagattggacagcactgtgtttggggatcctggagaaatttaaagtaggagaggatgtggtctacctccagggccacacagtccagcgggaaagagataattaataagctgaagtcgaggactgcaaagtaaattctgttttacagaaggggaaacattgcgactgatttcagtatctctgctgaggtggagaggctgaggttcttctttcgtagctgctgctgctgcttcttcttcttctccttcttcttcttcttcttcttcttcttcttcttctcctcctcctcctcctcttcctcttcttcttctttttgcatgtatcaagctaacttaatggagaatg

SEQ ID NO: 2078 - DNA, 355 bp, Homo sapiens; identical to SEQ ID NO: 2077
  AC025873.3_27205
  Located on chromosome 1
  Distance between a terminus base of telomere on chromosomal short arm and 5'-terminus of this base sequence : 241170984
  Distance between 3'-terminus of neighbour sequence of sequence listing upward to telomere on chrosomal short arm and 5'-terminus of this base sequence : -355

SEQ ID NO: 2079 - DNA, 413 bp, Homo sapiens
  chr1.fa.O7frz.268824808
  Located on chromosome 1
  Distance between a terminus base of telomere on chromosomal short arm and 5'-terminus of this base sequence : 241292205
  Distance between 3'-terminus of neighbour sequence of sequence listing upward to telomere on chrosomal short arm and 5'-terminus of this base sequence : 120866
catatgcagtacgtcattgaccaaattgttatgtggtgcacggctgtattacctctgaaagccatgtttgctttaaaaaaattatatcccagggactggcagagattaaaatataaataatccaacccacctttcaaaatgtgctaacctgtctcaataaaataaataaataaataaataaataaataaataaataaataaataaaggcttggatcattcaacacatttaagggtcacagagagctgttcacagtgggctgaaaagcatacactcagtgaattaactgcgcctgtgccttctgcgaaccgtgctcatgagcttcttccttggcctagtttctcaaaatttagacaaaacaaagtagatggcaatgtggcagaattctatctgtttggtaggtcctcaattaac

SEQ ID NO: 2080 - DNA, 270 bp, Homo sapiens
  DISO7_00002223
  Located on chromosome 1
  Distance between a terminus base of telomere on chromosomal short arm and 5'-terminus of this base sequence : 241462164
  Distance between 3'-terminus of neighbour sequence of sequence listing upward to telomere on chrosomal short arm and 5'-terminus of this base sequence : 169546
ttcatgcttgatagtgaccccctccctcctggtttttgttttctgcctctgtggcctgagcagtcgacctgatggggtctaaaaaacctttcttggccaggagcagtggctgatgcctgtaagaagttgcagcgagccaagatcgcaccattgcactccagcctgggcaacaagagcaaaactccatcatacacacacacacacacacacacacacacacacacacacacacacacgaaaaaaaaaaaaacctttgtcgttcagtctggc

SEQ ID NO: 2081 - DNA, 347 bp, Homo sapiens
  chr1.fa.O7frz.267555762
  Located on chromosome 1
  Distance between a terminus base of telomere on chromosomal short arm and 5'-terminus of this base sequence : 241538447
  Distance between 3'-terminus of neighbour sequence of sequence listing upward to telomere on chrosomal short arm and 5'-terminus of this base sequence : 76013
ttgaggtcaagagttcaagaccagcctggccagcatggtgaaaacccatctctactaagtatacaaaaattagccaggtgtgatggtgggcacctgtaatctcagctactagggaggctgaggcaggagaatcacttgaaccgggaggcagaggttgcagtgagccaagatcgcaccactgcactccagcctgggcgacagagtgagactctgtctcaaaaaaatatgtgtgcgtgtgtgtgtgtgtgtgtgtgtgtgtgtgtgtgtgtaacctaattacatatattgttagtttccgctcttttgtagtttgcagtccatcctggtttgtcatgtaaccactgagt

SEQ ID NO: 2082 - DNA, 181 bp, Homo sapiens
  D1S459
  Located on chromosome 1
  Distance between a terminus base of telomere on chromosomal short arm and 5'-terminus of this base sequence : 241666440
  Distance between 3'-terminus of neighbour sequence of sequence listing upward to telomere on chrosomal short arm and 5'-terminus of this base sequence : 127646
ggggaccctgtttctgctacatgtttcaagttggctgttctccacagcctttctactatgcctggctatcgttgtgtgtgtgtgtgtgtgtgtgtgtgtgtgtgtgtgtgcgcgtttgagggcgggggatctttgctatttattagcattggttctctctcctccataaaacaccccagct

SEQ ID NO: 2083 - DNA, 141 bp, Homo sapiens
  D1S437
  Located on chromosome 1
  Distance between a terminus base of telomere on chromosomal short arm and 5'-terminus of this base sequence : 241732926
  Distance between 3'-terminus of neighbour sequence of sequence listing upward to telomere on chrosomal short arm and 5'-terminus of this base sequence : 66305
caggtggccaaatgttcatgaacagatgaataggtaaagtaaatgtgatatacatacatatcacatttgagtgtgatatatatatacacacacacacacacacacacacacacacaaaaggagtactattcagccataaaa

SEQ ID NO: 2084 - DNA, 180 bp, Homo sapiens
  Z23665.1_132
  Located on chromosome 1
  Distance between a terminus base of telomere on chromosomal short arm and 5'-terminus of this base sequence : 241732935
  Distance between 3'-terminus of neighbour sequence of sequence listing upward to telomere on chrosomal short arm and 5'-terminus of this base sequence : -132
aaatgttcatgaacagatgaataggtaaagtaaatgtgatatacatacatatcacatttgagtgtgatatatatatacacacacacacacacacacacacacacacaaaaggagtactattcagccataaaaaagtaagaaatcctgtcatttgcagcaacatggatgagcctagaggac

SEQ ID NO: 2085 - DNA, 184 bp, Homo sapiens
  Z67361
  Located on chromosome 1
  Distance between a terminus base of telomere on chromosomal short arm and 5'-terminus of this base sequence : 241732942
  Distance between 3'-terminus of neighbour sequence of sequence listing upward to telomere on chrosomal short arm and 5'-terminus of this base sequence : -173
catgaacagatgaataggtaaagtaaatgtgatatacatacatatcacatttgagtgtgatatatatatacacacacacacacacacacacacacacacaaaaggagtactattcagccataaaaaagtaagaaatcctgtcatttgcagcaacatggatgagcctagaggacattatattaag

SEQ ID NO: 2086 - DNA, 191 bp, Homo sapiens
  chr1.fa.O7frz.269206941
  Located on chromosome 1
  Distance between a terminus base of telomere on chromosomal short arm and 5'-terminus of this base sequence : 241953223
  Distance between 3'-terminus of neighbour sequence of sequence listing upward to telomere on chrosomal short arm and 5'-terminus of this base sequence : 220097
atgactgtagtaccaacatgctatagttgggactgctttggtgaaagggctgctcagttgatttcatggtcagcttacctctagcttcaatttgtgtgtgtgtgtgtgtgtgtgtgtgtgtgtgtgtgtgtgtgtgtgtaaaataaaactttatttgcaaaaacaggctacttgcctgagtagcattagta

SEQ ID NO: 2087 - DNA, 183 bp, Homo sapiens
  DISO7_10008414
  Located on chromosome 1
  Distance between a terminus base of telomere on chromosomal short arm and 5'-terminus of this base sequence : 241975213
  Distance between 3'-terminus of neighbour sequence of sequence listing upward to telomere on chrosomal short arm and 5'-terminus of this base sequence : 21799
ctgagggtcagaatcaagcttttcaataggtgggttttgaacatgggcctttggcagactgtgtgcagctgaaaagcgctgtcctgagctgagggtgagcgcgcgcgcgcacacacacacacacacacacacacacacacacacgaccatcgcccttttgcataatcacttggatttactctg

SEQ ID NO: 2088 - DNA, 182 bp, Homo sapiens
  D1S2800
  Located on chromosome 1
  Distance between a terminus base of telomere on chromosomal short arm and 5'-terminus of this base sequence : 242172940
  Distance between 3'-terminus of neighbour sequence of sequence listing upward to telomere on chrosomal short arm and 5'-terminus of this base sequence : 197544
ttgttcaagggtcaaatgcgtgtgtgtgtgtgtgtgtgtgtgtgtgtgtgtgtgtactatctatctctcatctcctcaactgcccttcattcacttgttttaatcacataaatcaatgtttgaactaccaagtcagttttgggaggtgacatacaagtgcaaggcttcataccagagaggtt

SEQ ID NO: 2089 - DNA, 286 bp, Homo sapiens
  AC051657.3_152721
  Located on chromosome 1
  Distance between a terminus base of telomere on chromosomal short arm and 5'-terminus of this base sequence : 242314587
  Distance between 3'-terminus of neighbour sequence of sequence listing upward to telomere on chrosomal short arm and 5'-terminus of this base sequence : 141465
gtacaatcctgacaaacttctcactgtcaaccttttcaaaactttaactgtggcctataagtagagacaggatgaataacagcagccactgtcagatacggaaaggaaaaggttagaatgaaccttgcagtactgaactaaaactggacgtcctggtgtgaattcacggttcttaatatggatggatggatgaacggatggatggatggatggatggatggatggatggcggacagacaggcactcaaacagatataaatgagtaagtctggtcagtagacaaagc

SEQ ID NO: 2090 - DNA, 327 bp, Homo sapiens
  AL136124.10_83875
  Located on chromosome 1
  Distance between a terminus base of telomere on chromosomal short arm and 5'-terminus of this base sequence : 242351784
  Distance between 3'-terminus of neighbour sequence of sequence listing upward to telomere on chrosomal short arm and 5'-terminus of this base sequence : 36911
cagaaacaatttaggtttctgtagtatcttatatcctgtaactagtaactcctcaaagcattcttgcgaggcaggtcgctgggctaacctatttgtgcacctccaaagattgttcatttacatgtagagggtatgttagatgacacctctctctctctctgtgacacacacacacacacacacacacacacacacacacgctaggatagaggatcaaatgtccttcacatggcatggccaggtagagagtgttttgttttgttttaaatcattaagatcctgtatatgattagcttgagataatccagtttaattagtggaattaga

SEQ ID NO: 2091 - DNA, 223 bp, Homo sapiens
  DISO7_10000826
  Located on chromosome 1
  Distance between a terminus base of telomere on chromosomal short arm and 5'-terminus of this base sequence : 242506432
  Distance between 3'-terminus of neighbour sequence of sequence listing upward to telomere on chrosomal short arm and 5'-terminus of this base sequence : 154321
gtcctctattcctggattgtgtttttcgtcttaggtactcaagtaaaaaccaagatggtgtctctctctctctctctctctctctcatatatatatatgcacacacacacacacacacacacacacacacacacatatttaattttaataatgtcaggcagtatgtgttttgtttggaatgcactttgcacccatgagcaaaagccagcactgtgaatctaaa

SEQ ID NO: 2092 - DNA, 262 bp, Homo sapiens
  DISO7_00010685
  Located on chromosome 1
  Distance between a terminus base of telomere on chromosomal short arm and 5'-terminus of this base sequence : 242587134
  Distance between 3'-terminus of neighbour sequence of sequence listing upward to telomere on chrosomal short arm and 5'-terminus of this base sequence : 80479
aggattgagggctgaagatagagctgcgctcacagagggctggaggtctcaaaggaggggcagggaggagtcaggtggcaaggtagcctctaaagagcttccacccttctgtctctaaggtgaaagatggatagaagctgggtgaagtggtggagctaccaggcaacaaaacacaaccctgctcttgggagtgtgtgtgtgtgtgtgtgtgtgtgtgtgtgtgtacgcgcacatatgcgtgtatgtaatgcaaaccatgcta

SEQ ID NO: 2093 - DNA, 269 bp, Homo sapiens
  D1S2712
  Located on chromosome 1
  Distance between a terminus base of telomere on chromosomal short arm and 5'-terminus of this base sequence : 242643388
  Distance between 3'-terminus of neighbour sequence of sequence listing upward to telomere on chrosomal short arm and 5'-terminus of this base sequence : 55992
tgccaactcgggaatacccttcacttttccattacttctgcatggcaaatatatgtatagatattatcgtgtgtgtatgtgtgtgtgtgtgtgtgtgtgtgtacaatcaaaacttatcctctgtagcgaaaaaaaaaagtattaattatgttttggattgtcttcatagagatctgagagcataatttaagtaaatactgtagtcatgactagcaatgctatattattcttatttgaattttaaccctaagaattttccagtctgctag

SEQ ID NO: 2094 - DNA, 171 bp, Homo sapiens
  D1S2649
  Located on chromosome 1
  Distance between a terminus base of telomere on chromosomal short arm and 5'-terminus of this base sequence : 243101743
  Distance between 3'-terminus of neighbour sequence of sequence listing upward to telomere on chrosomal short arm and 5'-terminus of this base sequence : 458086
atacatatattacaccatgcacacatatatatgtgtgtgtgtgtgtgtgtgtgtgtgtgtgtgtatatatttttcccccccttggagacatggtctcactgtgtcatccaggttggagtgaagtggcctgatcactgctcactgtggtcttgacttcctgtgctcaaatga

SEQ ID NO: 2095 - DNA, 355 bp, Homo sapiens
  chr1.fa.O7frz.270353558
  Located on chromosome 1
  Distance between a terminus base of telomere on chromosomal short arm and 5'-terminus of this base sequence : 243161003
  Distance between 3'-terminus of neighbour sequence of sequence listing upward to telomere on chrosomal short arm and 5'-terminus of this base sequence : 59089
tgcaacctattagttgactgatttttactccctgattctcagtttctccacttctaaaaagagggtaaataataccttctgccttaaaaacactctatatataaatgttaagtctgctgcagacttatctttgaattatgattatcatgtgctaaatcaaatgcatactaaaaacaggcacaatggtaagagtaggaaaatccaacactaggcctaattttgtgtgtgtgtgtgtgtgtgtgtgtgtgtgcacgcgcgcagaccgctctgcctattcaatgactatgcacatatgagggacccaacaaatcatattttaataagtaaaataaggacaaactatcttacagatgac

SEQ ID NO: 2096 - DNA, 393 bp, Homo sapiens
  AL356781.6_728
  Located on chromosome 1
  Distance between a terminus base of telomere on chromosomal short arm and 5'-terminus of this base sequence : 243182951
  Distance between 3'-terminus of neighbour sequence of sequence listing upward to telomere on chrosomal short arm and 5'-terminus of this base sequence : 21593
agtgcttaggttacaggagtgagccacctcacccagccataatttactctaattaaaaaaaaaaaaaaggaggaaggaaggaaggaaggaaggaaggaaggaaggaaggaaggaagggaggaagggaggaagggagagaaagagggagggagggagggagaggagggagggaaggaagggagagagtacttcctgtatctaaatactaaaaaaccatagaagtcatgaccaacccagcagcaatgagcacccttaacaccctgattgtgatctctaaaaaccatttcccacttgagaaaaccagggctacttgttcttttctttttatatatatatttgatgtcattaatgtctcagcaaccagggttccttaaagaaatagctgattccaga

SEQ ID NO: 2097 - DNA, 252 bp, Homo sapiens
  chr1.fa.O7frz.270487636
  Located on chromosome 1
  Distance between a terminus base of telomere on chromosomal short arm and 5'-terminus of this base sequence : 243318340
  Distance between 3'-terminus of neighbour sequence of sequence listing upward to telomere on chrosomal short arm and 5'-terminus of this base sequence : 134996
agttaatggagaacatgcaacagtacgttttgctggtgttgtccctcccgtggcaggtaagcaattattgtgtgtgtgtgtgtgtgtgtgtgtgtgtgtgtgtgtgtgtgtgtgtgtgtgtattttgcagctgtttctgtgtaagcttctcagtagcactttataccacaaattttgacgaaattaacaactaatttataggtgcctcctgtatccagttttatctgagtgacagtatcctgtggtatctat

SEQ ID NO: 2098 - DNA, 434 bp, Homo sapiens
  AC025395.2_9954
  Located on chromosome 1
  Distance between a terminus base of telomere on chromosomal short arm and 5'-terminus of this base sequence : 243467643
  Distance between 3'-terminus of neighbour sequence of sequence listing upward to telomere on chrosomal short arm and 5'-terminus of this base sequence : 149051
gtaggattccataaagtgaatcacgtttaaaagagacactcttaaaaaatgaaatacgtggccataatcccagcaccttgggaggccgaggaaagtggatcacgaggtcaggagttcgagaccagcctggccaacatagtgaatccctgtctgtactaaaaatacaaaaaattagctgggcatggtggtgggcgcctgtaatcccagctactcaggaggctgaggcaggagaatcacttgaatcagggaggcagaggttgcagtgagccgagatcgcgccattacactctagcccaggcaacagtgggagactccgtctcaatgaaaaataaataaataaatgaataaataaatattgttctaatgagcaaatttaaaaaatcctaagtaaaatttggtctctttctcattagtgcttaatggtcttcaatcac

SEQ ID NO: 2099 - DNA, 322 bp, Homo sapiens
  M1_243661875
  Located on chromosome 1
  Distance between a terminus base of telomere on chromosomal short arm and 5'-terminus of this base sequence : 243661766
  Distance between 3'-terminus of neighbour sequence of sequence listing upward to telomere on chrosomal short arm and 5'-terminus of this base sequence : 193689
gagcaagtgccataaagtcagggattgcttggggccaggagttaaagaccagcctgggcaacacagcaagatgccatttctacaaaaaaaaaaaataataaataataattatatatatatatatatatatatatatattttttagccaggcgttgcagtgcacgcctgtagtcctagctacttgggcagctgaggtgggaggatggcttgagtccaagagttcgaggctgcagtgagcaatgatcaagccaatgcactccagcctgggtgacagagcaagacaagaccccgtcaatcaatcaatcagtaataaaacaggcca

SEQ ID NO: 2100 - DNA, 382 bp, Homo sapiens
  M1_243670246
  Located on chromosome 1
  Distance between a terminus base of telomere on chromosomal short arm and 5'-terminus of this base sequence : 243669945
  Distance between 3'-terminus of neighbour sequence of sequence listing upward to telomere on chrosomal short arm and 5'-terminus of this base sequence : 7857
gtcctccaattcataaaagcaaacaggctcacgctgtaatcccagcactttgggaggcctaggcaggcggatcacaaggtcaggagtttgagaccagcctggccaacatggtgaaaccccgtctgtactaaaaaaaatacaaaaattagccgggcatggtagcatgcgcctgtaatcccagctactcaggaggttgaggcaggagaattgcttgaacccgggaggcggaggttgctgtgagctgagatcacgccactgcactccagcctgggagacagagcaagactccatctcaaataaaaaggaaggaaggaaggaaggaaggaaggaaggaaggaaggaaggaaggaaggaaggaaacagaatagtaggttgccagctg

SEQ ID NO: 2101 - DNA, 385 bp, Homo sapiens
  AL390765.5_108117
  Located on chromosome 1
  Distance between a terminus base of telomere on chromosomal short arm and 5'-terminus of this base sequence : 243788406
  Distance between 3'-terminus of neighbour sequence of sequence listing upward to telomere on chrosomal short arm and 5'-terminus of this base sequence : 118079
atcctggctaacatggtgaaaccccgtctctactaaacatacaaaaaaattagctgggtgtggtggcacgcacctgtagtcccaggtactagggacggtgaggcaggagaatcgcttgaacccaggagggggaggttgcagtgagccgagatcgcaccactgcactccagcctggcaacagagtgagactccgtctcaaataataataataataataataataataataataataataataacaacaacaacaacaacaacaataatatcctagctgaattttctcaaatcaaagaattaatgggtgaacaaaaatatatctttagaaatgtatctctagatgaaaatgcaatatagtattctcatccagtttagtcatttgact

SEQ ID NO: 2102 - DNA, 193 bp, Homo sapiens
  D1S235
  Located on chromosome 1
  Distance between a terminus base of telomere on chromosomal short arm and 5'-terminus of this base sequence : 243830074
  Distance between 3'-terminus of neighbour sequence of sequence listing upward to telomere on chrosomal short arm and 5'-terminus of this base sequence : 41283
aacagtcaattacaaaatatgtgtgtgtatacatatatatgggtatatatatatgtacccatatatgtgtatatatatacatatttatatgtgtgtgtgtgtgtgtgtgtgtgtgtgtgtgtgtgtgtgtgtgtgtatatgtaaactaacaagggccagaacatgatgactgaaatcccatgaactcttgctg

SEQ ID NO: 2103 - DNA, 403 bp, Homo sapiens
  AL390765.5_154842
  Located on chromosome 1
  Distance between a terminus base of telomere on chromosomal short arm and 5'-terminus of this base sequence : 243854759
  Distance between 3'-terminus of neighbour sequence of sequence listing upward to telomere on chrosomal short arm and 5'-terminus of this base sequence : 24492
cagatcacgaggtcaggagtttgagaccagcctggccaacatggtgaaaccccatctctactaaagatacaaaaaactagccgggcatggtggtacgtgcctgtaatcccagctactcaggaggttgaggcaggagaatcgcttgaacctgggaggcggaagttgcagtgagccgagattgcaccattgcactccagcctgggcaacagggcgagactccgtctcaaaagaaaagaaaagaaaagaaaagaaaagaaaagaaaagaaaaaagacaaaagattcccaattatagtggagggaagaacacacttactcttcatcaaggccaatatgtcgaccaaagaacatttcgatgaagcattctaacaattcttgagttcctcgatgaagatacaactggtt

SEQ ID NO: 2104 - DNA, 303 bp, Homo sapiens
  AL133286.9_28428
  Located on chromosome 1
  Distance between a terminus base of telomere on chromosomal short arm and 5'-terminus of this base sequence : 243962167
  Distance between 3'-terminus of neighbour sequence of sequence listing upward to telomere on chrosomal short arm and 5'-terminus of this base sequence : 107005
gatcacttgaggtcagcagttcgagaccagcctgggcaacacggtgaaaccccatgtctactaaaattacaaaaattagccgggcatggtggcaggcatctgtagtcccagctactcaggaggctgaggcaggagaatcgcttgaacctaggagccggagtttgcagtaagctgagatcaccccactgcactctggcctgggcaacacagcaagtctccatctcaaaacaaacaaacacacacacacacacacacacacacacacacacacacacaccccttcaagataaagtgagactacca

SEQ ID NO: 2105 - DNA, 306 bp, Homo sapiens
  AL133286.9_47700
  Located on chromosome 1
  Distance between a terminus base of telomere on chromosomal short arm and 5'-terminus of this base sequence : 243981565
  Distance between 3'-terminus of neighbour sequence of sequence listing upward to telomere on chrosomal short arm and 5'-terminus of this base sequence : 19095
acagttaatgccactaaactgtacatttaaaaatgggtaagacgataaattttatgttatgtatatttaaacacacacactcacacatacacacacacactctttctttcacacacacacacacacacacacacacacaaataggaggcagaatacttaacccagatctggaggaaggaggatcgggaaggcttcacaaaggagatggctttgtcttgaaaaaagaggaggagtttggcaggcaggacaagagaaagatattccaggctgagggaatagcataggaagtaaggaggcaattccaag

SEQ ID NO: 2106 - DNA, 298 bp, Homo sapiens
  chr1.fa.O7frz.271017245
  Located on chromosome 1
  Distance between a terminus base of telomere on chromosomal short arm and 5'-terminus of this base sequence : 244085130
  Distance between 3'-terminus of neighbour sequence of sequence listing upward to telomere on chrosomal short arm and 5'-terminus of this base sequence : 103259
tccatctacaagcatctgatagtgagaatctttttgcgtgcctacaggcatttggatatcttttgtaatgaagtgtcaagtgttttgttcatttaaaaatttttattattgagttgtaggagttgttcgtatatttcagaaaaaactcctgtcatatacacatatatgcacatctatatgtataggaatttgtgtgtgtgtgtgtgtgtgtgtgtgtgtgtatatatatgcataaatatgtattttttgagacagggtctctgttgcccaggctggagtgtagtggcgtgattactgc

SEQ ID NO: 2107 - DNA, 313 bp, Homo sapiens
  chr1.fa.O7frz.271367092
  Located on chromosome 1
  Distance between a terminus base of telomere on chromosomal short arm and 5'-terminus of this base sequence : 244239116
  Distance between 3'-terminus of neighbour sequence of sequence listing upward to telomere on chrosomal short arm and 5'-terminus of this base sequence : 153688
ccgtaagatacagaatgttgagatgagatggtgacagaattggaggaatggctatcacccagagctcctgggcttggagctggacacagaaaatgatgatccttttgggggaaagagggaatgtgtttttctgttttcttccttccttccttccttccttccttccttccttccttccttccttcctttctccttccttccttttttcccctccctccctccttccttcccttccttccctttcttcccttccttccttcctgatggagtctcactctgtggcccaggctggagctcagtggcgtaatctcag

SEQ ID NO: 2108 - DNA, 286 bp, Homo sapiens
  AC073638.1_15127
  Located on chromosome 1
  Distance between a terminus base of telomere on chromosomal short arm and 5'-terminus of this base sequence : 244414762
  Distance between 3'-terminus of neighbour sequence of sequence listing upward to telomere on chrosomal short arm and 5'-terminus of this base sequence : 175333
ctgaagcaagagaatcgcttgaacctgggaggcggaggttgcagtgagccgtaattgtgccgttgcactccagcctgggtgacaagaatgaaactccttctatagtaaataaataaataaataaataaataaataaataaataaataaaatgactaacatattgtactagactacagtttaatgtgctagacatgtttaggaggctctaatattcaaaacatgggtaaaagtcatgccataattctgcaccatttcttcacacactaacttctaactgcaaatcgc

SEQ ID NO: 2109 - DNA, 420 bp, Homo sapiens
  AC073638.1_101005
  Located on chromosome 1
  Distance between a terminus base of telomere on chromosomal short arm and 5'-terminus of this base sequence : 244429444
  Distance between 3'-terminus of neighbour sequence of sequence listing upward to telomere on chrosomal short arm and 5'-terminus of this base sequence : 14396
cattatttcaaggattgatggtactaacaggatttaaactattaattgcatttcgccagttttcagagaatgtttttttaagggtcaatattacaaaaactttgaagagaagctagaatgagaggtggtccttttgttgctattttaagtattagtttggaaatgagaaagaatatgctatatgattatctgcaacctactctcatatctaaaacaaaagtttttaaaaattaattctttatatctatctgtctctatctatctatctatctatctatctatctatctatctatctaaatatatatggatttttttttcgaggcaaggtcttgctttgtcacccaggcaggagtacagtggtgcaatctcagctcattgcaacctccacctcctgggctcaagcaatcctcttacctaag

SEQ ID NO: 2110 - DNA, 399 bp, Homo sapiens
  D1S1680
  Located on chromosome 1
  Distance between a terminus base of telomere on chromosomal short arm and 5'-terminus of this base sequence : 244505235
  Distance between 3'-terminus of neighbour sequence of sequence listing upward to telomere on chrosomal short arm and 5'-terminus of this base sequence : 75371
ctgtcctgtgtgtgtcctcaatgatgctttttttgtggctctgcctttcccagcgatctactgcattttcctctccttcctttctttttctttctttctttctttctttctttctttctttctttctttctttctttctttctttctttcttttctttttctttctttctttccttccttcctttccttccttccttccttccttccttccttccttccttccttccttccttccttctttctttctttctttctttctttctttctttctttctttctttctttctctttccttttttttttctgctcattctaattttcctgtaggaagcaggattaacttgtcctggacgcagcgggcattgtttgcagaggatggtgtcagagcatttaaagccc

SEQ ID NO: 2111 - DNA, 221 bp, Homo sapiens
  D1S2680
  Located on chromosome 1
  Distance between a terminus base of telomere on chromosomal short arm and 5'-terminus of this base sequence : 244565942
  Distance between 3'-terminus of neighbour sequence of sequence listing upward to telomere on chrosomal short arm and 5'-terminus of this base sequence : 60308
tttctatccgttcagagactcactataattctctctttctgtctctgtccttcatctgtttctctctttctctctcactctctctctctgataaacacacacacacacacacactcacactcacacactcctgagtaagggaaatgtgagaagaaggtaaaacttcaactaaatgaaaagaaattgtatgaattatggtaagcaggttggtttttagttcc

SEQ ID NO: 2112 - DNA, 147 bp, Homo sapiens
  D1S2850
  Located on chromosome 1
  Distance between a terminus base of telomere on chromosomal short arm and 5'-terminus of this base sequence : 244566965
  Distance between 3'-terminus of neighbour sequence of sequence listing upward to telomere on chrosomal short arm and 5'-terminus of this base sequence : 802
cgaaggtgtactgggactggtctcctctgctgacttcatgggaagcacacacacgcgcacacacacacacacacacacacacacacatacacacacctgtccaagatcagaaaaaatccctcacatccctgtagcatgatcctgatt

SEQ ID NO: 2113 - DNA, 260 bp, Homo sapiens
  D1S2678
  Located on chromosome 1
  Distance between a terminus base of telomere on chromosomal short arm and 5'-terminus of this base sequence : 244577919
  Distance between 3'-terminus of neighbour sequence of sequence listing upward to telomere on chrosomal short arm and 5'-terminus of this base sequence : 10807
agctgttaatagtttatccaaaatccatatatatatgtgtgtgtgtgtgtgtgtgtgtgtgtatggatttatatatatatataaatggatatatatatatatctggatggatatataaatatgatatatatatgtgtgtgtgtgtatatatatatgtgtatatatgtatatatatatgatggaatactatttagccataaaaaggaatgaattaatggcattcgcagtaacctggatggacttggagaccattattattt

SEQ ID NO: 2114 - DNA, 388 bp, Homo sapiens
  AL390764.3_11725
  Located on chromosome 1
  Distance between a terminus base of telomere on chromosomal short arm and 5'-terminus of this base sequence : 244626548
  Distance between 3'-terminus of neighbour sequence of sequence listing upward to telomere on chrosomal short arm and 5'-terminus of this base sequence : 48369
gctgtatcaagcaaagtcagttttaggagaaatagcctttcagtggtagtaagtttaaaaaagatgacttcctgaagcggaagcttgtgagacatttaagatgactttgcgcatgttagagttaaaaacatcccaaggttgtaaactgatttcctgcaaagatcttaacaacaacaacaacaacaaactaggctgcctgccacgggtgtctgaagtatcatcttggctcaagctgggagaatggataaaggttacactgttcatttctgcccttcacacagaaaagaagataattttataggtaaaattcgtgcatatcttgattctagcatactgctgattcctgtagtttctggggtcagtactctcaactattgaggtggaacaa

SEQ ID NO: 2115 - DNA, 434 bp, Homo sapiens
  chr1.fa.O7frz.271845930
  Located on chromosome 1
  Distance between a terminus base of telomere on chromosomal short arm and 5'-terminus of this base sequence : 244858120
  Distance between 3'-terminus of neighbour sequence of sequence listing upward to telomere on chrosomal short arm and 5'-terminus of this base sequence : 231184
tatcctgatctcatgatccacccaccttggcctcccaaagtgctaggattacaagtgtgagccaccgcacctggccttttttctttttgttttgttttgttttgttttgttttgttctgtttttgagatggagttgtgcttttggtgcccaggctggagtgcaatggtgtgatctcagctccctgcaacctccacctcccaggttcaagcgattatcctgcctcagcctcccaagtagctgggattacaggcatatgccaccatgcctggctaattttttgtatttttactagaaacagggttttactatgttggccaggctggtcttgaactcctgacctcaggtgatccatctgcctcagcctcccaaagtgctgagcttacaggcgtgagccaccacgactagctacgttccaattcttaaagatcactaa

SEQ ID NO: 2116 - DNA, 279 bp, Homo sapiens
  D1S1568
  Located on chromosome 1
  Distance between a terminus base of telomere on chromosomal short arm and 5'-terminus of this base sequence : 244970936
  Distance between 3'-terminus of neighbour sequence of sequence listing upward to telomere on chrosomal short arm and 5'-terminus of this base sequence : 112382
agaccaagagtttaccgttggatttagaaatggggtcatttgtgatcttgctgtactgtttccaaggagatgaaaactttattggagtgggttcaagagagaataggagaagaatagaagcagcagtataggcaactttttacagttctgccataaggggagcaaaaaaatagggtggaaaccaggggggaaatacgaggttcagaaagggcgtgtgtgtgtgtgtgtgtgtgtgtgtgtgtgtgtgtgtgtgtgtgtgtgtagatgctgtgacaacat

SEQ ID NO: 2117 - DNA, 287 bp, Homo sapiens
  AL359259.10_71617
  Located on chromosome 1
  Distance between a terminus base of telomere on chromosomal short arm and 5'-terminus of this base sequence : 245085790
  Distance between 3'-terminus of neighbour sequence of sequence listing upward to telomere on chrosomal short arm and 5'-terminus of this base sequence : 114575
gagcctggaacattctagaaacaatcctagtctcagagaacctggagcaagggcaggggtagcaaaagatgagccagagctgatggagaggccagactgcacaggactctggagaacagggtgggaaatttcatttcactctgagcacaaagggaagccaaggagggttttaaagcagtgaggccataatttgatttgaatttttattatttatttatttatttatttatttatttatttatttatttattttttgagacagggtttctaagtgcagtggtacagtc

SEQ ID NO: 2118 - DNA, 291 bp, Homo sapiens
  AL359259.10_13826
  Located on chromosome 1
  Distance between a terminus base of telomere on chromosomal short arm and 5'-terminus of this base sequence : 245126855
  Distance between 3'-terminus of neighbour sequence of sequence listing upward to telomere on chrosomal short arm and 5'-terminus of this base sequence : 40778
cctgctttccaaacctatactcctcttactatgtcatcctgatgccctgtttagttgcttctcataagaatagaaatggtagccggccctggtggctcacacccataatcccattgctttaggaggccaaggcaagaggatttcttcagaccaggagttcaaaaccatcctgggcaacttatcaagactccaccccttaacaacaacaatttatttatttatttatttatttatttatttatttatttatttatttatttagagatacggtcttgctacattgaccagact

SEQ ID NO: 2119 - DNA, 250 bp, Homo sapiens
  D1S1567
  Located on chromosome 1
  Distance between a terminus base of telomere on chromosomal short arm and 5'-terminus of this base sequence : 245377585
  Distance between 3'-terminus of neighbour sequence of sequence listing upward to telomere on chrosomal short arm and 5'-terminus of this base sequence : 250439
caaattcagattatgttagcagagggatcttccctgtatagcccatttaaaatatcaactcccattattgctctgtcctaccctactttattttctttataccaattccccaacagatgtgtgtgtgtgtgtgtgtgtgtgtgtgtgtgtgtatgcatatagatacattgtctctccctattttatttctacaaagacaggagttttgtctgtttcgatctttcctttccatagtgcccaaaatagtgcc

SEQ ID NO: 2120 - DNA, 187 bp, Homo sapiens
  Z67140
  Located on chromosome 1
  Distance between a terminus base of telomere on chromosomal short arm and 5'-terminus of this base sequence : 245449420
  Distance between 3'-terminus of neighbour sequence of sequence listing upward to telomere on chrosomal short arm and 5'-terminus of this base sequence : 71585
tattgctgatccttgttatcatgaataggctaacatgtaggatatttcctacatacgtaataaacacacacacgtgtgtgtgtgtgtgtgtgtgtgtgtggtgttaatttttttttaaaaaaaaaaaccttttttgaggaaagagtgaaaatgtgctccaaagtaattcgtggctagaggaactgca

SEQ ID NO: 2121 - DNA, 288 bp, Homo sapiens
  chr1.fa.O7frz.272748789
  Located on chromosome 1
  Distance between a terminus base of telomere on chromosomal short arm and 5'-terminus of this base sequence : 245656259
  Distance between 3'-terminus of neighbour sequence of sequence listing upward to telomere on chrosomal short arm and 5'-terminus of this base sequence : 206652
ttactagaactgatcagaccttagaaattctgtaatcccaaaatattatgccgttatttcttactctatcaaggcaggagaaaccactcagtgccgtgggtactaaagacaaattgtctcaaaatgtctcctgtatatacgcatttctataaaaggtaaaacaataatatcatacacacacacacacacacacacacacacacacacacaccacgtatatctgctttagtaggtacatagactccccagcaggatatcgaagaattgttaacaattgatgcctttaga

SEQ ID NO: 2122 - DNA, 435 bp, Homo sapiens
  chr1.fa.O7frz.272636823
  Located on chromosome 1
  Distance between a terminus base of telomere on chromosomal short arm and 5'-terminus of this base sequence : 245790742
  Distance between 3'-terminus of neighbour sequence of sequence listing upward to telomere on chrosomal short arm and 5'-terminus of this base sequence : 134195
gatttcagtgcaagtcattaatagagtacttaagttactcatatatctctgaaactcatacagcctcccacattttaagaagaaaagaacatattttctctatgcaatttcctcttatgttacagtgcatccagaaaacaactgctcctaccaaaagtcattttcttttgtgtatttagctctatgtgtttgccatcgttttaggggaaagtgagagggaaggtatagggggtggatattaagagctatttagaccatataaattagtgtctgtctgtctttctttctttctttctttctttctttctttctttctttctttctttctttctttttctttcttttctctctttttttttttaattgaggcaaggtcttgctctgtctcccaggctagagtgcagtggcatgatctcagctcactgcaatctatgc

SEQ ID NO: 2123 - DNA, 411 bp, Homo sapiens
  chr1.fa.O7frz.272874281
  Located on chromosome 1
  Distance between a terminus base of telomere on chromosomal short arm and 5'-terminus of this base sequence : 245866142
  Distance between 3'-terminus of neighbour sequence of sequence listing upward to telomere on chrosomal short arm and 5'-terminus of this base sequence : 74965
cagttgtaaactggttatccagatcgtcctgaatatttatgaaactccaatgagtatattacttctatttctactagacggggactgaggctctaggaagacaagtttgcagactgtataaaagaaaaatgcattttataattgttctgatatattagaccacacacacacacacacacacacacacaccatatacatgtatatatatttcaaagcaagcatttgtcaaaacaaaaataagccctttattcttatatttcttaagcattgaaaattagaaagcacacaatatctgaaattactatagaattttttatatatttatctgcttccctaaaattacaattttcatttgtcttctaaaaattacgtgggaatgcataccagtgaattataatgacctaggaatct

SEQ ID NO: 2124 - DNA, 438 bp, Homo sapiens
  chr1.fa.O7frz.273231934
  Located on chromosome 1
  Distance between a terminus base of telomere on chromosomal short arm and 5'-terminus of this base sequence : 245948124
  Distance between 3'-terminus of neighbour sequence of sequence listing upward to telomere on chrosomal short arm and 5'-terminus of this base sequence : 81571
aaatgttcagaggaactcatattactttactataagtattgtattgttttgaacagcaaaggcttagtgcgtcagaaataatataccatcataccattacttgtaaagtttacttcaaaatgaaacactctttatatactgctttcatggaataatatgtttctaaaccagttgagttgaatgcacctgaatttaaatgtcacacacacacacacacacacacacatatagtgtgagtgtacagatatatacatacatccatttagcaaatttgatcaactgaatctctggaataaaagtaaaacatgcttttaaaaacgtaattgcttattgtagtcacttaatgattttggaagaaacataatactttctcttaacatgagtagggatgtgatggttactttgaaaacatatttctggttctgtgaagcagtatta

SEQ ID NO: 2125 - DNA, 443 bp, Homo sapiens
  chr1.fa.O7frz.273083463
  Located on chromosome 1
  Distance between a terminus base of telomere on chromosomal short arm and 5'-terminus of this base sequence : 246120940
  Distance between 3'-terminus of neighbour sequence of sequence listing upward to telomere on chrosomal short arm and 5'-terminus of this base sequence : 172378
taacagaaatcttattcacctcagaaactttgccatgcaaaaagacagaaatcttagttatccacatttccctcttctgtttgtctttagaggcagctggtctcatggagagagagagagagagagagagagagagagagtgtgtgtgtgtgtgtgtgtgtgtgtgtgtgtgtgtgtgtgtggtggggggagttaggtagagaccaggatagggcagatggtctgtcaaaggatgtggatgccaagctataaaaatcgtaaagcatattttttcatgacagcattaatttcttgacagaatccataagtctcagtgttggcagctataaaagtccctctggggctctcacatgagtggctgttaccaggaaggcccgactgtgtagccttttctttcctgatggaaacacactggtttatattaagtaacctccgattcatag

SEQ ID NO: 2126 - DNA, 458 bp, Homo sapiens
  chr1.fa.O7frz.273385736
  Located on chromosome 1
  Distance between a terminus base of telomere on chromosomal short arm and 5'-terminus of this base sequence : 246361851
  Distance between 3'-terminus of neighbour sequence of sequence listing upward to telomere on chrosomal short arm and 5'-terminus of this base sequence : 240468
ctcatgagaactcacttgctatcacgagaacagcatgggggaaactgcccccatgatccaatcacctcccaccaggtccctccctcaaaatgtggggattctaaggatacaatttgagatgaaatttgggtggggacacagagccaaaccatatcagtatataaactatttcagagagtattccaattctttttattaagctaatataattcttattttaaaatctgaagaaactattgcaaatattattttaaaatattacacacattatatatttatattatatatttatattttattatatatttatattttatataggttacatatatctatatatatatttgatgtagattgtctctctctctctctctctctagctatatagatagatagataaatagacagatactaggaacacagaggagagcatgatgtataatctgcctggaaagttt

SEQ ID NO: 2127 - DNA, 451 bp, Homo sapiens
  chr1.fa.O7frz.273463737
  Located on chromosome 1
  Distance between a terminus base of telomere on chromosomal short arm and 5'-terminus of this base sequence : 246456153
  Distance between 3'-terminus of neighbour sequence of sequence listing upward to telomere on chrosomal short arm and 5'-terminus of this base sequence : 93844
atttcagtttcaatgtatgcaccataatgcattcatttgctcagtccacattctgggaggttatcctttcatcctctttagaaaaaatccttttagttcttttcttaaatatacatattttttatatataagatatataatatagtttattaatgctaatattacttatatagtttattataatatataataaactatatattataaactatgtaatatacatataaatgatatataatataaactaaatatataaactatgtgtgtgcatatatatatatatatatatatataattttcatagcttctatcacaccttggcccaaggcatcataatttcttactgatattattataacgacttcttttttgtacaaccttttactagtactgttttcctcaaaacgattcccgcactgctgccgggttgatctttctgaaatgcaattct

SEQ ID NO: 2128 - DNA, 257 bp, Homo sapiens
  chr1.fa.O7frz.273689599
  Located on chromosome 1
  Distance between a terminus base of telomere on chromosomal short arm and 5'-terminus of this base sequence : 246677922
  Distance between 3'-terminus of neighbour sequence of sequence listing upward to telomere on chrosomal short arm and 5'-terminus of this base sequence : 221318
atacttcctattcctcatgcacccacaacagactatgatccctttgcctttctcaatttcccttgaatttctcttgtatattttctgacatttgtgcaaattaagacaaattattgatacccaacattctcaaactaacaaataaaaatgcttatatatatatatatatatatatatataaagagccataaccgggtagataaaaattatatagatgtttgtgtttgcaatgaacagatagaaatatccactgatgt

SEQ ID NO: 2129 - DNA, 291 bp, Homo sapiens
  chr1.fa.O7frz.273765213
  Located on chromosome 1
  Distance between a terminus base of telomere on chromosomal short arm and 5'-terminus of this base sequence : 246754342
  Distance between 3'-terminus of neighbour sequence of sequence listing upward to telomere on chrosomal short arm and 5'-terminus of this base sequence : 76163
gtactaaagccgtccttgatacaggtttccctcatgaaaatatactgaaccctttatttgcttctgaaaagcaattttaaaatccaagaatgaaagaacaatatctattggttgcaaaagttgtagctggggtgtgtgtgtgtgtgtgtgtgtgtgtgtgtgtgtaacttgcctgtgtaacaactcgagtacacctaacactgacccctttctcccaatccaggttagtaggtcaggatatgtattagtatgtatttgtctggtcttgccttgctgtaaagaaatacctga

SEQ ID NO: 2130 - DNA, 101 bp, Homo sapiens
  DISO7_10000832
  Located on chromosome 1
  Distance between a terminus base of telomere on chromosomal short arm and 5'-terminus of this base sequence : 246851864
  Distance between 3'-terminus of neighbour sequence of sequence listing upward to telomere on chrosomal short arm and 5'-terminus of this base sequence : 97231
tgagattctgcaatttaagctggacacacacacacacacacacacacacacacacacacacacacacacacacaggcttgctagacttacacatattctgc

SEQ ID NO: 2131 - DNA, 465 bp, Homo sapiens
  chr1.fa.O7frz.240400425
  Located on chromosome 1
  Distance between a terminus base of telomere on chromosomal short arm and 5'-terminus of this base sequence : 247070613
  Distance between 3'-terminus of neighbour sequence of sequence listing upward to telomere on chrosomal short arm and 5'-terminus of this base sequence : 218648
tttcagacttcaacttacagaatactagagggagaacatgtaggagaaaaagctaaaacccgtaaataattaaatcaactaaggcacaaagatcatgcatgaatgataattgataaatatatcttgcattttaacaacagatagttatttcaaaacttgtcatatctatatctctgtgagtggggaattcatattctcaataaaataattccatatccttcccttaaatcattacccctcttattttgaaacaatgaaattcagaacacaggaagcaacaatttgttttggatcattacctggtgattttattaaccctttctttcttagaagcatctttatttgtgtgtgtgtgtgtgtgtgtctgtgtttgtgtgtgtgtgtgtgtgtttaacctacagagttgagtgattataatttttgagctggagcttgagaagaaagtaagaaccgagttgatggtat

SEQ ID NO: 2132 - DNA, 372 bp, Homo sapiens
  chr1.fa.O7frz.240520003
  Located on chromosome 1
  Distance between a terminus base of telomere on chromosomal short arm and 5'-terminus of this base sequence : 247292538
  Distance between 3'-terminus of neighbour sequence of sequence listing upward to telomere on chrosomal short arm and 5'-terminus of this base sequence : 221460
ttgtgacattgaataaggaaagatttcataaatagaacacaaaaatacaatctagaaaagaacaaaacaacgcaaaaaataaacttcttcaaaatcagcaacctttaccctttgtattagttagggctctccagagaaagagaaaaaatggtatgtgtgtgtgtgtgtgtgtgtgagagagacagaaagagagatagagggcaacaaagaaatagagatttattttaagaaattggctcatgcaattgtgcagacttggtaaatccaaaatttgcagggtaggcctgcagttcagctcaaagcgagtctgctggcagaattccttcttgcccagtgtgatgattaatgttgtgtcaacttgactgagctaag

SEQ ID NO: 2133 - DNA, 152 bp, Homo sapiens
  DISO7_10000771
  Located on chromosome 1
  Distance between a terminus base of telomere on chromosomal short arm and 5'-terminus of this base sequence : 247319019
  Distance between 3'-terminus of neighbour sequence of sequence listing upward to telomere on chrosomal short arm and 5'-terminus of this base sequence : 26109
ttctcttggatagacaccagtaagttttatatatatatatatatatatatatatatatatatatatatatatatatacacacacacactcacacacacacacacacgattaaaattctcttgtttttaatacatgtgggtatgactatgcat

SEQ ID NO: 2134 - DNA, 143 bp, Homo sapiens
  DISO7_10000772
  Located on chromosome 1
  Distance between a terminus base of telomere on chromosomal short arm and 5'-terminus of this base sequence : 247358832
  Distance between 3'-terminus of neighbour sequence of sequence listing upward to telomere on chrosomal short arm and 5'-terminus of this base sequence : 39661
ttgaatgtttattaccaattctgagaaaaataaacctcaaagaatacctagccctttctttaccattgctttctctcaaattcacacacacacacacacacacacacacacacacacacacacacgggctccttgtcaatgag

SEQ ID NO: 2135 - DNA, 158 bp, Homo sapiens
  DISD22_0001284
  Located on chromosome 1
  Distance between a terminus base of telomere on chromosomal short arm and 5'-terminus of this base sequence : 247462728
  Distance between 3'-terminus of neighbour sequence of sequence listing upward to telomere on chrosomal short arm and 5'-terminus of this base sequence : 103753
cccaacatcactggtgtactagtaaatgtttagtagtagattccctaggaagaaacacacacacacatacacacacacacacacaaataaaacaaactgttttgtattgtttgccaatttatgtggtgtaaatattcccactatggtcagtttcaagc

SEQ ID NO: 2136 - DNA, 256 bp, Homo sapiens
  Z66797
  Located on chromosome 1
  Distance between a terminus base of telomere on chromosomal short arm and 5'-terminus of this base sequence : 247727341
  Distance between 3'-terminus of neighbour sequence of sequence listing upward to telomere on chrosomal short arm and 5'-terminus of this base sequence : 264455
gattcctgggctgccagaataagaatacatgctttcaagaatcttccaatcttcccagattgggaaatgacaactattagcctggaacaatcaaacatttggatatcaccatattcaggtacaaagttagggttaaagcaaaggctatttgtaacctcaagtactttctaccatacctcctaaagaaattgtgtatgcaacccacacacacacacacacacacacacacacacgtgagtgctataatttggtccca

SEQ ID NO: 2137 - DNA, 125 bp, Homo sapiens
  D1S2670
  Located on chromosome 1
  Distance between a terminus base of telomere on chromosomal short arm and 5'-terminus of this base sequence : 247750886
  Distance between 3'-terminus of neighbour sequence of sequence listing upward to telomere on chrosomal short arm and 5'-terminus of this base sequence : 23289
aaagactggctagcaatgttatatctttcattttattttctgatttaaaaaagtgtgtgtgtgtgtgtgtgtgtgtgtgtgtacgcgcgcgcgcgcgcgcgtgcacgtcagtgtcttcttcatgg

SEQ ID NO: 2138 - DNA, 346 bp, Homo sapiens
  chr1.fa.O7frz.241078302
  Located on chromosome 1
  Distance between a terminus base of telomere on chromosomal short arm and 5'-terminus of this base sequence : 247917923
  Distance between 3'-terminus of neighbour sequence of sequence listing upward to telomere on chrosomal short arm and 5'-terminus of this base sequence : 166912
aacgataagctcactgcagcctcaaccttttgggcacaagtgatcttttcaccccagtctcccaaatagctgggactacaggctcatgctccacacctgactaatattattattattattattattattattattattaattatttttgtagagacggggtttcacttaattgccccggctggtccccatttcttgggctcaagagatcctcccttcttggcatcccaaggttttgggattgcaggtgtgagccaccacaccctacctggaagaaatattttttattgtttcaaaagctaatacctgacaaaatacctgcttgtttcctgatacctttatgagtct

SEQ ID NO: 2139 - DNA, 349 bp, Homo sapiens
  AL356361.5_97452
  Located on chromosome 1
  Distance between a terminus base of telomere on chromosomal short arm and 5'-terminus of this base sequence : 248299041
  Distance between 3'-terminus of neighbour sequence of sequence listing upward to telomere on chrosomal short arm and 5'-terminus of this base sequence : 380772
gctatagcctggatgtcagagcaagactctgtctcagaaaaaaaaaagaagaaagaagaaagaagaaaaagaaagaaagaaagaaagaaagaaagaaagaaagaaagaaagaaagaaagaaagaaagaaagaaagaaaggaaggaaggaaagaaagaaagaagggaggaggggagggagggaggcaggcaggaaggaaggaaaagaaaagaaaagagaagagcaaagaaaagaaaaggacaatggaatgaaaagggtgcatataccaagaggaattcattcaaatgaggctcagcactgaaccctcagtctaaggaaagaggctgctcctgtcttattggaaatgagcc

SEQ ID NO: 2140 - DNA, 440 bp, Homo sapiens
  chr1.fa.O7frz.241466646
  Located on chromosome 1
  Distance between a terminus base of telomere on chromosomal short arm and 5'-terminus of this base sequence : 248366921
  Distance between 3'-terminus of neighbour sequence of sequence listing upward to telomere on chrosomal short arm and 5'-terminus of this base sequence : 67531
agtcatagaattaactcaatgcagttattcttttctcatcacaaacagctcttccccatcccttacgcaaaagggctgagaagatacataaataaaacaatgcaacacatagatagatagatagatagagagagagagagagagagagagagagggagggagagatagctttgatctcagggagagaagttgtttcaatcaacgttttcatacatttggaaatcatagaatttttatacactaaaggaaaacgtgttgttccaaactttaccccataccactcctcctgtttaatatctagttagggtcaaagccagcaccaggcactcaggggcagacagggcggggaaggcaagtcctccgagttaagttataattcaattaacttgatttactggatgcctactatttaaacgcactggcctagaatctggagatac

SEQ ID NO: 2141 - DNA, 174 bp, Homo sapiens
  DISO7_10000777
  Located on chromosome 1
  Distance between a terminus base of telomere on chromosomal short arm and 5'-terminus of this base sequence : 248525252
  Distance between 3'-terminus of neighbour sequence of sequence listing upward to telomere on chrosomal short arm and 5'-terminus of this base sequence : 157891
gaattatttgcatacatggagagatatatatatatatctgtgtatatatatatatatatatatatatatttgtgtatatatatatatctatatctgtgtatatatatatatacacacacacacacacacacacacatacacacatattcttttggtcttcagtttgttcctcat

SEQ ID NO: 2142 - DNA, 119 bp, Homo sapiens
  DISO7_10000779
  Located on chromosome 1
  Distance between a terminus base of telomere on chromosomal short arm and 5'-terminus of this base sequence : 248662077
  Distance between 3'-terminus of neighbour sequence of sequence listing upward to telomere on chrosomal short arm and 5'-terminus of this base sequence : 136651
agcattgttctgtgcacttcatacacacacacacacacacacacacacacacacacactcacacacacttaaaattttaaaatatgtaactgaaaaagattgaatacattcattccagg

SEQ ID NO: 2143 - DNA, 450 bp, Homo sapiens
  chr1.fa.O7frz.241902791
  Located on chromosome 1
  Distance between a terminus base of telomere on chromosomal short arm and 5'-terminus of this base sequence : 248791912
  Distance between 3'-terminus of neighbour sequence of sequence listing upward to telomere on chrosomal short arm and 5'-terminus of this base sequence : 129716
ttccttaaagaggttaaatcctagtggagggagagccatagttatcacacatagaaaatatcttgtgtttctgatggcggtcagtgctgtagagaaaaggaaggaatattcaggggtggctgttgtggaaggttgggccaagtgttcagcttttactttggcttctcatgaggatctcactaagcaaggatttgaatgaggtgagagagagagagagagagagagagagagagccgtgagacacttgggtgaagagcattccaggcagatgaaaaacaagtatggcatcaaaacgtcatgctctgtgaggccagaatgacagaagcgaaaactcggtaggtaaagatgggatattactgctctagttggaatgggaagcctctctggcatcagctagccaaaagtaaagtaaaaacacttatgattctgaaagtcagctcatctttagct

SEQ ID NO: 2144 - DNA, 222 bp, Homo sapiens
  AL358176.2_133763
  Located on chromosome 1
  Distance between a terminus base of telomere on chromosomal short arm and 5'-terminus of this base sequence : 249058879
  Distance between 3'-terminus of neighbour sequence of sequence listing upward to telomere on chrosomal short arm and 5'-terminus of this base sequence : 266517
ttatgtcaagtactggaataaccactttatataagagatatatatagatagatagatagatagatagatagatagatagatagatagatatatggcaagaaccacctcaggtaagaatcatcatcatcatcaccatcaccatttcatagagaagaaatacttagagaagttaagtctctatctaaatatagttaattagtaaatagccaagataggagtcaa

SEQ ID NO: 2145 - DNA, 264 bp, Homo sapiens
  AL358176.2_15454
  Located on chromosome 1
  Distance between a terminus base of telomere on chromosomal short arm and 5'-terminus of this base sequence : 249076656
  Distance between 3'-terminus of neighbour sequence of sequence listing upward to telomere on chrosomal short arm and 5'-terminus of this base sequence : 17555
caggcggatttacagattaatgatttgttaaaacaaacaaacaaacaaacaaacaaactcctggcacaatgtcctgcttttctccaacaatgctcagaagactcagtgaatgtgagtgtgacccaggatggaggatagcataacaaaaggtaaaatgatcagattctgtgccggggtacttggggagtagtggggaaactgaataggacacaatgtagcatcagttgttttgcattaaaaatgacaggtggaaatagaactcta

SEQ ID NO: 2146 - DNA, 120 bp, Homo sapiens
  D1S1594
  Located on chromosome 1
  Distance between a terminus base of telomere on chromosomal short arm and 5'-terminus of this base sequence : 249142256
  Distance between 3'-terminus of neighbour sequence of sequence listing upward to telomere on chrosomal short arm and 5'-terminus of this base sequence : 65336
tttgatgagcttgaactagggttatctctctatcatccatctatctatctatctatctatctatctatctatctatctatctctctctctatctgtagctaactttgtcatttgatagca

SEQ ID NO: 2147 - DNA, 235 bp, Homo sapiens
  chr1.fa.O7frz.274231318
  Located on chromosome 1
  Distance between a terminus base of telomere on chromosomal short arm and 5'-terminus of this base sequence : 249359473
  Distance between 3'-terminus of neighbour sequence of sequence listing upward to telomere on chrosomal short arm and 5'-terminus of this base sequence : 217097
cgactttggcttaattctaaacataattggaagccactggagagttttaaacaggagagtgacttcatatgatttatttttcaaaactcattcagaccttacactccacacacacacacacacacacacacacacacacacacacaaactcaaaatgaatcataaacctaaatgtaaaatgctaaattataaaatttttagaaaataacaggagaacatctaggtgaccttgagt

SEQ ID NO: 2148 - DNA, 175 bp, Homo sapiens
  Z66679
  Located on chromosome 1
  Distance between a terminus base of telomere on chromosomal short arm and 5'-terminus of this base sequence : 249618813
  Distance between 3'-terminus of neighbour sequence of sequence listing upward to telomere on chrosomal short arm and 5'-terminus of this base sequence : 259105
aactgcagacaggcttcctttgctgctctctgcacaggggcattacccagcccctaggttacattgcctcagtgccagacatacataaacacacacacacacacacacacacacacacacacacacagagtcacacacacacttcaccaaagttctgggaatctcaacagaagcc

SEQ ID NO: 2149 - DNA, 172 bp, Homo sapiens
  D1S304
  Located on chromosome 1
  Distance between a terminus base of telomere on chromosomal short arm and 5'-terminus of this base sequence : 249650041
  Distance between 3'-terminus of neighbour sequence of sequence listing upward to telomere on chrosomal short arm and 5'-terminus of this base sequence : 31053
accctttttcctccaatcatctagatacccgacatgcacaaagacatggacacacacacacacacacacacacacacgctgaattcatcctccctttgatccacagaaaaccaagggttcctcctctgctctcccacagaacagcatccctcccactcagctttcagcttct

SEQ ID NO: 2150 - DNA, 380 bp, Homo sapiens
  chr1.fa.O7frz.274590647
  Located on chromosome 1
  Distance between a terminus base of telomere on chromosomal short arm and 5'-terminus of this base sequence : 249760442
  Distance between 3'-terminus of neighbour sequence of sequence listing upward to telomere on chrosomal short arm and 5'-terminus of this base sequence : 110229
tttgcttactgaatctgcttcccagaacagtggctgatgagaagcctaggcaccaattttctcattcccatttccctcaacctaatatagggagtgagatacaagggtgaacccctaggagatgcactttgagagagagagagagagagagagaaagacagacagagacagaggagaggagagagtaagagttagctctctggctttcctggcttcctctcattttctgtttttatatgcattttatttgttcacatgtttttaaagtctgcagtttgagaccatgagatgacaaggagagaactgaaagccaaacttttgagaatacttaagagaaagttaccaagtgcctgagtcttctatgatatcactgagcaaat

SEQ ID NO: 2151 - DNA, 286 bp, Homo sapiens
  chr1.fa.O7frz.274556935
  Located on chromosome 1
  Distance between a terminus base of telomere on chromosomal short arm and 5'-terminus of this base sequence : 249781518
  Distance between 3'-terminus of neighbour sequence of sequence listing upward to telomere on chrosomal short arm and 5'-terminus of this base sequence : 20696
catagcaaggatatttgtcaacttctcccgtaggccaagaccccagttattcttaaactaccactagaaatacacacacacacacacacacacacacacacacacacgtgtgtgtatctatatatacatattgtatatatatgtgtatatatgtgtgtgtgtgtatacactatatatattgtgtatatatacagtgtacatatatacacacacacattgcttttctaagactactgtcttagtccatttgggctgctataacaaagtatctgaaaccggataattt

SEQ ID NO: 2152 - DNA, 281 bp, Homo sapiens
  AL359764.8_80791
  Located on chromosome 1
  Distance between a terminus base of telomere on chromosomal short arm and 5'-terminus of this base sequence : 249882293
  Distance between 3'-terminus of neighbour sequence of sequence listing upward to telomere on chrosomal short arm and 5'-terminus of this base sequence : 100489
ctaacgactccgctgaaagtcccagggaagcagatgatttattattattattattattattattattattattattattattattattatgcttaaataacagagtagagagatattgagacaccctaggaatgaaggaaatggccaggaccaaatgaatcattcatccccgtttgcctgcggttttcacagcttcttcctaagttggagaaatgggaaacgatttgaaagctgccaaccggaggtgaaaatcttgccacttgtgaaactgaaggaacatc

SEQ ID NO: 2153 - DNA, 250 bp, Homo sapiens
  D1S204
  Located on chromosome 1
  Distance between a terminus base of telomere on chromosomal short arm and 5'-terminus of this base sequence : 249967653
  Distance between 3'-terminus of neighbour sequence of sequence listing upward to telomere on chrosomal short arm and 5'-terminus of this base sequence : 85079
ctaacactcagaaagcactcaataaatgtaagatttttttccttcattctgccgtataagttgtttacctaagtaggtaagttagtggtaattccaacatttatctgtctaaatatcaagaaaacacattgatttaaaaagacatttttgcagcatatatgtgtgtgtgtgtgtgtgtgtgcacacttatatttttaatgcatacatcatgctccatatatttgcatggcagcaatttgagcctaaagta

SEQ ID NO: 2154 - DNA, 186 bp, Homo sapiens
  Z66804
  Located on chromosome 1
  Distance between a terminus base of telomere on chromosomal short arm and 5'-terminus of this base sequence : 250037529
  Distance between 3'-terminus of neighbour sequence of sequence listing upward to telomere on chrosomal short arm and 5'-terminus of this base sequence : 69626
tattagcatgttggcatccccagtctctatctcatgcaatgagggtgtgtgtgtgtgtgtgtgtgtgtgtgtatatgagaaacacacactttctgttcattttttcctaaacaaaattaggatcgtaaaatacatatatttttgcaaactttcctccctatttctcataggctaggctttgtgcat

SEQ ID NO: 2155 - DNA, 285 bp, Homo sapiens
  G07828
  Located on chromosome 1
  Distance between a terminus base of telomere on chromosomal short arm and 5'-terminus of this base sequence : 250117299
  Distance between 3'-terminus of neighbour sequence of sequence listing upward to telomere on chrosomal short arm and 5'-terminus of this base sequence : 79584
aattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcag

SEQ ID NO: 2156 - DNA, 364 bp, Homo sapiens
  AL355992.3_123361
  Located on chromosome 1
  Distance between a terminus base of telomere on chromosomal short arm and 5'-terminus of this base sequence : 250130947
  Distance between 3'-terminus of neighbour sequence of sequence listing upward to telomere on chrosomal short arm and 5'-terminus of this base sequence : 13363
cctgtaatctcagcactttgagaggccgaggcgggtggatcacctgaggtcaggggtttaagaccagcctggccaacatggcgaaaccctgtctctactaaaaatacaaaatattagctgggcgcggtggcagaagcctgtaatcctggctacttgggaggctgaggcaggaaaattgtatgaaccagggaggtggaggttgcagtgagccgagttcgtgccattgcactccagcctgggcaacaagagtgagactctgattcaaaataaataaataaataaataaataaataaataaataaataaaataaataaaataacttggaggtttctaacctgcctaaggaatagcgagtgattacat

SEQ ID NO: 2157 - DNA, 235 bp, Homo sapiens
  AC004783.1_77955
  Located on chromosome 1
  Distance between a terminus base of telomere on chromosomal short arm and 5'-terminus of this base sequence : 250281583
  Distance between 3'-terminus of neighbour sequence of sequence listing upward to telomere on chrosomal short arm and 5'-terminus of this base sequence : 150272
gtagaagtgcaagtttgttacataggtaaacttgtgtcatggaggtttgttgtacagattattttatcacccaggtaattttcttaataactgccaagagctcattattctttttttctgataatctccctctctctctctctctctctctctctcccctcttttcctcacccccaacccttactattttaatatatacccaacctttactctgtattccagatgtttattctgt

SEQ ID NO: 2158 - DNA, 385 bp, Homo sapiens
  chr1.fa.O7frz.275262535
  Located on chromosome 1
  Distance between a terminus base of telomere on chromosomal short arm and 5'-terminus of this base sequence : 250443242
  Distance between 3'-terminus of neighbour sequence of sequence listing upward to telomere on chrosomal short arm and 5'-terminus of this base sequence : 161424
atttgaattatcttcaaatgtgatggggccatgcgcttaccaaaaataaaataaaataataaaataaaataaaataaaataaaataaaataaaataaaataaaataaataaaataaactactactgaggtacacgaagaccaaactgctgcttggacatacgcacaatgggtaaaatgtgcccccgccctccacccggctactgactctttgttgccctctgctgttcctcatgttggctacatcgagttactgcaaatagagccaactctgcaaattgaccaagtgacaaatgatcacattgaacaaatttcctgactgtggttttaacagcattgacatgaatgttccattctcagttactgaagatgaaattctaaacgtta

SEQ ID NO: 2159 - DNA, 413 bp, Homo sapiens
  AC012079.4_71311
  Located on chromosome 1
  Distance between a terminus base of telomere on chromosomal short arm and 5'-terminus of this base sequence : 250648904
  Distance between 3'-terminus of neighbour sequence of sequence listing upward to telomere on chrosomal short arm and 5'-terminus of this base sequence : 205277
agtggtatgatatgcttcaatgtccattgaattgagctgtacatgtaattctgttactgataaaatgaaagttccaaagaatgaagcctaatttgcctttataaattagatttaccattattcctactataaagtcatagtcacttgctttctggtagccttttgagagtgagagacaataataatagtaataataataataataataataataataataataataaatagtagccatgttggctagttggctataacagggtcctggatggacacagtgactgtgatagcagcattcacagtgacaactataataactaacttattagtttgttctcatgctgctaataaagacatatccaagactgggtcatttataaagaaaaagaagtttaatggactaacagttccac

SEQ ID NO: 2160 - DNA, 174 bp, Homo sapiens
  D1S1634
  Located on chromosome 1
  Distance between a terminus base of telomere on chromosomal short arm and 5'-terminus of this base sequence : 250649038
  Distance between 3'-terminus of neighbour sequence of sequence listing upward to telomere on chrosomal short arm and 5'-terminus of this base sequence : -279
tcatagtcacttgctttctggtagccttttgagagtgagagacaataataatagtaataataataataataataataataataataataataaatagtagccatgttggctagttggctataacagggtcctggatggacacagtgactgtgatagcagcattcacagtgacaa

SEQ ID NO: 2161 - DNA, 303 bp, Homo sapiens
  HUMUT498
  Located on chromosome 1
  Distance between a terminus base of telomere on chromosomal short arm and 5'-terminus of this base sequence : 250661809
  Distance between 3'-terminus of neighbour sequence of sequence listing upward to telomere on chrosomal short arm and 5'-terminus of this base sequence : 12597
gggaggctgaggtaggagaattgcttgaagccaggaggcggaggttgcagtgagctgagattttgccactgcactccagcctaggtgacagagtgagactctgtctcaaaacaaaaccaaaattgagtgtgtgtgtgtgtgtgtgtgtgtgtagggaggacagttgatggttaacctgtgagctattttcagtgtttcaaatatcatcacactttcagtgcacactcactaaaatctcgagtgcttttgcttttagtttatttaaacatagcagggtaatgcttatgcagggtagtgagtggt

SEQ ID NO: 2162 - DNA, 242 bp, Homo sapiens
  AC012079.4_15654
  Located on chromosome 1
  Distance between a terminus base of telomere on chromosomal short arm and 5'-terminus of this base sequence : 250676552
  Distance between 3'-terminus of neighbour sequence of sequence listing upward to telomere on chrosomal short arm and 5'-terminus of this base sequence : 14440
caagtggataaactgtgagctatctctatatctatctatctatctatctatctatctatctatctatgtatctatctatgtatctatctatctatctatctatctatctatctatctatctatctatctacctatctatgatagaatactactcagccataaaaaagaatgaattaatgccattcacagcaaactggatgggactggagattattattctaagtgaagtaactcaggaatgg

SEQ ID NO: 2163 - DNA, 472 bp, Homo sapiens
  chr1.fa.O7frz.275639174
  Located on chromosome 1
  Distance between a terminus base of telomere on chromosomal short arm and 5'-terminus of this base sequence : 250788327
  Distance between 3'-terminus of neighbour sequence of sequence listing upward to telomere on chrosomal short arm and 5'-terminus of this base sequence : 111533
tatggttactgtgatcctgaacctccccttccatgctccagcctactaagcttatgatcaaggaattccctgtggattacacggatatcccttgactgaaaacggctcatgctggcagggatgagagatcaagttgtgaaactgttctggaagcaagaaatggtggtctctaaccagtgatatatatatttttaacataatctaagcttgtctgcctgcacaaagaagcatttgctaagataaaaaggaaagaacatacaaaattaaaatttgccatttatccagaaatgaaccaactcgcccaccatgtaacaaacagaaaactgcactcatattaccaaggaatgctacactgagaaagagaataagaatttattaaaacacacacacacacacacacacacacacacacacacacacacacacacacaccccacttacgcaaacaaactctttgtaggtacaggtgcta

SEQ ID NO: 2164 - DNA, 313 bp, Homo sapiens
  AC026828.3_10991
  Located on chromosome 1
  Distance between a terminus base of telomere on chromosomal short arm and 5'-terminus of this base sequence : 250791111
  Distance between 3'-terminus of neighbour sequence of sequence listing upward to telomere on chrosomal short arm and 5'-terminus of this base sequence : 2312
ccatagaaagcatgtagagcaggggtgcccaagggagagaacacagtcatggcttcttagtttctgtgtttggtctggttgggccagtaaagccccttcctcatcccgcttttctgcttactactagagacagaaattaaaaaccatggccttgggctgataaaacccaacaaaacagaacaacaacaacaacaacaaaataaggagggttgggcaatcttgatgtagactaagttttcttttctttttttttttttttttaagatggagtctcactctgttgcccaagctggagtgcaatggcactaaacct

SEQ ID NO: 2165 - DNA, 142 bp, Homo sapiens
  DISD22_0001302
  Located on chromosome 1
  Distance between a terminus base of telomere on chromosomal short arm and 5'-terminus of this base sequence : 251130470
  Distance between 3'-terminus of neighbour sequence of sequence listing upward to telomere on chrosomal short arm and 5'-terminus of this base sequence : 339046
ccactgcagatgacattaaatagtaaatacatgatttgagtgtgttcttttccaggttgtatgtgaatgtgtgtgtgtgtgtgtgtgtgtgtgtgtgtgtgtgtgtggttggttgttttgtttccaaggtatatcccaagca

SEQ ID NO: 2166 - DNA, 219 bp, Homo sapiens
  D1S2842
  Located on chromosome 1
  Distance between a terminus base of telomere on chromosomal short arm and 5'-terminus of this base sequence : 251225261
  Distance between 3'-terminus of neighbour sequence of sequence listing upward to telomere on chrosomal short arm and 5'-terminus of this base sequence : 94649
tcacctgacctgtcccttaaaatacagaatctcgattaatatatatagaatctgtcatcttaaatacacacatgcatacacacacacacacacacacacacacacacacactccatgacatctccattcttacagtagcactcaaggaatgtttgttgtcaagttacagagtagcaggctgcttagagagaggcaagttcattttgtggctgagaacca

SEQ ID NO: 2167 - DNA, 192 bp, Homo sapiens
  D1S2679
  Located on chromosome 1
  Distance between a terminus base of telomere on chromosomal short arm and 5'-terminus of this base sequence : 251343368
  Distance between 3'-terminus of neighbour sequence of sequence listing upward to telomere on chrosomal short arm and 5'-terminus of this base sequence : 117888
ctaggcagcaagagcatctgtcccactcaaaagagcagcaacagacctggagaaaggaactccatttctttctcattatatatattctccatatgtttaaatatttacacacacacacacacacacacacacacatatcaatggaaacaaatgaaaaccagacctaagttcattattaaaatcccggctatg

SEQ ID NO: 2168 - DNA, 343 bp, Homo sapiens
  HUMUT1917
  Located on chromosome 1
  Distance between a terminus base of telomere on chromosomal short arm and 5'-terminus of this base sequence : 251388059
  Distance between 3'-terminus of neighbour sequence of sequence listing upward to telomere on chrosomal short arm and 5'-terminus of this base sequence : 44499
gggacaagtagaaagggcatggaaaaagtattcttagggctaacttgtttttaatctagagaggagaatttgtggctacacagtattcattatattattatttgtacttttctgtgttttttgaaacttaatccaaaaacttaaatctgaaagaaggagagatgaagggaaggaggaagggaagaaaaggaaggaaggaaggaaggaaggaaggaaggaaggaaggaaggaaggaaggaattattttttccacacatttctttttcctgaaaggagaaaacaatttcccgaatcaatttataaaaataagcaactccagcttttcttcctctaccaccttcca

SEQ ID NO: 2169 - DNA, 225 bp, Homo sapiens
  DISO7_10000838
  Located on chromosome 1
  Distance between a terminus base of telomere on chromosomal short arm and 5'-terminus of this base sequence : 251644870
  Distance between 3'-terminus of neighbour sequence of sequence listing upward to telomere on chrosomal short arm and 5'-terminus of this base sequence : 256468
atggtggtcttgtgtttcccgtgtgtgtgtgtgtgtgtgtgtgtgtgtgtgtgtgtgtgtaatttttggtagagatgagggtctagccatgttgtccaggctggtcttgagctcttggcctcaagcaattctcctggcacagcctcccagggtactgggattgcagttgtgagtcactgtgcaaggcccctaaatctagataaatggccctacctccaagaccag

SEQ ID NO: 2170 - DNA, 260 bp, Homo sapiens
  DISO7_10000836
  Located on chromosome 1
  Distance between a terminus base of telomere on chromosomal short arm and 5'-terminus of this base sequence : 252004801
  Distance between 3'-terminus of neighbour sequence of sequence listing upward to telomere on chrosomal short arm and 5'-terminus of this base sequence : 359706
acatgatacatgccgtaaatgtttgttgaaaaagaataaaatatttctgctttcagggagctcaccaaagaataagaagaaaagcttaggataggagaaaaatagatatgaaagcacactctgtgtgtgtgtgtgtatgtgtgtgtgtgtgtgtgtaagtcactaacagcagagctcttatataatctctccccccaccgccccacaaactgatcaagcttttaattgtattgcttcccctagaagccttagataatgtg

SEQ ID NO: 2171 - DNA, 101 bp, Homo sapiens
  DISO7_10000835
  Located on chromosome 1
  Distance between a terminus base of telomere on chromosomal short arm and 5'-terminus of this base sequence : 252112581
  Distance between 3'-terminus of neighbour sequence of sequence listing upward to telomere on chrosomal short arm and 5'-terminus of this base sequence : 107520
atgacagtcatggagagtttctaccctctgtcaggaaatccgactctgtgtgtgagtgtgtgtgtgtgtgtgtgttcacatgcatgattgacacttcgctg

SEQ ID NO: 2172 - DNA, 444 bp, Homo sapiens
  AL356512.4_131448
  Located on chromosome 1
  Distance between a terminus base of telomere on chromosomal short arm and 5'-terminus of this base sequence : 252266819
  Distance between 3'-terminus of neighbour sequence of sequence listing upward to telomere on chrosomal short arm and 5'-terminus of this base sequence : 154137
agttaagcttccaagactccagacacatccaaatgaggtgctgcatgtggcactctgcctttcttaaaaaaggaagaaagaaagaaaaagaaagaaaaagaaagaaagaaagaaagaaagaaagaaagaaagaaagaaagaaagacaaatgagactacctcaaacttaaaaacttgtgtgcatcgaaagacacaatcaacagagtaaaaaggcaacctacaaaatggaagaaaacgtttgtaaatcatatatttggtaagaggttaacatccaaaatattcacaattatttaatatataagtaatttctacaactcaacaacaaaatatcaaataatcctatttaaaaatgggcaaaaacctaggcacagtggtgcacgcctgtagtcaaaagctactcaagaggttgaattgggaggatcacttaagtccaggaattcaaggt

SEQ ID NO: 2173 - DNA, 444 bp, Homo sapiens; identical to SEQ ID NO: 2172
  AC024005.2_46314
  Located on chromosome 1
  Distance between a terminus base of telomere on chromosomal short arm and 5'-terminus of this base sequence : 252266819
  Distance between 3'-terminus of neighbour sequence of sequence listing upward to telomere on chrosomal short arm and 5'-terminus of this base sequence : -444

SEQ ID NO: 2174 - DNA, 466 bp, Homo sapiens
  chr1.fa.O7frz.278518038
  Located on chromosome 1
  Distance between a terminus base of telomere on chromosomal short arm and 5'-terminus of this base sequence : 252324577
  Distance between 3'-terminus of neighbour sequence of sequence listing upward to telomere on chrosomal short arm and 5'-terminus of this base sequence : 57314
gtaagcatcttaagcaaattacacagatgatttttgttaattactcctcaaaaacatgtctttatcttccagactcttactcttcagagcgaactgagcgaactgcatgttggagtcacagtgacacctcttgttctaatgaaacttaactccttctgtgcctgagggctacagtggtccacagtttgttcattaatattgctccgggaagaagaaaagtcttatccaagttacatggcctccatccatggtacaccagagaacatggcaactgtttggctataaggttgcaaatgctaaaggtataatggaaattgtacctaaatgcaaggtacaaatgcttaaaacacacaccacacacacacacacacacacacacacacacaattattattcacaaaggcttgcagaaattttgtagttaaaattgaggccccacatctcattactaacaatgagctgatgc

SEQ ID NO: 2175 - DNA, 136 bp, Homo sapiens
  DISD22_0001312
  Located on chromosome 1
  Distance between a terminus base of telomere on chromosomal short arm and 5'-terminus of this base sequence : 252395429
  Distance between 3'-terminus of neighbour sequence of sequence listing upward to telomere on chrosomal short arm and 5'-terminus of this base sequence : 70386
aagccatcttcaaatagagacccgtgtgtgtgtgtgtgtgtgtgtgtgtgtgtgtgtcttgttataacagaatatctaagtttggaaaattgttcacttccctttactttatcttcccctttgcttgtaagttgcc

SEQ ID NO: 2176 - DNA, 155 bp, Homo sapiens
  chr1.fa.O7frz.278400063
  Located on chromosome 1
  Distance between a terminus base of telomere on chromosomal short arm and 5'-terminus of this base sequence : 252631238
  Distance between 3'-terminus of neighbour sequence of sequence listing upward to telomere on chrosomal short arm and 5'-terminus of this base sequence : 235673
gtaaccagacttcaaactatctgaaaacgtttgtgagaaggaacacacagacacgcacactcacacacacacacacacacacacacacacacacacagaactgctttggacttggatacttcctagtcctcctgttattcctatgaacgattcct

SEQ ID NO: 2177 - DNA, 136 bp, Homo sapiens
  Z67694
  Located on chromosome 1
  Distance between a terminus base of telomere on chromosomal short arm and 5'-terminus of this base sequence : 252724032
  Distance between 3'-terminus of neighbour sequence of sequence listing upward to telomere on chrosomal short arm and 5'-terminus of this base sequence : 92639
atttagcctggtgacctagaagtacttaggaaatgtgtgtgtgtgtgtgtgtgtgtgtgtgtgtgtgtgtgcacccgtgtatgagtatatgtgttttggttttccaatctttggttcacgaatgtagtccatattc

SEQ ID NO: 2178 - DNA, 164 bp, Homo sapiens
  D1S423
  Located on chromosome 1
  Distance between a terminus base of telomere on chromosomal short arm and 5'-terminus of this base sequence : 252768994
  Distance between 3'-terminus of neighbour sequence of sequence listing upward to telomere on chrosomal short arm and 5'-terminus of this base sequence : 44826
ggcctaagattgctgtgaagattaagttcattattctaaaagaaataaattgtttttggttctgtacactgttctaagcacaggtttgtgtgtgtgtgtgtgtgtgttttgtttcttgttttgttttgttttgtttttgaggcagagtttcattcttgttgccc

SEQ ID NO: 2179 - DNA, 358 bp, Homo sapiens
  AC024493.2_70342
  Located on chromosome 1
  Distance between a terminus base of telomere on chromosomal short arm and 5'-terminus of this base sequence : 252821406
  Distance between 3'-terminus of neighbour sequence of sequence listing upward to telomere on chrosomal short arm and 5'-terminus of this base sequence : 52248
cttatggctgttacctagagtcacctcccagttaacctaccagcaccctcatccttgtacaaggatatgtctgagggaacttggtataagatattggaagtatatgctcttttgtccatccatccatccatccatccatccatccatccatccatccatctctccatccacccattcatccatccatccatctctccatccatccatccatccatccatccatccatccatccatctctccatccatccatccatccatctctccatctacccatccatccatccatccatccatccatccatccatccatccacccacccaaccatccaacaagcatttggtaagctcatgctgtat

SEQ ID NO: 2180 - DNA, 434 bp, Homo sapiens
  AL357555.5_46932
  Located on chromosome 1
  Distance between a terminus base of telomere on chromosomal short arm and 5'-terminus of this base sequence : 252871101
  Distance between 3'-terminus of neighbour sequence of sequence listing upward to telomere on chrosomal short arm and 5'-terminus of this base sequence : 49337
cacagattaaactgctaaaggaattttgcagcaaaatgaaatagattttggagcattgtttggagattggagatttggactttgttccaaattgcagatttggagattgttccaacaatttggagctgcttctcctccttcttctccttctccttcttctttcttctttcctcctcctccttctcctcttcctcttcttcttcttcttcttcatattattattattattattattattattcttttaattcttcaaaggagaagctcccaagagagtcgatttgtgtgagagggcctgtgactgggcccctgagagttgcttttttttgaattaactgggataacaaaagacaagcaggcatcttggtattttaagtgtgttttcccaatggaaatagaaataaacacaacactgaccaagtattcaacagagg

SEQ ID NO: 2181 - DNA, 242 bp, Homo sapiens
  Z67507
  Located on chromosome 1
  Distance between a terminus base of telomere on chromosomal short arm and 5'-terminus of this base sequence : 253023351
  Distance between 3'-terminus of neighbour sequence of sequence listing upward to telomere on chrosomal short arm and 5'-terminus of this base sequence : 151816
ccatgttgcttaaaatgacaggatttcattatttttatggctgaataatattccattgtgtgtgtgtgtgtgtgtgtgtatctatctcacattttctttattaatttacccattgatggacacttagactgattctatattttggctattgtgaatagtgctacaataaacatggtagtgcagatacctctttgatatactgatttcttttactttggatatatactcagcagtgggattgc

SEQ ID NO: 2182 - DNA, 453 bp, Homo sapiens
  chr1.fa.O7frz.277854393
  Located on chromosome 1
  Distance between a terminus base of telomere on chromosomal short arm and 5'-terminus of this base sequence : 253268491
  Distance between 3'-terminus of neighbour sequence of sequence listing upward to telomere on chrosomal short arm and 5'-terminus of this base sequence : 244898
gctgaggaaagaattagtgaactgcaaggtaggtcaaatgaacatatccatcaaagatacagagacaatgtaacagaaataaacaggagcagaggtctcatatgtgtcaactggaatctcaaatgagagaaaggagagaatggggcagaagctatatatatacacacacacacacatacacacatatacatacatacatatatatacccacatatatacatacatatatacacatacatatatatacatgtatacatacatacatacatacatacatatggctgtaatggcggaacattttcaaaactaaagacagcaagtcacagattaaaaaatgctaagaattgcacagaaactacaataattcagcaaagggaaaaagaagaaggatgagggataaggtaggcgtggcaaaatcttgataagaattactgaagctggatgatagacata

SEQ ID NO: 2183 - DNA, 325 bp, Homo sapiens
  chr1.fa.O7frz.277833064
  Located on chromosome 1
  Distance between a terminus base of telomere on chromosomal short arm and 5'-terminus of this base sequence : 253289513
  Distance between 3'-terminus of neighbour sequence of sequence listing upward to telomere on chrosomal short arm and 5'-terminus of this base sequence : 20569
caatgacagaccatctgattagactgttttaaacattctaattttaaacttgtgtgtgtgtgtgtgtgtgtgtgtgtgtgtgtaagcggtatacgtattcccaaaaggctgttcgatgaaatttgatttatgtcctctttctgggcttactctcaaatatatatgaaagagtgctgactttgtacctagagggtttacaactgagccaactcattcattcattcactcattcatttattcattctcttcaaggaatatttattgagaacccacaatcagccaagcactcttctagatgctgggtaccgctctagatgagtgttac

SEQ ID NO: 2184 - DNA, 203 bp, Homo sapiens
  Z66683
  Located on chromosome 1
  Distance between a terminus base of telomere on chromosomal short arm and 5'-terminus of this base sequence : 253368013
  Distance between 3'-terminus of neighbour sequence of sequence listing upward to telomere on chrosomal short arm and 5'-terminus of this base sequence : 78175
aggcactgttctaggcagtagggatagagcagtaaataaatcagataatcatggtgttcatactgaagaggcaggtggaacacacggcaagagaagatatgtgcatgcgcgtgcgtgtgcgtgcgcgcgcacacacacacacacacacactcacacacacattttgttgggagaaaaacaaggaagagggatggggaatactg

SEQ ID NO: 2185 - DNA, 377 bp, Homo sapiens
  chr1.fa.O7frz.277542153
  Located on chromosome 1
  Distance between a terminus base of telomere on chromosomal short arm and 5'-terminus of this base sequence : 253488509
  Distance between 3'-terminus of neighbour sequence of sequence listing upward to telomere on chrosomal short arm and 5'-terminus of this base sequence : 120293
ctagaataaacgcagaggaatcactaggaggcaggtttggctttacgttattaaacagacaaaccaaaccaaacacacacacacacacacacacacacacacacaccgccacccacaaaccagtcctaaccacagggctacacaagcctcccctgcccagtcctaaccaacagagcttcccaaatggagctgtagctgcctgctcaagcgccacgatataatggagacaacccagtctctggaaacagaggctgccatttccagttctgattcagccattctcaggtgtgtagctctggtcaagttattttctctgagtctcagtttgctcaactggaaattattggagaacacttacctcaaagaattgttaagaa

SEQ ID NO: 2186 - DNA, 219 bp, Homo sapiens
  DISD22_0001314
  Located on chromosome 1
  Distance between a terminus base of telomere on chromosomal short arm and 5'-terminus of this base sequence : 253619040
  Distance between 3'-terminus of neighbour sequence of sequence listing upward to telomere on chrosomal short arm and 5'-terminus of this base sequence : 130154
ccaatggcaataaactataacatctatttccccccagagaaaatgagaaagaaaacaatattttatatatatattattaagtatatatatacttacacacacatacatacacacacacacacacacacacacacacacacatatattccattacttctgtccctctggagaaccctaactaatacaaccatttagcaactgtgtaatactaagcaattt

SEQ ID NO: 2187 - DNA, 270 bp, Homo sapiens
  D1S2836
  Located on chromosome 1
  Distance between a terminus base of telomere on chromosomal short arm and 5'-terminus of this base sequence : 253909455
  Distance between 3'-terminus of neighbour sequence of sequence listing upward to telomere on chrosomal short arm and 5'-terminus of this base sequence : 290196
tttaaccaaggaggtgaaagatatctatcaggaaaactttaacacagagatgaaaaaaattgaaggagacacacacacacacacacacacacacacacacacagaggaaaaaaaagggaaagaaatagaaatagaaaaaaaaagtcacctagcagaggcttgcaaaggtgcagattgccctcagggatttggtagataccagtcctcctgcccctggctgcagtgcagaatgtacaggaatggggaaggtcagggaggatttcattccag

SEQ ID NO: 2188 - DNA, 458 bp, Homo sapiens
  chr1.fa.O7frz.277447373
  Located on chromosome 1
  Distance between a terminus base of telomere on chromosomal short arm and 5'-terminus of this base sequence : 253991596
  Distance between 3'-terminus of neighbour sequence of sequence listing upward to telomere on chrosomal short arm and 5'-terminus of this base sequence : 81871
atagcatgctaaagcaatacacacacacacacacacacacacacacacacacacacttcagaggaatataagagaatccagaaacctataacatattaaaaatgttctgaataaaacccaaaattactagacatatgagggaagaggacagggtgacccattctcaagaaaaaaaaattcaatcaatgaaaaccaacccaaaatggcccaactgcctcaaaaactaggtaagaatgtttatagtcagctttcattactatgcccaagaaaagacaggaaaatatgcttgtaatgaacaaataggaaatatcaacaaagaatcttaaaaatgtgatatgaataaaatgtgaaatgaatgaaaaataatccaataaaaatggaagaggaagagaaagacacaaataaaagaaccagagagacggcagtgataagaactcagtcttacatggtaagaactc

SEQ ID NO: 2189 - DNA, 268 bp, Homo sapiens
  AL356975.6_48792
  Located on chromosome 1
  Distance between a terminus base of telomere on chromosomal short arm and 5'-terminus of this base sequence : 254029754
  Distance between 3'-terminus of neighbour sequence of sequence listing upward to telomere on chrosomal short arm and 5'-terminus of this base sequence : 37700
gagcctgtaatctcagatactcaggaggctgaggcaggagaatcgcttgaacccaggaggcggagcttgcagtgagccgagatcacgccactgccctccagcctgggcaacagagtaagactctgtctcaaaaaataaataaataaataaataaataaataaataaataaataaataaaatttaataaaaagagactacccattgtttccactagaattgctgccaagggaaatataccttttaaggatcaaggcttagaattgcttt

SEQ ID NO: 2190 - DNA, 335 bp, Homo sapiens
  AL358859.7_11733
  Located on chromosome 1
  Distance between a terminus base of telomere on chromosomal short arm and 5'-terminus of this base sequence : 254166820
  Distance between 3'-terminus of neighbour sequence of sequence listing upward to telomere on chrosomal short arm and 5'-terminus of this base sequence : 136798
tgattcaatgtcagaactcaatactgttctcttcagggtttcaatttcttcctgactcaatcttaagagattgtgtgtgtattagtcagggttctcttagagggacataactaataagatggatagatagatagatagatagatagatagatagatagatagatagatacacacacacatacatacatacatagatacatagatagatacatagatataaacgggagtttgttaagtattaacttacatgattacaaggtcccacaataggctgcaagctgaggagcaaggagagccagttcaagttccaaaactgaagaatttggagtctgatg

SEQ ID NO: 2191 - DNA, 146 bp, Homo sapiens
  chr1.fa.O7frz.280737549
  Located on chromosome 1
  Distance between a terminus base of telomere on chromosomal short arm and 5'-terminus of this base sequence : 254481930
  Distance between 3'-terminus of neighbour sequence of sequence listing upward to telomere on chrosomal short arm and 5'-terminus of this base sequence : 314775
aggttatgaaatcggaaactttaaaataattatcattcattgtttctatttgtgaaatatatatgtgtgtgtgtgtgtgtgtgtgtgtgtgtgtgtaaaacttatgaatggatataatcttatatacaaggttaaatgccattatc

SEQ ID NO: 2192 - DNA, 231 bp, Homo sapiens
  Z66783
  Located on chromosome 1
  Distance between a terminus base of telomere on chromosomal short arm and 5'-terminus of this base sequence : 254587913
  Distance between 3'-terminus of neighbour sequence of sequence listing upward to telomere on chrosomal short arm and 5'-terminus of this base sequence : 105837
tgcaagtaacagccaaaactcatgacagaataaaggaaagaaaatgaaaataacaatgtacatgagactatataaacttcacatacatgcaaattaataacaattctttattagcaaagaaaacagaagaaaatctttacaacaaaaaagtagttttcccataaaaaggtagaatacacacacacacacacacacacacacacacacatgaactcatttttcattggtcca

SEQ ID NO: 2193 - DNA, 101 bp, Homo sapiens
  DISD22_0001317
  Located on chromosome 1
  Distance between a terminus base of telomere on chromosomal short arm and 5'-terminus of this base sequence : 254733570
  Distance between 3'-terminus of neighbour sequence of sequence listing upward to telomere on chrosomal short arm and 5'-terminus of this base sequence : 145426
cagaatggaatcttgggaccattgtagttaaaaaaaatatatatatatatatatatttctgatcattagccacttgaagacaaggcaagaggcttagcagt

SEQ ID NO: 2194 - DNA, 439 bp, Homo sapiens
  chr1.fa.O7frz.281549419
  Located on chromosome 1
  Distance between a terminus base of telomere on chromosomal short arm and 5'-terminus of this base sequence : 254888267
  Distance between 3'-terminus of neighbour sequence of sequence listing upward to telomere on chrosomal short arm and 5'-terminus of this base sequence : 154596
ctagctgtgactttaacttggtagagcagaacatagtgacaaccatgaaaagtctaaattagaaaaatagataatgattgatgccttgttctactagatgacaaaatatactatacatcaacagctattaaaagtgttacaaatgtgaatgaaataaaataaatgaataaatattaatagaattgatattcctgaaataaatttgcacatatatgaaattttgaatatggtaaaggtataatttgaagcaaataatgaaaatacagctagcgaaataaattgttttgggacaattgactgaacatttggaaaacaacatctgtcttacacacacacacacacacacacacacacacactctgcagatgcagtgaattgaaaacctaaacataaaatagaaaaccataaaacgagaagataaatacaatctggaagatcg

SEQ ID NO: 2195 - DNA, 457 bp, Homo sapiens
  chr1.fa.O7frz.281457498
  Located on chromosome 1
  Distance between a terminus base of telomere on chromosomal short arm and 5'-terminus of this base sequence : 254981992
  Distance between 3'-terminus of neighbour sequence of sequence listing upward to telomere on chrosomal short arm and 5'-terminus of this base sequence : 93286
atgcagtaagttcaataccataagtggaaaataaaaccataaataatgttatattatttttcaattaatagattgcactgatatatttccataccatcttcttatctgatttatagattaagcacaacacattttagaatacacagttatttctttttttggggtgatagcagttctggatctgggcatgagcaatgcacatccatgaaagcaggtaaaagaaaagagggagtagtataatacgagttttgatgtgtggtgaattggatgagtctatatttcctttcagtggtgaaaggtgtgtgtgtgtgtgtgcgtgtgtgtgtgtgtgtagtctcgatgtatggtgggattggatgagtctatatttcttttcagtggtgaaagttctgtatgtgtgtgtgttcaatgaaaaggatgtgcacatttaaacatgtttgcattgactgaattttaa

SEQ ID NO: 2196 - DNA, 305 bp, Homo sapiens
  AL359674.4_58977
  Located on chromosome 1
  Distance between a terminus base of telomere on chromosomal short arm and 5'-terminus of this base sequence : 255247767
  Distance between 3'-terminus of neighbour sequence of sequence listing upward to telomere on chrosomal short arm and 5'-terminus of this base sequence : 265318
ctggctaacacggtgaaaccccgtctctactaaaaatacaaaaaattagccgggcgtggtggcgggcgcctgtagtcccagctactcgggaggctgaggcagaatggcgggaacccgggaggcagagcttgcagtgagcccagatcgcaccactgcactccagcctgggcgaagcgagaccccagctcaaaaataaataaataaataaataaataaataaataaataaataaataaagtaaaaatgcaaacctggttctgccacctccctgctgtgacgggctctcaaggtacattccaacaaga

SEQ ID NO: 2197 - DNA, 233 bp, Homo sapiens
  AL359674.4_160136
  Located on chromosome 1
  Distance between a terminus base of telomere on chromosomal short arm and 5'-terminus of this base sequence : 255304879
  Distance between 3'-terminus of neighbour sequence of sequence listing upward to telomere on chrosomal short arm and 5'-terminus of this base sequence : 56807
ccatttgtccataattagcaaccaatatatgttcacaaagctctgatactcccttggatggattgatggatggatggatggatggatggatggatggatggatggattgacggatggaaaatagagggatggatgatggatggatggatggatggacagatgaatggattatataacaatctattgtattaaaaaaagtctggatggttgttcatcagactattgtaaatggc

SEQ ID NO: 2198 - DNA, 101 bp, Homo sapiens
  DISD22_0001318
  Located on chromosome 1
  Distance between a terminus base of telomere on chromosomal short arm and 5'-terminus of this base sequence : 255474301
  Distance between 3'-terminus of neighbour sequence of sequence listing upward to telomere on chrosomal short arm and 5'-terminus of this base sequence : 169189
aagccagcagtgttaagtctcttattcatgagagagagacagtgtgtgtgtgtgtgtgtgtgtgtgtgtgtgcatgcgtgcgcaggtaagtagcatccaaa

SEQ ID NO: 2199 - DNA, 424 bp, Homo sapiens
  chr1.fa.O7frz.281628275
  Located on chromosome 1
  Distance between a terminus base of telomere on chromosomal short arm and 5'-terminus of this base sequence : 255606557
  Distance between 3'-terminus of neighbour sequence of sequence listing upward to telomere on chrosomal short arm and 5'-terminus of this base sequence : 132155
gaaccttgaggacattatgataagtgaaataagccagtcacagacacacacacacacacacacacacacacacacacacaataccacatgattccatttatatgaggtttctaaaacactcaaatttatagagacacaaaatagaatggtggttgctgggggctgtgtgtgagaagaatggggagttatttcacagtgggtacagaatttcaatttagggaggtgaaatgagattcatagatggatattgtggatggtcatacaacaatatgattatacttgaagccactgtactgattgtgccttaaaaatatttaatatgatagaaaaaataatttaagaaacttgtccaacaccctacagttatgacattacagactgattttttaaaagatatttaaagttgatcaagcttcaacactaa

SEQ ID NO: 2200 - DNA, 119 bp, Homo sapiens
  D1S2682
  Located on chromosome 1
  Distance between a terminus base of telomere on chromosomal short arm and 5'-terminus of this base sequence : 255654450
  Distance between 3'-terminus of neighbour sequence of sequence listing upward to telomere on chrosomal short arm and 5'-terminus of this base sequence : 47469
ccttctgcaccgtaacaccttttgtgcatgcaaacacaccacacaccacacacacacacacacacacgaggtgcacacccggggccacccaggcacttctgacaagttcctttaagggg

SEQ ID NO: 2201 - DNA, 165 bp, Homo sapiens
  DISD22_0001324
  Located on chromosome 1
  Distance between a terminus base of telomere on chromosomal short arm and 5'-terminus of this base sequence : 255760213
  Distance between 3'-terminus of neighbour sequence of sequence listing upward to telomere on chrosomal short arm and 5'-terminus of this base sequence : 105644
gtgctatttggacagacactgaatggaaagagacagagagagggggagagagagagagagagagagagagagagagagagagagagagagagagaaagaaagagaaagaaagagagagagaccttgtcatgaaagagtttgtaaaaccaatggacatgcattggt

SEQ ID NO: 2202 - DNA, 179 bp, Homo sapiens
  DISD22_0001329
  Located on chromosome 1
  Distance between a terminus base of telomere on chromosomal short arm and 5'-terminus of this base sequence : 256080617
  Distance between 3'-terminus of neighbour sequence of sequence listing upward to telomere on chrosomal short arm and 5'-terminus of this base sequence : 320239
gtggaaattctagttatgcactaagatgaaacagtatactaaataaatatacacctatatttaataatattatttgattcaacttcatatatatatatatatatatatatatactgaaaaataagaaaaatatatgagcagttatttcacagaaaaacagacacacgtggccagtaaac

SEQ ID NO: 2203 - DNA, 439 bp, Homo sapiens
  chr1.fa.O7frz.282025624
  Located on chromosome 1
  Distance between a terminus base of telomere on chromosomal short arm and 5'-terminus of this base sequence : 256401089
  Distance between 3'-terminus of neighbour sequence of sequence listing upward to telomere on chrosomal short arm and 5'-terminus of this base sequence : 320293
actggctaaatcaggtactaaaactgtgtgcgtgtgtgtgtgtgtgtgtgtgtgtgtgtatgtgtgtgtcctcttccaaaaaattcatactaacaggagtgcaaggctacaggttcaagatgaggtaattaaagcagttcgaacatgtgtggaatgggaaggaataaatcaccacaacaagctgcagttacacaaccttgaaatattttatgaaggtacttttatacttttatacttttagtttttgaagaaacatttgcatttctatctacatatagtagtgcaaatattgtctttctcccattcaacaggttttttttttcaggatttttcatcatttcatcaacaattttttcatctttttttgtcataaagtatttatgcttttttggggttttgttgcagatcttctatagtaaagaccaggatgttctacttt

SEQ ID NO: 2204 - DNA, 328 bp, Homo sapiens
  M2_142914
  Located on chromosome 2
  Distance between a terminus base of telomere on chromosomal short arm and 5'-terminus of this base sequence : 142766
  Distance between 3'-terminus of neighbour sequence of sequence listing upward to telomere on chrosomal short arm and 5'-terminus of this base sequence : 0
gagaggaccttcaattatcaattataggttttaaatttaccctagcttttaaaggaatagggcacacttttttttttttttactatttctatctttctccttctctctttgactccctgcttgtctctctgcctctttctcctctctgtctctctctctcctctctgtctctctcctctccatctctctcctttgtctctctcctctgtctctctgtctctgtctctctctgtttctctctatctctttctctctctctctctctctccccgtctctctctctttgccgtttacaaacttgggaccctggcaagagtggtggggaatg

SEQ ID NO: 2205 - DNA, 175 bp, Homo sapiens
  U50153.1_105
  Located on chromosome 2
  Distance between a terminus base of telomere on chromosomal short arm and 5'-terminus of this base sequence : 168693
  Distance between 3'-terminus of neighbour sequence of sequence listing upward to telomere on chrosomal short arm and 5'-terminus of this base sequence : 25599
tgcagattagacctctgtaacacacacacacacgcacacgcgcacacacacacacacacacacacacattatagcctttaggggtttaaaggagggagagaatttgcctggataactctcacctaggtattttctggggagatctagaatcgtctaaggggttaagctggactag

SEQ ID NO: 2206 - DNA, 220 bp, Homo sapiens
  D2S2268
  Located on chromosome 2
  Distance between a terminus base of telomere on chromosomal short arm and 5'-terminus of this base sequence : 212777
  Distance between 3'-terminus of neighbour sequence of sequence listing upward to telomere on chrosomal short arm and 5'-terminus of this base sequence : 43909
tggaaattattttgctatcctctgaaacaattttaatattacgaagctgactttttatatttttgaatttaattgaaaaggattaagcaacatagtcatttctattttatttgattaggattttttgtgtgttgtgtgtgtatacacacaaactcactctacacacacacacacacacacacacacacacatatataccctgagttactaagagtttgaa

SEQ ID NO: 2207 - DNA, 357 bp, Homo sapiens
  AC068963.2_93669
  Located on chromosome 2
  Distance between a terminus base of telomere on chromosomal short arm and 5'-terminus of this base sequence : 600448
  Distance between 3'-terminus of neighbour sequence of sequence listing upward to telomere on chrosomal short arm and 5'-terminus of this base sequence : 387451
gagacataagctttgaattgctagttatcattattgcttagtgcagttgttgtaacaaaaacaaccaaaccgaactttaacttatttttatttatttatttatttacttatttgcaaactgaatcttggaaaaaaaaccaaatcatccttaatccctgtagtttcgtttattaatcaacttctgccgtgtactgaagcctgtgccacatccaggcatgcggcagctccaggacccatagctctgtacccagggatgataactcaacagcaagcctctgcaccctgcatttcctggaaccgagggatgcagtctccatgtgctgggatcccttttctcgattcctattcagtttctag

SEQ ID NO: 2208 - DNA, 266 bp, Homo sapiens
  chr2.fa.O7frz.842218
  Located on chromosome 2
  Distance between a terminus base of telomere on chromosomal short arm and 5'-terminus of this base sequence : 886976
  Distance between 3'-terminus of neighbour sequence of sequence listing upward to telomere on chrosomal short arm and 5'-terminus of this base sequence : 286171
gcacagaacaggcacttagggaaccctcactgaatgaatgaatgaatgaatgaatgaatgaatgtttgggcaaataaacgctgacaaggacagaagggcctagcgggaagggaacaggagtaagaccagcgcacagcccgacttgtgttcagaagacctgggattggacctgaggagttcaattttggatgaatctcttaattaacctgtggggttcccagttcctcccctgagcgcccaggacagtagagtcaacctcacgtttg

SEQ ID NO: 2209 - DNA, 207 bp, Homo sapiens
  chr2.fa.O7frz.1155982
  Located on chromosome 2
  Distance between a terminus base of telomere on chromosomal short arm and 5'-terminus of this base sequence : 1046470
  Distance between 3'-terminus of neighbour sequence of sequence listing upward to telomere on chrosomal short arm and 5'-terminus of this base sequence : 159228
tccacgtctctttcatttaaccattgaagaacattttttgctctaatcgtaaaagttatgctcaatgaaaacaatttggaaaactgaaaaattataaagcagttctttcatcccacagggacagctactgttacattctcctccgtgctctgtgtgtgtgtgtgtgtgtgtgtgtgtgtgtgtgtgtacagaaccatgagtaaccag

SEQ ID NO: 2210 - DNA, 205 bp, Homo sapiens
  Z67661
  Located on chromosome 2
  Distance between a terminus base of telomere on chromosomal short arm and 5'-terminus of this base sequence : 1443644
  Distance between 3'-terminus of neighbour sequence of sequence listing upward to telomere on chrosomal short arm and 5'-terminus of this base sequence : 396967
cttggagcagatgacactttttaattaacttataaaaatgctgctaattttggaacttaataatttcctagggcatatcaatctctctcttttatacacacacacacacacacacacacgcacacacacacacacacacacagagcatctagaaccaaagttggaagttaaaacagaaagaagaaattgggcataaaataacagc

SEQ ID NO: 2211 - DNA, 388 bp, Homo sapiens
  AC008276.2_87185
  Located on chromosome 2
  Distance between a terminus base of telomere on chromosomal short arm and 5'-terminus of this base sequence : 1480238
  Distance between 3'-terminus of neighbour sequence of sequence listing upward to telomere on chrosomal short arm and 5'-terminus of this base sequence : 36389
ccactaatggaacataggtaaattttcttttcaaatgtttataggtaagttgtttacatggtttaaagctataacatatgtagggatctactagggaaagacttttttccttctaatttcatctgccgaattccaagccctcttaaacatatcaatattgttctttgttgtttacagatccttcccaagattttcccattctacctttcttattacagaaaaggttgtctgctacaccgttctactgtttacactctccattttggcaatgcctcttgggaatgtgtgtgtgtgtgtgtgtgtgtgtgtgtgtgtgtgtgtataaagttaactagatctctatattgcataaaaacatgatagagatctaattaacttgatccgtgaa

SEQ ID NO: 2212 - DNA, 274 bp, Homo sapiens
  Z23862.1_106
  Located on chromosome 2
  Distance between a terminus base of telomere on chromosomal short arm and 5'-terminus of this base sequence : 1480352
  Distance between 3'-terminus of neighbour sequence of sequence listing upward to telomere on chrosomal short arm and 5'-terminus of this base sequence : -274
aatttcatctgccgaattccaagccctcttaaacatatcaatattgttctttgttgtttacagatccttcccaagattttcccattctacctttcttattacagaaaaggttgtctgctacaccgttctactgtttacactctccattttggcaatgcctcttgggaatgtgtgtgtgtgtgtgtgtgtgtgtgtgtgtgtgtgtgtataaagttaactagatctctatattgcataaaaacatgatagagatctaattaacttgatccgtgaa

SEQ ID NO: 2213 - DNA, 191 bp, Homo sapiens
  D2S323
  Located on chromosome 2
  Distance between a terminus base of telomere on chromosomal short arm and 5'-terminus of this base sequence : 1480468
  Distance between 3'-terminus of neighbour sequence of sequence listing upward to telomere on chrosomal short arm and 5'-terminus of this base sequence : -158
gctacaccgttctactgtttacactctccattttggcaatgcctcttgggaatgtgtgtgtgtgtgtgtgtgtgtgtgtgtgtgtgtgtgtataaagttaactagatctctatattgcataaaaacatgatagagatctaattaacttgatccgtgaagcactgagtgctggatgggtggaatcaatggtc

SEQ ID NO: 2214 - DNA, 271 bp, Homo sapiens
  AC008276.2_236452
  Located on chromosome 2
  Distance between a terminus base of telomere on chromosomal short arm and 5'-terminus of this base sequence : 1536397
  Distance between 3'-terminus of neighbour sequence of sequence listing upward to telomere on chrosomal short arm and 5'-terminus of this base sequence : 55738
tctttgcacttaagtgactaaaagcagaaaccttgagctggggttggtcactgtcctgaatcaaaatgcaattcatatcggcacatggctctttattcagtcacagttctgctcctctctctcctcccatggcataaacacacacacacacacacacacacacacacgcgtaggtggacacgggtgcacacactgcacatacagatgcacaaacattcaagtacacacacacacacacacacacacacttgaaattggatataaagacctt

SEQ ID NO: 2215 - DNA, 362 bp, Homo sapiens
  AC008276.2_133932
  Located on chromosome 2
  Distance between a terminus base of telomere on chromosomal short arm and 5'-terminus of this base sequence : 1638888
  Distance between 3'-terminus of neighbour sequence of sequence listing upward to telomere on chrosomal short arm and 5'-terminus of this base sequence : 102220
ccttgatactttgttaacggtgttatttatcagattactcagagattgagcaccaacaaatcctgtctcaggaagtcttggttaggcaacatttgcctcagtccattgccccatgctcaactcaccctaccgcccttcctccctgctggggtgcatgtgtgtgtgagtgcgtgtgtgtgtgtgtgtgtgtgtgtgtatgtgtttccaacatgtgtctacaatagaatctccaacttttttgtttcacaatttctttgcattttgttgttcttaccatcaagtcaaaccagaaaactacatttctattgcacttatacactatgtcttttgatattgttgttcagttgcattataaatctgat

SEQ ID NO: 2216 - DNA, 134 bp, Homo sapiens
  DISO7_10000840
  Located on chromosome 2
  Distance between a terminus base of telomere on chromosomal short arm and 5'-terminus of this base sequence : 1653049
  Distance between 3'-terminus of neighbour sequence of sequence listing upward to telomere on chrosomal short arm and 5'-terminus of this base sequence : 13799
aggtcttggaggataaatgggtagacatgtttgtttggaaagaaatttcaagaaaatataataataaaatgtgtgtgtgtgtgtgtgtgtgtgtgtgtgtgtgtgtgtgtgtgcatgcctgttatagcagtcat

SEQ ID NO: 2217 - DNA, 152 bp, Homo sapiens
  DISO7_10000842
  Located on chromosome 2
  Distance between a terminus base of telomere on chromosomal short arm and 5'-terminus of this base sequence : 1710109
  Distance between 3'-terminus of neighbour sequence of sequence listing upward to telomere on chrosomal short arm and 5'-terminus of this base sequence : 56926
ctaataatggcttactgcctttcattttttaaaaaggtatcacccttttcccccttcactgactggtgttgtctgtgtgtgtgtgtgtggtgtgtgtgtgtgtgtgcacgtatgtgtgcgtgcatgtcgcggggggaaacgagaatggatgg

SEQ ID NO: 2218 - DNA, 142 bp, Homo sapiens
  DISO7_10000845
  Located on chromosome 2
  Distance between a terminus base of telomere on chromosomal short arm and 5'-terminus of this base sequence : 1725787
  Distance between 3'-terminus of neighbour sequence of sequence listing upward to telomere on chrosomal short arm and 5'-terminus of this base sequence : 15526
gaatgtgttaattgaacaaatgagtgaatgaatgaatgaatgaatgaatgaataaggatgttcaacaagcaaaatctaagaaaaactaaagcagtttcaaaagagggaaagaaagaaaaagtaattgtcagagtgatccctg

SEQ ID NO: 2219 - DNA, 181 bp, Homo sapiens
  DISO7_10000849
  Located on chromosome 2
  Distance between a terminus base of telomere on chromosomal short arm and 5'-terminus of this base sequence : 1863035
  Distance between 3'-terminus of neighbour sequence of sequence listing upward to telomere on chrosomal short arm and 5'-terminus of this base sequence : 137106
tcaggtacaagaaacataacaccaaactagactgtaaaaaatgacaagtgtaagtgctagaaaaaaatctcaataatagaaatgcttatcacatgatttggggtagaagctgggtgagagtgtgtgtgtgtgtgtgtgtgtgtgtgtgtgtgtgtgaatgaacataggttgaggtgggaga

SEQ ID NO: 2220 - DNA, 469 bp, Homo sapiens
  AC064814.5_27872
  Located on chromosome 2
  Distance between a terminus base of telomere on chromosomal short arm and 5'-terminus of this base sequence : 1943351
  Distance between 3'-terminus of neighbour sequence of sequence listing upward to telomere on chrosomal short arm and 5'-terminus of this base sequence : 80135
cacttaggaattggtgctaattggcgccccttgttcgccctctcccagttcactccccaagccagggtgcaagtatttagaactctcgcatccctaataagatacctttcctgcctgggaatgttccccacctacgagaggaggaggtagacattaagcaaatgcgtgtgggctcacacacacacacacacacacacacacacacagacacaaaaatacatcgacacacaacacacacactcatagagacaagcagacacaaacacatacacaaacattgttgcacactcgatacacacacacactctcacacaccagacacacacaccccagcggttcctgtgttgtcagatgatgggtgtcatggattgaattgtgtgcccttaaattcatatgctgaagccctcgctccagtgtggctgtgttggagacagccctcatggaggtaactaaggttagatgaggtcgt

SEQ ID NO: 2221 - DNA, 247 bp, Homo sapiens
  D2S2393
  Located on chromosome 2
  Distance between a terminus base of telomere on chromosomal short arm and 5'-terminus of this base sequence : 2182888
  Distance between 3'-terminus of neighbour sequence of sequence listing upward to telomere on chrosomal short arm and 5'-terminus of this base sequence : 239068
tgaacattagcctgaaggaactgaaggaaacaaggaatcattaattcaggagaaagtattttatatcagccttcgaagatgaatagcagaatcagattttcatttgtgtttggagtgggacagtcttccccggaaagtgagaactaaataccatccttacccacacacacacacacacacacacacacacacacacacacagagagagagagagagagagagagagttcaggtgttaaccccagtcc

SEQ ID NO: 2222 - DNA, 446 bp, Homo sapiens
  AC011995.7_100133
  Located on chromosome 2
  Distance between a terminus base of telomere on chromosomal short arm and 5'-terminus of this base sequence : 2262385
  Distance between 3'-terminus of neighbour sequence of sequence listing upward to telomere on chrosomal short arm and 5'-terminus of this base sequence : 79250
cagatatttggtcaaacatgactctgagtgtttctttgagggtgttcccggatgcaattaacatttaagtcagcagactctgagtaaaagcagacccctccctgccatgcgtgggcctcatccaggctgctgaaggcctaaaagaacaaggacagaggccccggagctgggggtttccctgcagatgctctctgccctgaaccaaagcaccagctcttccaccagcccaccctgggcactttggacttgccagcccccataatcacataagccaatttcttaaaatctctcactgtctgtacacacacacacacacacacacacacacacacacacacccctttgtttctgcttctctggagaatgctgactgataaacttcctgtatttcccctgagagcaatggttcagaattcactaatacagtgtttgtggcgactttacag

SEQ ID NO: 2223 - DNA, 172 bp, Homo sapiens
  D2S2245
  Located on chromosome 2
  Distance between a terminus base of telomere on chromosomal short arm and 5'-terminus of this base sequence : 2262620
  Distance between 3'-terminus of neighbour sequence of sequence listing upward to telomere on chrosomal short arm and 5'-terminus of this base sequence : -211
gcactttggacttgccagcccccataatcacataagccaatttcttaaaatctctcactgtctgtacacacacacacacacacacacacacacacacacacacccctttgtttctgcttctctggagaatgctgactgataaacttcctgtatttcccctgagagcaatggt

SEQ ID NO: 2224 - DNA, 177 bp, Homo sapiens
  G10168
  Located on chromosome 2
  Distance between a terminus base of telomere on chromosomal short arm and 5'-terminus of this base sequence : 2307412
  Distance between 3'-terminus of neighbour sequence of sequence listing upward to telomere on chrosomal short arm and 5'-terminus of this base sequence : 44620
ccacagaaggtcaggctagagaatcatgagggtggatggatggatggatggatggatggatggatggatagatggaaggatggatacactcactgcctcttgccagcagctgaggactccagagcaagggtcgcctctcctgccaggcactggccaggctactgctacagctgtgca

SEQ ID NO: 2225 - DNA, 351 bp, Homo sapiens
  AC011995.7_6847
  Located on chromosome 2
  Distance between a terminus base of telomere on chromosomal short arm and 5'-terminus of this base sequence : 2324556
  Distance between 3'-terminus of neighbour sequence of sequence listing upward to telomere on chrosomal short arm and 5'-terminus of this base sequence : 16967
caggcactttcattgaaatcacccactctggactctggagcaggtattttggtggtgtccctgcaatgcctacagcctcctcctctccttgtcagcttcccattaactcacacctgtctggatatcctgagagcaagcagtggccttcctggctatcactccccaaggacttattatgtctgtgtgtgtgtgtatatatatatatatatatatatatatatatatatatatatatatatatatatatatatctccctgtattatttccttactgcttgaagatacttagagtggcttctgtttttctgatattctgtattagaatattcttaccacttgtgcttatgagtg

SEQ ID NO: 2226 - DNA, 170 bp, Homo sapiens
  chr2.fa.O7frz.2639069
  Located on chromosome 2
  Distance between a terminus base of telomere on chromosomal short arm and 5'-terminus of this base sequence : 2420468
  Distance between 3'-terminus of neighbour sequence of sequence listing upward to telomere on chrosomal short arm and 5'-terminus of this base sequence : 95561
catcagaactgtgatggagtagcttcccacagcataaattcccactatccatcccttcctagtccaacccttcccccaacacgcacatgcacacacacacacacacacacacacacacacacacacacatatcacagactgaaaaagaagttactgaagccagatacatg

SEQ ID NO: 2227 - DNA, 424 bp, Homo sapiens
  chr2.fa.O7frz.3762366
  Located on chromosome 2
  Distance between a terminus base of telomere on chromosomal short arm and 5'-terminus of this base sequence : 2654265
  Distance between 3'-terminus of neighbour sequence of sequence listing upward to telomere on chrosomal short arm and 5'-terminus of this base sequence : 233627
actttcagtccagttccttaactcttactcatgccttgcaacacacacacagaaacacacatgcacacacacatacacacacacagacacacagagacacacacagacacacacacacacagacacacacgcagagacacacagacacacagacacacagacacacagagacacacagagacatacatacacacacacagagacacacatgcacacacacacagagacacacacacacagagacacacatgcacacacacacacagacacacatgcacacacacacagagacacacatgcacacacacacacagacacacatgcacacacacacagagacacacacgcacacacacacacacacagagacacgcacgcatgcacacacacatgtgttttatttcctccgcaaatgaatttactc

SEQ ID NO: 2228 - DNA, 445 bp, Homo sapiens
  AC068013.2_108705
  Located on chromosome 2
  Distance between a terminus base of telomere on chromosomal short arm and 5'-terminus of this base sequence : 2663981
  Distance between 3'-terminus of neighbour sequence of sequence listing upward to telomere on chrosomal short arm and 5'-terminus of this base sequence : 9292
ttatcctttatcaaacaatcagacaaaagaaattattctttaatccagtttgtgttaaacacagtttgctgtacatccttctccttcaaaccctctctaccgcattcagaattgtgggtgtttgtgtatgtgtgtgtgtgtgtgtgtgtgtgtgacagagtcctgctgtgtcgcccaggctggagtgcagtgacgccatctcagcttactgttagctcagcctcctgggttcaagcaattttcctgcctcagcctccggagcagctgggattacaggcagaatgtgttttaattacccagattgaagcatgaaccgtgacacttggatcaaatctggggccagattctttccattcttccattgcaagatttacttcttctttcattcttttcttctgtgctttactttatgaatcctactgtcttcagtgttgactgtcttagt

SEQ ID NO: 2229 - DNA, 438 bp, Homo sapiens
  AC068013.2_119325
  Located on chromosome 2
  Distance between a terminus base of telomere on chromosomal short arm and 5'-terminus of this base sequence : 2692732
  Distance between 3'-terminus of neighbour sequence of sequence listing upward to telomere on chrosomal short arm and 5'-terminus of this base sequence : 28306
tattgactgcaaggctagatactattaataaagtagcacatctagcaagaacatggctgatcatttgcaacaaggaccttaagaggtgtgtgtgtgtgtgtatgtgtgtgtgtgtgtgtgcgcgttgttagcatagcccatatgtgaattgaaacatgtacagtatacttaggagataatttgtcaggctctcattgtgtcttttttattttgtagatagcatgagctggttggcagttaagcatactagtaacaaagattatgagtagaagatttgctgctagaagcaggtgttactgattttaaagctgtataggtatataggtggaaggaagaaaagatagaggtaaactagaaaataagaataactaaaaaatgaattatgcatcagaaaaaaattgcttataataatacctaccttctacaggtatgttgaaa

SEQ ID NO: 2230 - DNA, 405 bp, Homo sapiens
  AC022311.4_88385
  Located on chromosome 2
  Distance between a terminus base of telomere on chromosomal short arm and 5'-terminus of this base sequence : 2822110
  Distance between 3'-terminus of neighbour sequence of sequence listing upward to telomere on chrosomal short arm and 5'-terminus of this base sequence : 128940
tttacattcctacaagcaatatgagggttccaaattcttcagttttgtcaaggcgttttctttttattttgtgtcttcttctcccctcctccccctcctcctctctccctccctcccctctctccctccctcctttccttccttccttccttctttccttccttccttccttccttccttccttccttccttccttccttccttcctttttcctaccagcatttccttaaggactaataatgctgaacatctcatgttcatattagctgtccatatatcttactttgtaaaacgcctatgcaaacattttgcctacagttaaattgggttatttctcttctttatattgagtggaaagtcttctttatatatcctggagacaagttctattcagtgctcagacat

SEQ ID NO: 2231 - DNA, 175 bp, Homo sapiens
  D2S304
  Located on chromosome 2
  Distance between a terminus base of telomere on chromosomal short arm and 5'-terminus of this base sequence : 2863134
  Distance between 3'-terminus of neighbour sequence of sequence listing upward to telomere on chrosomal short arm and 5'-terminus of this base sequence : 40619
tccctcagtcatggctgtccagagaacagaagcaagagggtgtgtgtgtgtgtgtgtgtgtgtgtgtgtgtgctggcgcatacagagagagaaagagagagagagatttttaggaatagtctgatgtgattatggagactggggggtctgccagcaggttggagacgcaggaaca

SEQ ID NO: 2232 - DNA, 148 bp, Homo sapiens
  D2S205
  Located on chromosome 2
  Distance between a terminus base of telomere on chromosomal short arm and 5'-terminus of this base sequence : 2918550
  Distance between 3'-terminus of neighbour sequence of sequence listing upward to telomere on chrosomal short arm and 5'-terminus of this base sequence : 55241
gggacatcttggggaatcattttggaattccctctgcaacaccttatgaagtattctaacttctggccagaaatacatacatacacacacacacacacacacacacacataaaaataaagaggaggaagccaatgttgatttgctctg

SEQ ID NO: 2233 - DNA, 358 bp, Homo sapiens
  AC016674.6_90585
  Located on chromosome 2
  Distance between a terminus base of telomere on chromosomal short arm and 5'-terminus of this base sequence : 2932052
  Distance between 3'-terminus of neighbour sequence of sequence listing upward to telomere on chrosomal short arm and 5'-terminus of this base sequence : 13354
tatttatcagatgaggaaacagattggcactacagaatttttggtggtcatacagtaagtgcctgtgggctggcatctctctctctctctctctctctctctctctctctctgcctgactccaaaatcctttttgtttctacatagtctcagtttatgtagctgtaaggataaaacctgaatgttgtgttgagaaatgttggagaacaagcgcaaacttcaccagacaggaaacaaaagtgggagaagggggcaggtagctctaagtgactaaacatttacctgtgctaaatcctctagatcatttacaatttaacacaaccttatgagctgtggtgtgctggttaatctttaaagct

SEQ ID NO: 2234 - DNA, 242 bp, Homo sapiens
  D2S2166
  Located on chromosome 2
  Distance between a terminus base of telomere on chromosomal short arm and 5'-terminus of this base sequence : 3071040
  Distance between 3'-terminus of neighbour sequence of sequence listing upward to telomere on chrosomal short arm and 5'-terminus of this base sequence : 138630
gaccctttcaatgaagcatacaaacactgtgaaactgtgtgtgtgtgtgtgtgtgtgtgtgtgtgtgtgcatatacttgaatcagaattctctgatatgcttctttctttctgaaacctgtcccaaccctactgaattaaaggctttgcaggtaaggctcaggtgattctagcaatattcaaaataccgggtaaaaaaaatttttttgaaaggttacaccagttttgctggcagaggtctaa

SEQ ID NO: 2235 - DNA, 463 bp, Homo sapiens
  AC013440.6_155998
  Located on chromosome 2
  Distance between a terminus base of telomere on chromosomal short arm and 5'-terminus of this base sequence : 3124134
  Distance between 3'-terminus of neighbour sequence of sequence listing upward to telomere on chrosomal short arm and 5'-terminus of this base sequence : 52852
gacggcgtttaaataggtttaagtacttacatcttgatctccaaatcccactcttcactagaatgaactgaagttcctggaagaagcagtttgccagcttggaggccaggaaggtacaagcgagtgtaggacatctcatgctggaaaacaagaaaatattcaaacttttatgggatgtggggtgtggctggaggggaggaggagagggctcctgcagggcttgcgattctgcctcttgagctcagtgcagggtacacaggtgggctcaaattgtgaaaattaattgagactgtagagagtttcagtaagtcttgtgtgtgtgtgtgtgtgtgtgtgtgtgtgtgtgtgtgtgtagaaagcttcaatagaaggtttgaaaactatgaataaggaggtaaaaagataattctaaggggttcctactgactaagtttgaaacaatttcaccatgaaattactaatg

SEQ ID NO: 2236 - DNA, 390 bp, Homo sapiens
  chr2.fa.O7frz.3341117
  Located on chromosome 2
  Distance between a terminus base of telomere on chromosomal short arm and 5'-terminus of this base sequence : 3246071
  Distance between 3'-terminus of neighbour sequence of sequence listing upward to telomere on chrosomal short arm and 5'-terminus of this base sequence : 121474
gatgtcatcttcaatatgtttgtattagtaggggttctccagagaaattgaaccgatgggagataacacacgcacacacacacacacacacacagtgggagttagcacatgtgattatggagctgagaagtcccactatctgctgtgtgcaaggtgcagacccaggagagttgctggtgtgactcagtctgggtccaaagacctgagaactgggggagtggatggtgtaaatcctcatccacaggcaggagaagacccaggttccagctcaataggcaggcaggaggagccaggattctcccttcctctgcattttgtttaggccctcagcagattaaatgatgcccacttgtgctgggagggaactttctttactgagtccacgaattc

SEQ ID NO: 2237 - DNA, 478 bp, Homo sapiens
  chr2.fa.O7frz.3458304
  Located on chromosome 2
  Distance between a terminus base of telomere on chromosomal short arm and 5'-terminus of this base sequence : 3501741
  Distance between 3'-terminus of neighbour sequence of sequence listing upward to telomere on chrosomal short arm and 5'-terminus of this base sequence : 255280
attgatgtgaagatttgttcacgtaaggtggatataaaaataaaattgaggccaggcacggtggctcacacctgtaatcccagcacttggggaggacgaggcgggtggctcacctgaggtcaggagttcgagaccagtctggccaacatggcgaaactccgtctctactaaaaatacaaaaactatccgggcatggtggcgcatgcctgtgatccctgcttctcgggaggctgaaacaggagaatcgcttaagccctggaggggtaggctgcagtgagctgagatcgtgtcactgcactccagcctgggtgacagagtgagactccatctcaaataaaataaaataaaataaaataaaataaaataaaataaaataaaataaaaataaaatgaataaaataaaatcggaaacctaaaaaaaagtttgcaacaattctaattttgcaataattcattttaatggacaaacgtaatgttc

SEQ ID NO: 2238 - DNA, 318 bp, Homo sapiens
  G08006
  Located on chromosome 2
  Distance between a terminus base of telomere on chromosomal short arm and 5'-terminus of this base sequence : 3670374
  Distance between 3'-terminus of neighbour sequence of sequence listing upward to telomere on chrosomal short arm and 5'-terminus of this base sequence : 168155
tatggaagtgggactgaggacactggactttcggtgtggattccccgtttaagctgtgtaattttgagcatgctactttaacccttagaactctgtctgtctgtctatctatctatctatctatctatctatctatctatctatctatcttttatttatttttttgagatggagtcttgctgtgtcgcccagcctggagtgcagtggcgcaatctcagctcactgcaacctccacctccagggtccaagcgattctcctgcctcagcctcccgagtagctgggattacaggcatcctagacaatacccagctaatttt

SEQ ID NO: 2239 - DNA, 101 bp, Homo sapiens
  DISD22_0001533
  Located on chromosome 2
  Distance between a terminus base of telomere on chromosomal short arm and 5'-terminus of this base sequence : 3811275
  Distance between 3'-terminus of neighbour sequence of sequence listing upward to telomere on chrosomal short arm and 5'-terminus of this base sequence : 140583
tgagtaactgttgtggtccccaaggatcatgacagagagagagagagagagagagagagagagaccaaacaccaaaggctgacatgggctaagagtaggag

SEQ ID NO: 2240 - DNA, 273 bp, Homo sapiens
  AC019118.4_32770
  Located on chromosome 2
  Distance between a terminus base of telomere on chromosomal short arm and 5'-terminus of this base sequence : 4064027
  Distance between 3'-terminus of neighbour sequence of sequence listing upward to telomere on chrosomal short arm and 5'-terminus of this base sequence : 252651
cacctgtaacaatagactggactaaaggttctgtgaatgtggtctctctctctccttgtctcccaatatcttgttgtactcacctatttttagactgtggctgacctcaggtaactgcaactgtggaaagcgaaactggataaggcaggactgccatatgtatggtgtgtgtgtgtgtgtgtgtgtgtgtgtgtgtgtgtgtgtgtgtgtgtgtagttttcaaaatacagcttaatcctgaaaagtcagatcttctttcctcaggttaatgat

SEQ ID NO: 2241 - DNA, 155 bp, Homo sapiens
  chr2.fa.O7frz.5120010
  Located on chromosome 2
  Distance between a terminus base of telomere on chromosomal short arm and 5'-terminus of this base sequence : 4203147
  Distance between 3'-terminus of neighbour sequence of sequence listing upward to telomere on chrosomal short arm and 5'-terminus of this base sequence : 138847
atggtaagctcagataaacagtagagagatgtgtgtgtgtgtgtgtgtgtgtgtgtgtgtgtgtgtgtatctttccaaaacaccagagtcctggcagaattcaaatagacattttaaaaaacactccatgtgactattgtaactagcaaactcca

SEQ ID NO: 2242 - DNA, 349 bp, Homo sapiens
  chr2.fa.O7frz.5049005
  Located on chromosome 2
  Distance between a terminus base of telomere on chromosomal short arm and 5'-terminus of this base sequence : 4290035
  Distance between 3'-terminus of neighbour sequence of sequence listing upward to telomere on chrosomal short arm and 5'-terminus of this base sequence : 86733
gctccacatttgtaaatactgtcagatctcagcatgaccctagaacatatacacaacttctgacccagaaaggaagaaagctaacgccaaaagtcttcctctctctctctctctctccctctgtcataacatattatatgataccaataccaatgtttccttgtatgtaaaatagacacacacacacacacacacacacacacacacacagcagaacttggggaataggtataccagtgggctccaagtgttctataccaatgaacaagaaacatgatttcagattaggtcaatttataaacaaggatgtttttattagagataagagtttcaatatgcaagttcaaac

SEQ ID NO: 2243 - DNA, 310 bp, Homo sapiens
  AC012595.5_48118
  Located on chromosome 2
  Distance between a terminus base of telomere on chromosomal short arm and 5'-terminus of this base sequence : 4623357
  Distance between 3'-terminus of neighbour sequence of sequence listing upward to telomere on chrosomal short arm and 5'-terminus of this base sequence : 332973
aaagtggtaagattaggttgactttatgctgccttcagctgaatttttgtgggtgttaatcaatgtgaatttttattttggtcaatacctgtaagaagagaccttctaaaggcatattctcactcagaatttttgagatgccattttcaaatttaaaaattatacttatttgaaagagtgtgtgtgtgtgtgtgtgtgtgcgcgcgcacacgcacccatgcacacacacgggcctgcctgcacacgtgcacactcatgtatgtttaaattctctcaatcccccccaaagaagttggaaacatttgcgata

SEQ ID NO: 2244 - DNA, 443 bp, Homo sapiens
  chr2.fa.O7frz.5514198
  Located on chromosome 2
  Distance between a terminus base of telomere on chromosomal short arm and 5'-terminus of this base sequence : 4798871
  Distance between 3'-terminus of neighbour sequence of sequence listing upward to telomere on chrosomal short arm and 5'-terminus of this base sequence : 175204
aacacggtacaacctcgtctctactaaaaatacaaaaacttagccgggcgtagtggcgggcgcctgtagtcccagctacttaggaggctgaggcaggagaatggcgtgaacccgggaggcagagcttgcagtgagctgagatcacgccactgcactccagcctgggcgacagagccagactctgtctcaaaataaagaaataaaataaataaataaataaataaataaataaataaataaataaataaaatacaggcgatgctgaggggctcgccagtgcctcctcctccagcccatctccatcatgtaccccgcacgcatcccagccaggtgaagctgctcttttaaaagccatctcagtccctcaagatctgagcttcaggcaggcaatattggaaaatcaccttacatttctgggcctcagtttaccttacttgtgatgt

SEQ ID NO: 2245 - DNA, 310 bp, Homo sapiens
  chr2.fa.O7frz.5616466
  Located on chromosome 2
  Distance between a terminus base of telomere on chromosomal short arm and 5'-terminus of this base sequence : 4937354
  Distance between 3'-terminus of neighbour sequence of sequence listing upward to telomere on chrosomal short arm and 5'-terminus of this base sequence : 138040
tttagcctgttaacacaatcaggaggaatacagaaataaaacaaatgaatacagtttatagttaatttgaggaagacaagtgttcattctgtggctccaaaagtaatgtacacattacgttattattattattattattattattattattattattattattattatttgagatggagtcttgctctttcacccaggctggagtgcagcagcacgatctcagctcactgcaacctctgtctcccaggttcaagtggttctcctgcctcagcctcccaagtagttgggactacaggcacatgtcactaca

SEQ ID NO: 2246 - DNA, 390 bp, Homo sapiens
  AC010729.7_86071
  Located on chromosome 2
  Distance between a terminus base of telomere on chromosomal short arm and 5'-terminus of this base sequence : 5032489
  Distance between 3'-terminus of neighbour sequence of sequence listing upward to telomere on chrosomal short arm and 5'-terminus of this base sequence : 94825
cattgttaacgtttggagttagcctccatgtgttctagaacattggattataaactcattttgacatatccagactaggacacatttcacatttacattttaacctactgtccacaaatgcaaacaaatatttctctctctcgcacacacacacacacacacacactcacacacacacacacgcacacaatcttgcaccacactctagtattttctctttcactctcttttcttctattgtactttattttatttcattctaaggaagtctggtcacaactcagaagattgatttcatcaccccctggatcaggacctgaagtatggaaaatactgctccagaataactcagaaactcctgagtctctatgcatagttcaaatgaatctc

SEQ ID NO: 2247 - DNA, 243 bp, Homo sapiens
  DISO7_00010955
  Located on chromosome 2
  Distance between a terminus base of telomere on chromosomal short arm and 5'-terminus of this base sequence : 5200977
  Distance between 3'-terminus of neighbour sequence of sequence listing upward to telomere on chrosomal short arm and 5'-terminus of this base sequence : 168098
cccaagtctgtcctagttaggaaaatattccctaggatctcagtatgaattaacattctttaaacacacacacacacacacacacacacacacacacacacacacacacacgcctcgtgctctccttctcctcctcctgacatgatggacggcaggcgcagcccaggggcccgcaggtcacgctgtgtccacgaatccctctgggggctcttctttccctgggtcctccatgaaggtctgaaa

SEQ ID NO: 2248 - DNA, 430 bp, Homo sapiens
  chr2.fa.O7frz.6020328
  Located on chromosome 2
  Distance between a terminus base of telomere on chromosomal short arm and 5'-terminus of this base sequence : 5373314
  Distance between 3'-terminus of neighbour sequence of sequence listing upward to telomere on chrosomal short arm and 5'-terminus of this base sequence : 172094
ggcactttagcttatgtactaaagggcgaattatgttccacaaaaggtaaccacatagaacaaatccacaaggaaatggagtaagtctaattcatctcaaataccagaatcataaaggtcatctgaatatttgagatgaatccaatcagttatactgtcaaacaagctataaggcaaaaaatttactattcactttgaaatttctacctataaatgaagaatatggctctagtcttattgttgggacgtatggtttcattgcatatatgtgtaggtttgtaagatgtggaaagtgtgtgtgtgtgtgtgtgtgtgcgcatgttcatgtatttgaatgtatgtgtgtgtatacacactatacgtatgcatgtatgatgtatgtctgtatgtttaaaagaggaattaaaagaagtgtcactgttatgcaaag

SEQ ID NO: 2249 - DNA, 289 bp, Homo sapiens
  chr2.fa.O7frz.6213316
  Located on chromosome 2
  Distance between a terminus base of telomere on chromosomal short arm and 5'-terminus of this base sequence : 5521125
  Distance between 3'-terminus of neighbour sequence of sequence listing upward to telomere on chrosomal short arm and 5'-terminus of this base sequence : 147381
gcttatgtgcttgttatcctatacatttttattgtgattttagagtgtactctttctacatatatatgtatatatatatatacacacacacacatatatagtgtgtatatatacgaagagtgtatatatacgaagaatatatatatatatgcactcttcatatatatatatactctttatgtgtgtgcatatatatatatatatatatatatatatatatatatatatatatatagtttttaaagtaacaataaaacagtctcaggcagatccttcaggaggtagtcta

SEQ ID NO: 2250 - DNA, 391 bp, Homo sapiens
  chr2.fa.O7frz.6710460
  Located on chromosome 2
  Distance between a terminus base of telomere on chromosomal short arm and 5'-terminus of this base sequence : 5607004
  Distance between 3'-terminus of neighbour sequence of sequence listing upward to telomere on chrosomal short arm and 5'-terminus of this base sequence : 85590
taaaattatggtttgtagctgaagcaatgttcagaaggatatttatagctttacacacacacacacacacacatatacacacacacaaagaaagatctcaaataaagaatctaagctctacattaagaaactagaaatggaagaacaaattatatccaaacagagtatcaagaatatttaatagaggaacagagtgaaactaaaatagaacacaaaacagagaaaattaataaaaccaagcattgacttttaaaaatattttttaaatgataaaactttagctagactgactaagaaaaaaaggaatattttaatcagtttaaatgatgacccctctttcatccctgatagtggtaagttgatatcctttctgttatcgactgaatgtcgg

SEQ ID NO: 2251 - DNA, 190 bp, Homo sapiens
  chr2.fa.O7frz.6417740
  Located on chromosome 2
  Distance between a terminus base of telomere on chromosomal short arm and 5'-terminus of this base sequence : 5726441
  Distance between 3'-terminus of neighbour sequence of sequence listing upward to telomere on chrosomal short arm and 5'-terminus of this base sequence : 119046
aaccttaggcaattaatgctagaaataatatgctgatttgtatgttgtgtgtgtgtgtgtgtgtgtgtgtgtgtgtttcctaatatgaaataggaaggcctcaaaactccctagatgatcaaagtttatgacatatgctttttaagaaaataaactttattatatatacttaaggtatgcaacataatgc

SEQ ID NO: 2252 - DNA, 387 bp, Homo sapiens
  chr2.fa.O7frz.6833282
  Located on chromosome 2
  Distance between a terminus base of telomere on chromosomal short arm and 5'-terminus of this base sequence : 5993895
  Distance between 3'-terminus of neighbour sequence of sequence listing upward to telomere on chrosomal short arm and 5'-terminus of this base sequence : 267264
gctgttctcatgatagtgaataagtcccacgagatctgatggttttataaaagggagctcccctgcacatgccctctttcctgccaccacgtaagatgagatttttctcctctttgccttccaccatgattgtgagacctccccagctaattaaagtgtgagtcaattaagcctctttcctttataaattacccagtctcaggtatgtctttataagcagcatgagaacagactaatacagatgatagctatatagagatagatagatagatagatagatagatagatagatagatagatagatatagatggatggatagataaatgtagacagactgattgattattagaatggactcatgagatcatgaggtaattcagtctgag

SEQ ID NO: 2253 - DNA, 460 bp, Homo sapiens
  chr2.fa.O7frz.6589738
  Located on chromosome 2
  Distance between a terminus base of telomere on chromosomal short arm and 5'-terminus of this base sequence : 6045785
  Distance between 3'-terminus of neighbour sequence of sequence listing upward to telomere on chrosomal short arm and 5'-terminus of this base sequence : 51503
tcaccaagaataagtggtaagtagatactgtgggacaaacagcattatgtcactctctaaatacatgaaatttatgaggactaaatcctgacatattcttgactccttaaatttgcaaatacctctctcccatataatatataccttaaaatgcacattgaacaagagataatcacagaattgcactgacattgtggtgctaggctcagctggcccagccctttccacaaaggagtggttagctattttccatgtctgcctcacagactgtgatttaacttcatgctttggaaaatggtgtgttagtagctggccatgtgccttcaacttgcttaggaatatttgaaactatgtaagtggatcagtgcctgatcccaactgttcattggatcaaatggaaaacacacacacacacacacacacacacacacatcattcctgaacagtctgacttaatgga

SEQ ID NO: 2254 - DNA, 368 bp, Homo sapiens
  AC017076.13_184551
  Located on chromosome 2
  Distance between a terminus base of telomere on chromosomal short arm and 5'-terminus of this base sequence : 6115108
  Distance between 3'-terminus of neighbour sequence of sequence listing upward to telomere on chrosomal short arm and 5'-terminus of this base sequence : 68863
tactttaatgagaacagccagttcttaacaattcacactaatagatgagaaaacattcaatggcattaaaaagtcagagctcatttgaaaaaaaacccactggatttgtttttgagttgtttacatatttgtttatggatgtaagtggtatcctattaattttagtaatattctctctctacacacacacacacacacacacacacacacacacacacacacacacacacacacaaagctctgtgaaagttcattcttggggaatctggaaaactgcccaaacattgtttacttttttcattcagggccacctcaacttgttcctaaacccctctcagcaacacatctgaatagactgacctttgtca

SEQ ID NO: 2255 - DNA, 435 bp, Homo sapiens
  AC068481.1_71031
  Located on chromosome 2
  Distance between a terminus base of telomere on chromosomal short arm and 5'-terminus of this base sequence : 6145896
  Distance between 3'-terminus of neighbour sequence of sequence listing upward to telomere on chrosomal short arm and 5'-terminus of this base sequence : 30420
attgtattgaagttaccagacaagcacactgttaggaaatgagaagcctcatcctatccttcagtatatcagattttttcaagtcacacacagtagtgtgtgtgtgtgtgtgtgtgtgtgtgtgtgtgtcactgagggccaggtgcggtctataggttcctacatagtctgagctccttgacagcagagaccacatcttattcaccttgttgtcactcctatgtgctgtctgagcacatggtcggggtgcaagaaaaggttgagtgcgtgaacatttactacagatatttctgctaaaacccagtacgtacattcctggtgttctataaaaacaggtactaaaaatgtgagggcttcttgagtattgagggactgaccactccataccggtgtggctttgtaaccagagtatatgaagaacaattcttgatacct

SEQ ID NO: 2256 - DNA, 239 bp, Homo sapiens
  AC019048.4_109915
  Located on chromosome 2
  Distance between a terminus base of telomere on chromosomal short arm and 5'-terminus of this base sequence : 6239278
  Distance between 3'-terminus of neighbour sequence of sequence listing upward to telomere on chrosomal short arm and 5'-terminus of this base sequence : 92947
ttccttctgatacactacgataagggaccctgccggaacaagctgggccactcccgggcatctgtgatctggcatcggacacaggtaggaggtgatttgcctggaaggttgatctcagagagagactgtgtgtgtgtgtgtgtgtgtgtgtgtgtgtgtgtgtgtgtgtgtgtgtatgtatatctttagtgtttccagacttgcctaaaggacgaagatctcctggatagaaagagcta

SEQ ID NO: 2257 - DNA, 254 bp, Homo sapiens
  D2S2211
  Located on chromosome 2
  Distance between a terminus base of telomere on chromosomal short arm and 5'-terminus of this base sequence : 6540395
  Distance between 3'-terminus of neighbour sequence of sequence listing upward to telomere on chrosomal short arm and 5'-terminus of this base sequence : 300878
tgggttagtcatcaagggaatagattcctgataaaaggatgcgttcagcctctctttgtctgcttctctgtctatctctgtctctatctctctttgtctttcacacacacacacacacacacacacacacacacacaggcacacacgcacacacaccctctcttgcctttcctctttatgccatgggatgatgcaacacaaggccctcatcaagtactggtgccatgatcttgaacttcccagactcctgaatc

SEQ ID NO: 2258 - DNA, 443 bp, Homo sapiens
  chr2.fa.O7frz.7427618
  Located on chromosome 2
  Distance between a terminus base of telomere on chromosomal short arm and 5'-terminus of this base sequence : 6714292
  Distance between 3'-terminus of neighbour sequence of sequence listing upward to telomere on chrosomal short arm and 5'-terminus of this base sequence : 173643
ccttcaactccttattgtcacttttgctttgtttactttactgcagttttcatttatgttttctcacacctgtaattccagcactttgggagggtgaggtgtgtggatcacctgaagtcaggagttcaataccagcctggccaacatggtgaaaccccgtgtctgctaaaaatacaaaaattagccaggcgtggtggcagccgcctttaatcccagctactcaggaggctaaaacaggagacttgtttgaacccaggaggcagaggttgcagtgagccgagatcacaccattgcactccagcctgggtgacagagcaagaccctgtttcaaaaaataataaataaataaataaataaataaataaaaataataaataaaatttaggcagcaagagtaggaggtttgattgtgtgtctgttgctttagtctcaggagcctaatc

SEQ ID NO: 2259 - DNA, 432 bp, Homo sapiens
  AC013460.5_154667
  Located on chromosome 2
  Distance between a terminus base of telomere on chromosomal short arm and 5'-terminus of this base sequence : 6762519
  Distance between 3'-terminus of neighbour sequence of sequence listing upward to telomere on chrosomal short arm and 5'-terminus of this base sequence : 47784
taattaaatgggtaataggcctacatgtaaattatagagaactctgaaagaaataacaggagaaaaatatttgtgactttgagtaaggtatgaatattttagatacaacatgaaaatcaagatctataaaaagaaagactgattatttcaatgtgaccaaaattaagaatatctgctcttcacaggacactgtaaagagaatgaaatggcaagcccctcactgtaagaaaatattcacaaatatcataactgatgaagcactgatatatatatatatatatatgtatcaagtctcaaaaatagtaacataacccagtttataaacagacaaaagctttgaacagacatttcaccaacaaagatagatagatggaaattagcaaataaaaatatgctcaatatatttagttattaaggaactgcaaattaaac

SEQ ID NO: 2260 - DNA, 201 bp, Homo sapiens
  D2S1329
  Located on chromosome 2
  Distance between a terminus base of telomere on chromosomal short arm and 5'-terminus of this base sequence : 6981245
  Distance between 3'-terminus of neighbour sequence of sequence listing upward to telomere on chrosomal short arm and 5'-terminus of this base sequence : 218294
ttgtggaaccgttctcaaataccaggaatctcattcagttgtatctatctatctatctatctatctatctatctatctatctatcaatctagttatagtttttgatccctacaacaatcttccatgatgatttatggtaatatattctaattttattgatgtaagaattatggttaaattaagaacccaggtggaagtttc

SEQ ID NO: 2261 - DNA, 105 bp, Homo sapiens
  DISO7_10000854
  Located on chromosome 2
  Distance between a terminus base of telomere on chromosomal short arm and 5'-terminus of this base sequence : 7067750
  Distance between 3'-terminus of neighbour sequence of sequence listing upward to telomere on chrosomal short arm and 5'-terminus of this base sequence : 86304
ttattccttcctgcctgccttgtttccttccttcctttcttccttccttccttccttccttccttctttcctttctttattgtgctttaagtagttcacagcttc

SEQ ID NO: 2262 - DNA, 179 bp, Homo sapiens
  AC007463.3_8819
  Located on chromosome 2
  Distance between a terminus base of telomere on chromosomal short arm and 5'-terminus of this base sequence : 7092461
  Distance between 3'-terminus of neighbour sequence of sequence listing upward to telomere on chrosomal short arm and 5'-terminus of this base sequence : 24606
agatgacggatgagtcagtatggaattacacgcatgcacacacacacacacacacacacacacacacacatatgtatatatattttattttactggactggcataaacctagatgtcatgggactttatgaaaggattgaattatttccagttgaatataggtggttagtatttccacc

SEQ ID NO: 2263 - DNA, 317 bp, Homo sapiens
  AC007463.3_78063
  Located on chromosome 2
  Distance between a terminus base of telomere on chromosomal short arm and 5'-terminus of this base sequence : 7161585
  Distance between 3'-terminus of neighbour sequence of sequence listing upward to telomere on chrosomal short arm and 5'-terminus of this base sequence : 68945
aaagtcatgttcagaaatatgactttttatagtggagatgattgtgtgtgtgggttgaactaagctcctctcaacccttgcaatttgtatgttggactcctaagatataaattacagttctcccactgagaatagagaatttatcctctctctctctgtgtgtgtgtgtgtgtgtgtgtgtgtgtgtgtgtgtgtgtgtgtgtcctgttcttcaatgtccaataattgtgtccagggaaaatagagaagtacaaatgtcagactctcaaaaaataacagagtaagggttctaggttgtaaatgcctcagttcaaatc

SEQ ID NO: 2264 - DNA, 433 bp, Homo sapiens
  AC007463.3_130296
  Located on chromosome 2
  Distance between a terminus base of telomere on chromosomal short arm and 5'-terminus of this base sequence : 7213745
  Distance between 3'-terminus of neighbour sequence of sequence listing upward to telomere on chrosomal short arm and 5'-terminus of this base sequence : 51843
accaattctggtgacagttagggggtttgtggccctagcctacatcattctcccctgctggatgcttcctgctcttgaacatcggactccaggttcttcagttttgggactcggactggctctccttgctcttcagcttgcagatggcctattgtgggatcttgtgagttaatacttattatgctctatctatctatctatctatctatctatctatctatctatctgttatctatctatctatctatctatctatctatctatctatctgtctatctacctatcctattagttctgtccctctagagaattctgagtaatacagtgggcatgctgatttgggtacagaaatattcttacacttggcattacactagtggaatatatcttaccttctggtgcataaccctccaagagcagacttactagatat

SEQ ID NO: 2265 - DNA, 226 bp, Homo sapiens
  D2S359
  Located on chromosome 2
  Distance between a terminus base of telomere on chromosomal short arm and 5'-terminus of this base sequence : 7323761
  Distance between 3'-terminus of neighbour sequence of sequence listing upward to telomere on chrosomal short arm and 5'-terminus of this base sequence : 109583
agcctcttgtgggacttcaccttgtgatcgtgagtcaattctccttaataaactccctttcatatatagatccatttgattagtcctgaccccctagagaaccctgactaatacacacacacacacacacacacacacacacacacacacacacacacctcaccagcagacccctgcaattcaacactctaaatgatcaccaactgaaaatgaaaacccaagttag

SEQ ID NO: 2266 - DNA, 180 bp, Homo sapiens
  Z24198.1_124
  Located on chromosome 2
  Distance between a terminus base of telomere on chromosomal short arm and 5'-terminus of this base sequence : 7323789
  Distance between 3'-terminus of neighbour sequence of sequence listing upward to telomere on chrosomal short arm and 5'-terminus of this base sequence : -198
cgtgagtcaattctccttaataaactccctttcatatatagatccatttgattagtcctgaccccctagagaaccctgactaatacacacacacacacacacacacacacacacacacacacacacacacctcaccagcagacccctgcaattcaacactctaaatgatcaccaactgaa

SEQ ID NO: 2267 - DNA, 205 bp, Homo sapiens
  D2S2164
  Located on chromosome 2
  Distance between a terminus base of telomere on chromosomal short arm and 5'-terminus of this base sequence : 7362888
  Distance between 3'-terminus of neighbour sequence of sequence listing upward to telomere on chrosomal short arm and 5'-terminus of this base sequence : 38919
gtcactatcagccccagggaagttctgctgacattactggcaaaaccactctcctctgtctctgtctctgtctctttctctctctctttctcttttccctttctctctctctctttcacacacacacacacacacacacacacacacgcacacacaaacacacaattatttgattatttgtcagtgaatctgtaatggctctctc

SEQ ID NO: 2268 - DNA, 446 bp, Homo sapiens
  U91324.1_25348
  Located on chromosome 2
  Distance between a terminus base of telomere on chromosomal short arm and 5'-terminus of this base sequence : 7400522
  Distance between 3'-terminus of neighbour sequence of sequence listing upward to telomere on chrosomal short arm and 5'-terminus of this base sequence : 37429
gtaaacatcctacggttcacaggacagcacctgccacagagaataattcagtcaaagttgtcaataatgctgagatgaagaaactctcacctatagtaagggtaagactcataaagcttttgttctgtgacgtgtgtgtgtgtgtgtgtgaaggtaatttcatttgtctgagacttatcagttactcactagtaagttagccataagaatgcctcaccttgggtggttttaagaatgattctatgaaataagtcatgtgactaaacaacacacacacacacacacacacaaacacaaattccatccacataatatatgttaatccttacccaccccccacccccgccctgcttttcttctgaatggtaaaatacctaaaaaggtggctgacacacagcaggtgttcaagaaataaatatcttgtctgaaattcctaaattgctaag

SEQ ID NO: 2269 - DNA, 343 bp, Homo sapiens
  U91324.1_39496
  Located on chromosome 2
  Distance between a terminus base of telomere on chromosomal short arm and 5'-terminus of this base sequence : 7414854
  Distance between 3'-terminus of neighbour sequence of sequence listing upward to telomere on chrosomal short arm and 5'-terminus of this base sequence : 13886
gatggtatccaattctagaatcacaaataagagccaatccagatctttaaactaaatctgtcacgattttgtcttttgacagcaacacacacacacacacacacacacaatatcttcacattcacacacacatacacgcacacacacaatgtcttcacattcacacacacacacacgcacacacacaaagtcttcacattctcaaccttgggtcctctcgtgctttctattgtcttttgcattgggggaaggttttcaataacgtcaaattttataacttaaaataaaaaagtttctccaaggttaggcaaacacattgctatttggttatgaactttggttg

SEQ ID NO: 2270 - DNA, 389 bp, Homo sapiens
  U91324.1_57987
  Located on chromosome 2
  Distance between a terminus base of telomere on chromosomal short arm and 5'-terminus of this base sequence : 7433162
  Distance between 3'-terminus of neighbour sequence of sequence listing upward to telomere on chrosomal short arm and 5'-terminus of this base sequence : 17965
gtttgctagaactcatgtaacaaagtaccacacacagagagctgttaaactacagggtttcattttctcacagctctagaagctgaaagtccaagattaaggtgtcagcagggttggtttcttctggggctgtgagaaagactctgtctcaggcctctcttcctctcttctagcctctggtagtttgctggtcatctttggtggtcttggtttgtagagacatcaccccagtctctgccttcatgttcacatggtgttgtgtgtgtgtgtgtgtgtgtgtgtgtgtgtgtgtgtgcgtctgaatgtccccttcttataagaacaccagtcatattggatttggggcacaccagctccagtatgatctcatttacaggaattacatcagc

SEQ ID NO: 2271 - DNA, 238 bp, Homo sapiens
  U91324.1_72081
  Located on chromosome 2
  Distance between a terminus base of telomere on chromosomal short arm and 5'-terminus of this base sequence : 7447335
  Distance between 3'-terminus of neighbour sequence of sequence listing upward to telomere on chrosomal short arm and 5'-terminus of this base sequence : 13784
aaatctagtaccagcaaattgaagccgtttctaaatgtctcctttcaaatagcatatccaccacatagtttgcagctatgcaaaataccttctatttttgtaaagcaataaataataagaattatatgttgaggttcaactatgtaccaattatatggagctggatgcattaggggtatgtgtgtgtgtgtgtgtgtgtgtgtgtgtgtgtgttctaatctgaacaaaggttctacga

SEQ ID NO: 2272 - DNA, 384 bp, Homo sapiens
  U91324.1_106143
  Located on chromosome 2
  Distance between a terminus base of telomere on chromosomal short arm and 5'-terminus of this base sequence : 7481273
  Distance between 3'-terminus of neighbour sequence of sequence listing upward to telomere on chrosomal short arm and 5'-terminus of this base sequence : 33700
attgtggctaggcatagtgactcatgcctgtaatcccagcactttgggaggccaaggcaggtggaacagttgaggtcgggagtttgagaccagcctggccaatatggtgagaaaccctgtctctactaaaaagacaaaattagccaggcttcgtggcatgcctataatcctagttactcaggaggctgaggcaggataaactcttgatcctgggaggcagagattgcagtgagccaaaatcgtgccactgcactccaacctgggcaacagagcgagactccatctcaaataataataatcattatatatatatatatatatatatatatatataaacacacacacacacaatattgttaactctattcacctgactgtgctatt

SEQ ID NO: 2273 - DNA, 105 bp, Homo sapiens
  DISO7_10000852
  Located on chromosome 2
  Distance between a terminus base of telomere on chromosomal short arm and 5'-terminus of this base sequence : 7571296
  Distance between 3'-terminus of neighbour sequence of sequence listing upward to telomere on chrosomal short arm and 5'-terminus of this base sequence : 89639
attgttcggaaacaccatccaataaatgtgaaacagtctctctctctctctctctctctcataaagtgaactaaaatgaacatgatggagcctcaggatcccata

SEQ ID NO: 2274 - DNA, 151 bp, Homo sapiens
  DISO7_10000855
  Located on chromosome 2
  Distance between a terminus base of telomere on chromosomal short arm and 5'-terminus of this base sequence : 7775155
  Distance between 3'-terminus of neighbour sequence of sequence listing upward to telomere on chrosomal short arm and 5'-terminus of this base sequence : 203754
tccatcagtccagggatcccctctaatgggcaaaatgtcccccacacccatgctcatacacacacacacacacacacacacacacacacaggtacacacaaacacgcacaaatacaacacacccacaggggcagttctatgatacagactt

SEQ ID NO: 2275 - DNA, 204 bp, Homo sapiens
  D2S2326
  Located on chromosome 2
  Distance between a terminus base of telomere on chromosomal short arm and 5'-terminus of this base sequence : 7909955
  Distance between 3'-terminus of neighbour sequence of sequence listing upward to telomere on chrosomal short arm and 5'-terminus of this base sequence : 134649
ttcaccaggcaggtcagggggaaaagaatgagcgaatggagaggtctcttggatttaaggaaggaggtgggtgggggctgcactggaggggaggaaggaggagcctgagggctctgtgtgtgtgtgtgtgtgtgtgtgtgtgtgtgtgtctgtctgtctaacgggagggacatgagcatgttttaaagttgacgcaagtagctg

SEQ ID NO: 2276 - DNA, 407 bp, Homo sapiens
  AC011747.5_17095
  Located on chromosome 2
  Distance between a terminus base of telomere on chromosomal short arm and 5'-terminus of this base sequence : 7911689
  Distance between 3'-terminus of neighbour sequence of sequence listing upward to telomere on chrosomal short arm and 5'-terminus of this base sequence : 1530
acaagtaccagtaagtcagatgacgaagtggaatgtatcctcatgaaaggaagcatattaaagataagacccagctgctctgccaaggagtggctgttctttattcctttacttttcctaataaacttgctttcattttactttatggacttgccctgaattctttcttgcgcaaggtccatgaaccctctcttgggatctggattgggacccctttccggtaacatcttcctggtgaaccatgaagggatgatactgaggaaacttccaatccttcctgcaacacacacacacacacactcacacacacacacacacacacacacaaacacacacacaaataaaaaagataaaacccaacattttaaatccttcagacccgcatttcactggtaagtagaaagtca

SEQ ID NO: 2277 - DNA, 124 bp, Homo sapiens
  D2S162
  Located on chromosome 2
  Distance between a terminus base of telomere on chromosomal short arm and 5'-terminus of this base sequence : 7971044
  Distance between 3'-terminus of neighbour sequence of sequence listing upward to telomere on chrosomal short arm and 5'-terminus of this base sequence : 58948
gctacctgacaatgggaaatttaaacgcacagacacacacacacacacacacacacacacacacacacagcaccagtttaaatctatttcaaattagttatgcttacaccaaaaggcagagttc

SEQ ID NO: 2278 - DNA, 440 bp, Homo sapiens
  chr2.fa.O7frz.8844606
  Located on chromosome 2
  Distance between a terminus base of telomere on chromosomal short arm and 5'-terminus of this base sequence : 8031240
  Distance between 3'-terminus of neighbour sequence of sequence listing upward to telomere on chrosomal short arm and 5'-terminus of this base sequence : 60072
tgatgtttctcactccaaatatgtatttccactggaaaaatctggaatagaactcaaaataaataaaaggactgctggtttctggttctacatatatgtaaacactttggaagtggccactccttgattacgtaagcttatatatgtgtgtgtgtgtctgtgtgtgtgtgtgtgtgtgtggtggggggtgtgtgtgtgtgtgtataatgtacatattatgtatgcttataaatgtaaatgaaattagtaacaacaatgatacaagggacgggagagaggaattaggattattttgctattataagataaactacctgagaagtgatatagtattacttgaaagtgggcttggattagttataaatgcatattgcaaaccctagggcaaccactcaaaaaaaacagtttaaaaaaaagtacaactgatatgctaagaaagg

SEQ ID NO: 2279 - DNA, 412 bp, Homo sapiens
  chr2.fa.O7frz.8963089
  Located on chromosome 2
  Distance between a terminus base of telomere on chromosomal short arm and 5'-terminus of this base sequence : 8222906
  Distance between 3'-terminus of neighbour sequence of sequence listing upward to telomere on chrosomal short arm and 5'-terminus of this base sequence : 191226
ataagaaacagtcacgagtagaacttttgggccattcttgtgagactggggggacactgtccggcgtgctacttactaaatccacccacttgagaagttgctcacagacaggagagccagaaaacaattgtttcatgatggactggagtgtttcattttctaagacactgaaaaatatgtaatcagtgtgtttccctctttgtcttcatccccaagaaactcagagccaattatgtgcttatttgcagattttctcagcccaagatttatttatttatttatttatttatttatttatttatttatttcttcttcttctttttaacaaggccttttttttttcacttccaacatctggagaaaacacataaggaaatgttaataaatagttacaggaattgataacattgaa

SEQ ID NO: 2280 - DNA, 396 bp, Homo sapiens
  chr2.fa.O7frz.9062341
  Located on chromosome 2
  Distance between a terminus base of telomere on chromosomal short arm and 5'-terminus of this base sequence : 8318070
  Distance between 3'-terminus of neighbour sequence of sequence listing upward to telomere on chrosomal short arm and 5'-terminus of this base sequence : 94752
aacactcagaggttctatccttacatgcaagaaaaggagaatgggccggtgcagaggagcacccctgcagtcccagctactcaggaggctgacgtgggaggctcacttgagcccaggagtttgaaatcaaaatagtaagacgctgtgtcagaaaaaaaaaaaaagaaaagaaaagaaagaaagagacggaaggaaggaaggaaggaaggaaggaaggaaggaaggaaggaaggaaggaaggaaagaaggagggagggagggagggagggaggaaagtgtgagccaccgcgcctggccagtcgatttccactcttaactggattcaaatcatcgtgggaatttgaactctgcacgtgttagggctgcaccccctgagattctgattcagttgatcaa

SEQ ID NO: 2281 - DNA, 445 bp, Homo sapiens
  AC041014.2_108442
  Located on chromosome 2
  Distance between a terminus base of telomere on chromosomal short arm and 5'-terminus of this base sequence : 8384846
  Distance between 3'-terminus of neighbour sequence of sequence listing upward to telomere on chrosomal short arm and 5'-terminus of this base sequence : 66380
agcttgcaagatgtttgaggagcttagcattgactgtggcaggcgggccattgcttctatgattaaaaaggcccaactcccccctacatctgccctcgactctcagggcacacctgggccctcaggccgggtgtgctcagctgagcttggccatttctcctccctcgctccacaggcgcacagggccagttggtcatcatgcagcccacgtggcctttgggaccaaccctgccctgctgggatatgcttcagggacctgaggatggaacactcccctgggccagtggacagacacacacacacacacacacacacacacacacacacacagaagcaaaaactgctttgtccaagaaaggcacagacgcatttataaccagattccaaggtcagctgcttggagcatgaagcgaggtcatgtcctcttgcttcttgaattaggtca

SEQ ID NO: 2282 - DNA, 158 bp, Homo sapiens
  D2S2243
  Located on chromosome 2
  Distance between a terminus base of telomere on chromosomal short arm and 5'-terminus of this base sequence : 8385083
  Distance between 3'-terminus of neighbour sequence of sequence listing upward to telomere on chrosomal short arm and 5'-terminus of this base sequence : -208
tgggatatgcttcagggacctgaggatggaacactcccctgggccagtggacagacacacacacacacacacacacacacacacacacacacagaagcaaaaactgctttgtccaagaaaggcacagacgcatttataaccagattccaaggtcagct

SEQ ID NO: 2283 - DNA, 148 bp, Homo sapiens
  DID22N_0015799
  Located on chromosome 2
  Distance between a terminus base of telomere on chromosomal short arm and 5'-terminus of this base sequence : 8446533
  Distance between 3'-terminus of neighbour sequence of sequence listing upward to telomere on chrosomal short arm and 5'-terminus of this base sequence : 61292
atactcacatcccactgcctcagagcgtgggctcattcccaaggggccttctctctctctctctctctctctctctctctctctctttctctctctctctctctctctctctctctctccctccctccaactcagcagcactctttag

SEQ ID NO: 2284 - DNA, 234 bp, Homo sapiens
  D2S2207
  Located on chromosome 2
  Distance between a terminus base of telomere on chromosomal short arm and 5'-terminus of this base sequence : 8811543
  Distance between 3'-terminus of neighbour sequence of sequence listing upward to telomere on chrosomal short arm and 5'-terminus of this base sequence : 364862
caagacacctctggtcagatgcctacaatgaaaggggctggtgatatttctgtcgcagggccacaaatgagagaatggtacacactggcatttagaaaagttataccctccctccccggcctttttgtgtgtgtgtgtgtgtgtgtgtgtgtgtgtgtgtgtgtgtgtgtgcgcgcgcgcgcgcgcgctgtggggggagacagtctatcacccaggctggaactcagtggtgca

SEQ ID NO: 2285 - DNA, 253 bp, Homo sapiens
  D2S2169
  Located on chromosome 2
  Distance between a terminus base of telomere on chromosomal short arm and 5'-terminus of this base sequence : 9037086
  Distance between 3'-terminus of neighbour sequence of sequence listing upward to telomere on chrosomal short arm and 5'-terminus of this base sequence : 225309
tcacttgagcccaggagttcgagacgagcctgagcaacacagtgagacctcatctctacaaaaaattaaaataaaataaaataaaataaaatctagataatctgacctggtgacttaagcacacacacacacacaacacaacacacactacacacaacacacagacacacacacacacacacacacacacacacacacacacacacagcctggccagtctttggctcctagtataagtctcaacactgggctt

SEQ ID NO: 2286 - DNA, 207 bp, Homo sapiens
  AC010969.10_123247
  Located on chromosome 2
  Distance between a terminus base of telomere on chromosomal short arm and 5'-terminus of this base sequence : 9331206
  Distance between 3'-terminus of neighbour sequence of sequence listing upward to telomere on chrosomal short arm and 5'-terminus of this base sequence : 293867
actacaggatcaagcctagcttattattactattattattattattattattattattttggagagacaggttctcactacgttgttcaggctggtctcaaactcttagcctcaagcaatcctcctgcctcggccttctgagtgactgcgattacaaatgtgagccactgcgccgggctctttgtcatttctgttcttttggatcta

SEQ ID NO: 2287 - DNA, 454 bp, Homo sapiens
  AC007240.2_71393
  Located on chromosome 2
  Distance between a terminus base of telomere on chromosomal short arm and 5'-terminus of this base sequence : 9489646
  Distance between 3'-terminus of neighbour sequence of sequence listing upward to telomere on chrosomal short arm and 5'-terminus of this base sequence : 158233
gcacctacgcatagattgttcttggggggtaaatgaattaatacatgtgagggttggccaggcacagtggctcacgcctgtaatcccagcactttgggaagctgaggcggacagatcacaaggtcaggagttcgagcccagcctggccaataaggtgaaaccccatctctctactaaaaatacaaaacttagccaggcgtggtggtgcaagcctgtaattgcagctactcgggaggctgaggcagaagaataacttgaacccgggaggcggaggttgcagtgagcagagattgtgccatcgcactccagcctgggtgacagagtgagactctgtctcacaaaaataaatacatacatacatacatacatacatgtgacggtctcccagacatgcactccggctccaccttgaccaaggggatggggctcacggttaagtcaaactctcaggctc

SEQ ID NO: 2288 - DNA, 430 bp, Homo sapiens
  AC007240.2_115392
  Located on chromosome 2
  Distance between a terminus base of telomere on chromosomal short arm and 5'-terminus of this base sequence : 9533884
  Distance between 3'-terminus of neighbour sequence of sequence listing upward to telomere on chrosomal short arm and 5'-terminus of this base sequence : 43784
agttaattccttgtaaatctcagatccccagtgacagatagaatttatatagtatatatatataaaattctattatatatattctatatatgtattctatatatattcatctatctatctatctatctatctatctatctatctatctatctatctatctatctatctatatgatagccagagacaaaaagcagagaagtcgaggatggaataacaattaggccagcagcaaattcctcaacagcaacgataaaattataaaatgatatcttcaaaatttcaagaataatgttcaaataaaggtattttcagataaagagcagatgctcaacttcattagtaataaagaaaattaaaattggatcacattgaaataccattttactcccacttacattggtaaaagaagtctgacaataccaactgttag

SEQ ID NO: 2289 - DNA, 137 bp, Homo sapiens
  D2S398
  Located on chromosome 2
  Distance between a terminus base of telomere on chromosomal short arm and 5'-terminus of this base sequence : 9689660
  Distance between 3'-terminus of neighbour sequence of sequence listing upward to telomere on chrosomal short arm and 5'-terminus of this base sequence : 155346
tgatgccctcataacaaagagttcttttgtgtgtgtgtgtgtgtgtgtgtgtgtgtgtgtgtgtgtgtgtgtgtgtgacggagtcttgctctgtcacccaggctggagtgcagtagtgtgatcttgtctcgctgcaa

SEQ ID NO: 2290 - DNA, 456 bp, Homo sapiens
  AC007249.3_26376
  Located on chromosome 2
  Distance between a terminus base of telomere on chromosomal short arm and 5'-terminus of this base sequence : 9798125
  Distance between 3'-terminus of neighbour sequence of sequence listing upward to telomere on chrosomal short arm and 5'-terminus of this base sequence : 108328
ctccagataaatctgatctttaaagttcaaaacaaaacaccccctatttatcaaatatgtgtgtttaaaaagactggaagaaaacgagagaaaataatagcttctattgtctttgggtaataagatcatgtgtggtttcccctttatttttatttattttctccatttttttcccctacattttctgagtgttctacaacaggcctgcagttcttggataatcagaaaaacagcgagagagagagagagagagagagagagagagagagagagagagtgtgtgtgtgtgtgtgtgtgtgtgtgtagcagcatgcagatgaggcgaaacttgtttgcttgctttggtgggagaagttgtcattttaaagatgcaggtgcttctctaacaggaaaagcaaagcacattccctttatccgggcagaaccccagagctggcctccatagctatgcacctg

SEQ ID NO: 2291 - DNA, 236 bp, Homo sapiens
  chr2.fa.O7frz.10503354
  Located on chromosome 2
  Distance between a terminus base of telomere on chromosomal short arm and 5'-terminus of this base sequence : 9932140
  Distance between 3'-terminus of neighbour sequence of sequence listing upward to telomere on chrosomal short arm and 5'-terminus of this base sequence : 133559
caataactcagaagtgtgagctagccctgaactgggaccaacaggtcaccaaaaatatatgcacacaaaacacacacacacacatacacacacacacacacacacacaccccgtaaaaacatctaaaagcacctaatgaagtctaaaaaagcaagaataatgtctaaattaaaccaaaacaaagtcagagctgtttttcatagcttgtaactcttgtagaatctttcatcttagca

SEQ ID NO: 2292 - DNA, 100 bp, Homo sapiens
  D2S297
  Located on chromosome 2
  Distance between a terminus base of telomere on chromosomal short arm and 5'-terminus of this base sequence : 10306070
  Distance between 3'-terminus of neighbour sequence of sequence listing upward to telomere on chrosomal short arm and 5'-terminus of this base sequence : 373694
gatcaaaaaaccaagttcaaaggagaatcaaaggacgtgtgtgtgtgtgtgtgtgtgtgtgtgtgtctttgtgtgtgtgtgtgtgtgtgtgcaatcagga

SEQ ID NO: 2293 - DNA, 466 bp, Homo sapiens
  AC019041.7_105187
  Located on chromosome 2
  Distance between a terminus base of telomere on chromosomal short arm and 5'-terminus of this base sequence : 10344512
  Distance between 3'-terminus of neighbour sequence of sequence listing upward to telomere on chrosomal short arm and 5'-terminus of this base sequence : 38342
gtgctgatgcatttgacacagtgcgctcctgaggccatcgccatggtctcaataacaaatgcccgggtgcggggagcggggagggatagcattgggagatatacctaatgctagatgacgagtcggtgggtgcagcgcaccagcatggcacgtgtatacatatgtaactaacctgcacattgtgcacatgtaccctaaaacttaaagtataataataataaataaataaataaataaataaataaataaataaataaaaaatgcccatcatcctgatagtgtcctgggcccttgtcacccccccttttcaccctctgcccaattcccaggcaaccctcatctgctttcagtcaaaccggtggcttctaatcagcaatgttcatttgtcgtcagggatggtcactgtcagagtttatacctttttttgtaatgaaataggaatgaaagcatgtcattaagcactgat

SEQ ID NO: 2294 - DNA, 310 bp, Homo sapiens
  AC019041.4_171977
  Located on chromosome 2
  Distance between a terminus base of telomere on chromosomal short arm and 5'-terminus of this base sequence : 10387920
  Distance between 3'-terminus of neighbour sequence of sequence listing upward to telomere on chrosomal short arm and 5'-terminus of this base sequence : 42942
tcagaatactgagtaaagattgaagaagtttgaatttaaaatacacaaatccctggtattttagaccatgatctctgtctcagaccacaaatgcacattcaggtccacagacatacacacacacacacacacacacacacacacacacacacacacatatatgtatatatacctgcatacatatatgtgtgtgtatacgtgtgtgtgtgtgtgtgtatatatatgtgtgtctgtaatttggtgagggttctctttacccacaaaaatccctgttgaaagacaagcctatctgtgtcttgcggttgactag

SEQ ID NO: 2295 - DNA, 423 bp, Homo sapiens
  AC019041.4_35988
  Located on chromosome 2
  Distance between a terminus base of telomere on chromosomal short arm and 5'-terminus of this base sequence : 10420040
  Distance between 3'-terminus of neighbour sequence of sequence listing upward to telomere on chrosomal short arm and 5'-terminus of this base sequence : 31810
gtttagcatttgaatcggtagatgcaggaaagcagatttccctccccggtgtgtgcaggcctcatccagtccaccgaaggcctgacatgtgctctcactgtctgagctgaaacatgaatcttctctgccttccgattctgactcggactggaacttacacatcagctctcccaggtccccagcctgctgactgcagatctggagacctctcagcctccataaccacgagtcagttccttatgataaatctctctttctctctctctctctttctctctctctctctctgcatgtgtatgtgtgtgtgtgtgtgtgtgtgtgtgtgtgtgtgtgtgtgtgtaggctattggttctttagaaccaattccctggagaacccagactaaaacaccaacaaaacctaagtcattaacaattaagtca

SEQ ID NO: 2296 - DNA, 279 bp, Homo sapiens
  D2S2278
  Located on chromosome 2
  Distance between a terminus base of telomere on chromosomal short arm and 5'-terminus of this base sequence : 10420256
  Distance between 3'-terminus of neighbour sequence of sequence listing upward to telomere on chrosomal short arm and 5'-terminus of this base sequence : -207
ccataaccacgagtcagttccttatgataaatctctctttctctctctctctctttctctctctctctctctgcatgtgtatgtgtgtgtgtgtgtgtgtgtgtgtgtgtgtgtgtgtgtgtgtaggctattggttctttagaaccaattccctggagaacccagactaaaacaccaacaaaacctaagtcattaacaattaagtcatatatttccatatgttcctccatgcctatataatcctttacagaccaaaaaatggatgatggcatctttact

SEQ ID NO: 2297 - DNA, 187 bp, Homo sapiens
  DISD22_0001552
  Located on chromosome 2
  Distance between a terminus base of telomere on chromosomal short arm and 5'-terminus of this base sequence : 10518241
  Distance between 3'-terminus of neighbour sequence of sequence listing upward to telomere on chrosomal short arm and 5'-terminus of this base sequence : 97706
ggtcacaccatgattccccatattctctaatatatacagcattccaaatttaaacttttgccttttttactcaaatatttcagttactcatatgtaaacttgaaattatttcaccttaataaagtttattaaaaatatatatatatatatatatatatatatactctccaattcagaataggataga

SEQ ID NO: 2298 - DNA, 215 bp, Homo sapiens
  Z67467
  Located on chromosome 2
  Distance between a terminus base of telomere on chromosomal short arm and 5'-terminus of this base sequence : 10734891
  Distance between 3'-terminus of neighbour sequence of sequence listing upward to telomere on chrosomal short arm and 5'-terminus of this base sequence : 216463
aagtgcttaatcgccgggagccagaaggtcacacccattgtaacaactggcaaggctggagtggcagccaacagggcttgacttccagagtgaaggagatgttgacagaatacagcaatgctagtgaggggcggcccatacgtggactgctgtgtgtgtgtgtgtgtgtgtgtgtgtatttacgtgtgtatatataaactggactggagttagct

SEQ ID NO: 2299 - DNA, 115 bp, Homo sapiens
  D2S1400
  Located on chromosome 2
  Distance between a terminus base of telomere on chromosomal short arm and 5'-terminus of this base sequence : 10822613
  Distance between 3'-terminus of neighbour sequence of sequence listing upward to telomere on chrosomal short arm and 5'-terminus of this base sequence : 87507
tggaatcgttttacctctgcctgcccgcctgcctgcctgcctgccttccttccttccttccttccttccttccttcctccttcctgtttgacgaatgagttatcgttgacctata

SEQ ID NO: 2300 - DNA, 370 bp, Homo sapiens
  AC011994.9_144312
  Located on chromosome 2
  Distance between a terminus base of telomere on chromosomal short arm and 5'-terminus of this base sequence : 10872031
  Distance between 3'-terminus of neighbour sequence of sequence listing upward to telomere on chrosomal short arm and 5'-terminus of this base sequence : 49303
tgatgccatctaccaagacttgggtatctttcactgcctccaaaaccaggtaattaccaagtgctgtagattttcctgcaggtgtgtgtgtgtgtgtgtgtgtgtgtgtgtgtgtgtgcacgcaatctgttctcttctatcttgccctgactgctctggtgccgtcctcagctggactgtcataactgacttctcccaggtctccacacagaccagattcccaccagtgcatcctcgaatgtcttctacaacatagtcacatcacccaggggcttcaaaccctgcagtgtttccatttggcctcgggagctaataagtgactcttctcttccccaccccaagtcccagctgtagttgacgtaggagtcag

SEQ ID NO: 2301 - DNA, 429 bp, Homo sapiens
  chr2.fa.O7frz.11492754
  Located on chromosome 2
  Distance between a terminus base of telomere on chromosomal short arm and 5'-terminus of this base sequence : 11085802
  Distance between 3'-terminus of neighbour sequence of sequence listing upward to telomere on chrosomal short arm and 5'-terminus of this base sequence : 213401
taatgctatccagttatgagctagctagcttgctttctttcttttctttctttctttctttctttctttctttctttctttctttctttctttctttcttttctttctttctttctcattcttgggtgtttcttgcagagggggatttggcagggtcataggacaacagtggagggaaggtcagcagataaacaagtgaacaaaggtctctggttttcctaggcagaggaccctggggccttccgcagtgtttgtgtccctgggtacttgagattagggagtggtgatgactcttaacgagcctgctgccttcaagcatctgtttaacaaagcacatcttgcaccgcccttaatccatttaaccctgagtggacacagcacatgtttcatggagcaccgggttgggggtaaggtcatagatcaacagca

SEQ ID NO: 2302 - DNA, 213 bp, Homo sapiens
  D2S328
  Located on chromosome 2
  Distance between a terminus base of telomere on chromosomal short arm and 5'-terminus of this base sequence : 11141173
  Distance between 3'-terminus of neighbour sequence of sequence listing upward to telomere on chrosomal short arm and 5'-terminus of this base sequence : 54942
aaatggtatcttagccagagagagactaaggatgttttggtgtgtgtgcatgtgtgtgtgtgtgtgtgtgtgtgtgtgtgtgtgtgtggttgttttggcttggcttgttttaaggatgaaatgagagattgcagaatatttatgtgctgatgtgaattacccaaaagagaggaggaatttgatggggtgtgtgtaggggcgaatgaagcaaat

SEQ ID NO: 2303 - DNA, 437 bp, Homo sapiens
  AC012456.8_124696
  Located on chromosome 2
  Distance between a terminus base of telomere on chromosomal short arm and 5'-terminus of this base sequence : 11168910
  Distance between 3'-terminus of neighbour sequence of sequence listing upward to telomere on chrosomal short arm and 5'-terminus of this base sequence : 27524
gtattgagtgatgtagctaggacttgagctgagagctgtccgactccggaacctgtcccataagaccatgatctcattgtgtgtgtgtgtgtgtgtgtgtgtgtgtgtgtgtgtgtgtgtgtgtggtaggggcagtggtgtggtggggactgggtctgttcacccagggcctgctgactgcaacagccattcttcctgctttggaaaacttctggtcaccttatggggaaaaatcctgagatttctcagtatagtatccctggaagaccattcactaggacctggcattgttggaaggcaagcattcctggacagatgccagaggctgagcacgggtttagttcaatccaactcagttcaatgcaacctgcattatttagccctgaccatgtgccagtttgctcttggccacagtgtagtttaggagaaacagatga

SEQ ID NO: 2304 - DNA, 443 bp, Homo sapiens
  chr2.fa.O7frz.11989499
  Located on chromosome 2
  Distance between a terminus base of telomere on chromosomal short arm and 5'-terminus of this base sequence : 11500094
  Distance between 3'-terminus of neighbour sequence of sequence listing upward to telomere on chrosomal short arm and 5'-terminus of this base sequence : 330747
tccatctctatctgtccatctacctatttatctatcactatctgttaatatatctatctgtctatcatctgtctctgtcactctatcattctatctatcatctatttatgtatcatctatataatctaccactatctattatctatctatctatctatctatctatctatctatatctatctatctatatctgtccctctatctaatctatcaatcactcctactacatctatcatctatctatctatctatctatcactatttatctatctatcatctatgtaatctatctttttttttgcaagtttgaaggactgaaggagcagagggagaatgctccagtcacccagtgcccactaatggctgggataaggactacgctgggcaagaacacaggcataaatgtgaataggatttcatccctgtggaaactccttccagag

SEQ ID NO: 2305 - DNA, 301 bp, Homo sapiens
  chr2.fa.O7frz.12096839
  Located on chromosome 2
  Distance between a terminus base of telomere on chromosomal short arm and 5'-terminus of this base sequence : 11560841
  Distance between 3'-terminus of neighbour sequence of sequence listing upward to telomere on chrosomal short arm and 5'-terminus of this base sequence : 60304
attctgttgcttgatagaataaacaagtaatacccatgtgatttaaatccatatgtatatgtgtgtgtggaagagaggtatgtgtatgtgtgtctgtgtgtgtgtgtgtgtgtgtgtgtgtgtgtgtgtgtttatgatcagaacaagtatgccacaatgtgtacgtcctcaaaacgttagggcaaacctagtttgcttcataggtatttattcagtaggagttcagaataaggtaagttatagtttttcccattatctggtggacagatcatatattgtgtcagctcagttctaaatgttg

SEQ ID NO: 2306 - DNA, 475 bp, Homo sapiens
  chr2.fa.O7frz.12273362
  Located on chromosome 2
  Distance between a terminus base of telomere on chromosomal short arm and 5'-terminus of this base sequence : 11731678
  Distance between 3'-terminus of neighbour sequence of sequence listing upward to telomere on chrosomal short arm and 5'-terminus of this base sequence : 170536
acttatttcacagctttcgttaccactcgacctttgccccaacacctgatgtcagtttaaaatgagttcccaactggaggcagatgaggctgggtgggaaggatggaaaagccaagtgggcctggtatggcttggttagaggcagggctgctctgatgctcagctcagttctagtatgagatggattttctgtttgagagaaccattgctgctgtaacataggcagaaatgagagagagagagagagagagagagagatactgagacttggggtagtatctttggagacaaacacatctgattcaaatcctggatctggcccttatttactctcagtggtgagtttttaacccctctttcatttttcttacctttaaaatgagattatagatacatatacacacatactcatacatatatgcgtgtttatgtatgtatgtatgtatgtatatgaagactttaccagaattgaatg

SEQ ID NO: 2307 - DNA, 464 bp, Homo sapiens
  chr2.fa.O7frz.12398808
  Located on chromosome 2
  Distance between a terminus base of telomere on chromosomal short arm and 5'-terminus of this base sequence : 11785074
  Distance between 3'-terminus of neighbour sequence of sequence listing upward to telomere on chrosomal short arm and 5'-terminus of this base sequence : 52921
ttaacctgcaaatttcagatacggttgttaatagaaaaattcttataaaagtagcataataatccttttagggcttaaatttttttattcaaaatatcaaatgatattatttatagataacattaactcagtcattcacaaatactagagatatttgtttatttttccccattattattttatgtattcaatcttttttgtcttactatggctttcttgatatttattttatattttggttataacaccacaatgatttattcttttcttttgccaagttgttccagcttctgccgctgggaactctttcagttggttcctgtgttcctctaaaacaccccatcaatgtgtgtgtgtgtgtgtgtgtgtgtgtgtgtgtgtgtgtattaagcatttctactttctggcattacaagatgctccaagctcattttgtgcattccctactccagtgctagaaccag

SEQ ID NO: 2308 - DNA, 376 bp, Homo sapiens
  AC068976.2_47846
  Located on chromosome 2
  Distance between a terminus base of telomere on chromosomal short arm and 5'-terminus of this base sequence : 12182220
  Distance between 3'-terminus of neighbour sequence of sequence listing upward to telomere on chrosomal short arm and 5'-terminus of this base sequence : 396682
tcaaggtacaatttctcaagttacttgggatttgggccccttcttactttcccttgtcacatcttttttagccccaagggttttgacattaaagtgacatctaacactcagcaaattagggttgtctagtttcactattaatgttgcctacctcttatgcttctcaagataacacacacacacacacacacacacacacacacattcatgaatcagataataaaggatgcaagtagagacaaggctcaccatttgacccctacttctttgaagtagttagaacattttacttgcaagtgacagaaacccagttcaagctgccaaaccaaaaccaaactgaaaaaaaaaaaaatagacttttgaactaccaaggtag

SEQ ID NO: 2309 - DNA, 190 bp, Homo sapiens
  D2S2199
  Located on chromosome 2
  Distance between a terminus base of telomere on chromosomal short arm and 5'-terminus of this base sequence : 12182288
  Distance between 3'-terminus of neighbour sequence of sequence listing upward to telomere on chrosomal short arm and 5'-terminus of this base sequence : -308
tagccccaagggttttgacattaaagtgacatctaacactcagcaaattagggttgtctagtttcactattaatgttgcctacctcttatgcttctcaagataacacacacacacacacacacacacacacacacattcatgaatcagataataaaggatgcaagtagagacaaggctcaccatttgacc

SEQ ID NO: 2310 - DNA, 160 bp, Homo sapiens
  Z67480
  Located on chromosome 2
  Distance between a terminus base of telomere on chromosomal short arm and 5'-terminus of this base sequence : 12183646
  Distance between 3'-terminus of neighbour sequence of sequence listing upward to telomere on chrosomal short arm and 5'-terminus of this base sequence : 1168
cacaaggctttccaagcagaaccttgctgattgtgtgtgtgtgtgtgtgtgtgtgtgcacgtgtgcttgcagatgcttagaatcacaggcttttatgatctgggtttcttaaaccttatctggttcaaccacttccttattcagatcaggtaactgaggc

SEQ ID NO: 2311 - DNA, 263 bp, Homo sapiens
  AC068976.2_116519
  Located on chromosome 2
  Distance between a terminus base of telomere on chromosomal short arm and 5'-terminus of this base sequence : 12278220
  Distance between 3'-terminus of neighbour sequence of sequence listing upward to telomere on chrosomal short arm and 5'-terminus of this base sequence : 94414
aactttaaattcctttctgcacagacaaaaggaagtgacttatttcccacgctgtgaaaccgtgctatatatttacggatttttgacaagtactttcaagtcacagggcagcacacacacacacacacacacacacacgcacacacacacacacacatctttatctctatatctctctatctctaactctatctctatctctatttctatctctatcttctctatctctatctctactggagttccatgaaaggataagagac

SEQ ID NO: 2312 - DNA, 359 bp, Homo sapiens
  AC073062.3_77917
  Located on chromosome 2
  Distance between a terminus base of telomere on chromosomal short arm and 5'-terminus of this base sequence : 12492169
  Distance between 3'-terminus of neighbour sequence of sequence listing upward to telomere on chrosomal short arm and 5'-terminus of this base sequence : 213686
taggtatcatcgtttctaaggagaatgttttcctcagtaaacctgttgccaccatcataaatatatgtgtgtgtgtgtgtgtgtgtgtgtgtgtgtgtgtgtgtgtgtgtgtgtatgaaatatatgtgtttgtgtatgcatatatgaatacatacacatatacacaaaaacacacatacacatatatttctaaattccaatgagagagaatataactaattaaattttttaaaatatttacatatatgcttacacgtgagtggtgcatgtttatatacatatatgtgcatttgtgtgagagcactcataagtcccatgaacaaatctggcattttctgttacattttctgcaaccataa

SEQ ID NO: 2313 - DNA, 471 bp, Homo sapiens
  chr2.fa.O7frz.13409101
  Located on chromosome 2
  Distance between a terminus base of telomere on chromosomal short arm and 5'-terminus of this base sequence : 12520924
  Distance between 3'-terminus of neighbour sequence of sequence listing upward to telomere on chrosomal short arm and 5'-terminus of this base sequence : 28396
tctgaaggtcataagacttgtaacttccccaattacttataggtaaaaatagataaaaatcacttttgttgaccctcatattgggctgactcagcacacaaggaccactttccacacccctgtgatttcaccccaaccaatcagtggtatgcattccctagtccctgcctgccaaattattcttaaaaattcccagtctccaaattttgggggagactgatttgagtaaaaaattccagttttccacttacatatactgtatatatgtgtgtgtgtgtgtgtgtgtgtgtgtgtgtgtataatacgcatactatatatgatatatatattatatatatgtatgtggatttataaaagacaaaaataataaacaagcctggaccatgcaaaagctactcaagagcttatagcctagatcaatacaaaaagataatcataaaaaagtctgcctgaattcacagttattgcagt

SEQ ID NO: 2314 - DNA, 302 bp, Homo sapiens
  AC073062.3_102617
  Located on chromosome 2
  Distance between a terminus base of telomere on chromosomal short arm and 5'-terminus of this base sequence : 12533211
  Distance between 3'-terminus of neighbour sequence of sequence listing upward to telomere on chrosomal short arm and 5'-terminus of this base sequence : 11816
ggtattaatgacttcagtaccaaataagtctagaatttattttctcccagtatgcagaataagaatttgaaatgatttcacacacacacacacacacacacacacacacacacacacacacatatatatatttggtatgtgctagcatggtttacagtgaagacattgacagggtgaaagaaaaaggaagggtttaaagatgatactgtattttttttcacattaagtaggaaacaagaatggttcaaaattggtcaacatagtagatattgaatggaatataaatcaatggaattgtggta

SEQ ID NO: 2315 - DNA, 142 bp, Homo sapiens
  D2S2267
  Located on chromosome 2
  Distance between a terminus base of telomere on chromosomal short arm and 5'-terminus of this base sequence : 12603544
  Distance between 3'-terminus of neighbour sequence of sequence listing upward to telomere on chrosomal short arm and 5'-terminus of this base sequence : 70031
aagccctgatgtgtcctttctgaagctggttatttacacacacacacacacacacacacacacacacacacacacgacagagagagagttttttctctggaatataactgttaaaataatgacacttaaaatctatcaagaa

SEQ ID NO: 2316 - DNA, 197 bp, Homo sapiens
  G12426
  Located on chromosome 2
  Distance between a terminus base of telomere on chromosomal short arm and 5'-terminus of this base sequence : 12676284
  Distance between 3'-terminus of neighbour sequence of sequence listing upward to telomere on chrosomal short arm and 5'-terminus of this base sequence : 72598
actgagggaagaatcaatcaaccagagggggattttagaaattatttaaattaagtcacacaaaaaagaataaaaatccagaacaaagatttaagagatataggccaatatcaaaacatctatctacctatctatctatctatctatctatctatctatctatctaagtctatatgtgattggtatctcagaaagtg

SEQ ID NO: 2317 - DNA, 465 bp, Homo sapiens
  AC041020.2_167743
  Located on chromosome 2
  Distance between a terminus base of telomere on chromosomal short arm and 5'-terminus of this base sequence : 12709388
  Distance between 3'-terminus of neighbour sequence of sequence listing upward to telomere on chrosomal short arm and 5'-terminus of this base sequence : 32907
gaatccaagcctattttagattagtgacacacgcctggccttctgagacatcatttggtccttttcctctctttgctttctagtatttgtacatttaatgagaaatttcagtatggataaatgagatgtgtgtatttgtgtgtgtgtgtgtgtgtgtgtgtgtgtgtgtacttaaattcttattgcaaatatttatgttgtcatgaagtctggaaatctatacacccacaagcataaaaaattactttgcagttacaaaacttgatgtaattcttataaatgattgccaaaaaagttaattttatagtaaatcttatctattaaaaagctgtgaagaaatgtaagcatattttctgtgaatatagaacactatttgaaaatagcttcatcaaataatcgtgtaataataaacaagcatactaacaaacaaaaccaaaactattctcacttgtcttcaccttgtta

SEQ ID NO: 2318 - DNA, 133 bp, Homo sapiens
  DISO7_10000859
  Located on chromosome 2
  Distance between a terminus base of telomere on chromosomal short arm and 5'-terminus of this base sequence : 12876706
  Distance between 3'-terminus of neighbour sequence of sequence listing upward to telomere on chrosomal short arm and 5'-terminus of this base sequence : 166853
ctgagaacctaggtcgatctctttctctctctctctctctctctctctgtctctgtgagactgtatatcaatctctgtctttatctctctctctctctctcatatatagttccctcttgaagcatttctctgt

SEQ ID NO: 2319 - DNA, 238 bp, Homo sapiens
  DISO7_10000860
  Located on chromosome 2
  Distance between a terminus base of telomere on chromosomal short arm and 5'-terminus of this base sequence : 12952924
  Distance between 3'-terminus of neighbour sequence of sequence listing upward to telomere on chrosomal short arm and 5'-terminus of this base sequence : 76085
tcctgtgctatgtgctgtgccaaatttatatataaatataaatacacatttattcatgcatatgaatttagtttacattgtaaatttttgaggttacacacacatatacatatatacatttaaatatgtatatgtatatgtatatatgcacacacacacacacacacacatatatatatatggtctttccactttattgaagataaaaactgaatgaaaacaacatgacattgggctc

SEQ ID NO: 2320 - DNA, 475 bp, Homo sapiens
  AC017088.4_132096
  Located on chromosome 2
  Distance between a terminus base of telomere on chromosomal short arm and 5'-terminus of this base sequence : 13150098
  Distance between 3'-terminus of neighbour sequence of sequence listing upward to telomere on chrosomal short arm and 5'-terminus of this base sequence : 196936
cctaatcacatacaaagcacttatattatataatcacatataagcttgcatatatttaaacacaatgaaatcaggagaaaacgtatatttatacccttgtatgttcactatttattatttaaaaaaataaatatccacttttattattgtctgtgaaaaaaatcccaagtgtgtgtatacaaacgcaaatacacacacacacacacacacacacacacacacaagcttgtattcatttgtacaagcaaggataaatatgcgcaaattttgttgcatgaagggaaaagcattaaggcagggaaagggtgaaattttataagtacatattggctaaatttgttctggggtgtctggaattggctctctaatctgattaaagcactaatgactatttttagtagtaaagagagtactgataattcatggaatgagctgtttatatagatttacaaagtatctgcattggatactcaag

SEQ ID NO: 2321 - DNA, 456 bp, Homo sapiens
  AC017088.5_116365
  Located on chromosome 2
  Distance between a terminus base of telomere on chromosomal short arm and 5'-terminus of this base sequence : 13247032
  Distance between 3'-terminus of neighbour sequence of sequence listing upward to telomere on chrosomal short arm and 5'-terminus of this base sequence : 96459
atgcagacttgatttaacgtagtcaaccaatgtattcaccaaatcaataaacaaaaagtagaaaaatataaatatgatcttctcaataggtacagataaagcaattgtcaaaactgaatatccattccttataaaaaaagctcagaaaactagaaaactaggaaggacatgaaaaaaatctatagctaaacaccatactaatgttgaatggctgaatgcttttcctctaagggcaggtatgagacaaacatgtttgctctcactgtttcgaagccaatgaaacagggcaaaataataataataataataataataacaataaataaataaaacatccaagctgaaaagaaataaaactgcttttattcactgtttcttaaaaattgaagcatacacctatcatatattccacccatctcgctactaggaatttactcaagacaaatgaaagcgtat

SEQ ID NO: 2322 - DNA, 462 bp, Homo sapiens
  AC017088.4_102019
  Located on chromosome 2
  Distance between a terminus base of telomere on chromosomal short arm and 5'-terminus of this base sequence : 13260669
  Distance between 3'-terminus of neighbour sequence of sequence listing upward to telomere on chrosomal short arm and 5'-terminus of this base sequence : 13181
attggtaaggtttctggtaaacagtagattattagtagttaaatttctggggagtcaaaagttacacacagattttcacttgagggagggagcctggctcctctaatacctgaattgttcaaaggtcaaatctgtgtgtgtgtgtgtgtgtgtgtgtgtgtgtgtgtgtgtgtgtgtgtgtatttataattttattttttaaacttttttaaatttgcttttctgtttctaatttgttaaaatggaagtttaaatcatttaatttagaattttatttttttctaatgtaactttttgaagttacaatttcccactaagcactaatttaacagttaaattatgttatgctatgttatgttttcattatcattcagtcaaaatattttctaatttccctcatgattttttcctttggtccatggtttatttagtagtgaactgtataatttccaaagatctttg

SEQ ID NO: 2323 - DNA, 228 bp, Homo sapiens
  D2S149
  Located on chromosome 2
  Distance between a terminus base of telomere on chromosomal short arm and 5'-terminus of this base sequence : 13260760
  Distance between 3'-terminus of neighbour sequence of sequence listing upward to telomere on chrosomal short arm and 5'-terminus of this base sequence : -371
gcctggctcctctaatacctgaattgttcaaaggtcaaatctgtgtgtgtgtgtgtgtgtgtgtgtgtgtgtgtgtgtgtgtgtgtgtgtatttataattttattttttaaacttttttaaatttgcttttctgtttctaatttgttaaaatggaagtttaaatcatttaatttagaattttatttttttctaatgtaactttttgaagttacaatttcccactaagc

SEQ ID NO: 2324 - DNA, 293 bp, Homo sapiens
  AC022996.2_106023
  Located on chromosome 2
  Distance between a terminus base of telomere on chromosomal short arm and 5'-terminus of this base sequence : 13591740
  Distance between 3'-terminus of neighbour sequence of sequence listing upward to telomere on chrosomal short arm and 5'-terminus of this base sequence : 330752
ctcaccagacacataatctgaggccttgatcatggacttcccagcctccagaactgagaaatagatttctattgttaataacccacccagtctatggcattgtgttatagcagctcaaatgaactaagacagacagagaaacacatacacacaaatacatacacacacacacacacacacacacacacacacacacacagacagagagatcgtgacctgcccactgaattgctcttaaagagaagaaaatgcctttgtttagttgattgcttgttaaaacagtacgtagtgct

SEQ ID NO: 2325 - DNA, 441 bp, Homo sapiens
  AC022996.2_23796
  Located on chromosome 2
  Distance between a terminus base of telomere on chromosomal short arm and 5'-terminus of this base sequence : 13643043
  Distance between 3'-terminus of neighbour sequence of sequence listing upward to telomere on chrosomal short arm and 5'-terminus of this base sequence : 51010
aagtcttggagtcatacagctaataattgacagagctgagattaaaacccaggtttctggcaaataactccaggctctatccactgtagcacaagtaaacaacctccccgtaattacttccattaaaatatataaatacgtgtgtgtgtgtgtgtgtgtgtgtgtgtgtgtgtgtgtttgtatctgtgtgtgtgtttattttctggtcaagtgtcacaatatagacctttactgaggccacgtaaggattgcccaatttttttttaatgtattatgcactggaagatgctaaggaaaatttaacatgattccttcccttttctaattccttgcttctaaaaaaattatcttcttgagaaattctattctcaagcatttgctctgggaagaaattgctctcaacagaatgtgtggactctagatgctgaaagttgtaatctc

SEQ ID NO: 2326 - DNA, 440 bp, Homo sapiens
  AC022996.2_168360
  Located on chromosome 2
  Distance between a terminus base of telomere on chromosomal short arm and 5'-terminus of this base sequence : 13676358
  Distance between 3'-terminus of neighbour sequence of sequence listing upward to telomere on chrosomal short arm and 5'-terminus of this base sequence : 32874
acacctaatgctaaatgacgagttaatgggtgcagcacactaacatggcacatgtatacatatataacaaacctgcacgttgtgtacatgtaccctaaaacttaaagtataataataattaaaattagaaaaataataaaataaataaataaataaataaataaataaataaataaatgtatgcagttttgagctgttaaacgtgagcatagtgtgttaggcagcaaaataaaactgagacatatattcaaggctcatcccaaatgtcagctcttagaggaaaacgtcggattctcaaataccagcaaggagacccctcctcagatcctctacagtatcctgtgcctctctttatcaaagcatccaaaaataccatctcataattgtctgcttgtttttcttgctgtttccctagggtaagatcactttgctagtggaac

SEQ ID NO: 2327 - DNA, 168 bp, Homo sapiens
  D1S1639
  Located on chromosome 2
  Distance between a terminus base of telomere on chromosomal short arm and 5'-terminus of this base sequence : 13843209
  Distance between 3'-terminus of neighbour sequence of sequence listing upward to telomere on chrosomal short arm and 5'-terminus of this base sequence : 166411
gtttacatacttcaatgaaacttgcatttaaatgattaacttatatttccatacatcttgatcacttgcaaaacttttatttgaatacccttaatctatctatctatctatctatctatctatctatctatctatctaatcttagtttgttagggttactatagcaaa

SEQ ID NO: 2328 - DNA, 400 bp, Homo sapiens
  chr2.fa.O7frz.14451677
  Located on chromosome 2
  Distance between a terminus base of telomere on chromosomal short arm and 5'-terminus of this base sequence : 13844681
  Distance between 3'-terminus of neighbour sequence of sequence listing upward to telomere on chrosomal short arm and 5'-terminus of this base sequence : 1304
atctaacgtaggcctacatgtaacagtcaggtacacctttatgccatttgacacttgtacaattgcctcctctctttctgattcttcatacacacacacacacacacacacacctgactaaattttgatttactgtataattcttttatgggaagaaaaaaaattgctcaaaatatatgaacagctgttctctttgacagttgtatttttcactgtaaattaaaaaaagataagatgcgggtccaaccctgacagactgatcatctctttgaatctttgggaacagaattgggagctgaccttggatcagtgaggtaactatttattataggtatggaaaccaagaaattatttcttaccattatgcccactttttctctgaggaactatagacctggac

SEQ ID NO: 2329 - DNA, 396 bp, Homo sapiens
  chr11.fa.O7frz.52166229
  Located on chromosome 2
  Distance between a terminus base of telomere on chromosomal short arm and 5'-terminus of this base sequence : 14003488
  Distance between 3'-terminus of neighbour sequence of sequence listing upward to telomere on chrosomal short arm and 5'-terminus of this base sequence : 158407
cgtaggcatacatgtatcagtcaggtacacctgtatgccatatgacacttgtacaatagcctcctctcttactgattcttcatacacacacacacacacacacacacacctgactaaattgtgatatactgtataattcttttatgggaagaaaaaaaattgctcaaaatatatgaacagctgttctctttgacagttgtatttttcattgtaaattaaaaaaagataagatgcgggtccaaccctgacagactgatcatctctttgaatctttgggaacagaattgggagctgaccttggatcagtgaggtaactatttattataggtatggaaaccaagaaattatttcttaccattatgcccactttttctctgaggaactatagacctggac

SEQ ID NO: 2330 - DNA, 250 bp, Homo sapiens
  AC067771.2_151330
  Located on chromosome 2
  Distance between a terminus base of telomere on chromosomal short arm and 5'-terminus of this base sequence : 14195682
  Distance between 3'-terminus of neighbour sequence of sequence listing upward to telomere on chrosomal short arm and 5'-terminus of this base sequence : 191798
tggcagctttaaacatactagaactatcataaacgtacatagccttgaaatatcaccccagtctatacccacagacactcctttcacttttgtaatagtgaacaactatactcctatactagtcagggttctctagggggacaggactaatatgatagatagatagatagatagatagatagatagatagatagatagatagatagatgaaagggggtttattaaggagtattgactcacgtgatcacaa

SEQ ID NO: 2331 - DNA, 463 bp, Homo sapiens
  AC011897.7_83217
  Located on chromosome 2
  Distance between a terminus base of telomere on chromosomal short arm and 5'-terminus of this base sequence : 14199978
  Distance between 3'-terminus of neighbour sequence of sequence listing upward to telomere on chrosomal short arm and 5'-terminus of this base sequence : 4046
gttagtttccagaaaggactattatcattcttgagttaaaggtaaactataaactaaattcctcccgtagttagcttggcctacatgcaagaatgagcaaaggcaattagcttatagggggtagaaacaagatggagtcagctatgttcaatttttttgactgttaatctctaaaatatagggaattctttcaagctttccacgttgtcccattggtacacatccccctcccccccaacagacacacacacacacacacacacacacacacacacacacacaccgcttgatgtgaagcagatctcttccattccctttcctacctttttggtgtggagaaggtagagattcacagcatagcagcttctctttatcaagaaaatgcctcagatttttactcttccatcccataagttcaggtttttttcctagtttttttaattggtatgccaaggaacgtatg

SEQ ID NO: 2332 - DNA, 358 bp, Homo sapiens
  AC011897.7_176815
  Located on chromosome 2
  Distance between a terminus base of telomere on chromosomal short arm and 5'-terminus of this base sequence : 14274062
  Distance between 3'-terminus of neighbour sequence of sequence listing upward to telomere on chrosomal short arm and 5'-terminus of this base sequence : 73621
tgaatatttgagcattctgaagagtggttgtcaaactgcattagttgtggccttcagtgggttatgaaaatttgtttcaaatttgaaaaaatttaatgggtcataaccagcattttgtaaatgaaaggattagaacagcatggatgacagtagagtcatcagtttgaaatgcttttgttttgtttttgtgtgtgtgtgtgtgtgtgtgtgtgtgtgtgaatgcattgaaccatgatagtttcttaccataggttgatgtcaaaaatgtttgagaaacacaatttatgattctagccttcaaagaaaatgatagaatcatgaaataaaagagcagctgaccttagaattggagataagt

SEQ ID NO: 2333 - DNA, 236 bp, Homo sapiens
  D2S312
  Located on chromosome 2
  Distance between a terminus base of telomere on chromosomal short arm and 5'-terminus of this base sequence : 14600478
  Distance between 3'-terminus of neighbour sequence of sequence listing upward to telomere on chrosomal short arm and 5'-terminus of this base sequence : 326058
ggactagccagcctccatatcatgtgggccaattccttaaatctttttatacaaacacacacacacacacacacacacacacacacaccccatattggttctgtttctctgaagaattctaatacagttattatatgttgttctcatccatttattaaaataggtacctgagtaacttctgggcagtatcagtcacatagtaagaagtagttagagaagacaaactgtgggttcct

SEQ ID NO: 2334 - DNA, 166 bp, Homo sapiens
  DISO7_10000862
  Located on chromosome 2
  Distance between a terminus base of telomere on chromosomal short arm and 5'-terminus of this base sequence : 14652778
  Distance between 3'-terminus of neighbour sequence of sequence listing upward to telomere on chrosomal short arm and 5'-terminus of this base sequence : 52064
tctgcctctatcttctgtggttttagtgtatggtgtgtgtgtgtgtgtgtgtgtatgtgtgtgtgcaagtgtatacacactatataaaaaccacctcaaatcctttacaaaaataacaagaataatatattttagaagccagaaaatcctgcttcctgctgtagtc

SEQ ID NO: 2335 - DNA, 134 bp, Homo sapiens
  DISO7_10000863
  Located on chromosome 2
  Distance between a terminus base of telomere on chromosomal short arm and 5'-terminus of this base sequence : 14658682
  Distance between 3'-terminus of neighbour sequence of sequence listing upward to telomere on chrosomal short arm and 5'-terminus of this base sequence : 5738
tgcattgagatgtatgtgtttgtttgtatgtgtgtgtgtgtgtgtgtgtgtgtgtgtgtgtcttcatgcctagtgtatggtgggtgatttataaaggaaagcttttattatggtttaatcttcactctgaacct

SEQ ID NO: 2336 - DNA, 431 bp, Homo sapiens
  chr2.fa.O7frz.15435361
  Located on chromosome 2
  Distance between a terminus base of telomere on chromosomal short arm and 5'-terminus of this base sequence : 15048628
  Distance between 3'-terminus of neighbour sequence of sequence listing upward to telomere on chrosomal short arm and 5'-terminus of this base sequence : 389812
gaccatcctgactaacatgatgaaaccctgtgtctacttaaaatacaaaaaaattagccaggtttggtggcgggcacctgcagtctcagctacttgagacactgaggcaggagaatggcatgaacccgggaggcagagcttgcagtgagccaagatcactcaactgcactccagcctgggcgacagagcaagactccgtctcagaaataaataaataaataaataaataaataaataaataaataaaaataaaaaaataaaataaaatggcatagtattttcatataacccacacatatcctcctgtatactttgaatcatctctagattccttataatatccaatacaatataaatgctatgtaaatagtagttatactatattgttcagagaatgacaagaaaaagtctgtacatgttcaatacagaca

SEQ ID NO: 2337 - DNA, 428 bp, Homo sapiens
  chr2.fa.O7frz.15515900
  Located on chromosome 2
  Distance between a terminus base of telomere on chromosomal short arm and 5'-terminus of this base sequence : 15129138
  Distance between 3'-terminus of neighbour sequence of sequence listing upward to telomere on chrosomal short arm and 5'-terminus of this base sequence : 80079
atgtaataccttatttgtgctcacataaatacatcatatacacactttatatatttttatttatttatttatttatttttggagatggagtctcgttctgttgcccaggctggagtgcagtggtgtgatctcagctcactgcaacgtctgcctcccaggttcaagcagttctcctccctcagcctcctgagtagctgggactagatgtgcacgccgccatgcccggctaattttgtgtgtgtgtgtgtgtgtgtgtgtattttagtagagacggggtttcaccattttgcccaggctggtcttgaactcctgagctcaggcaatctgcctgcctcggcctcccaaagtgctaggattacaggcgtgagccaccgcgccggcccatatacacactttaaaaatacctcatctttattgactgctttcta

SEQ ID NO: 2338 - DNA, 393 bp, Homo sapiens
  chr2.fa.O7frz.15692789
  Located on chromosome 2
  Distance between a terminus base of telomere on chromosomal short arm and 5'-terminus of this base sequence : 15305983
  Distance between 3'-terminus of neighbour sequence of sequence listing upward to telomere on chrosomal short arm and 5'-terminus of this base sequence : 176417
cttcacctggtttctatcctagtcctagtgtccttttctagaaaatgtgatggcagggcatggtggctcacgcctgtaatcccagcactttgggaggccgaggtgtgtggatcatgaggtcaggagatcgagaccatcctggctaacatggtgaaaccccatctctactaaaaatgcaaaaattagctgggtgtggtggcatgtgcctgtagtcccagctactccagaggctgaggcaggagaattgcttgaacccagaaggcagagattacagtgagccaagatcacgccattgcactcaagcctgggtgacagagtgagattccatcaaaaaaaagaaagaaagaaagaaagaaagaaagaaagaaagaaagaaaggtggacaatactgat

SEQ ID NO: 2339 - DNA, 431 bp, Homo sapiens
  AC010145.7_93835
  Located on chromosome 2
  Distance between a terminus base of telomere on chromosomal short arm and 5'-terminus of this base sequence : 15517338
  Distance between 3'-terminus of neighbour sequence of sequence listing upward to telomere on chrosomal short arm and 5'-terminus of this base sequence : 210962
cactgattagctatgttagcactacatatccatatgatcttggttgaatacaacaaaagaagcaaataaactgtcttgtccaacctcttatattttcaggtgtggcccagaaaaattgaccgaattgtcccaggcattatggttggttcctggcagatctgaaccgagaactccagtatcattctctccttctagacagacacacacacacacacacacacacacacacacgcacacacacatgacaggggcacatgtcccatgctgctttctatttaaaaaaaaaaatgacatctgcccaggaatcacattgcacaatggcagtcctttcttttcctcttcctgtgttgagtcattgcccttgcctgtgaagtgcctgcatgaccacgttgccctatggacttactcagaagaaaggagtaatgatcagc

SEQ ID NO: 2340 - DNA, 456 bp, Homo sapiens
  HUMUT8122B
  Located on chromosome 2
  Distance between a terminus base of telomere on chromosomal short arm and 5'-terminus of this base sequence : 15529107
  Distance between 3'-terminus of neighbour sequence of sequence listing upward to telomere on chrosomal short arm and 5'-terminus of this base sequence : 11338
ccacgaagactagagcgtcttggaaaactggggcctccctgagccttgctttcctcctttcactaatggggagattctgccctttctttctttctttctttctttctttctttctttctttctttctttctttctttctttctttctctttcgttctttctttctttctctttctttctttctttctttctttctttctttctttctttctttctttccttccttccttccttccttccttcccttccccttccttccttccttccttccttccttccttccttccttccttccttccttccttccctccttccttccttccttccttccttccttccttccttccttccttccttccttcctctctctctctctctttctttctttctttctttcaatggcgtcttgctctgtctcccaggctggagtgattggtgcaatcttgactcactacaa

SEQ ID NO: 2341 - DNA, 459 bp, Homo sapiens
  AC010145.7_66776
  Located on chromosome 2
  Distance between a terminus base of telomere on chromosomal short arm and 5'-terminus of this base sequence : 15565152
  Distance between 3'-terminus of neighbour sequence of sequence listing upward to telomere on chrosomal short arm and 5'-terminus of this base sequence : 35589
tccttaagctcgtgttctaatatgtaagaggctgaaagactacctcctagggttgtaggcttaagccacaggtttcccagactttttggatcatggtgctcctaggccaaaaaaatatgtaactgttctgtttaagtgtttatatatatatatatatatatatagtatctcctaatgaattagtaggtatttgaaataatactgataaatggaaagaaaaagtactgtctttatttctttcacaaataactacaactcacaggatatgtgagccagttgggccctatgcaccttctcagatcttggaatctgatgggccactaccaccttcaccgcccgttccacattggttttcacactgcacgtgcctgttatccctgcaaccacctcaaactcagctttgcaaggatatgatgtccttgaaagggatgcagcacaatctaatgctgaaacggtgag

SEQ ID NO: 2342 - DNA, 385 bp, Homo sapiens
  AC062006.2_137637
  Located on chromosome 2
  Distance between a terminus base of telomere on chromosomal short arm and 5'-terminus of this base sequence : 15636712
  Distance between 3'-terminus of neighbour sequence of sequence listing upward to telomere on chrosomal short arm and 5'-terminus of this base sequence : 71101
attcctcacgtacaatttgaagtccaaaaagccctttaaaaaagcaggaggccgggcgaggtggctcatgcctgtaatcccagcactttgggggcctgagaagggcgggtcacttgaagtcagcatttcaagaccagcctggccaacatggtgaaaccctgtctctactaaaaatacaaaaattagctgggcgtggtggtacatgcttgtaatcccagctactcgggaggctgaggcaggagaatcacttgaacctgggaggcagaggttgcagtgagctgacatcatgccactgcactccagcctgggcaacagagcaagactctgtcaaaataaataaataaataaataaataaatagtaaaaagctggagaccttgtaatcc

SEQ ID NO: 2343 - DNA, 360 bp, Homo sapiens
  AC062006.2_172199
  Located on chromosome 2
  Distance between a terminus base of telomere on chromosomal short arm and 5'-terminus of this base sequence : 15716882
  Distance between 3'-terminus of neighbour sequence of sequence listing upward to telomere on chrosomal short arm and 5'-terminus of this base sequence : 79785
ctcaaattgtattgctttggagagtttttctttgaaaagcttttattgacttttgctaaaagaagaagcgatgtgtcagattctaaatgaaatcctctttctgaggagctgtgaggtccccacaatgtgtcaacaacaatcaagatgttgaaattgaaagcattcacagaggtcattcagcccagccattcccagatctgaccgatcaccggaatcatgtgggcatcagagacagagcaacaacaacaagctacaacagcagcagcagcagcagcagcagcagcagcagcagcagcagcagcagaatgaaggaatgaatgaatgaatgagcgagtgagtgagtaaatccgcatttctgga

SEQ ID NO: 2344 - DNA, 233 bp, Homo sapiens
  AC062006.2_13350
  Located on chromosome 2
  Distance between a terminus base of telomere on chromosomal short arm and 5'-terminus of this base sequence : 15751585
  Distance between 3'-terminus of neighbour sequence of sequence listing upward to telomere on chrosomal short arm and 5'-terminus of this base sequence : 34343
aagtgccaagattacaggtattagccactgtgactggcccaaatttatttatttatttatttatttatttatttatttatttattattattttttgaggtggagtcttgctctgtcggcaggctggagtccagtggcacaatctcagctcactgcaacttctgcctcctcggctcaagtgattctcctgcctcagcctcccgagtagctgggattacagatgcacgccactac

SEQ ID NO: 2345 - DNA, 431 bp, Homo sapiens
  AC062006.2_95501
  Located on chromosome 2
  Distance between a terminus base of telomere on chromosomal short arm and 5'-terminus of this base sequence : 15770765
  Distance between 3'-terminus of neighbour sequence of sequence listing upward to telomere on chrosomal short arm and 5'-terminus of this base sequence : 18947
gaggaaaggtaggaagttacagagctttctgccctagaggagcaaaacaaaaacggggtaacaagatggacattcatgcccaaagaaaaatatatgctatcctgaaacttgtcaactgaacgatctctgcaaaatatcagtgctgctctggataaagaaagggcaatggtgccaagtgaaagcacctctcttgcaagcttatcccagacattaagggttaacggtaaacacacacacacacacacaaacacacacacacacacacacacacacgcacacacacacagagaactgttttcccttgcaagattagtgctgctttccaatgcctgatttcccccaaccatgttcctatgtgatgatcctttgccacacacaagactgtcattgtatattcattcattagagataatgattttgagtttctgtcc

SEQ ID NO: 2346 - DNA, 133 bp, Homo sapiens
  D2S2295
  Located on chromosome 2
  Distance between a terminus base of telomere on chromosomal short arm and 5'-terminus of this base sequence : 15770961
  Distance between 3'-terminus of neighbour sequence of sequence listing upward to telomere on chrosomal short arm and 5'-terminus of this base sequence : -235
gcttatcccagacattaagggttaacggtaaacacacacacacacacacaaacacacacacacacacacacacacacgcacacacacacagagaactgttttcccttgcaagattagtgctgctttccaatgc

SEQ ID NO: 2347 - DNA, 250 bp, Homo sapiens
  G09373
  Located on chromosome 2
  Distance between a terminus base of telomere on chromosomal short arm and 5'-terminus of this base sequence : 15938577
  Distance between 3'-terminus of neighbour sequence of sequence listing upward to telomere on chrosomal short arm and 5'-terminus of this base sequence : 167483
cgccaaaagtctgcatagattctgggttttagacccctgtttagtgacccttattgtgttagtcaggtttctctacagaaacggaaccaataggagacagacacacagagagaggtagatatagatacagtaatagagatagatgacagatagatagatagatagatagatagagatagatagacatagatataaaagaaggtttattatgagggtttggtttatgtaattatgaggctgagaagtccca

SEQ ID NO: 2348 - DNA, 322 bp, Homo sapiens
  AC010880.7_156025
  Located on chromosome 2
  Distance between a terminus base of telomere on chromosomal short arm and 5'-terminus of this base sequence : 15950300
  Distance between 3'-terminus of neighbour sequence of sequence listing upward to telomere on chrosomal short arm and 5'-terminus of this base sequence : 11473
tctagtgcttatggactcagactgggacttacagcatcagcccctgattctcaggtctgcagactcaaactgaattacaccaccagctttcctgtttctccggcttggagacagcagattgtgggacttcttgttctccataactgtatgagccaattcttataataaatctccatatacgtatatagatatatgtgtgtgcagatatgtgtgtgtgtgtgtgtgtgtgtgtgtgtgaatagatagataaatagataccctgttagttgtgtttctctggagaatccttactaacacagaatcttactccagactctttcat

SEQ ID NO: 2349 - DNA, 195 bp, Homo sapiens
  D2S2346
  Located on chromosome 2
  Distance between a terminus base of telomere on chromosomal short arm and 5'-terminus of this base sequence : 16096152
  Distance between 3'-terminus of neighbour sequence of sequence listing upward to telomere on chrosomal short arm and 5'-terminus of this base sequence : 145530
tgggattacaagcgtgaaccaccgcagccgtctggcaaaggtgttttatctgtgagtggctctatgagaaaagccttcttgccatgaggtaaaccatgtctactacacacacacacacacacacacacacacacacacacacatacacacacccctaaaattttctggcttaatctgtccaccttgagtttggcc

SEQ ID NO: 2350 - DNA, 207 bp, Homo sapiens
  HUMUT868
  Located on chromosome 2
  Distance between a terminus base of telomere on chromosomal short arm and 5'-terminus of this base sequence : 16114422
  Distance between 3'-terminus of neighbour sequence of sequence listing upward to telomere on chrosomal short arm and 5'-terminus of this base sequence : 18075
tggcttggggattattgtcttgctacataattcccttccttccttccttccttccttccttccttccttccttccttcctgccttttctttctttctttctttctttctttctttctttctttctttctttctttctttctttctttcttctttctttcttttcttctttctttctgtatgtcaaaaccctgttcttcaacctggcc

SEQ ID NO: 2351 - DNA, 161 bp, Homo sapiens
  DISO7_10000870
  Located on chromosome 2
  Distance between a terminus base of telomere on chromosomal short arm and 5'-terminus of this base sequence : 16206114
  Distance between 3'-terminus of neighbour sequence of sequence listing upward to telomere on chrosomal short arm and 5'-terminus of this base sequence : 91485
tctatcccactggcaatgcggaatcagatgcacaaattaaaagggagagagagagatcattgtaacactgtgtgtgtgtgtgtgtgtgtgtttgtaggtgtgtgtgtgtgtgtttgtatgtgtgtgtgtgtgtgataaagtctcaaggagtagtgctcagc

SEQ ID NO: 2352 - DNA, 254 bp, Homo sapiens
  DISO7_10000869
  Located on chromosome 2
  Distance between a terminus base of telomere on chromosomal short arm and 5'-terminus of this base sequence : 16270816
  Distance between 3'-terminus of neighbour sequence of sequence listing upward to telomere on chrosomal short arm and 5'-terminus of this base sequence : 64541
ccaaataggctagaggcttcttttgggcatgtgcatgtgtgcctgtgtgcgtccgcgcgcgcacacacacacacacacacacacacacacacacacacacagagcactttatatttatcacttcataggaacacctaatattttgcctaggaagaaaatgatttccctatttactcagaaacttaaaaccaattccaatcactatttttggaagaaagggatgagataaaagggatctgattggaaatattccg

SEQ ID NO: 2353 - DNA, 197 bp, Homo sapiens
  chr2.fa.O7frz.17102754
  Located on chromosome 2
  Distance between a terminus base of telomere on chromosomal short arm and 5'-terminus of this base sequence : 16491763
  Distance between 3'-terminus of neighbour sequence of sequence listing upward to telomere on chrosomal short arm and 5'-terminus of this base sequence : 220693
acttggatattaggacatggacattttcaggcagagacaggtcattattcagcctatgatatcaggaaaagctgcatatatccttagcgcgctctctctctctctctctctctctatatatatatatatatacacatagcatatatatacatatttcttttatttaccccaaccataatccaatgaagttaaaccag

SEQ ID NO: 2354 - DNA, 421 bp, Homo sapiens
  chr2.fa.O7frz.17183900
  Located on chromosome 2
  Distance between a terminus base of telomere on chromosomal short arm and 5'-terminus of this base sequence : 16578177
  Distance between 3'-terminus of neighbour sequence of sequence listing upward to telomere on chrosomal short arm and 5'-terminus of this base sequence : 86217
atgttaatttgcttaggataacagcctccagctgcatccatgttgttgcaaaggacattatttcattctttttaatggctaggtagtattccatggggtgtgtgtgtgtgtgtgtgtgtgtgtgtgtgtgtgtgtgtgtatgtatgtgtatatatatatatacatacacatatatatgtacacacatacacataccacattttctttatccaattcaccactgacgggcacttagattgattccatgttttaacttttgtgaatagtatggtgatgaacatatgagtgcatgtgtatgtagccacacacctataaccatcttatctttgacgaagctgacaaaagcaaacaatgaggaaaagactccttattcaataaatggtgctgggataattggctatccatatgcagaattaaactg

SEQ ID NO: 2355 - DNA, 475 bp, Homo sapiens
  AC068614.2_11485
  Located on chromosome 2
  Distance between a terminus base of telomere on chromosomal short arm and 5'-terminus of this base sequence : 16682711
  Distance between 3'-terminus of neighbour sequence of sequence listing upward to telomere on chrosomal short arm and 5'-terminus of this base sequence : 104113
gtctaaagccagacttgagtttcaagggcaaatctgtgaagagttggagaagacaaggaacccagatccttcaatgagcatggaacacatagccaaccagaccatagcttataagttctacacttactagctatgtgacaaacataatacctttccttacatacaactgctctctctctctctctctctctctatctctgtctctgtatctctctctctctctctcacacacacacacacacacacacaaacacacaaacagatttcctaaggcaaggttttgatgagatcttaccagtaataattcagggacatagtgactataaatctcatatttctgagtgcctatgtaaaatttatgaaataaaaattagaatttctacaatatataaccttaaatatctatggcttgttttgaccttaatatgacagctcatacacatttttatgtatggtatgatatgtttctaagcat

SEQ ID NO: 2356 - DNA, 154 bp, Homo sapiens
  D2S332
  Located on chromosome 2
  Distance between a terminus base of telomere on chromosomal short arm and 5'-terminus of this base sequence : 16682844
  Distance between 3'-terminus of neighbour sequence of sequence listing upward to telomere on chrosomal short arm and 5'-terminus of this base sequence : -342
tgtgacaaacataatacctttccttacatacaactgctctctctctctctctctctctctatctctgtctctgtatctctctctctctctctcacacacacacacacacacacacaaacacacaaacagatttcctaaggcaaggttttgatga

SEQ ID NO: 2357 - DNA, 215 bp, Homo sapiens
  Z23932.1_87
  Located on chromosome 2
  Distance between a terminus base of telomere on chromosomal short arm and 5'-terminus of this base sequence : 16682849
  Distance between 3'-terminus of neighbour sequence of sequence listing upward to telomere on chrosomal short arm and 5'-terminus of this base sequence : -149
caaacataatacctttccttacatacaactgctctctctctctctctctctctctatctctgtctctgtatctctctctctctctctcacacacacacacacacacacacaaacacacaaacagatttcctaaggcaaggttttgatgagatcttaccagtaataattcagggacatagtgactataaatctcatatttctgagtgcctatgtaa

SEQ ID NO: 2358 - DNA, 279 bp, Homo sapiens
  AC068614.2_124816
  Located on chromosome 2
  Distance between a terminus base of telomere on chromosomal short arm and 5'-terminus of this base sequence : 16703593
  Distance between 3'-terminus of neighbour sequence of sequence listing upward to telomere on chrosomal short arm and 5'-terminus of this base sequence : 20529
attcttatcctaggactgagtcaggacacgctcttgaaatggctgccaaagagtttcatggtagagaggaagacaaattaactagctttggcttgtcctcagaataccttcccaaagtcagaaggaatttatgaaacaaatctgagattatgtttatggtattagtctctctctctctctctctctctctctccgtattttagatagaaagtcagccgtatgcagtaccttgtgaacattttggctcaagaaaacctctagcaaagtaagcatgaaaga

SEQ ID NO: 2359 - DNA, 257 bp, Homo sapiens
  D2S2155
  Located on chromosome 2
  Distance between a terminus base of telomere on chromosomal short arm and 5'-terminus of this base sequence : 16934183
  Distance between 3'-terminus of neighbour sequence of sequence listing upward to telomere on chrosomal short arm and 5'-terminus of this base sequence : 230311
gcaataaatcttctggaaaataatatgaacatatttttgagatgacaaatcttataacttagatgacttaattatacacaaacttctatctctcaaaaaataccagaaagaccgctaaagtcaagactcagagcaagagaagatttttgcaacatttagaaccaaaaatagaaaaaaagtccttcaaaataataagaagaaaacacacacacacacacacacacacacacacacaaacgaacaagagacttaaacaa

SEQ ID NO: 2360 - DNA, 406 bp, Homo sapiens
  chr2.fa.O7frz.17743170
  Located on chromosome 2
  Distance between a terminus base of telomere on chromosomal short arm and 5'-terminus of this base sequence : 17027157
  Distance between 3'-terminus of neighbour sequence of sequence listing upward to telomere on chrosomal short arm and 5'-terminus of this base sequence : 92717
ttatcctgctatgtatttgcacatgtggtgggactgctccatttcagccactcagtttttatttaaatgaatcttgctaagattcagctaggctgattgctagattacctgggaggagctggatatgcagttctgtgtgcctcttcatactcagcagaccctggtatgttctggaagactggatttagatacagtaggtaagagacaggctgagggcaacacacacacacacacacacacacacacacacacacacacacacacatatattttgtttcaatcctctttaatacccaaagggcttatggaaaaaagatgctcatgggtgcttcttggctcccttgtaggccctttccacatccacgaagttctcctggtcctcttctaggagcattcttaaatcctc

SEQ ID NO: 2361 - DNA, 381 bp, Homo sapiens
  AC009788.3_86238
  Located on chromosome 2
  Distance between a terminus base of telomere on chromosomal short arm and 5'-terminus of this base sequence : 17067161
  Distance between 3'-terminus of neighbour sequence of sequence listing upward to telomere on chrosomal short arm and 5'-terminus of this base sequence : 39598
cctaaggacaggagtttgagaccagcctgaccaacagggtgaaagcctgtctttactaaataaaaaattagccgggtgtggtggtacatgcctgtgtaatcccagctacttgggaggttgaggcaggagaattgcttgaacccaggaggcagaggttgcagtgagccaagattgcaccactgcacttcagcctgggcaacaagagtgatactccgtctcaaaataataataataataataataataataataataatacaaaaatttagtctatcaaaaaaaggaattaaagcagaaaaataaaaagcagaaagtgaaaagactactagtaaaaaatggagacaaattctaatcagggtaaagcttcactagcactgagac

SEQ ID NO: 2362 - DNA, 349 bp, Homo sapiens
  AC009788.3_160075
  Located on chromosome 2
  Distance between a terminus base of telomere on chromosomal short arm and 5'-terminus of this base sequence : 17174555
  Distance between 3'-terminus of neighbour sequence of sequence listing upward to telomere on chrosomal short arm and 5'-terminus of this base sequence : 107013
cttcagatcttgactggaatctacaccatctgttgcctctctggctctcaggcctttgaacaataccacagactttcctgggtatacagcttgcagacagcagactgtgggacttcacctctattcatccatccatccatccatccatccatccatccatccatccatcctattggttctgtttccctgtgaaccctggagaaccaatagaacactcaaacaccttccccacaaacaagcagagtgaggctccagtgcactgctgaccaaatctcacccttgcgaactcccaccagaagctccttgtcatctccaagataaagtccaagtgtcttatcattgcagacga

SEQ ID NO: 2363 - DNA, 377 bp, Homo sapiens
  chr2.fa.O7frz.17817938
  Located on chromosome 2
  Distance between a terminus base of telomere on chromosomal short arm and 5'-terminus of this base sequence : 17252856
  Distance between 3'-terminus of neighbour sequence of sequence listing upward to telomere on chrosomal short arm and 5'-terminus of this base sequence : 77952
tcagatgttacgaagatgagattcagccctgaggctcaggcttgagcttccatgacagagcttgtctcctctgggatgaaagggtaaaaagaaaggaaagtaccatgtatggcagtgttcatctgggtgtccccatccatccgtccgtccatccatccatccatccatccatccatccatcccattcttccaccacccatttaaatgtccatccatccatccatccatccatccatccatccatccacccacccacctacccacctttgccacagtgtaaaaaggtatcagggtccccatgccctctcatcttctccttaaatcacaattcctacaaagtaggctcttttaagatgtgaacataggagtcttgtgaa

SEQ ID NO: 2364 - DNA, 298 bp, Homo sapiens
  AC009788.3_56029
  Located on chromosome 2
  Distance between a terminus base of telomere on chromosomal short arm and 5'-terminus of this base sequence : 17393853
  Distance between 3'-terminus of neighbour sequence of sequence listing upward to telomere on chrosomal short arm and 5'-terminus of this base sequence : 140620
gaggcaggagaatcacttaaacccaggaggcggaggtcgcagtgagccaagatcgcgccactacactccagcctgggcaacagagccaggctacatctcaaaaaaaaaaaagaaagaaagaaaagaaagaaagaaaagaaagaaagaaagaaagaaagaaagaaagaaagaaagaaagaaagaaagaaagaaagaaagaaagaaaagaaagaaagatcttcaatgaatcctagtaatgttgcagcactttctccttagctcagctaaaaccaggctcttgtcatatgaccaggaaaga

SEQ ID NO: 2365 - DNA, 179 bp, Homo sapiens
  D2S320
  Located on chromosome 2
  Distance between a terminus base of telomere on chromosomal short arm and 5'-terminus of this base sequence : 17524647
  Distance between 3'-terminus of neighbour sequence of sequence listing upward to telomere on chrosomal short arm and 5'-terminus of this base sequence : 130496
cagcccagccattgatatttgcaaactttagactttctatttagttgatgaggttaaagagatatatctctcttcaaaactgcgtgcgtgcctgtgtgtgtgtgtgtgtgtgtgtgtgtgtgtgtgtgtgtgtgtttaatctgaggaaaacccaggaatctctagcatagttgttggtt

SEQ ID NO: 2366 - DNA, 338 bp, Homo sapiens
  chr2.fa.O7frz.18165099
  Located on chromosome 2
  Distance between a terminus base of telomere on chromosomal short arm and 5'-terminus of this base sequence : 17524655
  Distance between 3'-terminus of neighbour sequence of sequence listing upward to telomere on chrosomal short arm and 5'-terminus of this base sequence : -171
ccattgatatttgcaaactttagactttctatttagttgatgaggttaaagagatatatctctcttcaaaactgcgtgcgtgcctgtgtgtgtgtgtgtgtgtgtgtgtgtgtgtgtgtgtgtgtgtttaatctgaggaaaacccaggaatctctagcatagttgttggttatgttctttttcaagagctcagcctgcctatcatctgcagtggtcctagcattcagttggaacatgtggaacaaatgccttctcttcccagactcaaggacaagggaggtcacacagatgttcaacagatgtcaagggaggtccagtgaagtgactgtgaagttgat

SEQ ID NO: 2367 - DNA, 312 bp, Homo sapiens
  AC067841.2_19088
  Located on chromosome 2
  Distance between a terminus base of telomere on chromosomal short arm and 5'-terminus of this base sequence : 17867222
  Distance between 3'-terminus of neighbour sequence of sequence listing upward to telomere on chrosomal short arm and 5'-terminus of this base sequence : 342229
tactcagctaggacctagtttcagacccattttggtgggagggagttcttctttcctctggtatcatgctcttttttgtttgtttgtttgtttgtttgtttgggatggaatttcactcttcttgcccaggctggagtacaatgatgcgatctcagctcactgcaatttccgcctcctgggttcaagtgattctcctgccacagcctcccaagtacctgggattacaggcatgcaccaccatacctggctaatttttttagtagagaacggggtttcaccacattggccaggctgatcttgaactcctgacct

SEQ ID NO: 2368 - DNA, 240 bp, Homo sapiens
  AC067841.2_105007
  Located on chromosome 2
  Distance between a terminus base of telomere on chromosomal short arm and 5'-terminus of this base sequence : 17956372
  Distance between 3'-terminus of neighbour sequence of sequence listing upward to telomere on chrosomal short arm and 5'-terminus of this base sequence : 88838
atgacagtgatatgtagcaaatgaagctagaggtacacagtggaaatgtgttattaaagacaagataggtcaggctaagaggcgtgaaggctgatttatcttgtagatggtgaagagtaaattttagggtgaacagaataagaatcttatgtattaaaaaaaatgatgatgatgatgacaacgatgatggtgatgatagctaagatttagtattcacttactaggtgctaaactctgtgc

SEQ ID NO: 2369 - DNA, 361 bp, Homo sapiens
  AC024406.2_76270
  Located on chromosome 2
  Distance between a terminus base of telomere on chromosomal short arm and 5'-terminus of this base sequence : 18036942
  Distance between 3'-terminus of neighbour sequence of sequence listing upward to telomere on chrosomal short arm and 5'-terminus of this base sequence : 80330
tattctgcgtatgagtatccagtttctccagcagcatttattaaagagattaccttttccccaatgtatgttattggtgcctttgtcaaaaatgagatgactgtaaaagcatgagtttatttctggattatctattctgttcccttggtgtgtgtgtgtgtgtgtgtgtgtgtgtgtgtgtgtgtgtgtttggcagtacatgctgtgttggttactctagctttgtagtataatttgaagtctggtaatataatacctacagctttgttcagttttctcaggattgtttgttcagccattataaagaatagtttaggggttcctcaaaagctaaaaatataactaccatatgatccagcca

SEQ ID NO: 2370 - DNA, 254 bp, Homo sapiens
  D2S2375
  Located on chromosome 2
  Distance between a terminus base of telomere on chromosomal short arm and 5'-terminus of this base sequence : 18086364
  Distance between 3'-terminus of neighbour sequence of sequence listing upward to telomere on chrosomal short arm and 5'-terminus of this base sequence : 49061
cttcagccctcagcacagaaatctcattttcttcctctcttgggacctgaatttccactgcccagaagtcatttttcttgaagatttcatttctaacatcagtgtaggaataataatttttaaaaagccgtttcgttcctgaacaagattgagataaatcaggctcgtgtgtgtgtgtgtgtgtgtgtgtgtgtgcgcttgttttttgcttccttggacttccctgatcttccctgatgaccctggggtagtgg

SEQ ID NO: 2371 - DNA, 478 bp, Homo sapiens
  AC024406.2_45795
  Located on chromosome 2
  Distance between a terminus base of telomere on chromosomal short arm and 5'-terminus of this base sequence : 18093757
  Distance between 3'-terminus of neighbour sequence of sequence listing upward to telomere on chrosomal short arm and 5'-terminus of this base sequence : 7139
atttccaatttgtctctaccagtatcttaactcctcttttaatagcttgtatgatgatgatgatggtggtggtggcggtggtggtgatgatggtgggggagagagagagagagagagaaagagagaggaaaggagaggagaagagaggagaaaagagaagagaggagaggggaggggagaggagaggagaagagaagagggaagagaagagaagaagagaagaagagaaggggagaagaggaggggaggggaagggaagagggagaggaggagaaaggagaggaggggacatggggagagaaggggaggtaagaggagggaaggcgggggaagggaagggaagggaagggaagggaagtttcatctttttaatactctgcctttagcccaggagtacatgtggacctgttcattcacttggcgtactcactcactactatatgaatttacatgactcataagtaattctgtgagttgc

SEQ ID NO: 2372 - DNA, 475 bp, Homo sapiens
  chr2.fa.O7frz.18614037
  Located on chromosome 2
  Distance between a terminus base of telomere on chromosomal short arm and 5'-terminus of this base sequence : 18160159
  Distance between 3'-terminus of neighbour sequence of sequence listing upward to telomere on chrosomal short arm and 5'-terminus of this base sequence : 65924
gcataccttaagataaacacgtagtccttcagaatccagcttattgtgaatctgtgtgggtatctatcaaaccccagatgttttgcagactttcacttctgttgtccttgaggtgctaggcagtcaaaacaaacgttcacattcattgtcgtttcttctaggaagacaaataccctctgggtaaaagtgattttgcgttctctcttaacttttaggtagggttctcaccttcatgttggcttgattttgacctaaaaatttttcaccagcttgtagcattatgatgtttttaagaaaaaaagtagacatatggatatctatctatgtatctatctatgtatctatgtatctatgtatctatgtatctatctatctatctatctatctatctatctatctatctatctaatctatttaaatttcatccagaatttctagttgttctggaataaaaattggtcaaagtaatttagcc

SEQ ID NO: 2373 - DNA, 175 bp, Homo sapiens
  chr2.fa.O7frz.18786223
  Located on chromosome 2
  Distance between a terminus base of telomere on chromosomal short arm and 5'-terminus of this base sequence : 18339551
  Distance between 3'-terminus of neighbour sequence of sequence listing upward to telomere on chrosomal short arm and 5'-terminus of this base sequence : 178917
atacttgtcgcagatacacaaggcgctatggataagaatgagttagatcctgactgtgcatgcacatgcacacacacacacacacacaccacacatatacagacacagacagaacatgcctgtttccatttaaatttgctttttggatgaaatcgtttacataagtaggaccata

SEQ ID NO: 2374 - DNA, 160 bp, Homo sapiens
  D2S2342
  Located on chromosome 2
  Distance between a terminus base of telomere on chromosomal short arm and 5'-terminus of this base sequence : 18454073
  Distance between 3'-terminus of neighbour sequence of sequence listing upward to telomere on chrosomal short arm and 5'-terminus of this base sequence : 114347
attcatgcacactcacaccaacgacacacacacacacacacacacacacacacacatgaggggttctagcatgcccgtggcctttctcctcattggccttctccctcgcggggccagggagaggctgctcacccttggcagtcccaggagcccgaggtgc

SEQ ID NO: 2375 - DNA, 381 bp, Homo sapiens
  AC055837.2_56611
  Located on chromosome 2
  Distance between a terminus base of telomere on chromosomal short arm and 5'-terminus of this base sequence : 18487531
  Distance between 3'-terminus of neighbour sequence of sequence listing upward to telomere on chrosomal short arm and 5'-terminus of this base sequence : 33298
ccgttactcacatccacagagcagggtgacacagccactgcctaatgcttactcatgcactgccttctagcctgggtgtctggtgtgtgtgtgtgtgtccttcctggataaactgaaatccctctacagcagagagacctctccttcctcagtggcctcatggagatacaataggtgtgtaataattactgcctgtcctgctcagagcttctgagcattccaacgtgtgtgtgtgtgtgtgtgtgtgtgtgtgtgtgtgtgtgtacaaggaagtctagctcccatatctgctcttaatggtgttacaatttttttttgagacagagtcttgctttgtcacccaggctggatgcagtggtgtaatcataactcattacagcc

SEQ ID NO: 2376 - DNA, 205 bp, Homo sapiens
  D2S387
  Located on chromosome 2
  Distance between a terminus base of telomere on chromosomal short arm and 5'-terminus of this base sequence : 18514466
  Distance between 3'-terminus of neighbour sequence of sequence listing upward to telomere on chrosomal short arm and 5'-terminus of this base sequence : 26554
agctcacttttggcctcctcctttctttaatcctgcttttcacacacacacacacacacacacacacacacacacacacacacacacccttctctggaattaaggcttaaagatcaggaagggttactctaattagaaatgaagaattatcatatatgatttggccatcttcagatactattccagaatgaacatccaagatcca

SEQ ID NO: 2377 - DNA, 164 bp, Homo sapiens
  Z23327.1_228
  Located on chromosome 2
  Distance between a terminus base of telomere on chromosomal short arm and 5'-terminus of this base sequence : 18590423
  Distance between 3'-terminus of neighbour sequence of sequence listing upward to telomere on chrosomal short arm and 5'-terminus of this base sequence : 75752
atcagcaatgctagatctgtagcctgctggcccacactgaagactttgtactcaccagcctccataattgcatgaaccaattccttataacaaatcatattcgtgtgtgtgtgtgtgtgtgtgtgtgtgtgtgtgtgtgtatgtaatcacatcctcttggttct

SEQ ID NO: 2378 - DNA, 273 bp, Homo sapiens
  D2S305
  Located on chromosome 2
  Distance between a terminus base of telomere on chromosomal short arm and 5'-terminus of this base sequence : 18590480
  Distance between 3'-terminus of neighbour sequence of sequence listing upward to telomere on chrosomal short arm and 5'-terminus of this base sequence : -107
gcctccataattgcatgaaccaattccttataacaaatcatattcgtgtgtgtgtgtgtgtgtgtgtgtgtgtgtgtgtgtgtatgtaatcacatcctcttggttctgtttctctggagaaccctaatacaatatccattgctgcataacaagttacaccaaaactcaaagacttaaaacaacccatattcattatctcacaatttctgtggatcataagtatgggtgcagtgtatcggggccctctgcttcagtctctcacaggctgcaatt

SEQ ID NO: 2379 - DNA, 143 bp, Homo sapiens
  D2S310
  Located on chromosome 2
  Distance between a terminus base of telomere on chromosomal short arm and 5'-terminus of this base sequence : 18726089
  Distance between 3'-terminus of neighbour sequence of sequence listing upward to telomere on chrosomal short arm and 5'-terminus of this base sequence : 135336
tgaggcagaattgacaaggtgcaaagactgggacaaccaatgttttatagtacaacactggctttaaaaaaatgcaggaacccctgaatctcacacacacacacacacacacacacacacacacacgggatcacattgcaccc

SEQ ID NO: 2380 - DNA, 384 bp, Homo sapiens
  AC010096.5_82139
  Located on chromosome 2
  Distance between a terminus base of telomere on chromosomal short arm and 5'-terminus of this base sequence : 18822842
  Distance between 3'-terminus of neighbour sequence of sequence listing upward to telomere on chrosomal short arm and 5'-terminus of this base sequence : 96610
atgctaaagtaccttaagtgacagagacatcatgacactataaagagaagaaataaaatagggcagaccacacagctgggtctcttggaaacagaacagcattcatagttggagagctgtctgatgatactctcaacctgtctcctcagaagtgccatccattgttctctaccgtgaaggcccacaattcttctgaagcagcttctttctctgatgcctctcttctctgctctcctggtgtgtgtgtgtgtgtgtgtgtgtgtgtgtgtgtgtgtgtgtgtgtgccaaccgcacccccacaagagaaagaatctgattggttaccagtcaccattcaacatggggcacctctatcaggcagttgttgtaccacaattcctaacg

SEQ ID NO: 2381 - DNA, 385 bp, Homo sapiens
  AC010096.5_183020
  Located on chromosome 2
  Distance between a terminus base of telomere on chromosomal short arm and 5'-terminus of this base sequence : 18853840
  Distance between 3'-terminus of neighbour sequence of sequence listing upward to telomere on chrosomal short arm and 5'-terminus of this base sequence : 30614
ctggcttacttcacttatgataacaccctctaggtcatccatgttattgtaaatggcaggatttcctttttaagggcgaatgatattccattgtgtgtgtgtgtgtgtgtgtgtgtgtgtgatatatatatgtcatatatatgtcatatgtgtgtcatatgtcgtgtgtgtcatgtcatatgtcacatgtgtgccatatgtgtgtgtcatatatatatatatatatatatatatatatatatatgagttatatatatatctctctctcacaattgtttatccattcatccaccacaggacacttacgtgtttctatatcttggctattgtgaataatactgcaatgaacacggaagcatagatacctcttcaagatcctaatttc

SEQ ID NO: 2382 - DNA, 130 bp, Homo sapiens
  D2S2233
  Located on chromosome 2
  Distance between a terminus base of telomere on chromosomal short arm and 5'-terminus of this base sequence : 18971185
  Distance between 3'-terminus of neighbour sequence of sequence listing upward to telomere on chrosomal short arm and 5'-terminus of this base sequence : 116960
ggataaatggataaaggagatgtggtgtgtgtgtgtgtgtgtgtgtgtgtgtgtgtggtgtgtgtgcacaatgggataatattccaacttaaaaaaagaaggaaattctgtcatttgtgaccacagggat

SEQ ID NO: 2383 - DNA, 407 bp, Homo sapiens
  AC010096.5_10761
  Located on chromosome 2
  Distance between a terminus base of telomere on chromosomal short arm and 5'-terminus of this base sequence : 18993521
  Distance between 3'-terminus of neighbour sequence of sequence listing upward to telomere on chrosomal short arm and 5'-terminus of this base sequence : 22206
gcaagactgagcagaaataacaaatccagaggcctcacattacccgacttcaacctatactataaggccatagtcaccagaacagaatggtactggtataaaaataggcacatagacaaatggaaaagaatagataactcagaaataaagttaaatacttatagtcaactgatcttggacaaagcaaacacaaatgtaaagctgcggaaaggataccaacgcgtggataaagaaaattatacacacacacacacacacacacacacacacacacacacaccatggaaatactactcagccataaaaaagaatgaaacaatggcattagcagcaacctggatggaatggaaaaccaaatatcatgcattctcactcataagtgggatctatgctatgaggatgcaaag

SEQ ID NO: 2384 - DNA, 210 bp, Homo sapiens
  AC019055.2_167519
  Located on chromosome 2
  Distance between a terminus base of telomere on chromosomal short arm and 5'-terminus of this base sequence : 19049026
  Distance between 3'-terminus of neighbour sequence of sequence listing upward to telomere on chrosomal short arm and 5'-terminus of this base sequence : 55098
atgcaatatttagcaacatgagggccacaaatggatcacaaattgaggaaatattataagtttgctttcaaattctggaagtattttccaaatcatgcccttctcctctctctctctctctctctctctctctcacgtagacacatcatcaaccccctgacaattttggcagggccatccccagctgccctggttataacagaaggctga

SEQ ID NO: 2385 - DNA, 274 bp, Homo sapiens
  AC019055.2_57280
  Located on chromosome 2
  Distance between a terminus base of telomere on chromosomal short arm and 5'-terminus of this base sequence : 19111867
  Distance between 3'-terminus of neighbour sequence of sequence listing upward to telomere on chrosomal short arm and 5'-terminus of this base sequence : 62631
gtctgtaagttactcctaagcctagggatttctggtgacatagatataaactagagttagacttagaagtagatttagatacagatgagatatagacacagactggagatataggtatatgtgtatagatctacatatatagatacatacgtacgtgtgtgtgtgtgtgtgtgtgtgtatgtgtgtgatctccccactaagcacctttcctttcgtgagggacacagacatggagccactgattttatttgagttcatgtcctacatttagtgc

SEQ ID NO: 2386 - DNA, 147 bp, Homo sapiens
  D2S175
  Located on chromosome 2
  Distance between a terminus base of telomere on chromosomal short arm and 5'-terminus of this base sequence : 19113996
  Distance between 3'-terminus of neighbour sequence of sequence listing upward to telomere on chrosomal short arm and 5'-terminus of this base sequence : 1855
gaaagcacccctgtgatatttcagcatcctagtgactgaggctttgtgcacacacacacacacacacacacacacacacacacacacacatatcagaagcagtggaggcttctcccttgctactctgggtctctgatgtatggcaat

SEQ ID NO: 2387 - DNA, 379 bp, Homo sapiens
  chr2.fa.O7frz.19878160
  Located on chromosome 2
  Distance between a terminus base of telomere on chromosomal short arm and 5'-terminus of this base sequence : 19242382
  Distance between 3'-terminus of neighbour sequence of sequence listing upward to telomere on chrosomal short arm and 5'-terminus of this base sequence : 128239
ctacctccttcgttctatgaagtgaggccacacttgatattttcatggaaccaagtcccttagtacttaagccttatcagccatgaaatagacccttttcgggaaacaagatttgattaagttgaaaggaaatcagaatgtcagcgatctctgcactcctatggtcattgcagcactattcacaatgatatagaatccacctaagtccctctcagtccctcagttggatgaatggataaaatgtgaaatagattagatacacacacacacacacacacacacacacaggaataccattcagccacttttaaaaaatgaaatcctgtcccttgcagcaacgtggatgaacctggaggtcattatgttaagtgaaacaagc

SEQ ID NO: 2388 - DNA, 461 bp, Homo sapiens
  chr2.fa.O7frz.19996782
  Located on chromosome 2
  Distance between a terminus base of telomere on chromosomal short arm and 5'-terminus of this base sequence : 19335383
  Distance between 3'-terminus of neighbour sequence of sequence listing upward to telomere on chrosomal short arm and 5'-terminus of this base sequence : 92622
cttctgctttcttggtttattcctcattttgttagactatttcctaaagtaacttcctaagatagggaagcttggaagggaaatttttagtgagttacacatctaaaaatgtctgtattccacccatttatttatttatttatttatttatttatttacttactttgagacagagtctcactctgtcgcccaggctggagtgcagtggcacatctcggctcactgcagcctctgccttcagggttcaagcgattctcctgcctcagcttcccaagtagctgggattacaggcacccgccaccacacctggctaatttttgtatatttagtagagatagggttttgccatgttggccaggctggtcccaaactcctaacctcaggtgatctgcccaccttggcctcccaaagtgctgggctaccctcatatttaattagtagttgacttacagctatggaat

SEQ ID NO: 2389 - DNA, 144 bp, Homo sapiens
  chr2.fa.O7frz.19049278
  Located on chromosome 2
  Distance between a terminus base of telomere on chromosomal short arm and 5'-terminus of this base sequence : 19645110
  Distance between 3'-terminus of neighbour sequence of sequence listing upward to telomere on chrosomal short arm and 5'-terminus of this base sequence : 309266
ttctgtgaaggacacttaaattacatgccttaataaaggaagaaaagagacgagtgtgtgtgtgtgtgtgtgtgtgtgtgtgtgtgtgtgtgtgtgtgtgtgtgttggggtggggagagctggtactttgaagagcattctcct

SEQ ID NO: 2390 - DNA, 170 bp, Homo sapiens
  D2S2150
  Located on chromosome 2
  Distance between a terminus base of telomere on chromosomal short arm and 5'-terminus of this base sequence : 19880701
  Distance between 3'-terminus of neighbour sequence of sequence listing upward to telomere on chrosomal short arm and 5'-terminus of this base sequence : 235447
cttgactgctccccaaaactcaaatacacaaaatccacttccaaatatgagtatactgaaagttaagcattagggctttgctttcaactttttcacttatactactagagtgtgtgtgtgtgtgtgtgtgtgtgtgtgtgtgtgtgtgtttaaacgaatgggggtttcag

SEQ ID NO: 2391 - DNA, 189 bp, Homo sapiens
  G09722
  Located on chromosome 2
  Distance between a terminus base of telomere on chromosomal short arm and 5'-terminus of this base sequence : 19974090
  Distance between 3'-terminus of neighbour sequence of sequence listing upward to telomere on chrosomal short arm and 5'-terminus of this base sequence : 93219
ctgtaggttgtgagatggggagataatgatttaaccccacctcaaagagaggcagacactcccaagcagtgattttcaaagtttggtcacacagcagcagcagcagcagcagcagcagcatccgtgataattaattttatgagtcaacctgactgggcgatggggtgcctggatatctggccaaatgtt

SEQ ID NO: 2392 - DNA, 399 bp, Homo sapiens
  chr2.fa.O7frz.20577232
  Located on chromosome 2
  Distance between a terminus base of telomere on chromosomal short arm and 5'-terminus of this base sequence : 20046775
  Distance between 3'-terminus of neighbour sequence of sequence listing upward to telomere on chrosomal short arm and 5'-terminus of this base sequence : 72496
tatctttaacagctgattctgatgggcagccttttagcaggaaacccaaagatggtgcctgaatgcagtggcttacgaatgttaccctcccaactcccattaatggagcacttactgtgggccgggaatggtattggcacatctaattgtgtgtgtgtgtgtgtgtgtgtgtgtgtgtgtgtgatcttgttctttttacaaattgagatgtaattcaataccataaaactcacccttttaaagtgtacaattctggttttaaaatatattcacatggttgtgctatcaccagcagtaattccagaactttcccatcactcctaaaaaggaaccctgtacccatgagcagtcacacctcgctcactcctccctcattcctggaaatcgctaatctacttt

SEQ ID NO: 2393 - DNA, 409 bp, Homo sapiens
  chr2.fa.O7frz.20678443
  Located on chromosome 2
  Distance between a terminus base of telomere on chromosomal short arm and 5'-terminus of this base sequence : 20148077
  Distance between 3'-terminus of neighbour sequence of sequence listing upward to telomere on chrosomal short arm and 5'-terminus of this base sequence : 100903
cttatctgccatgttccattttattttcaaggaaaatgtattcatggacttcttgtgtaacacacacacacacacacacacacacacacacacacacactctgtttttttttttttaaagatctgactttaaaagcttacagtaaaaataacaattgttttacaagagactccaaacatgttcttctttggaggtgggaggtagggagggactgcctgattagcactgtgcccttgatatgccagcatcaggtccagctcctgtgcctcagtttccccatctgttccccagggagacaggcctgataatctccaaggttcattcagccctgccatcaagtgacaagaagttccactctgtgaagtcacaggcagcctgtctgcctgcgttccttgtgagccttagttac

SEQ ID NO: 2394 - DNA, 215 bp, Homo sapiens
  AC012361.9_192854
  Located on chromosome 2
  Distance between a terminus base of telomere on chromosomal short arm and 5'-terminus of this base sequence : 20301416
  Distance between 3'-terminus of neighbour sequence of sequence listing upward to telomere on chrosomal short arm and 5'-terminus of this base sequence : 152930
gaaattcaccaagttgacagttacagctacatgatttgagcttgcctcactcattctaagctgtattctttggagagaaaacaacgacaacaacaacaacaacaacaacagcaacaacaaaaaccaggcaccttcaatgtgaaactcataaacacatgcatcaggtcaatctggttctccaccttaaactctagtttcactgtacagtaacagcc

SEQ ID NO: 2395 - DNA, 482 bp, Homo sapiens
  AC023124.3_102254
  Located on chromosome 2
  Distance between a terminus base of telomere on chromosomal short arm and 5'-terminus of this base sequence : 20344345
  Distance between 3'-terminus of neighbour sequence of sequence listing upward to telomere on chrosomal short arm and 5'-terminus of this base sequence : 42714
atgaaatgttatgtcagtctatcagagacggacataacatggtgtccatagtggcttcacaatccttgaaatactgttatcctgattattaccacagtgtaaatagattagctcccccgaaacctgccacacacacacacacacacacacacacacacacacacacaaaatacaattctaaatcccacaaactaatgagcagggcaaacataaaagaacactaggaaatgaaatatgatctgaaaatgtcaaagcactataaacaatgagactatcaaactacaaatgttttatgcttccctccattctcagtgtcttcactgaatactccctttatctcctcaccatatctgaaatctggctctcccctgtaatgggctctcttcctttcaatcctcttcagcagaggcctcagtcactcttctctaacaccacatataactcaatgagagcaaagacttaatgcaacacagtattcctag

SEQ ID NO: 2396 - DNA, 185 bp, Homo sapiens
  Z67572
  Located on chromosome 2
  Distance between a terminus base of telomere on chromosomal short arm and 5'-terminus of this base sequence : 20344362
  Distance between 3'-terminus of neighbour sequence of sequence listing upward to telomere on chrosomal short arm and 5'-terminus of this base sequence : -465
tctatcagagacggacataacatggtgtccatagtggcttcacaatccttgaaatactgttatcctgattattaccacagtgtaaatagattagctcccccgaaacctgccacacacacacacacacacacacacacacacacacacacaaaatacaattctaaatcccacaaactaatgagcag

SEQ ID NO: 2397 - DNA, 433 bp, Homo sapiens
  AC012361.9_69709
  Located on chromosome 2
  Distance between a terminus base of telomere on chromosomal short arm and 5'-terminus of this base sequence : 20434661
  Distance between 3'-terminus of neighbour sequence of sequence listing upward to telomere on chrosomal short arm and 5'-terminus of this base sequence : 90114
acacctatttctgatgtttatcatcatgcctggcatacagaaagcccttaggaaattttggataaattaatccacgagtgatggatgaatgaatgaatatatgtatgagtaaattaaatttgaagtaactggttctcagagccagattgggaagtcactttctaataatggaaacacattgctgtgtgtgcgtgtatgtgtgtgtgtgtgtgtgtgtgtgtgtgtgtgtgtgtgtgtgtgtgaagccttagaggcttaggagcatcagacgggtgccaaccaagagacatataggggattgtgtagttgaggccttccagaatgagcacatgttatttcatcagatgttctctgtgaaatactaagataaaatattgggcaatccacggtgagagtctttccaatgtatggctcagaaacacctaacaattga

SEQ ID NO: 2398 - DNA, 368 bp, Homo sapiens
  AC010872.7_5425
  Located on chromosome 2
  Distance between a terminus base of telomere on chromosomal short arm and 5'-terminus of this base sequence : 20583229
  Distance between 3'-terminus of neighbour sequence of sequence listing upward to telomere on chrosomal short arm and 5'-terminus of this base sequence : 148135
ctgaggtcaggagctcaagaccagcctggccaacatggcaaaactccatctctactaaaaaatacaaaaattagctgggtgtaatggcacatgcctgtaatcccagttactcaggaggctgaggcagagagaattgcttgaacccaggaggcagaagttgcagtgagccgagatcatgccactgcactccagcctgggcaatagagtgagattccatctcgaaagaaggaaggaaggaaggaaagaagaaagggagggagggaggaaggaaggaaggaaggaaggaaggaaaggaaagaaacagcagaataaagtcagtagatgaaatctagagtctcattcccctagtaccttccaaatccttgtta

SEQ ID NO: 2399 - DNA, 288 bp, Homo sapiens
  AC068115.2_128241
  Located on chromosome 2
  Distance between a terminus base of telomere on chromosomal short arm and 5'-terminus of this base sequence : 20583309
  Distance between 3'-terminus of neighbour sequence of sequence listing upward to telomere on chrosomal short arm and 5'-terminus of this base sequence : -288
gtaatggcacatgcctgtaatcccagttactcaggaggctgaggcagagagaattgcttgaacccaggaggcagaagttgcagtgagccgagatcatgccactgcactccagcctgggcaatagagtgagattccatctcgaaagaaggaaggaaggaaggaaagaagaaagggagggagggaggaaggaaggaaggaaggaaggaaggaaaggaaagaaacagcagaataaagtcagtagatgaaatctagagtctcattcccctagtaccttccaaatccttgtta

SEQ ID NO: 2400 - DNA, 458 bp, Homo sapiens
  AC068115.2_18342
  Located on chromosome 2
  Distance between a terminus base of telomere on chromosomal short arm and 5'-terminus of this base sequence : 20608033
  Distance between 3'-terminus of neighbour sequence of sequence listing upward to telomere on chrosomal short arm and 5'-terminus of this base sequence : 24436
gcctgaattatccagataattacttctttctcacttcattaataacatcgccgtgtctccttgtgagaagtcagatgagctatttgctcccttactggtcagaaaagtaagagccttcctgaaaggagggaggcggaaaggtgggagagtcaggtggcacaggcagcttctgagcctgcctcactgaggaccggccccatcctcagggcaggtcagctctggtcttgagcctgattcccctcctgacaacgcttccttctcacccccatctctcactccctttctcctctctttctctctccacagctctctctctctctctctctctctctttctctcgccccaccaccaaatctcagctgcaatctccaccctcactaggaaggtggtctgtcctattcttcctcctctttctcacccttgccatctgttgtcccaatacctctgaattcgttggt

SEQ ID NO: 2401 - DNA, 433 bp, Homo sapiens
  AC010872.6_145643
  Located on chromosome 2
  Distance between a terminus base of telomere on chromosomal short arm and 5'-terminus of this base sequence : 20647261
  Distance between 3'-terminus of neighbour sequence of sequence listing upward to telomere on chrosomal short arm and 5'-terminus of this base sequence : 38770
aagtggcattaagtacatttacattattgtacagctaccacccatctctagaacttttcatccaaactgaaactctctactcattaaacaatttctccccagcccctgggaaaaccaccattctactttctgtctctatgagttcaactactctaggtaccttatataggtggaatcacacaatctttgtccttttgtgtctgacttatttcacttagcataatgtcctcaaggttcatccatgttttaacgtatgtcagaacttcattatttttataggctgaagaatattccattgtgtgtgtgtgtgtgtgtgtgtgtgtgtaagtgtatatgactttttgcttatctgtttagtcattaatggatatttggatcatttccacctgttggctattgtgaataatgttgctatgagcactggtgtacaaat

SEQ ID NO: 2402 - DNA, 311 bp, Homo sapiens
  AC010872.7_116586
  Located on chromosome 2
  Distance between a terminus base of telomere on chromosomal short arm and 5'-terminus of this base sequence : 20671688
  Distance between 3'-terminus of neighbour sequence of sequence listing upward to telomere on chrosomal short arm and 5'-terminus of this base sequence : 23994
gttgtcttcagatggagatgacattcttttacagctttctttattaaaacataaataaataaataaataaataaataaataaataaagggagtgggatgaaacctgggccttggagagggaataggataaggaagtcctagaggaggttggggaagagaagagcctgggtgtgtatgggaagccatagccttctgcctgtctaggaggaaggccacaaggccaggacactgtttctgggagcagataagagatacagtgaaaaggaagcatgcttccttttcatgtcccacttacaatggtcttgtggacc

SEQ ID NO: 2403 - DNA, 411 bp, Homo sapiens
  AC010872.6_54102
  Located on chromosome 2
  Distance between a terminus base of telomere on chromosomal short arm and 5'-terminus of this base sequence : 20738891
  Distance between 3'-terminus of neighbour sequence of sequence listing upward to telomere on chrosomal short arm and 5'-terminus of this base sequence : 66892
gaccttgtcttcatttaagctctccagtagagtaagtagcaggcagtttcttacaaaactccaattcctcgtgctcttcacgttcttcatgcctttctatggccgtggtcactagatccctcaaggcattgcctccaatgcattgcctccaatggttccttcatcccagtgaccacaggggttttatatatatatatatatatatatatatatatatatatatatatatatatatatatatgctcagcctcccaaagtgctgggcttacaggcatgagccactgcgcctggcccacaggggtaatttaattagcagtttcatcgctgagcgccttcaggtagtaggtactagatttctttttttggcagatgcatcagcaccagtcagtagtgaattctatggagttctga

SEQ ID NO: 2404 - DNA, 300 bp, Homo sapiens
  chr2.fa.O7frz.21407929
  Located on chromosome 2
  Distance between a terminus base of telomere on chromosomal short arm and 5'-terminus of this base sequence : 20746305
  Distance between 3'-terminus of neighbour sequence of sequence listing upward to telomere on chrosomal short arm and 5'-terminus of this base sequence : 7003
tttagcttccagaattgtgagaaaataaaattctgttgtttaagccaccttgcctgtggtattttgttatggcagcgcttgcaaactaatgcagtgctctctctctctctctctctctctctctctctctctctctctatatatatatatatatatatatatatatatatatatatatatatatatatatatatatttgagttgaattgtctttggggatattgctctgttgctgtttctaaagtagctctttatgtagtaaaaatatttactttctctgtctcatgttgaaagtcgttt

SEQ ID NO: 2405 - DNA, 343 bp, Homo sapiens
  AC040985.2_66938
  Located on chromosome 2
  Distance between a terminus base of telomere on chromosomal short arm and 5'-terminus of this base sequence : 20813229
  Distance between 3'-terminus of neighbour sequence of sequence listing upward to telomere on chrosomal short arm and 5'-terminus of this base sequence : 66624
ccataccagataattaacattgatataatccacagcgcttttttaggtttcaccaggtttgcatgaacgtgtgtgtgtgtgtgtgtgtgtgtgtgtgtgtgtgtgtgtgtcgggaaggggggagggtccatgaatgacttcatgtaaccaccacagtcaagatacagaactagactctcaccataaggttcccccatgctactcccttataggcacaccacaaagctatttttaatgcattcaagtagtcgggaaacagaattctttttagtacatgtttacagcaagaaatgactgacactgaacttgtggaagagtaatcttcctgtccttggtaatagtc

SEQ ID NO: 2406 - DNA, 210 bp, Homo sapiens
  D2S2201
  Located on chromosome 2
  Distance between a terminus base of telomere on chromosomal short arm and 5'-terminus of this base sequence : 20910347
  Distance between 3'-terminus of neighbour sequence of sequence listing upward to telomere on chrosomal short arm and 5'-terminus of this base sequence : 96775
tacatctcagccccatcaggctcttccatttgtcagtgcacagaatactgtcaggttctgcttcttagtgttttggggtttgtgtgtgtgtgtgtgtgtgtgtgtgtggttatcttaacacagcattcccaatcacaatgtgaatggaggagaggaacctgggaaaggttctctgggacccatttcatgagttatctgccaagtgcccac

SEQ ID NO: 2407 - DNA, 249 bp, Homo sapiens
  chr2.fa.O7frz.21779900
  Located on chromosome 2
  Distance between a terminus base of telomere on chromosomal short arm and 5'-terminus of this base sequence : 21121107
  Distance between 3'-terminus of neighbour sequence of sequence listing upward to telomere on chrosomal short arm and 5'-terminus of this base sequence : 210550
atctggtgatacttgtcattgtactatctgttctcaaatgatgctccttttacagataattctttcccttccaaatcctgttcattcattcattcattcattcattcattcattcattgctttacttcctcatttagcaagtatgattttgctgatgctgttccttctctctggggtcccctatccttcccactctctagagagctttatctttctcatcctattgtctcaccatactggactaagtga

SEQ ID NO: 2408 - DNA, 361 bp, Homo sapiens
  AC009411.2_165626
  Located on chromosome 2
  Distance between a terminus base of telomere on chromosomal short arm and 5'-terminus of this base sequence : 21233672
  Distance between 3'-terminus of neighbour sequence of sequence listing upward to telomere on chrosomal short arm and 5'-terminus of this base sequence : 112316
caatctatagcgagtcaaacagaagttgtggttgacttggggacctgctacttccaattggcatctgaagtgaaggccagttttgtaggattgaactccttctctgtggggcctgcgctaactccaattaatgtctgaattgaattggccagtgtggggacatggacacacacacacacacacacacacacacacacacacacaacacaagtgttctgtgttgtttttctctctactcacttttaacatatattatgttaaatggtagagaaatgagagaataaaaattctatgatataaacacaaacatattggtatgaaaacaacaaattaacataactgttgcagatctcatttctac

SEQ ID NO: 2409 - DNA, 109 bp, Homo sapiens
  G09458
  Located on chromosome 2
  Distance between a terminus base of telomere on chromosomal short arm and 5'-terminus of this base sequence : 21279063
  Distance between 3'-terminus of neighbour sequence of sequence listing upward to telomere on chrosomal short arm and 5'-terminus of this base sequence : 45030
aagcaacgttattgtgtctggtatacagtagatgctccaaaaaccatacctttcttcatcatcatcatcatcatcatcatcctttagcattatgcccttcgcagaatag

SEQ ID NO: 2410 - DNA, 418 bp, Homo sapiens
  chr2.fa.O7frz.22376945
  Located on chromosome 2
  Distance between a terminus base of telomere on chromosomal short arm and 5'-terminus of this base sequence : 21604787
  Distance between 3'-terminus of neighbour sequence of sequence listing upward to telomere on chrosomal short arm and 5'-terminus of this base sequence : 325615
gttgaaacatcttatgaatgctagaataataaagctaatgaaagaaaaattccagagaatattttcattacattgtataagaaatatttttagatggaaaacaaaaaaaatcacagagtgtaaaagaaaacaagagagataccaaattttattgatattaaatttcttctaataaaaaggcaatatttaaaaaatcaaaaagccataattggagcaaatattcacagaatattttttaaaagagcttgtatatatatatatatatatatatatatatatatatagccttttgcttatattgagttgtcttcttttattgctgatttctacaatatagaaatatatacatatatgtagaaatctacaataagacaactgaatataaacaaaaccaagcaagatgtttgaatagatactc

SEQ ID NO: 2411 - DNA, 239 bp, Homo sapiens
  chr2.fa.O7frz.22487774
  Located on chromosome 2
  Distance between a terminus base of telomere on chromosomal short arm and 5'-terminus of this base sequence : 21757978
  Distance between 3'-terminus of neighbour sequence of sequence listing upward to telomere on chrosomal short arm and 5'-terminus of this base sequence : 152773
gacctacaaccagataggaaacaaaatataaaacttttcatgtgtattttgaagaagttccatgtagtctcattttataggtgtttgtaactacatatagaaattatatttgtctctataggctaacacattatctctcttcacaaacacacacacacacacacacacacacacacacacactgtatgaactacaaagaaattctggttggagaaaagtatgaggacattagcaatgac

SEQ ID NO: 2412 - DNA, 133 bp, Homo sapiens
  DISD22_0001556
  Located on chromosome 2
  Distance between a terminus base of telomere on chromosomal short arm and 5'-terminus of this base sequence : 21892946
  Distance between 3'-terminus of neighbour sequence of sequence listing upward to telomere on chrosomal short arm and 5'-terminus of this base sequence : 134729
aaggatgctcagagtaaggggtgtgtatgtgtgtgtatgtgtgtgtgtgtgtgtgtgtgtgtgtgagagagagagagagagagagagagagaaacagagagaaaaatagagaagaataggaccaggacaagga

SEQ ID NO: 2413 - DNA, 356 bp, Homo sapiens
  chr2.fa.O7frz.22681562
  Located on chromosome 2
  Distance between a terminus base of telomere on chromosomal short arm and 5'-terminus of this base sequence : 22003736
  Distance between 3'-terminus of neighbour sequence of sequence listing upward to telomere on chrosomal short arm and 5'-terminus of this base sequence : 110657
aatattgttccaggactagtcatataaataaataaataaataaataaataaataaataaataaatatatgtgtgtgtgtgtgtgtgtgtgtgtgtgtgtgtatacactcaacaaatgttcaaattaaattattaatcaaattaatgatttggctattctttccaaacattttatgacgataaaaacttaaatcctgtactaaaatcttgcatcttttcatcccattcattctgtgacccagcagcttaatcctgccttgctgaccttgtatattctctagttccatgatgcctcctttaaggtggggtgaaatatgtagcaaataactcagggtaaaggcacaattatctgttaac

SEQ ID NO: 2414 - DNA, 179 bp, Homo sapiens
  chr2.fa.O7frz.22582655
  Located on chromosome 2
  Distance between a terminus base of telomere on chromosomal short arm and 5'-terminus of this base sequence : 22018547
  Distance between 3'-terminus of neighbour sequence of sequence listing upward to telomere on chrosomal short arm and 5'-terminus of this base sequence : 14455
tggtcaagtctaacctgagtatacaaatatcaaattcatatggattctgtaaaaaaattatatataattttatatatatatatatatatatatatggaatatatcacagaaactgcctaaatgctcaataaatagaaattaaaataaagcctgacctaacatttgcttcacaaataact

SEQ ID NO: 2415 - DNA, 399 bp, Homo sapiens
  chr2.fa.O7frz.22807387
  Located on chromosome 2
  Distance between a terminus base of telomere on chromosomal short arm and 5'-terminus of this base sequence : 22119808
  Distance between 3'-terminus of neighbour sequence of sequence listing upward to telomere on chrosomal short arm and 5'-terminus of this base sequence : 101082
tttacagttaaacagcctatgttgttactaaacgtcatcatctactgtgtgatttgtaagttatttaacctttacaagtttaattttcatcatctgtaagaagcagataatacctatctcactgatagctcatgagtttcaaattaaataatatatatatatatatatatatataacaaccaacagagtgattggcacatagtaatttctcaataaataatgaaatatttatcattgtattatctcatcatcatgaaagtataagaattgtttatggacaatttattcgcagaatatttattttccataaaattagaaaagtgacctcaagattaagaaatcataccatgtactcagtgcagaaattttctttgtaatttcatagttgactgtgacatt

SEQ ID NO: 2416 - DNA, 378 bp, Homo sapiens
  chr2.fa.O7frz.22913660
  Located on chromosome 2
  Distance between a terminus base of telomere on chromosomal short arm and 5'-terminus of this base sequence : 22225983
  Distance between 3'-terminus of neighbour sequence of sequence listing upward to telomere on chrosomal short arm and 5'-terminus of this base sequence : 105776
aaatctttaaattcctctggttactgttgagttttatatatatatatatatatatatatatatatatagtaaatatatcatatatataaataaccacagtgtattagtccattttgacactgctataaagaactttcctgagactgggtaatttataaagtaaagaggtttaattgactcacagttctgcatggctggggaggcctcaggaaacttacaatcatggcagaaggaggagcaggcacgtcttacctagcaacaggtgagagagagagagagagagagagagaccaagtaaagggggaagagcctcttataaaaccatcagatctcatgagaactcattcactatcatgagaactcattcactatcacgag

SEQ ID NO: 2417 - DNA, 470 bp, Homo sapiens
  chr2.fa.O7frz.23203897
  Located on chromosome 2
  Distance between a terminus base of telomere on chromosomal short arm and 5'-terminus of this base sequence : 22400661
  Distance between 3'-terminus of neighbour sequence of sequence listing upward to telomere on chrosomal short arm and 5'-terminus of this base sequence : 174300
acctacgtaggagcctgaggcacgagaatcgcttgaacctgggaggtggaggttgcagtgagccaagatcgtgccactgcaccgcagcctgggcaacagagcaagactctgtcagaaagaaagaaaagaaagaaaagaaaagaaaaagcaagcaagcaagcaagcaagcaagaaagaaagaaaagaaagaaagaaagagaaagaaagaaagaaggaaagagagagagagagaaagaaagaaagaaagaaaggaaagatagaaagaaagaaagaaagaaagaaagaaagaaagaaagaaagaaagaaagaaagaaagaaaaaaatatatcattaatattgatttcaactttttaaaatgtggctactaaaaaaatgtaaaaatgtaaaattacatatggggctagcatttgtggttttcattatatttctactggaccacgctggtctagactaaggtatttagaccaagc

SEQ ID NO: 2418 - DNA, 178 bp, Homo sapiens
  D2S2221
  Located on chromosome 2
  Distance between a terminus base of telomere on chromosomal short arm and 5'-terminus of this base sequence : 22579978
  Distance between 3'-terminus of neighbour sequence of sequence listing upward to telomere on chrosomal short arm and 5'-terminus of this base sequence : 178847
gtgctttattacgcactcttgtcacagaccccactgggcaagatatgtgttctatagtgtgtgtgtgtgtgtgtgtgtgtgtgtgtgtgtgtgtgtgtgtagtatatgtttagtacatgctattaccttcctgaaaacccaaatgttctgattttggaaacatatctcaacccaacgg

SEQ ID NO: 2419 - DNA, 285 bp, Homo sapiens
  AC018467.6_49378
  Located on chromosome 2
  Distance between a terminus base of telomere on chromosomal short arm and 5'-terminus of this base sequence : 22637821
  Distance between 3'-terminus of neighbour sequence of sequence listing upward to telomere on chrosomal short arm and 5'-terminus of this base sequence : 57665
ctctgcactgagtaattggaacaaaacgacccaggcagtcttgctgtaacatcaaagctgcatataataacctcacagatgaatttaagagtgaatacattcacagccactgctcaagtttgaagtatgctgcaatgtttttcagcttcagaaccaagcaagaagaagaagaagaaaaaactcacctgctattgcttcctctattgacccttctgggctgcagtggaaggtgtgcgtttatcgtcttcacataagaagtcagtctaagaacaatgacgaggatag

SEQ ID NO: 2420 - DNA, 344 bp, Homo sapiens
  AC018467.7_208262
  Located on chromosome 2
  Distance between a terminus base of telomere on chromosomal short arm and 5'-terminus of this base sequence : 22719307
  Distance between 3'-terminus of neighbour sequence of sequence listing upward to telomere on chrosomal short arm and 5'-terminus of this base sequence : 81201
tattagccagtttaccaactttcccactttttttccaatcaagatgtacgcagctggccctctaatttcacaaaagacaatgattcatggggctcagcaatgaattaaaagaatttacacacctgaattttctatggattcacacaggtcatgaaataccccagcagagtttaacacatatgagggttcaagtcccacctttatattaatttgtgtgtgtgtgtgtgtgtatatatatatatatatatatatatatatatatatatagagagagagagagagagagagagagagacatgctagatcacacatcctttaaaattcacctacgagtgataattcac

SEQ ID NO: 2421 - DNA, 355 bp, Homo sapiens
  AC018467.7_89588
  Located on chromosome 2
  Distance between a terminus base of telomere on chromosomal short arm and 5'-terminus of this base sequence : 22774623
  Distance between 3'-terminus of neighbour sequence of sequence listing upward to telomere on chrosomal short arm and 5'-terminus of this base sequence : 54972
agatggaaacttggatctttacagaagaataaagaagatcataaaagctttaaaatgtgtgtaaatacttttcagagtttttttcctttattctttctctctcatttctttctttttctttcttcccctctaaatctatccatagacacacacacacacacacacacacttttaacaacctacagaccatataaagcaaaaattttaaaaatgtattatggaattaataccatatgtagaagtaaaaaacatagaagaacaaagtgtaggaagggtaaatggaattttactgtataaatttcttacattattcatgaaataatattacaggctgagtaccacttatttgaaatgt

SEQ ID NO: 2422 - DNA, 165 bp, Homo sapiens
  DISD22_0001566
  Located on chromosome 2
  Distance between a terminus base of telomere on chromosomal short arm and 5'-terminus of this base sequence : 22966800
  Distance between 3'-terminus of neighbour sequence of sequence listing upward to telomere on chrosomal short arm and 5'-terminus of this base sequence : 191822
gaactcctcaacaagcgcaaccacagattctggttaaaaatccatgaagccatctctcttttaaaggctttccctcttctctctctctctttctgtgtgtgtgtgtgtgtgtgtgtgtgtgtgtgtgtgtgtgtacgtacaagggaaaggctgagctatacttct

SEQ ID NO: 2423 - DNA, 473 bp, Homo sapiens
  chr2.fa.O7frz.23828315
  Located on chromosome 2
  Distance between a terminus base of telomere on chromosomal short arm and 5'-terminus of this base sequence : 23053160
  Distance between 3'-terminus of neighbour sequence of sequence listing upward to telomere on chrosomal short arm and 5'-terminus of this base sequence : 86195
agaagtgaaggatttctggtacaaagtcattctgcttgtcctgaatgtcaggaaggaaggtttagacaagattgtgtgtgtgtgtgtgtgtgtgtgtgtgtgtgtgtgtgtgtctgtagctgtgtgtgtctgtgtgtctgtgtcggcatgtctgctttgtgtgtctgagtgtgtgttcatgtgcctgtgtgtcttggtgtgtgaacctgtgtgtgtgtgttatatgttgtgtgtgtgactgtgtatgtgtgactgtgtctgttagtgtgtctctgtgttgtgtgtatgtgtgtgtgttcatgtgtgtgtgtgtgtctgtgtgcatatgtgttcatacatctgtgtgtgtgtccatttgtctgtgtgtatgtacatctctggctccaaagaccaggtctgtgtgtgaatgtgtatttctgtatgtatgtgtgtatctgtgtgtctgtgtttgtgtcagtttatctgcctctgtg

SEQ ID NO: 2424 - DNA, 477 bp, Homo sapiens
  AC012506.7_39137
  Located on chromosome 2
  Distance between a terminus base of telomere on chromosomal short arm and 5'-terminus of this base sequence : 23067833
  Distance between 3'-terminus of neighbour sequence of sequence listing upward to telomere on chrosomal short arm and 5'-terminus of this base sequence : 14200
ttctatagctttattgcagatgactgagctttcagtgcatggggatgtttctgtatttcttgcgtattccccgcagtgcctagatggtgctgagcatgttgctgatactcagtaaacatccatggatttaagagaagtaaatagccaatcagctttgtgtgtgtgtgtgtgtgtgtgtgtgtgtgtgtgtgtgtgtgtgtgtgtgtctcagcaccagagaagtttaccttcagtttctcaaaagctggagttgcaaagccatctttgagagccacatttttttctccctcaaaatatggtcttaattgtgtggtgatagccacagacaccgcctggaagccttcctgtgcttcaggagcagaatgactctcctcattgtctgtgggtttaggcaccgagagctgcacagataaaagcagatgagtcacaggtgtggatctgctgggcggctcttgtcgttagcagtacaaagccaca

SEQ ID NO: 2425 - DNA, 305 bp, Homo sapiens
  D2S2337
  Located on chromosome 2
  Distance between a terminus base of telomere on chromosomal short arm and 5'-terminus of this base sequence : 23169094
  Distance between 3'-terminus of neighbour sequence of sequence listing upward to telomere on chrosomal short arm and 5'-terminus of this base sequence : 100784
agctgccgattcctgcggtgggcagaaactacacacacacacacacacacacacacacacacacacacacacacacacaggcacgcacacgcttctccagcagatcgggaggaggcatcctgtgtaaccactcatgcccaatattatgtcaggtgcattagtgcttagaatgcagagttgttataaccatacaagatactaggattcatctgttggcagaatttggagcacagaactgcagggactaaaggaagtaggaggccccatctgggtatttgggaagggatggttcatcgctctttgct

SEQ ID NO: 2426 - DNA, 309 bp, Homo sapiens
  chr2.fa.O7frz.24026968
  Located on chromosome 2
  Distance between a terminus base of telomere on chromosomal short arm and 5'-terminus of this base sequence : 23265210
  Distance between 3'-terminus of neighbour sequence of sequence listing upward to telomere on chrosomal short arm and 5'-terminus of this base sequence : 95811
tttagtggctgttaaatgacacattttataatatctcccaaatttgtgcacaggaattctgagagagcttggctagacagttctgctgatcccatggtattgactagtaacccttggtgatgttcagctgatttgctgatggtctggagggtctaagataccaaggcagaagcctcaaggcctcttaaaaagataggcccaggactggcatagtgtcgcatctgacatctctgtcaaaagagtcacagcactcgtgtgtgtgtgtgtgtgtgtgtgtgtgtgtgtgtgtttaatttgactaagtggaag

SEQ ID NO: 2427 - DNA, 476 bp, Homo sapiens
  chr2.fa.O7frz.24138562
  Located on chromosome 2
  Distance between a terminus base of telomere on chromosomal short arm and 5'-terminus of this base sequence : 23376935
  Distance between 3'-terminus of neighbour sequence of sequence listing upward to telomere on chrosomal short arm and 5'-terminus of this base sequence : 111416
tgagccaagatcgtgttactgcactccagtctgggcaacacaaccagactccacagcaagcaagcaagcacgcacgcaagaaagaaagcaagcgagaaagagagaaagagacagagagggatggaaggaaggaaggaaagaaggaaggaaggaaggaaggaaggaaggaaggaaggaaggaaggaaggaaggaaagggaagggaagggaagggaagggaagggaaggaaggaaaggaaggaaggaaggaagacttgaatacaagcaaaggaatttaccattcaccttaatgattgatgggttaaaaattcaatctctaaagccacaccacaagataggaccccccaacctgatgttagctgtgtaaccttgggcaagtcacctaagcattctctatttcagtttccccttctcttaaatgggaccaacaacagtacctacctcccacagttgctgtgataattaaatggttaatgc

SEQ ID NO: 2428 - DNA, 426 bp, Homo sapiens
  AC034295.2_125295
  Located on chromosome 2
  Distance between a terminus base of telomere on chromosomal short arm and 5'-terminus of this base sequence : 23738994
  Distance between 3'-terminus of neighbour sequence of sequence listing upward to telomere on chrosomal short arm and 5'-terminus of this base sequence : 361583
acatacagcttcctaagactgaaccaggaataaactgaatccctgaacagaccaataatgagttctgaaattgaattagtaataaaaagcccaccaaccaaaacaaacaaacaaacaaacaaaaaaggtccaggaccagagggattctcagccaaattctacctgatgtataaagaaaagctggtaccattccaacagaaactattacaaaaaattgaggaggagggactcctccccaactcattctatgaggccagcatcattctgataccaaaacctgtcagagacacaacaacaacaaaaataaaaagaaaagaaaaattcaggctgatatttttgatgaacatagatgcacaaattctcaacaaaatgctagcaaactgaatccaacagcacatgcaaagttggtttaacatatgcaaattg

SEQ ID NO: 2429 - DNA, 245 bp, Homo sapiens
  chr2.fa.O7frz.24845665
  Located on chromosome 2
  Distance between a terminus base of telomere on chromosomal short arm and 5'-terminus of this base sequence : 23895404
  Distance between 3'-terminus of neighbour sequence of sequence listing upward to telomere on chrosomal short arm and 5'-terminus of this base sequence : 155984
tgaatatccattgttccaataccatttgctgaaaagactgttctttttccactgagttgcttttgcacctctgtcgaaaatctgttgtttatacacacacacacacacacacacacacaaacacacgtagcatgaatctatttacctactctgttccattgatctattttcctgtctagatgctaatatcacaactgttttgactgctgtaacttttataataagccttaaattcaggtactaaa

SEQ ID NO: 2430 - DNA, 479 bp, Homo sapiens
  AC008073.2_70306
  Located on chromosome 2
  Distance between a terminus base of telomere on chromosomal short arm and 5'-terminus of this base sequence : 24006344
  Distance between 3'-terminus of neighbour sequence of sequence listing upward to telomere on chrosomal short arm and 5'-terminus of this base sequence : 110695
gctggtcatgctaagagtactactctggctacttgggaggctgaggcaggagaatggtgtgaacctgggaggcagagcttgcagtgagccgacatcgcgccactgcactccagtctgggcgacagagtgagactccatctcacacacacacacacacacacacacacacacaaaagagtactactctggcctgtgtgactgtgataattctcagtaccaattaacacattgtccctgtttgttcaccgggctctatgagtttggttaacatgagagatgatctcaagtgggctgacaaaatggggttttgaagccagcaaggccgagagccaaggaacatcagcaaggaatgcgtcctttagactcttggaggacagggtgtgtgcaatttatctcttcccagcttgctgcacatggcctgtccccagtagaagctcagtgttcatttatctgaactagacatccttaatagtaaggcc

SEQ ID NO: 2431 - DNA, 441 bp, Homo sapiens
  chr2.fa.O7frz.25090125
  Located on chromosome 2
  Distance between a terminus base of telomere on chromosomal short arm and 5'-terminus of this base sequence : 24331510
  Distance between 3'-terminus of neighbour sequence of sequence listing upward to telomere on chrosomal short arm and 5'-terminus of this base sequence : 324687
gaatcacctgttaaagatagtgacctgctgaattaaaatatcaaatgaaggcctgcccagatatcttaacaaaccttaaagctaatgcttaagttggccgggtgcagtggctcatgcctgtaatcccaacactttgggaggccgaggcaggtggatcacctgaggtcgggagttcaagaccagcctaatcaacttggagaaaccccatctccactaaaaatacaaaattagcgcgcatggtggcgcagtcctgtaatcccagctactcggaaggctgaggcaggagaatcacttgaacccgggaggtggaggttgcggtgagccaaggtcgcaccattgcactccagcctgggcaacaagagcgaaacttcatcgctaataataataataataataataataataataataatagtaataatgcttaagtttgacaatcat

SEQ ID NO: 2432 - DNA, 215 bp, Homo sapiens
  D2S2168
  Located on chromosome 2
  Distance between a terminus base of telomere on chromosomal short arm and 5'-terminus of this base sequence : 24496592
  Distance between 3'-terminus of neighbour sequence of sequence listing upward to telomere on chrosomal short arm and 5'-terminus of this base sequence : 164641
gcactctagcctcagcaacagagtgagactctgtctcaaaaaaagaaaaatagatttagtacaaaagagtgaataggctatcatctgtgtgtgtgtgtgtgtgtgtgtgtgtgtgtgtgtgtgtgtgtgtgaaaattctataaacctctgaaagggtacattaaaaagataatagtgactggtgattcatggatgggggctggatggctagggga

SEQ ID NO: 2433 - DNA, 132 bp, Homo sapiens
  D2S2170
  Located on chromosome 2
  Distance between a terminus base of telomere on chromosomal short arm and 5'-terminus of this base sequence : 24567630
  Distance between 3'-terminus of neighbour sequence of sequence listing upward to telomere on chrosomal short arm and 5'-terminus of this base sequence : 70823
taagggttcaacaatgcctgctattccaaactttaggaaaagcctaattcacacacacacacacacacacatttatttatttatttatttatttatttttcttttctgagacggagtttcactcttatgatc

SEQ ID NO: 2434 - DNA, 307 bp, Homo sapiens
  AC012457.4_148398
  Located on chromosome 2
  Distance between a terminus base of telomere on chromosomal short arm and 5'-terminus of this base sequence : 24835805
  Distance between 3'-terminus of neighbour sequence of sequence listing upward to telomere on chrosomal short arm and 5'-terminus of this base sequence : 268043
ccgaatgtcaagcttagtaacaatgaaacataactgtaaacattcaaaatctacaaataacctattctcctaacaaaatataatatgtataaatattttatatataatattcatatagaagtgtgtgtgtgtgtgtgtgtgtgtgtgtgtatataaaacacatatagattttcctgggcctgtattgttctaacctctcatcccactttgagagggatgcccatgttatgagctaggaatcagggcccagtcacggaacacgtgcagtcccactctctgcattcattaacctcattagagccagaag

SEQ ID NO: 2435 - DNA, 275 bp, Homo sapiens
  D2S171
  Located on chromosome 2
  Distance between a terminus base of telomere on chromosomal short arm and 5'-terminus of this base sequence : 24878654
  Distance between 3'-terminus of neighbour sequence of sequence listing upward to telomere on chrosomal short arm and 5'-terminus of this base sequence : 42542
tggcaggcagaggttacggtgagccgagatcatgccaccgcactccagcctgggcaacagagtgagactctgtgtcaaaaacacacacacaaaaaaaacacagcaaatcaccccaagcaaaaggcaaagtctacgatggcctacaaggatctgcaggatcttgcacctcaacagggtctgcattccaccatgcacacacacacacacacacacacacacacacacacacacacacacacactccctcccaccctcctgcctctgggcctttgcac

SEQ ID NO: 2436 - DNA, 174 bp, Homo sapiens
  D2S144
  Located on chromosome 2
  Distance between a terminus base of telomere on chromosomal short arm and 5'-terminus of this base sequence : 24961397
  Distance between 3'-terminus of neighbour sequence of sequence listing upward to telomere on chrosomal short arm and 5'-terminus of this base sequence : 82468
tctccctgacagactctgcgcatgcccacttgagtgatcacacacacacacacacacacacacacacacacacacagacacacacgctttccagcctggccgggccgcctcggaatgcggcacttgtcgtgagtcagggagggtcagctgctctctcagtacggcctatgcagc

SEQ ID NO: 2437 - DNA, 255 bp, Homo sapiens
  D2S2303
  Located on chromosome 2
  Distance between a terminus base of telomere on chromosomal short arm and 5'-terminus of this base sequence : 25070847
  Distance between 3'-terminus of neighbour sequence of sequence listing upward to telomere on chrosomal short arm and 5'-terminus of this base sequence : 109276
tgagctgcgtgactgggccagggctctagaagggcttggcttgcagggcaggaagtaacatgcaaacagctttcattttgtttgcaaacacattcatgtacatgttctcatttggacccctccccccgctgctgccggcaacctgtgagtggaaaggacatacgtgtgtgtgtgtgtgtgtgtgtgtgtatgtatatatttatatacgtatatatcttttttggagacagagtcttgctttgttgcccaggtgga

SEQ ID NO: 2438 - DNA, 458 bp, Homo sapiens
  AC027818.2_107130
  Located on chromosome 2
  Distance between a terminus base of telomere on chromosomal short arm and 5'-terminus of this base sequence : 25100053
  Distance between 3'-terminus of neighbour sequence of sequence listing upward to telomere on chrosomal short arm and 5'-terminus of this base sequence : 28951
taacagaaactttaaggccaggagcaatggctcatgcctgtaatcccagcaatttgggaggctgaagtgggtggatcacctgaggtcaggagtttgagaccagcctggccaacatggcaaaaccccatctctaccaaaaatacaaaaaaattaacctgggccgtggtggatgggcgcctggaatcccaccttctctggatgttgaggcaggataatcacttgaacctgggaggcggaggctccagtgtgccatacttgtgccactgcactccagcctgggtgacacagcgagactccatctcaaaacacacacacacacacacacacacacacacacacacacacacactactttaagtagttgagaaatattattcatttttacatagctaatatcctatttataaacattcttatttattcataaaagcaactgctcgagacattatcctatttcc

SEQ ID NO: 2439 - DNA, 231 bp, Homo sapiens
  D2S2144
  Located on chromosome 2
  Distance between a terminus base of telomere on chromosomal short arm and 5'-terminus of this base sequence : 25386257
  Distance between 3'-terminus of neighbour sequence of sequence listing upward to telomere on chrosomal short arm and 5'-terminus of this base sequence : 285746
tagccttctgcctcatacatttgtgtgtgtgtgtgtgtgtgtgtgtgtgtgtgtgtgtgtgtgtatgtatttagcatgcatgctccccaacactgcaccttccctgggtggggtctgggcagtctgccaagacctctggcttatctgatgccaggcatcctgcccaggcctctctgggaggcagggattcactcggtggtcccgtctacagcaggagcggtgagcaagtgc

SEQ ID NO: 2440 - DNA, 407 bp, Homo sapiens
  AC011742.2_140016
  Located on chromosome 2
  Distance between a terminus base of telomere on chromosomal short arm and 5'-terminus of this base sequence : 25759261
  Distance between 3'-terminus of neighbour sequence of sequence listing upward to telomere on chrosomal short arm and 5'-terminus of this base sequence : 372773
gatcagatgaggacttaggaatgatcattggatttgggaacatggagatcattgatcatagtgagagctgtgtgtgtgtgtgtgtgtgtgtgtgtgtgtgtgtgtgtgtgtgtgtgtgtgtgtgtgtgttggggtggttaataataacaacaacaacaaagcctgtttggaaaggattcaagaggtgagaggagagaaaactagagacagcacatataggtaacttcgaagaagtttggtaaaaacaaaaagtgaaatagagaggaaacttagtgaggaaggatccttaacctccaaatttaaaaggtttagtaatagaacctagtagttgtgattattgactagaagaaatgtgagggaaactcaaggagtccaaaatgaggcttctgtcttgaccagttagatta

SEQ ID NO: 2441 - DNA, 271 bp, Homo sapiens
  D2S158
  Located on chromosome 2
  Distance between a terminus base of telomere on chromosomal short arm and 5'-terminus of this base sequence : 25896362
  Distance between 3'-terminus of neighbour sequence of sequence listing upward to telomere on chrosomal short arm and 5'-terminus of this base sequence : 136694
ccaccatattccagtctgagcaacagagtgagaccccaacatgtgtgcgcgcgcacacacacacacacacacacacacaaaattaatacatttactattatgtaagtaatatctcaataatgctgattttcaataaatataagagggtaatgaacacacaagtcagaatagtggcttctttggataaagggaggcaaagaaactgaatgggaggaagtagcccatcagtagatatcaattattgttaatattctcaggttggttgtttcat

SEQ ID NO: 2442 - DNA, 455 bp, Homo sapiens
  AC010896.13_106977
  Located on chromosome 2
  Distance between a terminus base of telomere on chromosomal short arm and 5'-terminus of this base sequence : 26056856
  Distance between 3'-terminus of neighbour sequence of sequence listing upward to telomere on chrosomal short arm and 5'-terminus of this base sequence : 160223
gtatgaggcattatcttacagactcagaggtatacagatttggtctttaccttcaaggcacttagagtccagtaagacagaaaagaatagataatttcctaacataaacataaaggtatgcacaggatgctgtgggaacacagtgtggggagctggaagtaggttgccaactgggacaaaaaaggcttcttgggagaaatgaaacttaagatgaatcttgaagattgagagggagttaaccagtcacgaacaaaggaacagaagctttgtatatgcaacctgaaatgtttggcgatttatgaataatcctgcattctggggagatcaagagtgtgtgtgtgtgtgtgtgtgagtgtgtgtttgtatgtatgtgtgtgtgcgtgtgtatgtgtgtctgttggaaggaagggtcggagagaatgacgacaagagtaattaaattcaaagcaatcaag

SEQ ID NO: 2443 - DNA, 182 bp, Homo sapiens
  D2S2223
  Located on chromosome 2
  Distance between a terminus base of telomere on chromosomal short arm and 5'-terminus of this base sequence : 26057146
  Distance between 3'-terminus of neighbour sequence of sequence listing upward to telomere on chrosomal short arm and 5'-terminus of this base sequence : -165
ggcgatttatgaataatcctgcattctggggagatcaagagtgtgtgtgtgtgtgtgtgtgagtgtgtgtttgtatgtatgtgtgtgtgcgtgtgtatgtgtgtctgttggaaggaagggtcggagagaatgacgacaagagtaattaaattcaaagcaatcaagggaggctaggcgcagtg

SEQ ID NO: 2444 - DNA, 308 bp, Homo sapiens
  AC069198.2_74288
  Located on chromosome 2
  Distance between a terminus base of telomere on chromosomal short arm and 5'-terminus of this base sequence : 26161008
  Distance between 3'-terminus of neighbour sequence of sequence listing upward to telomere on chrosomal short arm and 5'-terminus of this base sequence : 103680
atgaatacatctgaatatggctatgcatagctaggtaaataaacagacataaacaggattatataagtatgtctatgtaaatatttacctatataaagcatgttccccaaaagacattttaaatactctagtgtatataatactaaggatgcaggtgtagagttagtgtgtttgtgtgtgtgtgtgtgtgtgtgtgtgtatatatatatatatagtttttttaactttagattcttgagcagcagcttcagcagaggaaagcaatttatcagctaaaccaagagaaattagagtacaacttgcaggtg

SEQ ID NO: 2445 - DNA, 94 bp, Homo sapiens
  D2S2350
  Located on chromosome 2
  Distance between a terminus base of telomere on chromosomal short arm and 5'-terminus of this base sequence : 26222566
  Distance between 3'-terminus of neighbour sequence of sequence listing upward to telomere on chrosomal short arm and 5'-terminus of this base sequence : 61250
ccttctgatgggggaggtgagttacacacacacacacacacacacagacacacacacacacacatacaggccaaaaagagactacatagggcca

SEQ ID NO: 2446 - DNA, 203 bp, Homo sapiens
  D2S174
  Located on chromosome 2
  Distance between a terminus base of telomere on chromosomal short arm and 5'-terminus of this base sequence : 26312992
  Distance between 3'-terminus of neighbour sequence of sequence listing upward to telomere on chrosomal short arm and 5'-terminus of this base sequence : 90332
ttagagcacacatggtcactcccagcctcccccactgctctacccattttacaggtgaggaatccgagaccagggaagtggtttgtcaagaacttacccacagcaagagcatggaatgtgtgtgtgtgtgtgtgtgtgtgtgtgcacgtgagcgtgggtgggcatgattgtgtcctgggcatgtaggaggtgggattcagcct

SEQ ID NO: 2447 - DNA, 348 bp, Homo sapiens
  AC015977.8_2495
  Located on chromosome 2
  Distance between a terminus base of telomere on chromosomal short arm and 5'-terminus of this base sequence : 26350619
  Distance between 3'-terminus of neighbour sequence of sequence listing upward to telomere on chrosomal short arm and 5'-terminus of this base sequence : 37424
gacggataatttggtagtgttaaaggaaaaagtaatttcaaagctggtctttagcgggtttctaagcagacagagatgggcccagatgcagtctggggtgggggatgggggctgactactccacaggagagaggaaaaggatgctatgggagtctggctgtggtgtgtgtgtgtgtgtgtgagagagagagagagagagagagagagagagagagagagagaatgagtctggtggaggctgggcctcaaggaggcaaaatggctcatgggagcggggaggtgggtagaggacacagccaaaggaatatcaaccttaaggtgttttctgtgctaaaatgcaatgtagct

SEQ ID NO: 2448 - DNA, 477 bp, Homo sapiens
  AC015977.8_58819
  Located on chromosome 2
  Distance between a terminus base of telomere on chromosomal short arm and 5'-terminus of this base sequence : 26382905
  Distance between 3'-terminus of neighbour sequence of sequence listing upward to telomere on chrosomal short arm and 5'-terminus of this base sequence : 31938
taggaagtagcatagacgtgaggcctggaggtgttcactccccttgccagacctcagtttcctcatgggcactgggcattctacgcttttctccagctttaattactctgtgatccttggccaaatgcagagaagactgggtatggaggggaaaatgcaaaggtccagaagacagaagaagaggggaagaggagacaaggactgaagctgaaattctcagactcacagacacacacagacacacacacacacacacacacacacacacacactccaggctggagaacaaaggctgatttcctcccaggtctggctctgtatcacctgctggccttcctgaaaccccagtaatggctgggtctgtcccagcccctgccccaagtgtgggaaggggaaggcattgaagaggaaaggaaaagggggaagaggatgagatgagtagaaagtggggagggaggtacacaaatggtaaagtca

SEQ ID NO: 2449 - DNA, 420 bp, Homo sapiens
  AC015977.8_166217
  Located on chromosome 2
  Distance between a terminus base of telomere on chromosomal short arm and 5'-terminus of this base sequence : 26431066
  Distance between 3'-terminus of neighbour sequence of sequence listing upward to telomere on chrosomal short arm and 5'-terminus of this base sequence : 47684
actcagataattgttccagctcctgtttcagaggaagggattttggttcgaagtggaagtgacatattcaaggtcatgaagcgagataatggtgtagccaaaattagtatccacatagcccaactttccaacacacacacacacacacacacacacaccagtaagggcccagccttctctgactctgatttcagatgaaaactgctaatctctgaggttgagtcactctgatgctggaaatttaccacatccacatctggacaaacacagagactcacactcctgcctctcagtctcccagctgcaggggagggcctcgtgggtggtgccagccccttagggcaaggactgtgatggaattgacctccgtgaccctctctggccagtgaacagcaccccctcgagaatccatatgaacag

SEQ ID NO: 2450 - DNA, 434 bp, Homo sapiens
  AC013472.5_156059
  Located on chromosome 2
  Distance between a terminus base of telomere on chromosomal short arm and 5'-terminus of this base sequence : 26562155
  Distance between 3'-terminus of neighbour sequence of sequence listing upward to telomere on chrosomal short arm and 5'-terminus of this base sequence : 130669
gtgatatcaagcaaattacctaacgcttctgaaccccactggcctcattcactgcagtgttgctgtgaggataagaaatgaaatacataaaacatctagtcctgtgcatgacacataatagaggctcagtaaatttgactgggtgagtatagttttcccctgattttattaacaatacatattcactgtggaaaatgtaaatgatatcgtaaggaagaaaacaagacacctgaaatcccacaaccctaaaatagccaccattagcagtttggtgaccacctttcatgcatctcattatgcaaacacacacacacacacacacacacacaatgttcattgtaattgttattttttctttctttgttaaaaaatgaggcttagaagaattgtaatgttcccaatacaaagaaaagataaagtttgaggtgatggat

SEQ ID NO: 2451 - DNA, 405 bp, Homo sapiens
  chr2.fa.O7frz.27432651
  Located on chromosome 2
  Distance between a terminus base of telomere on chromosomal short arm and 5'-terminus of this base sequence : 26578204
  Distance between 3'-terminus of neighbour sequence of sequence listing upward to telomere on chrosomal short arm and 5'-terminus of this base sequence : 15615
acttgcatgattttaaagtacaatatttacttatttatttattcattgagacaaggtctcactctgtcacccaggctggagttcagtggcatgatcacagctcactgcagtcccgacctccttggctcaagcaatcctcctgccttagccttctgactagctgggactacaggcgcacaccaccatgcccagcttattgtgtgtgtgtgtgtctgtgtgtgtgtgtgtgtgtgtgtgtgtatgtgtgtgtagacagggtgtcactatgttgcccaggctgttctcaaactcctaggcaattgctcaagcaatactcctgcctcagcctcccaaagtgctgagattacaggcataagcaccacgcccagcacaatatttatttttaattataagagcaatgttggc

SEQ ID NO: 2452 - DNA, 403 bp, Homo sapiens
  AC013472.5_6550
  Located on chromosome 2
  Distance between a terminus base of telomere on chromosomal short arm and 5'-terminus of this base sequence : 26691601
  Distance between 3'-terminus of neighbour sequence of sequence listing upward to telomere on chrosomal short arm and 5'-terminus of this base sequence : 112992
ctatgagtttatactggcctaaataaataaaagaaaaaataaatggaggaggaagggatagcttttcctttatgatggagttaaaagttaagaacagttcttaagtaggttggaggccaaatcagaatggggactttttcaaatacctgagggtctttctaagagaggtgtgtgtgtgtgtgtgtgtgtgtgtgtgtgtgtgtgtgtgtgtgtgtgtatgtgtgtgtgttttggaaaagctccccacaagatactaatgggccttttctgtttggggactactgatattccggccacagaagacagtggaaagatagcagagggaagtatgtcttcagcttgcttggcccattcatatctgcctatcgcctctattccttgttatcctcatcaatctatttgg

SEQ ID NO: 2453 - DNA, 154 bp, Homo sapiens
  D2S2247
  Located on chromosome 2
  Distance between a terminus base of telomere on chromosomal short arm and 5'-terminus of this base sequence : 26777030
  Distance between 3'-terminus of neighbour sequence of sequence listing upward to telomere on chrosomal short arm and 5'-terminus of this base sequence : 85026
ccgtgctctatgccagagagaagagaggggcagaagggttagtgagatcgcagagattccctgcccgtgtgtgtgtgtgtgtgtgtgtgtgtgtgtgtgtgtgtgtatttgtgtgtctgtgtgagagagagggagagagcacgcaaaagatgga

SEQ ID NO: 2454 - DNA, 147 bp, Homo sapiens
  chr2.fa.O7frz.27734449
  Located on chromosome 2
  Distance between a terminus base of telomere on chromosomal short arm and 5'-terminus of this base sequence : 26872689
  Distance between 3'-terminus of neighbour sequence of sequence listing upward to telomere on chrosomal short arm and 5'-terminus of this base sequence : 95505
ataagacgaaaagtacaaagcagtgtgtattttatgctaccagatcatacatcatttctgttttatttgcataagatacacacacacacacacacacacacacacacacacacaaaacaataaaaagcagttacttgttctagtgga

SEQ ID NO: 2455 - DNA, 460 bp, Homo sapiens
  chr2.fa.O7frz.27814274
  Located on chromosome 2
  Distance between a terminus base of telomere on chromosomal short arm and 5'-terminus of this base sequence : 26979466
  Distance between 3'-terminus of neighbour sequence of sequence listing upward to telomere on chrosomal short arm and 5'-terminus of this base sequence : 106630
attgttcagtaaagaggcctactggttaaaagctactgaggtcacttgacaagcagggagaaggcaaagaaatttacttctcagaagtccagccagttttgttttatctgtggtcatggggccaagcagagctaatcaaattcacagatactagtatagcccactggtttagaaataaaagcagcatataccagaatggattataagtgggctttttttttttttcctgtgctactggggaggttctagtaggctataaaatggaacagagatcagggagagtgaggggcaaaggcacacacacacacacgcgcgcacacacacacacacacacacacacacacacacacacggccttgccgttaagtaaaagccctgaatatggccaggtgcagtggctcacgcctgtaatcccaacactttgggaagctgaggccagcagatcacgaggtcaggagtt

SEQ ID NO: 2456 - DNA, 393 bp, Homo sapiens
  chr2.fa.O7frz.27990850
  Located on chromosome 2
  Distance between a terminus base of telomere on chromosomal short arm and 5'-terminus of this base sequence : 27213363
  Distance between 3'-terminus of neighbour sequence of sequence listing upward to telomere on chrosomal short arm and 5'-terminus of this base sequence : 233437
atccacatcagtatttgaacactctttgttgtgtttctttttgtaaaataataataaccttcttatgcaaaaggtagcatcttttttatatcttgcattttttgcttaagatattctgaaaatcactgcagtgcagtttatagatctcttcctcattattacttattatttgcatttgtgtgtgtgtgtgtgtgtgtgtgtgtgtgtgtgtgtgtaacaatagtttgccctgtcaatctcctatgcaggaacacaaaaccactgacccaggctcacctatactttccctgatccagccctggagtcagtcatttttctgaggagacctgatcttgttagtgggttctagtatttagaaacccaaatgctaggtatgttcactgctactggtgt

SEQ ID NO: 2457 - DNA, 266 bp, Homo sapiens
  chr2.fa.O7frz.28288200
  Located on chromosome 2
  Distance between a terminus base of telomere on chromosomal short arm and 5'-terminus of this base sequence : 27427158
  Distance between 3'-terminus of neighbour sequence of sequence listing upward to telomere on chrosomal short arm and 5'-terminus of this base sequence : 213402
acatatgcactggtttctacactggtctctcttgtccttaaaatgccttcaccagtttttttatgatctgggaaaacgcttgtgatttgatgattaggatacacacacacacactcacacacacacatgcacaattgtgtatctatagtagtctcaaccccaaaatataaaacatgtagaaattcatatacacaagcataatgttttgatgtttgcgctgtcttaagaccattctgtttctccccttctgttacaaaggaaatgtg

SEQ ID NO: 2458 - DNA, 255 bp, Homo sapiens
  DISO7_10000878
  Located on chromosome 2
  Distance between a terminus base of telomere on chromosomal short arm and 5'-terminus of this base sequence : 27513254
  Distance between 3'-terminus of neighbour sequence of sequence listing upward to telomere on chrosomal short arm and 5'-terminus of this base sequence : 85830
acacatcaagtatattgccaaagtaaagcaaaaacttcctgaaagaggaacccaaagtggtagagctgtatataatttcaaatttgcctttccaaatcctttattttttaatatatatgtatgcatatgtatgtgtgtgtgtgtgtgtgtgtgtgtgtgtgtgtgtgtatatatatatatataaaaccacatttcctttatctttttctctttctctctctcatatataaacagaatcctgctgatagaaataag

SEQ ID NO: 2459 - DNA, 250 bp, Homo sapiens
  chr2.fa.O7frz.28779280
  Located on chromosome 2
  Distance between a terminus base of telomere on chromosomal short arm and 5'-terminus of this base sequence : 27754612
  Distance between 3'-terminus of neighbour sequence of sequence listing upward to telomere on chrosomal short arm and 5'-terminus of this base sequence : 241103
caaagtccattaagtcattcttacgcctttgcatcttcaaagcttagctcccacttatgtgtgagagcatacaatgtttggttttccattcctgagttacttcacttagaataatcgtctccaattccatccaggttgctgcaaatgccattattttgtttctttttatggcttagtagtattccatgatgtgtgtgtgtgtgtgtgtgtgtgtgtgtgtgtgtgtgtgtagctacgatttctttatccg

SEQ ID NO: 2460 - DNA, 170 bp, Homo sapiens
  chr2.fa.O7frz.28869888
  Located on chromosome 2
  Distance between a terminus base of telomere on chromosomal short arm and 5'-terminus of this base sequence : 27872926
  Distance between 3'-terminus of neighbour sequence of sequence listing upward to telomere on chrosomal short arm and 5'-terminus of this base sequence : 118064
tctagtaaggccttatagccagtgttccagatggatgaagcagaattatgaaagtgatattcaacgtgtcctactttgtattgtgagctgagttgagagaattcattatttacttagtatttttgttttgttttgttttgttttgttttttagacaggttcttgatcctg

SEQ ID NO: 2461 - DNA, 466 bp, Homo sapiens
  AC036158.3_27209
  Located on chromosome 2
  Distance between a terminus base of telomere on chromosomal short arm and 5'-terminus of this base sequence : 28167955
  Distance between 3'-terminus of neighbour sequence of sequence listing upward to telomere on chrosomal short arm and 5'-terminus of this base sequence : 294859
atcctaagaattccaaactcaccaatttaacactctctgggactggaaaaatacattcccaagatagttttcctaaaaatttcccgtagagggcactagagaggtatgattgaggctagcttgggaatcacagtcatttctggtaaaagttctttgatgtgaggaatgtcccagtctggtacagttggcaaaagttcactctggggaattttgtgtgtgtgtgtgtgtgtgtgtgtgtgtgtgtgtgtgtgtgtgtgtgtcttgggaaggggtggttgaggaagaagagtgctagtctggtattccttaactccaaaaaggaaatactgcccttgatttattttcacaagttatctgagaaacaaatagcagccttggaaaagttctaggtcttgtttttgttttgttttttcattaaaagggggcccagctgatgaaaacaagttatgaaatgacctatgtttgt

SEQ ID NO: 2462 - DNA, 222 bp, Homo sapiens
  D2S366
  Located on chromosome 2
  Distance between a terminus base of telomere on chromosomal short arm and 5'-terminus of this base sequence : 28168112
  Distance between 3'-terminus of neighbour sequence of sequence listing upward to telomere on chrosomal short arm and 5'-terminus of this base sequence : -309
tgtgaggaatgtcccagtctggtacagttggcaaaagttcactctggggaattttgtgtgtgtgtgtgtgtgtgtgtgtgtgtgtgtgtgtgtgtgtgtgtgtcttgggaaggggtggttgaggaagaagagtgctagtctggtattccttaactccaaaaaggaaatactgcccttgatttattttcacaagttatctgagaaacaaatagcagccttgga

SEQ ID NO: 2463 - DNA, 192 bp, Homo sapiens
  D2S365
  Located on chromosome 2
  Distance between a terminus base of telomere on chromosomal short arm and 5'-terminus of this base sequence : 28217337
  Distance between 3'-terminus of neighbour sequence of sequence listing upward to telomere on chrosomal short arm and 5'-terminus of this base sequence : 49003
atgatttgtgtaccttatgtatgttttagacttcaataaattcactccaaaataccaccccctacacacaaacacacagacacagacacacagacacacacacacacagacacacacacacacacacacacacacacacacacacacacacacacggggagagatctgaagtaagtaggattcctccattga

SEQ ID NO: 2464 - DNA, 287 bp, Homo sapiens
  AC036158.3_101202
  Located on chromosome 2
  Distance between a terminus base of telomere on chromosomal short arm and 5'-terminus of this base sequence : 28220204
  Distance between 3'-terminus of neighbour sequence of sequence listing upward to telomere on chrosomal short arm and 5'-terminus of this base sequence : 2675
cattaggacaaatcattcagatccttctttctccccactagaagcacctttcatttgggaggtccaggtattcttcttgctcccacttcataagcttcaactcctttgagattgtgtgtgtgtgtgtgtgtgtgtgtgtgtgtgtgtgtgtgtgtgtgtttccgccccccacagccaaggtagaagttaattgagaccttcaaataaagcttccagaagacctgattcagagacagcattacctaacgaggatggctgagcagtgctgagtctgaagttgagacaag

SEQ ID NO: 2465 - DNA, 221 bp, Homo sapiens
  D2S2263
  Located on chromosome 2
  Distance between a terminus base of telomere on chromosomal short arm and 5'-terminus of this base sequence : 28235798
  Distance between 3'-terminus of neighbour sequence of sequence listing upward to telomere on chrosomal short arm and 5'-terminus of this base sequence : 15307
ttcctgtgtcagccttttggcttgctgtggcccaaggactaacacacacatgtacacacacacacacacacacacacacacacacacacacacacacacaccctgcttcttgactccttctcccaactccattccagtcgttaacagcagaaggtagagacactctgacaactccatcctgattaaacatgccccatagaagggcatcaggagtctgaata

SEQ ID NO: 2466 - DNA, 309 bp, Homo sapiens
  AC074011.3_17601
  Located on chromosome 2
  Distance between a terminus base of telomere on chromosomal short arm and 5'-terminus of this base sequence : 28366680
  Distance between 3'-terminus of neighbour sequence of sequence listing upward to telomere on chrosomal short arm and 5'-terminus of this base sequence : 130661
taatcaaccaatctatcagatgacgtcaggcactttcagggcggtatggccatagaccaatcagtctatctatacatatgtatgtacacacagacataaacataggggggtgtgtgtgtctctgtgtgtgtgtgtgtgtgtgtgtgtctatgtgttttctgcctgctacaaatttaggagacaggaatggtaggtttcagctgcctctttagcaaactgtaatgataatatttttgaagcaaatttatctatctctgccatattttacccagtcccaaggatttcccctaacatttgcatacgagctag

SEQ ID NO: 2467 - DNA, 254 bp, Homo sapiens
  D2S2312
  Located on chromosome 2
  Distance between a terminus base of telomere on chromosomal short arm and 5'-terminus of this base sequence : 28455018
  Distance between 3'-terminus of neighbour sequence of sequence listing upward to telomere on chrosomal short arm and 5'-terminus of this base sequence : 88029
gatggttttgaatgccacccaacacaaatttgtaaattttcttaaaacattatgagatttgtgtgtgtgtgtgtgtgtgtgattttcttttttagctcatcccctatctttagtgttagttagtttagtgttagtgtattttatgtgtggcccaagacaattcttccaatgtgtcccagaaaagccaaaagattgaatacccttgttctagcagctaataaatcatttaattaggaaaaacaatccctgtgaga

SEQ ID NO: 2468 - DNA, 272 bp, Homo sapiens
  Z66712
  Located on chromosome 2
  Distance between a terminus base of telomere on chromosomal short arm and 5'-terminus of this base sequence : 28555463
  Distance between 3'-terminus of neighbour sequence of sequence listing upward to telomere on chrosomal short arm and 5'-terminus of this base sequence : 100191
aaaataccttgttggcagcaaagggagtaataataaaatatcttccaaaaaacctgaaaataggaaataaatttgccttctgagagttaaaccagtcatacacacacacacacacacacacacacacacgtgcacacatgcacacatgtgcacgcatgtgaacatgcatagaatcacacagagattaggctaaacccaatgagggagtaaactgagagataaccagtgtgtacctgaagactttgggaatacccctaacttcagtgacctgg

SEQ ID NO: 2469 - DNA, 141 bp, Homo sapiens
  D2S1322
  Located on chromosome 2
  Distance between a terminus base of telomere on chromosomal short arm and 5'-terminus of this base sequence : 28556793
  Distance between 3'-terminus of neighbour sequence of sequence listing upward to telomere on chrosomal short arm and 5'-terminus of this base sequence : 1058
caagttatccacccacctctgcctccaaaagtgttgggattacaggcgtgagccactgcgcccagcctttttattattattattattattattattattattattattattattttgagacaaattcttgctctgtcaccc

SEQ ID NO: 2470 - DNA, 215 bp, Homo sapiens
  D2S170
  Located on chromosome 2
  Distance between a terminus base of telomere on chromosomal short arm and 5'-terminus of this base sequence : 28652641
  Distance between 3'-terminus of neighbour sequence of sequence listing upward to telomere on chrosomal short arm and 5'-terminus of this base sequence : 95707
cgcatgagaggcgtctctgtcacctgggtctgtcttataggaatggagggccggcctgtcataactttaaagacagtgtgggtgtatggacatgcgagtgtgtgtgtgtgtgaagggtgtgtgtgtgtgtgtgtgtgtgtgtgtgtgtgtgtgtgtgtgtgtggcttttccccagggaaaaagaaggaagattcacacctgacattattgagcaa

SEQ ID NO: 2471 - DNA, 336 bp, Homo sapiens
  chr2.fa.O7frz.29982612
  Located on chromosome 2
  Distance between a terminus base of telomere on chromosomal short arm and 5'-terminus of this base sequence : 29020953
  Distance between 3'-terminus of neighbour sequence of sequence listing upward to telomere on chrosomal short arm and 5'-terminus of this base sequence : 368097
taaggtaccacttgttcatgacttcccagtttccaaaattttgtcattgttgtgttcttgcagggtttaatgcaactaaaagactccctttattggtgtgtgtgtgtgtgtgtgtgtgtatgtatgtgtactttgtgaggggcatgtgttcaatctgccatttaaaattacatgtggctgttaatgtgtggtcccagccagcaatggcagcatcactctgggacttgttagaaatgcaaattctcagctagatcccagaccttctgaatcataaattcccagggtagggtccaataatctgaattttaacaagtctttatgaattctgatagatgc

SEQ ID NO: 2472 - DNA, 190 bp, Homo sapiens
  D2S146
  Located on chromosome 2
  Distance between a terminus base of telomere on chromosomal short arm and 5'-terminus of this base sequence : 29183526
  Distance between 3'-terminus of neighbour sequence of sequence listing upward to telomere on chrosomal short arm and 5'-terminus of this base sequence : 162237
caccacattcaaatgcctccttgctggttgtgtgtgtgtgcacacgtgcatatttgtgtgtgtgtgtgtgtgtgtgtgtgttggtctcctaatgagaaaatgacaggcacttgaaggaaaaggaggagaaatagcagaaggggaaagggaagagagatcatcagaggatctttgcttagagtaaggatga

SEQ ID NO: 2473 - DNA, 473 bp, Homo sapiens
  chr2.fa.O7frz.30310318
  Located on chromosome 2
  Distance between a terminus base of telomere on chromosomal short arm and 5'-terminus of this base sequence : 29351262
  Distance between 3'-terminus of neighbour sequence of sequence listing upward to telomere on chrosomal short arm and 5'-terminus of this base sequence : 167546
ctcagatctattgaatcagaatctcaggttataggatctaggcagtcttttctataagatatccagaagaattctgatgcactgtcaggttaagagcactcacctacacacacacacacacacacacacacacacagacacacacacacacaccctacaatacctatcaccatccagataaaagcagcttaaaatataagtcaaggtcaacccatcccaaaacagttataaaaacaaaaagtcagcccaggaaagtgtatagaaaggaaagtctcttttggttctttgatgacaaggtagaggctgaggtataagcctgagagcattaattgtttttgtgccacctccaatctccctcatcagcttacccaagacctgacctgttaggctccctagtagcataagcctgagatgagattctctcgagaatctggccacagagcaggctctggtcctggtctttctacaaagac

SEQ ID NO: 2474 - DNA, 173 bp, Homo sapiens
  D2S390
  Located on chromosome 2
  Distance between a terminus base of telomere on chromosomal short arm and 5'-terminus of this base sequence : 29446956
  Distance between 3'-terminus of neighbour sequence of sequence listing upward to telomere on chrosomal short arm and 5'-terminus of this base sequence : 95221
catgctccatcctggtacactgtgtgtgtgtgtgtgtgtgtgtgtgtgtgtgtgtgtgtgtctgtatgcacatgcctatgcgtggctgcctgggtctgagtctaggtcattgcaatatcccaaggcaatatgaacaccataattactaccatttattgagcacctcctatggg

SEQ ID NO: 2475 - DNA, 240 bp, Homo sapiens
  AC016907.2_47413
  Located on chromosome 2
  Distance between a terminus base of telomere on chromosomal short arm and 5'-terminus of this base sequence : 29581872
  Distance between 3'-terminus of neighbour sequence of sequence listing upward to telomere on chrosomal short arm and 5'-terminus of this base sequence : 134743
caaagaaatgactttgatataggtggcccttggttcaggctttttcacctctctctctctctctctcagacacacacacacacacacacacacacacacacacacacagtcacacacacacacactgtcacacacacagataaagttgaagtcccattttccttccttctcagtgttagccactatcatgaaatgaatttgggtttatcttttatagtaatgttgtctggtttagaagtg

SEQ ID NO: 2476 - DNA, 368 bp, Homo sapiens
  chr2.fa.O7frz.30718216
  Located on chromosome 2
  Distance between a terminus base of telomere on chromosomal short arm and 5'-terminus of this base sequence : 29648790
  Distance between 3'-terminus of neighbour sequence of sequence listing upward to telomere on chrosomal short arm and 5'-terminus of this base sequence : 66678
cacttcctaaaggagctattctatttacattacccagagctctcataagctcaggttaaagtaaacaacacacacacacacacactcactcacacacacacacacacacacacaatgcaacctcagccttatgacagctgtactccacacaatgttcaggatccaggttcctcccagctcattgctccattgtccctagatggcatcctggtccctgtggtatagacatcattcatgatccaggcagcaagatggaggggaaacaatgaatatgatctcaatataaagcaaggggcaagatagagggaagttattaaaaggttattagaacccaccagtaagaggttactggagtctaaactggagtg

SEQ ID NO: 2477 - DNA, 394 bp, Homo sapiens
  AC036205.3_4781
  Located on chromosome 2
  Distance between a terminus base of telomere on chromosomal short arm and 5'-terminus of this base sequence : 29656476
  Distance between 3'-terminus of neighbour sequence of sequence listing upward to telomere on chrosomal short arm and 5'-terminus of this base sequence : 7318
cctttaagtcgtacatgttaagattcaatgccgctgagaggaaacacaaattaataccacaataatgtaccactatatgcccatcagaaaggttacagagactgaaaatgccaagtatgtgtataactcaataagaaaaggcaaaagttacatatttttatatatatatatatatatatatataattacacaaaagaagctacactatttttttttaaataaacgcaaagaggtggttctcataaaagtcaggataccactgtctttagtgaggaaggaatgagttataatcaggaaaaagcctgatagggctccttgagtccagatggtgttctgcaggtttcttgacctggaggtggttgcacagatgatcacttacagtaatccattaagc

SEQ ID NO: 2478 - DNA, 457 bp, Homo sapiens
  AC036205.3_150632
  Located on chromosome 2
  Distance between a terminus base of telomere on chromosomal short arm and 5'-terminus of this base sequence : 29667114
  Distance between 3'-terminus of neighbour sequence of sequence listing upward to telomere on chrosomal short arm and 5'-terminus of this base sequence : 10244
cctgagatagaaggtcaggtagcctcgagggctggacagctatgctgggttgtattagcctgagaaacagaagaagcctgtgatagggtggagaacagagaagatggctggagagagacccagagagagagagagagagagagagagagagagagagaaaataggaaccaccgctagagctgcctttctcctttccttcctttccaaggtctgaggcttcagccacgttaccctgggttcttgtgcacctgcacccatccaatcagccctccattcctggggtaacttggtttttcctctaaagtgctctgacacacaggacaagcgctgacccttggctggagcaggcccacctccctggttgtggtggggagaacctgcctctggcagcctctagggccctggccttggtgatatcaacagcagggtgtatgatggtgcattcttattctctatt

SEQ ID NO: 2479 - DNA, 272 bp, Homo sapiens
  AC036205.3_78880
  Located on chromosome 2
  Distance between a terminus base of telomere on chromosomal short arm and 5'-terminus of this base sequence : 29758309
  Distance between 3'-terminus of neighbour sequence of sequence listing upward to telomere on chrosomal short arm and 5'-terminus of this base sequence : 90738
gaaatgtctttctgctgtcattacttgtcctggcttttgctcagactcacacaggacttacacccctgggcagggatgctgagtgcccgggtccccttagtctaaagctctgtcccttggaaggaaggaaggaaggaaggaaggaaggaaggaaggaaggaaggaaggaagggagggaggaaggaaagaaggaaggaagggaggaaggaaagaaatggtatgcccagatcttttttcccctcttctgagttaaacagctcaagtgctatgat

SEQ ID NO: 2480 - DNA, 295 bp, Homo sapiens
  chr2.fa.O7frz.30896158
  Located on chromosome 2
  Distance between a terminus base of telomere on chromosomal short arm and 5'-terminus of this base sequence : 29800834
  Distance between 3'-terminus of neighbour sequence of sequence listing upward to telomere on chrosomal short arm and 5'-terminus of this base sequence : 42253
ggatactggtactcctggttctcaggctttcagactcacacctggactctacaccttcagcctcctgggttttaggccttcaggcttgagctgaaatacaccgctgaattacgcctgtttccctagcttgtagatggcagactgtgggacttttgggcttccataaccacatgagccaatttttatagtaatctgctcgtgtatgtgtgtgtgtgtgtgtgtgtataaaattgcctaatttgttctgtttctctggagaactcgaatacaattgtgatgtcaatctaaagagctg

SEQ ID NO: 2481 - DNA, 430 bp, Homo sapiens
  AC073255.2_155875
  Located on chromosome 2
  Distance between a terminus base of telomere on chromosomal short arm and 5'-terminus of this base sequence : 29886429
  Distance between 3'-terminus of neighbour sequence of sequence listing upward to telomere on chrosomal short arm and 5'-terminus of this base sequence : 85300
gttaaaccaactgctaaaggtcagtaagtggcaaaagcaggcttaggcctacgtctttctgatgtttaagcccatgtgttttctgtcctaccatattacctctcaatggatcaaggagaacaatgtctgtttgtctgtgtgtgtgtgtgtgtgtgtgtgtgtgtgtgtgtttgtttttcttattattgagcatcctttttaaggtctgtcccttctctatacttcatttttcctttccataacattatttattattataaaagagctgcaattctacccaccttttgctgtgctggaagaaaaatgttgataaagtgcctagccccatatgccaccaaatcagagtcttttgcaagtcacgaccagatgatctcatctgaaagcttctgtgtgtgttgggtgcttgcagttgaataggatgagtcagatg

SEQ ID NO: 2482 - DNA, 455 bp, Homo sapiens
  AC073255.2_78875
  Located on chromosome 2
  Distance between a terminus base of telomere on chromosomal short arm and 5'-terminus of this base sequence : 29901316
  Distance between 3'-terminus of neighbour sequence of sequence listing upward to telomere on chrosomal short arm and 5'-terminus of this base sequence : 14457
atatcttgtccttccaggaaggtcctcttcatttctctaaatttcttttatcctccaaggactttgtggctataactggtctctccctgtagctgcacaactactaagcaatttagcccttgaacatacattattttgaattgttccattattgcatctatgtataaatcgtatccgttgccctcccctttcacatcacgcatgtgcgcgcgcgcacacacacacacacacacacacacacacacacacacacacacacacacacatcagactaggttggaagaacccgtgttctatcattacatgcagtgggtgctgggtacatcatgggtgaagtcatctgaactaaagtgagaggcacatgtgggccccactctcaaaaactgtaggctataaaggcctccagctcagatggtcactctttcaagaaagaacaagtcagcttagacaaatgt

SEQ ID NO: 2483 - DNA, 253 bp, Homo sapiens
  AC019120.4_37128
  Located on chromosome 2
  Distance between a terminus base of telomere on chromosomal short arm and 5'-terminus of this base sequence : 30036647
  Distance between 3'-terminus of neighbour sequence of sequence listing upward to telomere on chrosomal short arm and 5'-terminus of this base sequence : 134876
gactagtaactggatgcttatcagcaagacttatacactgaagtgaatttttttgtatatgcttatttatatatgtaaaatacagtattctagtttggacttacccaggccaaataaagtgtggtgtgtgtgtgtgtgtgtgtgtgtgtgtgtgtgtgtgtgtgtattatttatttattttgacacggagtcttgctccattgcccaactatgttgttgtgtggctgaagtgcagtggtacgatctcagctca

SEQ ID NO: 2484 - DNA, 179 bp, Homo sapiens
  D2S375
  Located on chromosome 2
  Distance between a terminus base of telomere on chromosomal short arm and 5'-terminus of this base sequence : 30224263
  Distance between 3'-terminus of neighbour sequence of sequence listing upward to telomere on chrosomal short arm and 5'-terminus of this base sequence : 187363
tttgtatcagagggattgcttcaagaattataaggacacacacacacacacacacacacacacacacacacacaccccagtacactgatcagcacatagtaggtgcttgatagatggtaactattatcattgttgctgtggtatgttagtgagttagtagagaatccccagaaactcaa

SEQ ID NO: 2485 - DNA, 243 bp, Homo sapiens
  AC068689.2_71353
  Located on chromosome 2
  Distance between a terminus base of telomere on chromosomal short arm and 5'-terminus of this base sequence : 30254895
  Distance between 3'-terminus of neighbour sequence of sequence listing upward to telomere on chrosomal short arm and 5'-terminus of this base sequence : 30453
gcataccttcctgtcctatttccaggtgtgccgccttcccccttcataatatcgtcactgcaaggtcttgctctttttttaaatttgtttcatttcatttcatgaactttcttttttccttccttccttccttccttccttccttttatccacattctttttctcctccaccccaagacaagcatttcaggatgtggaatgtgcaccttttgtttgtatgcgttcttgtgaaatgagaattgc

SEQ ID NO: 2486 - DNA, 338 bp, Homo sapiens
  AC068689.2_84520
  Located on chromosome 2
  Distance between a terminus base of telomere on chromosomal short arm and 5'-terminus of this base sequence : 30286208
  Distance between 3'-terminus of neighbour sequence of sequence listing upward to telomere on chrosomal short arm and 5'-terminus of this base sequence : 31070
tcctagctaacacggtgaaaccccgtctctactaaaaatacaaaaaaattagccaggtgtggtggcagacgcctgcagtcccagctactcgggagactgaggcaggagaatggcatgaacccgggaggcagagcttgcagtgagccgagattgcgccattgcactccagcctgggctacagagtgagactccatctcaaaaaaagaaagaaagaaagaaaagaaagaaagaaaagaaagaaaagaaagaaagaaagaaagaaagaaagaaagaaagaaagaaagaaagaaagaaagaaagaaagaaagaaagaaaactacgtagacctggaacaggta

SEQ ID NO: 2487 - DNA, 221 bp, Homo sapiens
  DISO7_00000998
  Located on chromosome 2
  Distance between a terminus base of telomere on chromosomal short arm and 5'-terminus of this base sequence : 30365260
  Distance between 3'-terminus of neighbour sequence of sequence listing upward to telomere on chrosomal short arm and 5'-terminus of this base sequence : 78714
gcctattagggaggcaattggttgagggtgatgcaacaaggtgggtgggtgggagagggagagacagagagagagagagagagagaaagaaaagtaaaaaaggcaagggatgaaaagagtcgccgacctggccccagcccgggctcttattcttactgtgtgccttgaacaagtcacttctactgctgcatctcagtgtcccctttcagtgctgacattct

SEQ ID NO: 2488 - DNA, 190 bp, Homo sapiens
  D2S400
  Located on chromosome 2
  Distance between a terminus base of telomere on chromosomal short arm and 5'-terminus of this base sequence : 30446183
  Distance between 3'-terminus of neighbour sequence of sequence listing upward to telomere on chrosomal short arm and 5'-terminus of this base sequence : 80702
aatgtgacaaagcccagtgttagcagaaggggttgggaagtgggaaaacaggacatttacatgggaaggaggagcggacactgaaaagaagagaaaggccatataagtcagtcctatgagagtgtatgctacacacacacacacacacacacacacacacacataggcacacatactcagggagattatc

SEQ ID NO: 2489 - DNA, 216 bp, Homo sapiens
  D2S2255
  Located on chromosome 2
  Distance between a terminus base of telomere on chromosomal short arm and 5'-terminus of this base sequence : 30526050
  Distance between 3'-terminus of neighbour sequence of sequence listing upward to telomere on chrosomal short arm and 5'-terminus of this base sequence : 79677
ccatttgtttgcagattcttgtatgtgtttctgtattggtcagggttctacagaaaaatatcaccaactgtgtgtgtgtgtgtgtgtgtgtgtgtgtgtgtgtgtgtatacacagaaattgagaggacagattgattgattggctgattgatttctaggaaattggctcatgtgattatggaggtacaaatccaaaatcctcaaagtagcctggag

SEQ ID NO: 2490 - DNA, 328 bp, Homo sapiens
  chr2.fa.O7frz.31727807
  Located on chromosome 2
  Distance between a terminus base of telomere on chromosomal short arm and 5'-terminus of this base sequence : 30617715
  Distance between 3'-terminus of neighbour sequence of sequence listing upward to telomere on chrosomal short arm and 5'-terminus of this base sequence : 91449
ctcaaacatcagactctaagttcttcagcttttgaactcttggacttacaccagtggttcgcctggagctctcaggactttggccatagactgaagcttgcaccgttggcttccctacttttgaggttttgagacttagactggcttctttgctcctcagcttgcagacagtctattgtgggacctcaccttgtgatcatgtgagccaattttccttaataaactccccttcatatatatatatatatatatctcctattagttctgtccctttagagaaccctgactaatacagatctcttttataaaggcactaatctattcatga

SEQ ID NO: 2491 - DNA, 268 bp, Homo sapiens
  D2S2283
  Located on chromosome 2
  Distance between a terminus base of telomere on chromosomal short arm and 5'-terminus of this base sequence : 30737312
  Distance between 3'-terminus of neighbour sequence of sequence listing upward to telomere on chrosomal short arm and 5'-terminus of this base sequence : 119269
gatcatggccccaatattattaaatgagcacgtgtgcatgtgcacacacacacacacacacacacacacacgatgggaagaaaatatatataaataagaatatgaactatctctggataatgtgactaagacatttattttactttattagactgttctatatttttggactcctcgattagtatgtattacttttatcatgaggaaaaaaatgtgtttaataaaaatacaatatttaaaaaaaagcaagtcagtggttacctggggc

SEQ ID NO: 2492 - DNA, 323 bp, Homo sapiens
  AC015980.2_190643
  Located on chromosome 2
  Distance between a terminus base of telomere on chromosomal short arm and 5'-terminus of this base sequence : 30803884
  Distance between 3'-terminus of neighbour sequence of sequence listing upward to telomere on chrosomal short arm and 5'-terminus of this base sequence : 66304
ggtttcatatgaagttatttcagttattgtactttctggccctaatccagcttttttttggccaaagtattgggaacactgcagtgtctacagggcttcagcatccacaagcgtgtgtgtgtgtgtgtgtgtgtgtgtgtgtgtgtgtttgtgtgtgtgtgaaaagagagagagagaaactctgtgcatttgtgtgtgtgcttgcttatgtgataactgtttttgttccatttctttagcagtgcaacagttttaaagagcacctgagaacgactttgcaaaccataccttaccacaaccttcctatcctgtttctattaagc

SEQ ID NO: 2493 - DNA, 192 bp, Homo sapiens
  D2S352
  Located on chromosome 2
  Distance between a terminus base of telomere on chromosomal short arm and 5'-terminus of this base sequence : 30803971
  Distance between 3'-terminus of neighbour sequence of sequence listing upward to telomere on chrosomal short arm and 5'-terminus of this base sequence : -236
ctacagggcttcagcatccacaagcgtgtgtgtgtgtgtgtgtgtgtgtgtgtgtgtgtgtttgtgtgtgtgtgaaaagagagagagagaaactctgtgcatttgtgtgtgtgcttgcttatgtgataactgtttttgttccatttctttagcagtgcaacagttttaaagagcacctgagaacgactttgc

SEQ ID NO: 2494 - DNA, 254 bp, Homo sapiens
  D2S2203
  Located on chromosome 2
  Distance between a terminus base of telomere on chromosomal short arm and 5'-terminus of this base sequence : 30971940
  Distance between 3'-terminus of neighbour sequence of sequence listing upward to telomere on chrosomal short arm and 5'-terminus of this base sequence : 167777
atatgctctctggtgactgtaggtgtctgggaataggaaactcagtagaccaggggtgggattagatgcagtctttggactgtcagcccaaaactaggtctttctttccctctcaaaaaacctacctgaattcaaatgaaatgagtttgaattcactctagtgtgtgtgtgtgtgtgtgtgtgtgtgtgtgtgtgtttgtgtacattagaaaacacaggaaattaaggtatgtcaggaacccttctaagcactt

SEQ ID NO: 2495 - DNA, 342 bp, Homo sapiens
  AC010743.7_16020
  Located on chromosome 2
  Distance between a terminus base of telomere on chromosomal short arm and 5'-terminus of this base sequence : 30971999
  Distance between 3'-terminus of neighbour sequence of sequence listing upward to telomere on chrosomal short arm and 5'-terminus of this base sequence : -195
gattagatgcagtctttggactgtcagcccaaaactaggtctttctttccctctcaaaaaacctacctgaattcaaatgaaatgagtttgaattcactctagtgtgtgtgtgtgtgtgtgtgtgtgtgtgtgtgtgtttgtgtacattagaaaacacaggaaattaaggtatgtcaggaacccttctaagcactttccctattttaacttaattaatgctcacaacaaccctatgaggtactatgatttttctgtttatagatgaagaagctgaggcacagaaaagttaagtttcttgcccaaatcacacagctaagaataaccaaatttcagtactggaat

SEQ ID NO: 2496 - DNA, 437 bp, Homo sapiens
  AL121654.1_28877
  Located on chromosome 2
  Distance between a terminus base of telomere on chromosomal short arm and 5'-terminus of this base sequence : 30999687
  Distance between 3'-terminus of neighbour sequence of sequence listing upward to telomere on chrosomal short arm and 5'-terminus of this base sequence : 27346
gcactgtgctaagtggtttaagaatatccaagaagagcatctcatgctgctagttttctgtgaaatacatttcagaaggtattactttgtctaattataatccatctctctaactagtatatgggctccagaatggcaaatgcctgatcttggagatcttattcccccagtgcatatcctgttgtctgaggcctcagaaggagcttgataaatgttgactatatggggagtgagcaagtgaatgatgagtaagtgagtgagtgagtgagtgagtgagtgaaagtcaccgtgacgatctctgtagctgacactcacttcttgtggggatcactcctggacacctttggctgcacccaacctgccagatcctcccagattcttccaggtgccacagtctcagctagacagagtgactactcagaaaagctagaatgctg

SEQ ID NO: 2497 - DNA, 459 bp, Homo sapiens
  AC010743.7_59283
  Located on chromosome 2
  Distance between a terminus base of telomere on chromosomal short arm and 5'-terminus of this base sequence : 31015067
  Distance between 3'-terminus of neighbour sequence of sequence listing upward to telomere on chrosomal short arm and 5'-terminus of this base sequence : 14943
catgcctttgttataaacagacagaggccccatttaactggtctagagaattttggaaccaaacatgaggttgtgatgaaaccatggaaagagtcccagtctaggaaaagagagactcaggtgaaagccaaggatttgctcctctctctgtcacttttggcaagcccctttcccatctataaaacttcaaggacccttccagctctaacatttatggatattatgacataatacctgtgtgtgtgtgtgtgtgtgtgtgtgtgtgtgtgtgtgtgtgtgtgtgtgcatgtgtggtgtgtttgcatcctcctttctggtggcctttttattcacaccatctgatcctcacccatttctgagcaagttgggtccatgctacaggatattcccacttgtccagcattggaatagctggaatgctaaggaaaagagtataataccagattatgaaagttctgc

SEQ ID NO: 2498 - DNA, 313 bp, Homo sapiens
  HUMUT710B
  Located on chromosome 2
  Distance between a terminus base of telomere on chromosomal short arm and 5'-terminus of this base sequence : 31039515
  Distance between 3'-terminus of neighbour sequence of sequence listing upward to telomere on chrosomal short arm and 5'-terminus of this base sequence : 23989
agacctaatgctgtattggcttgaggtcagaaccagcactgtcctagtggtggtggccataggggtgcttatgtcaccctgcacccagcttcggggtgggggggggagagagagagagagagagagagagagagagagacaaaggaaagaaagaaagaaaagaaagagagagagagagaagaaagaaagaaaagaaagaaagaaagaaagaaaaaagaaagaaagaaagaaaaaagaaagaaagaaagagaaagaaaaaagaaagaaagaaaaagaaagactccatttgtttgggagaaagtaaaggaagaaa

SEQ ID NO: 2499 - DNA, 340 bp, Homo sapiens
  AC010743.7_168218
  Located on chromosome 2
  Distance between a terminus base of telomere on chromosomal short arm and 5'-terminus of this base sequence : 31051612
  Distance between 3'-terminus of neighbour sequence of sequence listing upward to telomere on chrosomal short arm and 5'-terminus of this base sequence : 11784
gtatctgaacaaattaggtcagagataggctaggccaaatctacctaccctattagccatggaaggagtttgaattttattctaaacgtgttaagaattcattagaggggagtgtcatgatatgactatgtgttaaaagaccattcaggttgctgtatacagaaaaaaccatatgtggggtgtgtgtgtgtgtgtgtgtgtgtgtgtgtgtgtgtgtgtgtaaaaatagaaatacagagacctgttaagatgccaccctgataagaaatgatgatggtgtatgcagtgggtttaaaggtggtcgtcccaatgatatgtctacatcctaactcctggaact

SEQ ID NO: 2500 - DNA, 463 bp, Homo sapiens
  chr2.fa.O7frz.32230856
  Located on chromosome 2
  Distance between a terminus base of telomere on chromosomal short arm and 5'-terminus of this base sequence : 31142647
  Distance between 3'-terminus of neighbour sequence of sequence listing upward to telomere on chrosomal short arm and 5'-terminus of this base sequence : 90695
taaggagtagtcagtgatgcaggatttcattttgcttttccctggcatcaatttgcatttttcacctggctctctggaaacatgttgctttaaacattccttccattactcaaatggtagaaatttccaacatgtttcaggaccatgaaaaatatgtagggacagatggttcttcggtatcaatcagactgtgttcatgtaggcttattctgtttatgtgccctggtgatgaatagtcctggtaagatggcctctatcctgatcgtgtgtgtgtgtgtgtgtgtgtgtgtgtgtgtgtgtgtgtgtgtatgtgtgtgtgtgtgttaccgccaggccagtgaagaatttaaagcttacagacataaggtaatgtgcccaaggccacacagctacaaagaggcagcagagatggaatttaaatgtgggtcttctgcttcaaaataactcacttatttccaagtgg

SEQ ID NO: 2501 - DNA, 478 bp, Homo sapiens
  AC022481.4_155628
  Located on chromosome 2
  Distance between a terminus base of telomere on chromosomal short arm and 5'-terminus of this base sequence : 31442089
  Distance between 3'-terminus of neighbour sequence of sequence listing upward to telomere on chrosomal short arm and 5'-terminus of this base sequence : 298979
ttctacaatcctaccttgagctaaaaaaaatttgtaaagatcacataatctctgaagagtttcctggggaagaatttagctaaacaattccggatgaacggtcatctccccttttcttcaccaaaatttcccatgactgtgtgatgttatgttcctaaagttgcataagttttttccaaggtccagactcattaatgtctgtttaaaactatctaatctccatcatctatctttatctctatctatctatctatctatctatctatctatctatctatctatctatctatctatctatgttttcgtagagatggggtctttgttttccagactggtctcgaactcctggcctcaatcaatcctcccacctcagcctcctaaactgtgggtattacaggtgtaagccaccgcactcagcctaaaactattgactaaaacagaaaacagctcttcaccatcacatagagcatgttccttc

SEQ ID NO: 2502 - DNA, 426 bp, Homo sapiens
  AC010981.6_161507
  Located on chromosome 2
  Distance between a terminus base of telomere on chromosomal short arm and 5'-terminus of this base sequence : 31445055
  Distance between 3'-terminus of neighbour sequence of sequence listing upward to telomere on chrosomal short arm and 5'-terminus of this base sequence : 2488
agtgaaacatgatatcctgtagacactgagtccccaaacctacatttcagcataaattcttttagtactaacaattggtttaactatctttagtcaataatgtaaacatttagttaaaaattgcctgttattaaaaataaataaatgtgaaggttttttaaatggcacacacacacacacacagacacacacacacacacacacacacacacacatatcagggactagattaccgcaaggtatggtattttttctaacacaaaaataacaaagaaaaccagaaattagaaatttacctatagcaattatggaggtctgcttttttaaatataaatttataaactattataactgttaaaacatgcaccatggtttcatccaagttaattttctctgacaactgtaccaagtagagcttctaggaat

SEQ ID NO: 2503 - DNA, 426 bp, Homo sapiens; identical to SEQ ID NO: 2502
  AC022481.3_154554
  Located on chromosome 2
  Distance between a terminus base of telomere on chromosomal short arm and 5'-terminus of this base sequence : 31445055
  Distance between 3'-terminus of neighbour sequence of sequence listing upward to telomere on chrosomal short arm and 5'-terminus of this base sequence : -426

SEQ ID NO: 2504 - DNA, 217 bp, Homo sapiens
  Z66654
  Located on chromosome 2
  Distance between a terminus base of telomere on chromosomal short arm and 5'-terminus of this base sequence : 31445158
  Distance between 3'-terminus of neighbour sequence of sequence listing upward to telomere on chrosomal short arm and 5'-terminus of this base sequence : -323
aaacatttagttaaaaattgcctgttattaaaaataaataaatgtgaaggttttttaaatggcacacacacacacacacagacacacacacacacacacacacacacacacatatcagggactagattaccgcaaggtatggtattttttctaacacaaaaataacaaagaaaaccagaaattagaaatttacctatagcaattatggaggtctgct

SEQ ID NO: 2505 - DNA, 241 bp, Homo sapiens
  D2S2351
  Located on chromosome 2
  Distance between a terminus base of telomere on chromosomal short arm and 5'-terminus of this base sequence : 31449712
  Distance between 3'-terminus of neighbour sequence of sequence listing upward to telomere on chrosomal short arm and 5'-terminus of this base sequence : 4337
tgaactttgcagtgagaaatgttcatttgaacataatttacaattaataataaaaaaacaactgcattatagcatacctttcaaactcagacaaactggcttttaaaattcttttcattatttttatagtgattgccaaaattttgcattagaattaaatacatgtgcgcacgcacgcgcgcgcgcgcacacacacacacacacacacacacacacagagtacacacacatacacagtaaa

SEQ ID NO: 2506 - DNA, 374 bp, Homo sapiens
  AL121655.1_60964
  Located on chromosome 2
  Distance between a terminus base of telomere on chromosomal short arm and 5'-terminus of this base sequence : 31642601
  Distance between 3'-terminus of neighbour sequence of sequence listing upward to telomere on chrosomal short arm and 5'-terminus of this base sequence : 192648
tagctaggctttgtggcaggcacctgtagtcccagctacttaggaggctgaggcaggagaattgcttgaacccaggaggcggaggttgcagtgagccaagattgtgccactgcgttccagcctgggtgacagagcaagactccttctcaaaaataaataaataaataaataaataaataaataaataaaattttgagctgggcatgaaagctgaggcaggaggatcccttgagcccagcagtttgagaccccagtgagctataattctgacactgcacttcagcctggctgacagagggagaccgtgtatctaaaaagaataaaataacaatgatttttgagccaataactcttagccaatagatttcacataa

SEQ ID NO: 2507 - DNA, 395 bp, Homo sapiens
  AL121658.2_39457
  Located on chromosome 2
  Distance between a terminus base of telomere on chromosomal short arm and 5'-terminus of this base sequence : 31699780
  Distance between 3'-terminus of neighbour sequence of sequence listing upward to telomere on chrosomal short arm and 5'-terminus of this base sequence : 56805
cacctcaacattttggacatacctcatttccaacaaacatttgttacttctgatagagagtctgctgtcattctcatacttgttccttgtggaaatgtctatatataaagtctcagaactatatatttttaatatatatacatatttttatttatttaaaaatgtataattaagttagtagtagtagtagtagtagtagtagtagtagtagtagtagtttttttttttttagatggagcctccatctcccgggttcaagtgattctcctgcctcagcctcctgagtagctgggattacaggcacacaccaccatgcctggctaatttttgtattttgagtggagatggggtttcaccatgttggccaggctgatcttaaactcctgacctcagat

SEQ ID NO: 2508 - DNA, 388 bp, Homo sapiens
  AL121653.2_42229
  Located on chromosome 2
  Distance between a terminus base of telomere on chromosomal short arm and 5'-terminus of this base sequence : 31806355
  Distance between 3'-terminus of neighbour sequence of sequence listing upward to telomere on chrosomal short arm and 5'-terminus of this base sequence : 106180
gagtcaatcttcctcatcctttacttccagctgggtatcaagtccttccattactgcctctggaatatgatatatctgtctgtccctctctgatcccactatttttggcctggctcagctctcctcttttgttttgttttgttttgttttgttttgttttgttttgttttgtgacagagtcttgttctgtctcccaggctggagtgcagtggcatgatctctgctctctgcaacgtctgcctcctggattcaagtgattttcctgcctcagcctcctgagtagttgggattacaggtgcatgccaccatgcccagctaatttttgtatttttagtagagacgtgatttcgccatgttggccaggctggtctcaaactcctgacctcag

SEQ ID NO: 2509 - DNA, 424 bp, Homo sapiens
  chr2.fa.O7frz.33009252
  Located on chromosome 2
  Distance between a terminus base of telomere on chromosomal short arm and 5'-terminus of this base sequence : 31920977
  Distance between 3'-terminus of neighbour sequence of sequence listing upward to telomere on chrosomal short arm and 5'-terminus of this base sequence : 114234
gcaacgtgcaggtaactatgtatggtatacttgcaattgtgtaaaaataaatagaagaggctgggcgtggtggctcacgcctgtaatcccaacactttgggaggccgaggtgggtggatcacttgaggtcaggagttcgagaccagcctgaccaacatggagaaaccccatctctactaaaaatacaaaattagctgtgcatggtggttccacgcctgtaatcccagctactcaggaggctgaggcaggagaatcgcttgaacccgggacacggaggttacgataagccgagatggtgccattgcactccagcctgggcaacagagctgtacacacacacacacacacacacacacacacacacacacacacacagtagttgggctctctctttgcctctcagttcattctagaggaactcagc

SEQ ID NO: 2510 - DNA, 415 bp, Homo sapiens
  chr2.fa.O7frz.33179899
  Located on chromosome 2
  Distance between a terminus base of telomere on chromosomal short arm and 5'-terminus of this base sequence : 32091685
  Distance between 3'-terminus of neighbour sequence of sequence listing upward to telomere on chrosomal short arm and 5'-terminus of this base sequence : 170284
tatttgtgagtctaaatagaagcacaatttaagaaactaaacagagattcttccgtaagttttctctttaaatgttaatcaattttaaatctcattttccttcttaaagtggtgctgtgttttgttttgagagagtctcactctcacctaggctggagtgcagtggcacagtgtctcccgggttcaggcaattctcatgcctcagcctcctgagtagctgggattgcaggcgtgtttcaccacactggggcggggggtgggggggtgtttgtgtgtgtgtgtgtgtgtgtgtgtgtgtgtgtgtgtgtgtgtttagtagagatggggtttcaccatgttgtccaggctggtcttgaactcctggccccaagtgatcccccaccttggcctcccaaagtgttaggattacaggcat

SEQ ID NO: 2511 - DNA, 323 bp, Homo sapiens
  AL133246.2_21044
  Located on chromosome 2
  Distance between a terminus base of telomere on chromosomal short arm and 5'-terminus of this base sequence : 32182375
  Distance between 3'-terminus of neighbour sequence of sequence listing upward to telomere on chrosomal short arm and 5'-terminus of this base sequence : 90275
ggactaaatggatagatcacttgagctcaggagttcaagatcagcttgggcaacatggtgaaaccccgtctctacgaaatacaggaaacattaggtgggcataatggcgtgtgcctgtggtcccggctacctggaaggctgaagtgggagaattacctgagcctgggaagttgaggttgcaattagctgtaattgcaccactgtactccaagcctgggagacagagtaatactctgtttccagatagatggatggatggatggatggatggatggacggatggatagatattttcctatgttagctgaagaaagtgatctgaa

SEQ ID NO: 2512 - DNA, 274 bp, Homo sapiens
  AL133246.2_55081
  Located on chromosome 2
  Distance between a terminus base of telomere on chromosomal short arm and 5'-terminus of this base sequence : 32216609
  Distance between 3'-terminus of neighbour sequence of sequence listing upward to telomere on chrosomal short arm and 5'-terminus of this base sequence : 33911
tgcggtgaagatctgtaaatacagttgggttaagtaattttattttatctatttatttatttatttatttatttatttatttatttattgagacggagttttgctttttgcccaggctggagtgcaatggcgcgatctcggctcgctgcaacctccgcctcccgggttcaagtgattctcctgcctcagcctccagggtagctgggattacaggcatgcgccaccacgcccggctaattttgtatttttagtagagtcgaggtttcaccatgtt

SEQ ID NO: 2513 - DNA, 219 bp, Homo sapiens
  chr2.fa.O7frz.33580980
  Located on chromosome 2
  Distance between a terminus base of telomere on chromosomal short arm and 5'-terminus of this base sequence : 32339068
  Distance between 3'-terminus of neighbour sequence of sequence listing upward to telomere on chrosomal short arm and 5'-terminus of this base sequence : 122185
ccagaacagtagctgtaatcagagccaccactatgttaagtttatcataatccatgacattttccaggacccatttttgttctgctcagtttaaatgggtaggttaaaccacacacacacacacacacacacacacacacacacacacacacatgcacacacatatacacaagtttttgataatgacaccaacctctggtttactagatatgcagtgtt

SEQ ID NO: 2514 - DNA, 192 bp, Homo sapiens
  D2S2325
  Located on chromosome 2
  Distance between a terminus base of telomere on chromosomal short arm and 5'-terminus of this base sequence : 32519614
  Distance between 3'-terminus of neighbour sequence of sequence listing upward to telomere on chrosomal short arm and 5'-terminus of this base sequence : 180327
ttctattaaaaagtcttgtgaaatgtatcatatatagaaaagtttacaacatgcatgtatgtatatgcatgtttgcgtgcgcgcacgcacacacacacacacacacacacacatacattcatatatttaccattttaagaaatagactatgacctctgctttagaagctcatctctcccaacctctgacttt

SEQ ID NO: 2515 - DNA, 468 bp, Homo sapiens
  AC019180.9_163505
  Located on chromosome 2
  Distance between a terminus base of telomere on chromosomal short arm and 5'-terminus of this base sequence : 32582872
  Distance between 3'-terminus of neighbour sequence of sequence listing upward to telomere on chrosomal short arm and 5'-terminus of this base sequence : 63066
tgtaacagatgaggaaactgaggcctaggccattggaaccagctcagggtcacatggcacatggctcatttgaggcagagcctgtggcttgatgttgggcattcctgctacttgaagttacctgtttatcccaggccgggacctctgggctcatttacaagtggatggcccaaagaggggacttcagttaggggagtgtgtgtgtgtgtgtgtgtgtgtgtgtgtgtgtgtgtgttgggggttattcagggaccattcattacagagcttgactgtgggaaagagtagtcagatccaagtgattattgtagtgccctcgtcatttattagcagatctttctaagaagtgtcctacagaggagagtgctaaaacataaagggtgaaacccttgtcatcagaggtctttacgtagaacctaaatatccacccactcgagttagcaagagttaacattcactgaggactga

SEQ ID NO: 2516 - DNA, 405 bp, Homo sapiens
  chr2.fa.O7frz.33957951
  Located on chromosome 2
  Distance between a terminus base of telomere on chromosomal short arm and 5'-terminus of this base sequence : 32649422
  Distance between 3'-terminus of neighbour sequence of sequence listing upward to telomere on chrosomal short arm and 5'-terminus of this base sequence : 66082
aaactcactggagtcctagaatacacacagataattgacgtatctctaggggtatttgcattcaaggtaagtttcttttgattttagtaacatgtggcttttgattattatggaggacaatttaagcccaaagtattattttgccatttaggtttgtatcttaatttgggctgtgctgaaatcatcttggggggtgtgtgtgtatgtatgtgtgtgtgtgtttgggggggatgtgtgtgtatgatatatgtgggtaggtgagatatggagggaggcagggagggaacttttaataccgttcgttgtactgaattttaaattcagatctgtgtgtgtgtgtgtgtgtgtgtgtgtgtaaagaaatgcatttgtcatggctaactgtggtctttaatagcaaagtga

SEQ ID NO: 2517 - DNA, 402 bp, Homo sapiens
  AC019195.9_170341
  Located on chromosome 2
  Distance between a terminus base of telomere on chromosomal short arm and 5'-terminus of this base sequence : 32692453
  Distance between 3'-terminus of neighbour sequence of sequence listing upward to telomere on chrosomal short arm and 5'-terminus of this base sequence : 42626
atgccgtatacattgtctgtacgcatagtctgtatgctgtatgcattgtctgtatgcatagtttgtatgctgtatgcaccatgtgtgtagtctgtatgctgtttgcattgtctgcatgtgcttccctttagtctcttcatcagcagcctgttacctcctaattctgttttggtctgataggtaattccatatggatggggtcatggaccataaatccttgtctccgtttacgtgtgtgtgtgtgtgtgtgtgtgtgtgtgtgtgtgtgtgtgagtgttatgctgccatgtggcatcttcctaatggtttgcttattctttgccattccctatgtgcatattgcccttgagcactctccagggggaagagattttctgcatcaaatcatagctgacactttaa

SEQ ID NO: 2518 - DNA, 402 bp, Homo sapiens; identical to SEQ ID NO: 2517
  AC019180.9_98383
  Located on chromosome 2
  Distance between a terminus base of telomere on chromosomal short arm and 5'-terminus of this base sequence : 32692453
  Distance between 3'-terminus of neighbour sequence of sequence listing upward to telomere on chrosomal short arm and 5'-terminus of this base sequence : -402

SEQ ID NO: 2519 - DNA, 282 bp, Homo sapiens
  D2S2347
  Located on chromosome 2
  Distance between a terminus base of telomere on chromosomal short arm and 5'-terminus of this base sequence : 32826001
  Distance between 3'-terminus of neighbour sequence of sequence listing upward to telomere on chrosomal short arm and 5'-terminus of this base sequence : 133146
ctgcgtcacttcacatagaataatagtctccagtctcatctatgtggcaaatgccattaattccatcctttttatggctgagtagtattccattttgtgtgtgtgtgtgtgtgtgtgtgtgtgtgtgtgtgtgtgtgtgtgtgtgtgtgtatcacagtttctttatccactcgttgattgatggacatttggattggttccacaattttgcagttgtgacttgtgctgctataaacatgcgtgtgcaagttggaaaaacccttctagacatgggcttaggca

SEQ ID NO: 2520 - DNA, 369 bp, Homo sapiens
  AC019195.9_122104
  Located on chromosome 2
  Distance between a terminus base of telomere on chromosomal short arm and 5'-terminus of this base sequence : 32826048
  Distance between 3'-terminus of neighbour sequence of sequence listing upward to telomere on chrosomal short arm and 5'-terminus of this base sequence : -235
caaatgccattaattccatcctttttatggctgagtagtattccattttgtgtgtgtgtgtgtgtgtgtgtgtgtgtgtgtgtgtgtgtgtgtgtgtgtgtgtatcacagtttctttatccactcgttgattgatggacatttggattggttccacaattttgcagttgtgacttgtgctgctataaacatgcgtgtgcaagttggaaaaacccttctagacatgggcttaggcaagaattttgtgactaagaacccgaaagcaaatgcaataaaaacaaagataaatagctgcaacttaattaaactaaagaacttttgcatggcaaaaggaacagtcagcagagtaaatagacaactcacagagtgg

SEQ ID NO: 2521 - DNA, 253 bp, Homo sapiens
  AC019195.9_71920
  Located on chromosome 2
  Distance between a terminus base of telomere on chromosomal short arm and 5'-terminus of this base sequence : 32876206
  Distance between 3'-terminus of neighbour sequence of sequence listing upward to telomere on chrosomal short arm and 5'-terminus of this base sequence : 49789
cattggagaacaagattatctaattgaagataggtctcttttggcagatatgttcagtaacatcctaagctctaaagcttagcactggaacacacacacacacacacacacacacacacacacacacagagcattctaaagggccaaatagatatacttagcttttgtttaaaaaaacttaaaagaataagcttaatggagaaattaacaggaaaatatgagctcattgaagtggaaagtatcctaattgcat

SEQ ID NO: 2522 - DNA, 327 bp, Homo sapiens
  chr2.fa.O7frz.34174464
  Located on chromosome 2
  Distance between a terminus base of telomere on chromosomal short arm and 5'-terminus of this base sequence : 32956106
  Distance between 3'-terminus of neighbour sequence of sequence listing upward to telomere on chrosomal short arm and 5'-terminus of this base sequence : 79647
taaatttcatacttgcctatcaaggttccatgcgtattctcattttcacatcctgataaataatccaggagcagagccggaactctaccttaaataactacaattcataatagtagtgtaaacgcagccctgattcatgaatttattagtggaatgtgactgatcaaattggcaagtgattgttcttcaatataaataatactaaatgaattcttatacctatatgtgcatatatatatatatatatatatatataaactttagtgatagaagcacagcacctcatttaaaactaattttactttgtcaaccagatgagtagaatca

SEQ ID NO: 2523 - DNA, 382 bp, Homo sapiens
  AC019127.7_20741
  Located on chromosome 2
  Distance between a terminus base of telomere on chromosomal short arm and 5'-terminus of this base sequence : 33039693
  Distance between 3'-terminus of neighbour sequence of sequence listing upward to telomere on chrosomal short arm and 5'-terminus of this base sequence : 83260
gcagacaacgtacactgagtgctgctgtctgtatggagaggcctggggcatgcagtgtgccctctgccccctgaaggattcaggtgagcccatatccaattccttctgcaggaggcctttggggacaagttcatctcacctcctttgtagcctgacatttctcttctgtatctttgccttcactcctgatatcttactttcatcccgtgtgtgtgtgtgtgtgtgtgtgtagggcagaactgcataaacatttggctcctggtttacctctactcccgaccctgtcgttaatttttgaaactctcattccattaccccaatgaatgataaatgacccaaaaaaacataacttagcaatcagtggcataggcttagaatttat

SEQ ID NO: 2524 - DNA, 473 bp, Homo sapiens
  AC020594.3_118285
  Located on chromosome 2
  Distance between a terminus base of telomere on chromosomal short arm and 5'-terminus of this base sequence : 33142174
  Distance between 3'-terminus of neighbour sequence of sequence listing upward to telomere on chrosomal short arm and 5'-terminus of this base sequence : 102099
ctgtcaaatattgaccagaaagttaaagaagcaagacttgggaaaaagtgactggtttttctaatggatggtgaggctttttctttctttctttctttctttctttctttctttctttctttctttctttctttctttctttctctcttagtgtacatgatttgtttttttctctttgtgtagatgattgaagtacttaagtgtctttgtaagtccagtatctcttttcttattttaaaaagatctcattaaaaaatgaactaataaatatttattatagaaacagtagataaatgctgatgagcataaaggaggaggaaatatatgtgacccccaactcccagaaataatcactattaaaaatttgatatataatgtttcagatttttaatatattcacatattttcttagaaaaatgggattgtactgaataaacttttgtaacttttatatctcacttaatcgatgctga

SEQ ID NO: 2525 - DNA, 301 bp, Homo sapiens
  AC017050.7_81309
  Located on chromosome 2
  Distance between a terminus base of telomere on chromosomal short arm and 5'-terminus of this base sequence : 33239107
  Distance between 3'-terminus of neighbour sequence of sequence listing upward to telomere on chrosomal short arm and 5'-terminus of this base sequence : 96460
gaagttggtcttgaaacaactataacaagaccaactttttttctcatcaacgttgtaatgaaaggaaattgaatgaaattaccttgtggaggaccagtttgaacacttcatttgacttaaagttgctatttccaagaatctacagaccatgttaagtgaggacttacttactgtatacacacacacacacacacacacacacgcacacccccctattattactttgctgaagactaatttaagtctataacaaaactgccttataattatgattatatcatttactgacaaccagtgactc

SEQ ID NO: 2526 - DNA, 463 bp, Homo sapiens
  AC020594.2_25328
  Located on chromosome 2
  Distance between a terminus base of telomere on chromosomal short arm and 5'-terminus of this base sequence : 33239201
  Distance between 3'-terminus of neighbour sequence of sequence listing upward to telomere on chrosomal short arm and 5'-terminus of this base sequence : -207
cagtttgaacacttcatttgacttaaagttgctatttccaagaatctacagaccatgttaagtgaggacttacttactgtatacacacacacacacacacacacacacgcacacccccctattattactttgctgaagactaatttaagtctataacaaaactgccttataattatgattatatcatttactgacaaccagtgactctgatgtttccaatctatcaatttcccatcatcagtaaaataaaataggcaaatccacgatggggcaaaaagaacaatcacaattgactcctcctcaccttcattttgtaggtctgatgatcactgtcaccctgaaaattgaaaggaaaaacaaaagtaaactcttcttaacaatgaaaatgaggtatgaaggcaggatttattaaatgcttcaattgcatcttcattggagcatctacaaattgactgatgctttc

SEQ ID NO: 2527 - DNA, 310 bp, Homo sapiens
  chr2.fa.O7frz.34617786
  Located on chromosome 2
  Distance between a terminus base of telomere on chromosomal short arm and 5'-terminus of this base sequence : 33353087
  Distance between 3'-terminus of neighbour sequence of sequence listing upward to telomere on chrosomal short arm and 5'-terminus of this base sequence : 113423
aattctgcattacattgatcagaattgatcagaaactcagaaaagagttttccgcctcttattctatattgccaagttagtacctttccaagttagttatctagtccctagttctatctatctgtctatctatctatctatctatctatctatctatctatctatcatctctatctatatctatctatatctatctccatctatcctatttatcatctatctattcatcctatctatcatctatctatctatcatctattcatcctatctatcatctatctatctatctatggctatacaccatgaaact

SEQ ID NO: 2528 - DNA, 385 bp, Homo sapiens
  chr2.fa.O7frz.34754871
  Located on chromosome 2
  Distance between a terminus base of telomere on chromosomal short arm and 5'-terminus of this base sequence : 33489626
  Distance between 3'-terminus of neighbour sequence of sequence listing upward to telomere on chrosomal short arm and 5'-terminus of this base sequence : 136229
tgtctttgcaataaacgagtacttttattgttctagccattaaaattatgcacatatttgtaaaaagtggaatgtaaagaaatgtagaaagagaaaaatatagccctaatctttgatccccattactgctaacatttgtggtatttcttcaaatctttaaaaataatgaatgtatgtataatacatgcatttttcacacatttgggatgtatttttccactttccactaattttcactaatttggtaatgtatttttaaaaattaatattattccaagagtctttttcccatattattttatttatttatttatttattttttgagacagagtttcgctcttgtcacccaggctggagtgcagtggcttgatctcagctcactgc

SEQ ID NO: 2529 - DNA, 429 bp, Homo sapiens
  chr2.fa.O7frz.34853465
  Located on chromosome 2
  Distance between a terminus base of telomere on chromosomal short arm and 5'-terminus of this base sequence : 33552781
  Distance between 3'-terminus of neighbour sequence of sequence listing upward to telomere on chrosomal short arm and 5'-terminus of this base sequence : 62770
atcaatattgcttctaccgatacatcacactcttggtaagggatttcaccagtaaattttctttctctggggattcagtcaacaatatttatacaacactcacagcatgtaaagcatgcatggtagtagacaggacaaagaagcaagagaatcacaacgaatggttcctgctctttagggccatctttaatagttgagagattgataagtatattagacagggttctccagagaaagagaggaagcaagtgagagagagagagagagagagagagagagagagagagagagagagagagagagagatgagagaggcagatgagagaaagagacgagaaagagacagggaaagagagagagagagagagagaaactgatggatttattatgaggaattgtctcacgtgactatgcaggctaagtaccaag

SEQ ID NO: 2530 - DNA, 389 bp, Homo sapiens
  chr2.fa.O7frz.34963269
  Located on chromosome 2
  Distance between a terminus base of telomere on chromosomal short arm and 5'-terminus of this base sequence : 33680450
  Distance between 3'-terminus of neighbour sequence of sequence listing upward to telomere on chrosomal short arm and 5'-terminus of this base sequence : 127240
cctctgttagtgaactcaacacttgcagtattagcaattaacgagggattgatggagcccagagagggtttaactgctttccttctggttacggtcatcagtgggcatggggacatactcaggtggtgtgtaggagctgtgattccatataaaagcaaccccttcatctcgacagtatctctccctttgttcctgggcctaggatgtggggttatttctcttctgatattcagaagagaaatgccaatatattcccatggtgtgtgtgtgtgtgtgtgtgtgtgtgtatgtaatgaatgaactttactgccagaggggagcttaccgtatttcattgaatactataatttgagcgctagaagacaccatacagatcctttaatccaacc

SEQ ID NO: 2531 - DNA, 465 bp, Homo sapiens
  chr2.fa.O7frz.35076548
  Located on chromosome 2
  Distance between a terminus base of telomere on chromosomal short arm and 5'-terminus of this base sequence : 33793726
  Distance between 3'-terminus of neighbour sequence of sequence listing upward to telomere on chrosomal short arm and 5'-terminus of this base sequence : 112887
gtatacctgaggaatttcagataacgaggggcttttgatgataaattctttgtttttctttgtgtaagaatgtccttattttgcttttattctaaaagttcagttccccccttcccaagttgcatagggatgagacagaggcaggcccggatgaatgctgcacacacagtggatctatgtcacagctgagaatggtgagcccaagaaactctcaatcatataaaggcatctctagcaagcctgctcatcctcctctctggggacacacacacacacacacacacacacacacacacacacacacacacaccccagagaagggaaggagaggtctttattttcctgaaatattccagggagggaaacattatttatcttcactttcgtgaaatacctgtcaattcctggatgtggagaaacatgagagattgatggagaattgtcacctaagacatatgttcaatt

SEQ ID NO: 2532 - DNA, 428 bp, Homo sapiens
  AC008170.2_164203
  Located on chromosome 2
  Distance between a terminus base of telomere on chromosomal short arm and 5'-terminus of this base sequence : 33834829
  Distance between 3'-terminus of neighbour sequence of sequence listing upward to telomere on chrosomal short arm and 5'-terminus of this base sequence : 40638
cctgactgtacatttgtcctaggtatcatctgccatgagaccttactctgtgatcaagggatgtgtattgtcaggtaaaacaaccagatccatcaccaagttcccattattgtgtcctctactcttctatgaattcacacacacacacacacacacacacacacacacacacacacatcttttctgtgttgtcagttttaaggggcttgggctttctccttccctcacaattcacatttgatgagctcctgccacttcacatctctgactcaggcaaaaaccttctgggtcactggcccaacttggttacatcatggtgtccatggtgtttcatcttgtgtgatacacgttgagattatctcaagtaagagagcaggcctgacacagttgccttacctatggtggttagctatgagtcttactttcga

SEQ ID NO: 2533 - DNA, 289 bp, Homo sapiens
  AC008170.2_117497
  Located on chromosome 2
  Distance between a terminus base of telomere on chromosomal short arm and 5'-terminus of this base sequence : 33881581
  Distance between 3'-terminus of neighbour sequence of sequence listing upward to telomere on chrosomal short arm and 5'-terminus of this base sequence : 46324
acataatgttgaagtgttcaattcaacaaaaagacttaatatatatatatataatagttatatatataatagttttacatatatacacataaatacacacacacacacacacacacacacacacacacacatatatgtccaacagaggcacacccagattcataaaagaagttcttacagacctgcaaagagacttagactcccacacaagaatactaggggatgtcaacaccacactgacaatattagatcattgagacagaaagttaacaaagatattcaggacttg

SEQ ID NO: 2534 - DNA, 327 bp, Homo sapiens
  AC008170.2_108651
  Located on chromosome 2
  Distance between a terminus base of telomere on chromosomal short arm and 5'-terminus of this base sequence : 33890269
  Distance between 3'-terminus of neighbour sequence of sequence listing upward to telomere on chrosomal short arm and 5'-terminus of this base sequence : 8399
atggccactctattaggctcctcttgggcaacactaaagtcctctccactgcacctcttactccagccgcagctgcagtgatctgtgctaggtgggcttcccccagcttcatgcaggagcaccctggcagcatctcaggactgcccagtgcatgtctctggctggctgacctgcagcttcttgttcacaggtgtgtgagacatccactggcacctacttggcacccacacatgtggaatcctgaagtgtatatgtgtgtgtgtgtgtgtgtgtgtgtgtgtgtgtgtgttggggatggtgacccttagaccaaagaataactgtcaa

SEQ ID NO: 2535 - DNA, 143 bp, Homo sapiens
  D2S367
  Located on chromosome 2
  Distance between a terminus base of telomere on chromosomal short arm and 5'-terminus of this base sequence : 33890443
  Distance between 3'-terminus of neighbour sequence of sequence listing upward to telomere on chrosomal short arm and 5'-terminus of this base sequence : -153
agcttcttgttcacaggtgtgtgagacatccactggcacctacttggcacccacacatgtggaatcctgaagtgtatatgtgtgtgtgtgtgtgtgtgtgtgtgtgtgtgtgtgttggggatggtgacccttagaccaaagaa

SEQ ID NO: 2536 - DNA, 325 bp, Homo sapiens
  AC008170.2_46960
  Located on chromosome 2
  Distance between a terminus base of telomere on chromosomal short arm and 5'-terminus of this base sequence : 33952007
  Distance between 3'-terminus of neighbour sequence of sequence listing upward to telomere on chrosomal short arm and 5'-terminus of this base sequence : 61421
gaggtcaggagttcgagaccagcctggccaacatggcgaaaccctgtctctactaaaaatacaaaaattagccaggcatggtggtgcatgcctgtaatcccagctactgaggaggccgagacatgaaaattgcttgaacctaggaggcagaggttgcagtgagccaagatcatgccacagcactccagcctgggcaacagagcaatactccatctctaaataaataaataaataaataaatagaataactctgctcagccctgtcatagggagttcttgtgaggagatatttcttttgtggcttaaattgctcctgtaatgttat

SEQ ID NO: 2537 - DNA, 173 bp, Homo sapiens
  AC008170.2_46471
  Located on chromosome 2
  Distance between a terminus base of telomere on chromosomal short arm and 5'-terminus of this base sequence : 33952620
  Distance between 3'-terminus of neighbour sequence of sequence listing upward to telomere on chrosomal short arm and 5'-terminus of this base sequence : 288
gtacagatggaacactgcttacctttccagtgcttagcttagtgcctggcacatggaagtcactcccccacactggccccctctgtgtgtgtgtgtgtgtgtgtgtgtgtgtgtgtgttgaatgaatgaatgaaaaggaggatcagtcagaagtgcttctggaaacagactac

SEQ ID NO: 2538 - DNA, 465 bp, Homo sapiens
  chr2.fa.O7frz.35276482
  Located on chromosome 2
  Distance between a terminus base of telomere on chromosomal short arm and 5'-terminus of this base sequence : 34045166
  Distance between 3'-terminus of neighbour sequence of sequence listing upward to telomere on chrosomal short arm and 5'-terminus of this base sequence : 92373
catttcaagatgaaatcttcactcatatggctggcactgcagtgctccttagcttctctctccacctggcattttatcttccaggccctcttcatgcgtctttggctcttccaggctagcagtctcagggtagtcagacttcttacattaacagttgatttcctccagagcaagggttccatgagcaaatgtttcacgagatagaaagtggaagctgacctgggcctggcatcacaccgcttgtgttgttttctgttggtcagagcagttacagaacctacccattcaagaggaggtggtatagaggcctcctcacaatgggtgaagtgacagagcatgtgcagtcacctctagcctgataatcacacacacacacacacacacacacacacacacacacacacacagacagcaaatatataatatatactgcctgtaaaaatacatgactaatttcaggaccta

SEQ ID NO: 2539 - DNA, 412 bp, Homo sapiens
  chr2.fa.O7frz.35368306
  Located on chromosome 2
  Distance between a terminus base of telomere on chromosomal short arm and 5'-terminus of this base sequence : 34136928
  Distance between 3'-terminus of neighbour sequence of sequence listing upward to telomere on chrosomal short arm and 5'-terminus of this base sequence : 91297
agtactgtgctaggtactgtgaatacaaaataaattggtcacaagaaatccttagtctccatggggaaagtcactcttcccatactatacaactcagaaaatgcctctggatcctgttttttgctttctctttcaagcacacactttctctctttgtgtatgtgtgtgtgtttgtgtgtgtgtgtgtgtgtgtgtgtgtgtgtgtatatatatttatatatatatgtccctttctattttatataaatatttatttaaatttctgtctctttccttccaggagtcaggaagggctttgtatttaaaatgaactttcaattgagatgcaatgaatggatattgtcagatagacagggaaggaagggcaaagaaggtttaggtagcccctgtaaatggacaaagttgtcaatag

SEQ ID NO: 2540 - DNA, 360 bp, Homo sapiens
  chr2.fa.O7frz.35599247
  Located on chromosome 2
  Distance between a terminus base of telomere on chromosomal short arm and 5'-terminus of this base sequence : 34364804
  Distance between 3'-terminus of neighbour sequence of sequence listing upward to telomere on chrosomal short arm and 5'-terminus of this base sequence : 227464
tgattccatcttataatggtctagaaaaaacaaacaaatatacacctacagaaagcatattagtggataactgggagcaggaagtggggttggcagaagggagggattcaaaagggcacaagacaactttggcgagtagtggatgtggatatggttattattttaactatcatgatattttcagaggtttatatatatatatatatataggtcaaaacttatcaaattgtacctttaaatacatgctgaccattaattttatgtcagtcatccacaaataaatctgtagaaacataacatctgaatatcatcaacaaatctctcagttccttttctgttgcttataatggatacttgaaa

SEQ ID NO: 2541 - DNA, 400 bp, Homo sapiens
  chr2.fa.O7frz.36045634
  Located on chromosome 2
  Distance between a terminus base of telomere on chromosomal short arm and 5'-terminus of this base sequence : 34501309
  Distance between 3'-terminus of neighbour sequence of sequence listing upward to telomere on chrosomal short arm and 5'-terminus of this base sequence : 136145
ttattacctgcactgtcttcagcgtggcacatcagttgctgagctgcagactgtgctcatccaggcaaagtgggaaggacatgattgattagccaataaatgagattcatgcaaatggcctcttggaaatatctcgaggcaaaataaataattatttattttatatgctgtgtgaatttgtctatctaaataatgcttggagggctccatttcacttattttatctacacacacaccacacacacatacacacacacacacacaaacacagcacgagactaagccaaaacaaagtagacaattatgtttctgatggccttctttctggtgcccatattcacttttaatgtccccttgctggttacttttcatggggttcttttagcttcctgtcgattac

SEQ ID NO: 2542 - DNA, 317 bp, Homo sapiens
  chr2.fa.O7frz.35940030
  Located on chromosome 2
  Distance between a terminus base of telomere on chromosomal short arm and 5'-terminus of this base sequence : 34607080
  Distance between 3'-terminus of neighbour sequence of sequence listing upward to telomere on chrosomal short arm and 5'-terminus of this base sequence : 105371
gtgaaattgattcataaaagtcagccttcggcgactctaccaatgtgattgggtgtgtccggcatgttttatttaactctttttgtaagaagatcatgttaaattaaacacgtttgattgggatcctgagcctaggtatttctttccttccttccttccttccttccttccttccttccttccttccttcccccatcccactttatttctctctcttttcctttttaacttttttgtatccctacattgcttgtttatatactgtacacttaaaccatcattctatctggtagagatagcaactagatcaagtttga

SEQ ID NO: 2543 - DNA, 362 bp, Homo sapiens
  AC019064.4_14553
  Located on chromosome 2
  Distance between a terminus base of telomere on chromosomal short arm and 5'-terminus of this base sequence : 34713576
  Distance between 3'-terminus of neighbour sequence of sequence listing upward to telomere on chrosomal short arm and 5'-terminus of this base sequence : 106179
ctatctggatatgttagatttggaaatttcaaaataaccacataatgacatatagaaatgtaggtatatttaactacacacacacacagacacacacacacacacacacacaaacacattgtcttcgagataattgggatcatacaaagtagttcagcatgccttgaattagtcatttaactctatattatatttccatgcattttaaaacattctagaaaaatttcagctttgcagcaaggcttataatttgaagtcataatgatttcatttcttgaatttttaattttaatactataatgtctttgtatttttgtcaaatctttattaactttttgacaggtatcttcagactgaattac

SEQ ID NO: 2544 - DNA, 444 bp, Homo sapiens
  AC013442.8_24447
  Located on chromosome 2
  Distance between a terminus base of telomere on chromosomal short arm and 5'-terminus of this base sequence : 34842116
  Distance between 3'-terminus of neighbour sequence of sequence listing upward to telomere on chrosomal short arm and 5'-terminus of this base sequence : 128178
tagtttgacgtaattcaacttctctatattttttgctatttttcttgtgttttttaatttatgttttgcatagttcattgttagtgtataaaaactcaactagcttttgtatgttccttttgtatctgaaactttactgattgttgcgttagtcctaatgttttgcgtgcatgtatgtgtgtgtgtgtgtgtgtgtgtagtctttagggttttctccactaagattttaccatctgaaaacagacataattttacttagtgtttttttctgattttaatgttttttatttcttttccttgcttacctcttttggcgaagatttcagaagtggcaagaatgggcatctttgccttattctgaatcttagaggaaaagcttccaggtttttaccattaaatatgttagcaggaagcttttcatatatgaccttacttcggtttaag

SEQ ID NO: 2545 - DNA, 374 bp, Homo sapiens
  AC013442.8_176836
  Located on chromosome 2
  Distance between a terminus base of telomere on chromosomal short arm and 5'-terminus of this base sequence : 34935806
  Distance between 3'-terminus of neighbour sequence of sequence listing upward to telomere on chrosomal short arm and 5'-terminus of this base sequence : 93246
ggaaatgtcaaacataaagttaagaacatttttcacaattgagtaagattttaaggtgaccaaccgttaaggtagagttaatcatggataatatttttataataggacaaaatctaataatagaaatgaaggagagaggagagtaatcaatagtgatatttccttaaaaaagtacttaatttaatgaatttttctaatgttagatatataaaggctaagtatgatggctaaatatgatgaatgaaaacacacacacgtgcacacacacacacacacacacaaacacaaacaccgttttctcttttcagattctttcatctatttcctatgcatctcattggttttcaacatcaagatgacttctagagctccag

SEQ ID NO: 2546 - DNA, 132 bp, Homo sapiens
  chr2.fa.O7frz.36257466
  Located on chromosome 2
  Distance between a terminus base of telomere on chromosomal short arm and 5'-terminus of this base sequence : 34936014
  Distance between 3'-terminus of neighbour sequence of sequence listing upward to telomere on chrosomal short arm and 5'-terminus of this base sequence : -166
taaaggctaagtatgatggctaaatatgatgaatgaaaacacacacacgtgcacacacacacacacacacacaaacacaaacaccgttttctcttttcagattctttcatctatttcctatgcatctcattg

SEQ ID NO: 2547 - DNA, 285 bp, Homo sapiens
  D2S2374
  Located on chromosome 2
  Distance between a terminus base of telomere on chromosomal short arm and 5'-terminus of this base sequence : 35094382
  Distance between 3'-terminus of neighbour sequence of sequence listing upward to telomere on chrosomal short arm and 5'-terminus of this base sequence : 158236
agaatggcacccctaacccctgtgttgtttaagggtcaactgtgtgtgtgtgtgtgtgtgtgtgtgtgtgtgtgtgtgtgtgtgtatagatttcaaatagaaaccttaacactctgttatttaaaaaaaaacaaatatttttaaggctttcatatattattaaatacatatatattttcctacccactaaatagaacatgtactttaaaatatttcagaatatttagacaaactaacaatttctatgtcatggagaaaatacaaaccttaacaattatcatagga

SEQ ID NO: 2548 - DNA, 334 bp, Homo sapiens
  AC013407.5_126248
  Located on chromosome 2
  Distance between a terminus base of telomere on chromosomal short arm and 5'-terminus of this base sequence : 35378342
  Distance between 3'-terminus of neighbour sequence of sequence listing upward to telomere on chrosomal short arm and 5'-terminus of this base sequence : 283675
tagtgatacaactttctcaaggaggactttgctaacatacacatatctttaatcatattccttaagggagcaaaggaaccaacttcctgattcaataggagggttaagatgctactttataagccaagttgtgcagctcttgaatcaactgtgtgacagatgaaagtgtgtgtgtgtgtgtgtgtgtgtgtgtgtgtgtgtagctgtatgactgtaggatgttcttgggtcaccttgctcctactactgttgtgatggctactcacacaatggtttaattcagtctggctcaccaagaatagatctctcacttagcaattgttttcaataagaa

SEQ ID NO: 2549 - DNA, 138 bp, Homo sapiens
  chr2.fa.O7frz.36844739
  Located on chromosome 2
  Distance between a terminus base of telomere on chromosomal short arm and 5'-terminus of this base sequence : 35463824
  Distance between 3'-terminus of neighbour sequence of sequence listing upward to telomere on chrosomal short arm and 5'-terminus of this base sequence : 85148
agctgttttgaaattcataatgattttctccatccatggtcatgttatcttcaaataatgcaatctgtgtgtgtgtgtgtgtgtgtgtgtatgtgtgtgtgttttactgtattagtccatttgtatcactaatacctg

SEQ ID NO: 2550 - DNA, 119 bp, Homo sapiens
  D2S1325
  Located on chromosome 2
  Distance between a terminus base of telomere on chromosomal short arm and 5'-terminus of this base sequence : 35545932
  Distance between 3'-terminus of neighbour sequence of sequence listing upward to telomere on chrosomal short arm and 5'-terminus of this base sequence : 81970
ttgctgcagacctgtatgaatacagatttgctgccagtaacagataagatagatagatagatagatagatagatagatagatagatagatagatgcatacatacacacatacatgcata

SEQ ID NO: 2551 - DNA, 190 bp, Homo sapiens
  G08189
  Located on chromosome 2
  Distance between a terminus base of telomere on chromosomal short arm and 5'-terminus of this base sequence : 35795912
  Distance between 3'-terminus of neighbour sequence of sequence listing upward to telomere on chrosomal short arm and 5'-terminus of this base sequence : 249861
aatggatggacaaatggatggatgaatggatggatggatggatggatggatggatggatggatggatatggatagagataactagctagctagataggtaggtagatagatagatagatagatagatagatagatagatagatagatagataatttcttataagatattggctcatctaattatgaaggg

SEQ ID NO: 2552 - DNA, 394 bp, Homo sapiens
  AC009414.3_173680
  Located on chromosome 2
  Distance between a terminus base of telomere on chromosomal short arm and 5'-terminus of this base sequence : 36033672
  Distance between 3'-terminus of neighbour sequence of sequence listing upward to telomere on chrosomal short arm and 5'-terminus of this base sequence : 237570
ccagatcagaacattatctgaggccaacagctctgcagcagctcttaacctcaagaaaagggctcggcatttctggttccccaataaagccacagcacaccctgggactgttcaaattatggatacacacacacacacacacacacacacacacacacacactcaaaggagattattactaagcttgggctacagcttaagaggcataagtggcattctcttattcctctgacttgaatccctacacctgttacccaaacttcactcactgttctcctccacaaaaacacattgtatctttgacattactatcagttttgatatcagaagaatatgtgcccaggcagcagcatgacatatgttgaaagagctagaacacttggaactctaacct

SEQ ID NO: 2553 - DNA, 431 bp, Homo sapiens
  AC009414.3_107725
  Located on chromosome 2
  Distance between a terminus base of telomere on chromosomal short arm and 5'-terminus of this base sequence : 36099567
  Distance between 3'-terminus of neighbour sequence of sequence listing upward to telomere on chrosomal short arm and 5'-terminus of this base sequence : 65501
ggtacagcagttaaacatgtaaacaataattatatatatcacatatgtaatgtgatactaatgaaatactgattaattatggtaagaaaataataaatataatcagaaatatgattggtgctttatcaaattacatattgtcacagtaatactgtactccatcttccaatagcaaaaggaagaaaaatataagtctagatacacacacacacacacacacacctgcatgtagaagagctatacatggtaagttcaggaaaggaaattttacaatagcacggttagaactaactacttcccaatgctgttcaactccctcttctagtccatgttcattcaaaaacaaaaaaaattgactcacatattggtggaggaactggctctgaaaattccaaattctgccccttcacatggattcttgaagcaattag

SEQ ID NO: 2554 - DNA, 217 bp, Homo sapiens
  AC007363.3_157126
  Located on chromosome 2
  Distance between a terminus base of telomere on chromosomal short arm and 5'-terminus of this base sequence : 36460126
  Distance between 3'-terminus of neighbour sequence of sequence listing upward to telomere on chrosomal short arm and 5'-terminus of this base sequence : 360128
tttgctaacagagtagatcctaagtgtccttatcaccacacacacacacacacacacacacacacacacacacacacaaatggtaactgtgtggtgatagatgtgtcagttaattgaattctggtaatcatcacacaacgtacacctatatcagataatcacattgtacacttaaatatatataatccgtattgtcaactatacctcaatgaagatg

SEQ ID NO: 2555 - DNA, 300 bp, Homo sapiens
  AC007363.3_154803
  Located on chromosome 2
  Distance between a terminus base of telomere on chromosomal short arm and 5'-terminus of this base sequence : 36462380
  Distance between 3'-terminus of neighbour sequence of sequence listing upward to telomere on chrosomal short arm and 5'-terminus of this base sequence : 2037
tacattaaaccagaaacgttaaatgggactttttatgttgtctcatattctgtgaccctcaaagacaaaagttcacacatacaaggagaggtgtaaagcatattttgggacttgttataatgtaaacacacacacacacacacacactcaccccccaaaatgcaaaacagaatcctctgagggaaacataaattgttttattttattctcagtactcttctgtgttttctaaatatttgctaataaaccaacttaatttttatggtcagaaaaaaaactaaatagcaagcctaacagagt

SEQ ID NO: 2556 - DNA, 228 bp, Homo sapiens
  AC007363.3_138263
  Located on chromosome 2
  Distance between a terminus base of telomere on chromosomal short arm and 5'-terminus of this base sequence : 36478857
  Distance between 3'-terminus of neighbour sequence of sequence listing upward to telomere on chrosomal short arm and 5'-terminus of this base sequence : 16177
ccacttgttatgagtaatacatgagaatgttgatcttcgcccttactagtattgaatttttaaaaaaatctgtgtcaaatcaatgagctgaaaataaatgctttaatatcatcttaatttatacttcctgagtgtccccataggttaaatgattttttccacatttgttgcccacttaaagtgtgtgagtgtgtgtgtgtgtgtgtgtgtattgttcatatcactggc

SEQ ID NO: 2557 - DNA, 288 bp, Homo sapiens
  AC007363.3_134177
  Located on chromosome 2
  Distance between a terminus base of telomere on chromosomal short arm and 5'-terminus of this base sequence : 36483006
  Distance between 3'-terminus of neighbour sequence of sequence listing upward to telomere on chrosomal short arm and 5'-terminus of this base sequence : 3921
gagctctgattctatgtatcaaagaatattagaaaccaagctcttaatactgtgtgtgctcattggtagtaatgtttcattgattctaggccttttcaataagcagaactaagagacacacacacacacacacacacacacacacacctatttacatatctgtaaatagagataacgttattccttctttactaattatttttcctttaatggatttttcttgtcaagttgcactggctaatatttttaacacaatgttgaatagtagcagatagagtggttatcctt

SEQ ID NO: 2558 - DNA, 401 bp, Homo sapiens
  AC007382.3_58998
  Located on chromosome 2
  Distance between a terminus base of telomere on chromosomal short arm and 5'-terminus of this base sequence : 36638393
  Distance between 3'-terminus of neighbour sequence of sequence listing upward to telomere on chrosomal short arm and 5'-terminus of this base sequence : 155099
atttacttagccaacattaatgagatcccataattttggtgaacaaataatttctccttctacctgaactttactataattaaagaatagctattgttttctctactgaaatttctaggaattcacattcaaaattcttggaaagtatatatggtgctcagaagagcacaaagcgcatgaaatgtcccctgaagtcctagaagttgagcagatacattaaaaagacattgatggtcacaaatcaggaccttcacagattggtaaacacacacacacacacacacacgcatgcatgcacacacacacacacacacacacacacacacacacactaactctctctctctctctgtgccccccctcccaccccctccccaaactcaatcttcatcctcactgta

SEQ ID NO: 2559 - DNA, 236 bp, Homo sapiens
  D2S2186
  Located on chromosome 2
  Distance between a terminus base of telomere on chromosomal short arm and 5'-terminus of this base sequence : 36638567
  Distance between 3'-terminus of neighbour sequence of sequence listing upward to telomere on chrosomal short arm and 5'-terminus of this base sequence : -227
gcatgaaatgtcccctgaagtcctagaagttgagcagatacattaaaaagacattgatggtcacaaatcaggaccttcacagattggtaaacacacacacacacacacacacgcatgcatgcacacacacacacacacacacacacacacacacacactaactctctctctctctctgtgccccccctcccaccccctccccaaactcaatcttcatcctcactgtaaggctgcat

SEQ ID NO: 2560 - DNA, 210 bp, Homo sapiens
  AC007382.3_58952
  Located on chromosome 2
  Distance between a terminus base of telomere on chromosomal short arm and 5'-terminus of this base sequence : 36638584
  Distance between 3'-terminus of neighbour sequence of sequence listing upward to telomere on chrosomal short arm and 5'-terminus of this base sequence : -219
aagtcctagaagttgagcagatacattaaaaagacattgatggtcacaaatcaggaccttcacagattggtaaacacacacacacacacacacacgcatgcatgcacacacacacacacacacacacacacacacacacactaactctctctctctctctgtgccccccctcccaccccctccccaaactcaatcttcatcctcactgta

SEQ ID NO: 2561 - DNA, 304 bp, Homo sapiens
  AC073168.1_113317
  Located on chromosome 2
  Distance between a terminus base of telomere on chromosomal short arm and 5'-terminus of this base sequence : 36679660
  Distance between 3'-terminus of neighbour sequence of sequence listing upward to telomere on chrosomal short arm and 5'-terminus of this base sequence : 40866
gtatgtctgaatgacgtaacaaccactttctttatagtatcactaacttaaaaaaagtcagtttattcattttatatatataagtcacacaaaaaaatataatcactaagaagaaatgatcagtgcaatttcctagaatcagtttctcctgaaagacacacacacacacacacacacacacacacacacacacacacacggaagattttagtgatttttagtaaattaagcacaaacactttacaatcaagaacttctcggccaggtggggtggctcacgcctataattccagcactttaggag

SEQ ID NO: 2562 - DNA, 306 bp, Homo sapiens
  AC073168.1_51246
  Located on chromosome 2
  Distance between a terminus base of telomere on chromosomal short arm and 5'-terminus of this base sequence : 36775522
  Distance between 3'-terminus of neighbour sequence of sequence listing upward to telomere on chrosomal short arm and 5'-terminus of this base sequence : 95558
ctatcaattcctgcatctaactatagatgttatatctacatctaaaattgatatatccatcatcactatataaaattgcacaaagatacatgtctacatataacagacacagatacacacacacacacacacacacacacacacacacacacacacacacacgtataggggacgagaagtgtttattgtctgtgttttcctaccagaaatgtaagctccatgagatcagggacctttgcctgttttatttcacgagaaattctcaatgcctagaacactacctggtacacagccatccagtaacta

SEQ ID NO: 2563 - DNA, 396 bp, Homo sapiens
  chr2.fa.O7frz.38249513
  Located on chromosome 2
  Distance between a terminus base of telomere on chromosomal short arm and 5'-terminus of this base sequence : 36863667
  Distance between 3'-terminus of neighbour sequence of sequence listing upward to telomere on chrosomal short arm and 5'-terminus of this base sequence : 87839
aggtataaagctcatggctaagaattcaagctttggtatttggctgcccggaatttgaatttcatttccgacacagaacagtttttagaaaaatagttacagaatctaagtctcaatttcctcatctataaaatagtagtaacagtccatataattcacaagggcttttatgaggattaaattttgtaatacacttaattcagtgcctggcacatagttagcactttaaaacattacatcatcatcatcatcatcatcatcatcatcatctactgaaataattatcattaaagatgaaaatcaaagctcaaagaagtgaaatagggtttcacagttaataaatataagagacaggacttgaacctaaaacatctggttctctttctatgatacaga

SEQ ID NO: 2564 - DNA, 329 bp, Homo sapiens
  chr2.fa.O7frz.38357563
  Located on chromosome 2
  Distance between a terminus base of telomere on chromosomal short arm and 5'-terminus of this base sequence : 36987501
  Distance between 3'-terminus of neighbour sequence of sequence listing upward to telomere on chrosomal short arm and 5'-terminus of this base sequence : 123438
aagttggtaaagcttgttatcatttctttaagctttttttctcctcttttctttttttcaatctgaaccattccaatgaccttttcttctttctccttccttcctccctccctccctccctccctccctcccttccttccttccttctttccttccttccttccttccttccttccttccttccttccttccttccttccttccttccttccatttttgagacacagtcttactctgtcgcccaggctggagtgcagtggcacgatcttggctcactttaacctctgcctcctgggttcaagcaactctcctgccttagatttccgaat

SEQ ID NO: 2565 - DNA, 331 bp, Homo sapiens
  chr2.fa.O7frz.38462223
  Located on chromosome 2
  Distance between a terminus base of telomere on chromosomal short arm and 5'-terminus of this base sequence : 37092059
  Distance between 3'-terminus of neighbour sequence of sequence listing upward to telomere on chrosomal short arm and 5'-terminus of this base sequence : 104229
gcaaagactccttgagtaagacctgaaaagcacaggtagccaaaataaaaatggacaaagggggtcacatcaagctaaaaagtcgggcacagtgactcacactgataatcctagcactctgggaggccaaggtagtggactgcctgagctcaggagttcgagactagcctggtcaacatggtgaaaccccacctctactaaaatacacacacacacacacacacacacacacacacacacacacacacacacaagcttctgcaaggaaataattaacaagtgaagtgacaacctacagaatgggagaaaatatttgcaaactattcaactg

SEQ ID NO: 2566 - DNA, 129 bp, Homo sapiens
  DISO7_10000882
  Located on chromosome 2
  Distance between a terminus base of telomere on chromosomal short arm and 5'-terminus of this base sequence : 37189071
  Distance between 3'-terminus of neighbour sequence of sequence listing upward to telomere on chrosomal short arm and 5'-terminus of this base sequence : 96681
agtcaatctggactgctggcaaaactccattctctcaggttctctaggaaacacacacacacacacacacacacacacacacacacacacacacacacgtgtaaaaaaagctactgcgtactgagggct

SEQ ID NO: 2567 - DNA, 415 bp, Homo sapiens
  chr2.fa.O7frz.38623211
  Located on chromosome 2
  Distance between a terminus base of telomere on chromosomal short arm and 5'-terminus of this base sequence : 37253199
  Distance between 3'-terminus of neighbour sequence of sequence listing upward to telomere on chrosomal short arm and 5'-terminus of this base sequence : 63999
catacttagtttctgtttgcactctttccctgactagtgagtgagaaaggtctgtgtgtgtgtgtctgtgtgtgtgtgtgtgtgtgtgtgtgtgtgtgtgtgagtgtgtatgcttctttgtggccctatttttgctttgcttcaacttatttcgtcatttcatgcttgctgcctagcagacatggatgggtggattttgatcagagttaaaggcagtttgcccactatctgccatggtgggacttatgcctgccagtcggtaggcctccctgaagttcatcttgtcttgtcaaaatgctgatgcatcaagattgatgtgttttgagtaggaattatttttcaaagccttgtttgggccagttctggtctggtgccatgtcttacatagtgtatatcatgaatcttcactgagaaa

SEQ ID NO: 2568 - DNA, 279 bp, Homo sapiens
  chr2.fa.O7frz.38940017
  Located on chromosome 2
  Distance between a terminus base of telomere on chromosomal short arm and 5'-terminus of this base sequence : 37395093
  Distance between 3'-terminus of neighbour sequence of sequence listing upward to telomere on chrosomal short arm and 5'-terminus of this base sequence : 141479
tcctcagattcactaaactcatactctagtgtctttgcatttgtgatttttctctatccagaatatgttttcccagatctccatgaaattttctccttcacctattttagggatcttctcaaatgtgaccttatctgatgaaatttcctaaacaccttacatatatataaaatgtaattcctattctccttacacactctgtcacacacacacacacacacacacacacacacgtctattctgttttagtttttccatagcacttaacatcacttgaca

SEQ ID NO: 2569 - DNA, 257 bp, Homo sapiens
  D2S2163
  Located on chromosome 2
  Distance between a terminus base of telomere on chromosomal short arm and 5'-terminus of this base sequence : 37531071
  Distance between 3'-terminus of neighbour sequence of sequence listing upward to telomere on chrosomal short arm and 5'-terminus of this base sequence : 135699
acttctggaatacctactgtgtgccagacaccatggatcactgggttatgcgagaacgtgtcaaggggcctgccgcagtttagggggtcatggaaacattctctgaggaagtgtggacttgaactgagatctggggaggaagatcaggaggaggaggtaattagatgaatagtgcttgtgtgtgtgtgtgtgtgtgtgtgtgtgtgtgtgtgtagggaatagagattgcggaacattccagacagaggctcagcata

SEQ ID NO: 2570 - DNA, 292 bp, Homo sapiens
  D2S177
  Located on chromosome 2
  Distance between a terminus base of telomere on chromosomal short arm and 5'-terminus of this base sequence : 37622216
  Distance between 3'-terminus of neighbour sequence of sequence listing upward to telomere on chrosomal short arm and 5'-terminus of this base sequence : 90888
ctgtattaggatacttggctattgaatataatgctgtcctattccatatatatttcccaaatatctatttgtgtgtatgtgtgtgtgtgtgtgtgtgtgtgtgtgtgtctgtgtgtatctccatataaaattgttctatatatattttccttctactcctagatgacaaagttcttatgggcagggaccagatcttacatttcttttgtacctccatgggccacttcccttcaaaaaagtattttttgagagcggattctgcaccagtggattggagaggtgtctctgagct

SEQ ID NO: 2571 - DNA, 280 bp, Homo sapiens
  chr2.fa.O7frz.39241956
  Located on chromosome 2
  Distance between a terminus base of telomere on chromosomal short arm and 5'-terminus of this base sequence : 37695273
  Distance between 3'-terminus of neighbour sequence of sequence listing upward to telomere on chrosomal short arm and 5'-terminus of this base sequence : 72765
ctaccgagcatttgaggtagagcctagagcagtaacgggatagcactgtgaccccctggcagtgcaagactgtcgtctcctcctccctacctagcctggcaagctttcattctttccacttgctctcctcccaaccctacagacacacacacacacacacacacacacacacacacacacacacacacattcagacacttcagacactttccacccctgcaggctacatatcagagggagtcactgggcttggaaaacaacaggtttctgaaacttaagg

SEQ ID NO: 2572 - DNA, 378 bp, Homo sapiens
  D2S1348
  Located on chromosome 2
  Distance between a terminus base of telomere on chromosomal short arm and 5'-terminus of this base sequence : 37862320
  Distance between 3'-terminus of neighbour sequence of sequence listing upward to telomere on chrosomal short arm and 5'-terminus of this base sequence : 166767
ggtacccaggacagtgtctgacaaatgcacactgtgtgccctacctgccccttcctactactttttagcatctcctcctctttggttttctcctgttttcttctagaagttgtatagttttgaattttacatttaggtccatgatgcattttgagtcaatgtttttgaacagtataaggcctgtgtctagattcattattattattattattattattattattattattattttgcatatggacatccaatttttccagtactacttgttaaaagactagtctttattgaattgccttttactatttgtcaaagatcagttgactatatttgtgtgtctatttctaaactttcttacctcttccattgatttctgtg

SEQ ID NO: 2573 - DNA, 249 bp, Homo sapiens
  D2S1346
  Located on chromosome 2
  Distance between a terminus base of telomere on chromosomal short arm and 5'-terminus of this base sequence : 37862458
  Distance between 3'-terminus of neighbour sequence of sequence listing upward to telomere on chrosomal short arm and 5'-terminus of this base sequence : -240
ccatgatgcattttgagtcaatgtttttgaacagtataaggcctgtgtctagattcattattattattattattattattattattattattattttgcatatggacatccaatttttccagtactacttgttaaaagactagtctttattgaattgccttttactatttgtcaaagatcagttgactatatttgtgtgtctatttctaaactttcttacctcttccattgatttctgtgtctattctt

SEQ ID NO: 2574 - DNA, 322 bp, Homo sapiens
  AC016689.2_55771
  Located on chromosome 2
  Distance between a terminus base of telomere on chromosomal short arm and 5'-terminus of this base sequence : 37864741
  Distance between 3'-terminus of neighbour sequence of sequence listing upward to telomere on chrosomal short arm and 5'-terminus of this base sequence : 2034
cttgcgatcagtactgataaaccctccccaatctctgatattagtcatttgtatcttccttgttttttctcttggtgaacctggccagagatttatcaatcttattgatcttttccaaaacctccccccgccacacacacacacacacacaccacacacacacacacacaccacacacacacacacacatcaggttttggtttaattcattttctctatttttctaacagcagttttggtttctactctaattttttttttctgctttcttccggcttatattgtttttctttctctagtgtcataaggtggaagcttagat

SEQ ID NO: 2575 - DNA, 262 bp, Homo sapiens
  chr2.fa.O7frz.39489215
  Located on chromosome 2
  Distance between a terminus base of telomere on chromosomal short arm and 5'-terminus of this base sequence : 37942596
  Distance between 3'-terminus of neighbour sequence of sequence listing upward to telomere on chrosomal short arm and 5'-terminus of this base sequence : 77533
aggatttgatcaccagaaatactaccacatatttggtttaagcataaagaacaagcatcttacaaaaatgttagccaaatgtctctttacatcacacacacacacacacacacacacacacacacacacacgattagtacaccctgagcatttatctaagaataacatgaacaatcaaaagtttttggaagcagaggatctagatcatgagttatagttctgaattctgtgttggtcagactacttcgaaatacattgtcca

SEQ ID NO: 2576 - DNA, 96 bp, Homo sapiens
  D2S1305
  Located on chromosome 2
  Distance between a terminus base of telomere on chromosomal short arm and 5'-terminus of this base sequence : 38022139
  Distance between 3'-terminus of neighbour sequence of sequence listing upward to telomere on chrosomal short arm and 5'-terminus of this base sequence : 79281
gtgagcacacaccgtctaaacacacaaatatgcgcatgcacgtgcacacacacacacacacacacacacacttgtatgtcaccactgaactagtaa

SEQ ID NO: 2577 - DNA, 114 bp, Homo sapiens
  D2S2220
  Located on chromosome 2
  Distance between a terminus base of telomere on chromosomal short arm and 5'-terminus of this base sequence : 38095665
  Distance between 3'-terminus of neighbour sequence of sequence listing upward to telomere on chrosomal short arm and 5'-terminus of this base sequence : 73430
agatgattggaaaactctcggaaatctctctcgctctctctctctctctcacacacacacacacacacacacacacacactactcaaacacaattaccaaataaatcgtgccgg

SEQ ID NO: 2578 - DNA, 375 bp, Homo sapiens
  AC016995.3_113252
  Located on chromosome 2
  Distance between a terminus base of telomere on chromosomal short arm and 5'-terminus of this base sequence : 38096228
  Distance between 3'-terminus of neighbour sequence of sequence listing upward to telomere on chrosomal short arm and 5'-terminus of this base sequence : 449
aaattcaaacatctagcttcatacctcaaataaatactgctttaaagcacccagcaaatctaacatagcattaaaaagtccaaaattagaaatattcttctgaggtctctgcccaaaatgcaagaccagcatccccaggaccttcctctctcctgccccttcaaacatcacgcagacaaaattcttgtggacataacaatatataaaacacacacacacacacacacacacacacacacacctttactttctctctgtttctgaaaatttccccttattcactcaaagtctgagaatgtattggggggggctcttattgctgaaacagacgaaagatttgctaatgagaatgatggtttctttatccatactctt

SEQ ID NO: 2579 - DNA, 252 bp, Homo sapiens
  chr2.fa.O7frz.39852782
  Located on chromosome 2
  Distance between a terminus base of telomere on chromosomal short arm and 5'-terminus of this base sequence : 38187536
  Distance between 3'-terminus of neighbour sequence of sequence listing upward to telomere on chrosomal short arm and 5'-terminus of this base sequence : 90933
agttgtaaagtatcaagccataaaagaactctgaaatttgggatagccagttagcaagggaatcatacacacacacacacacacacacacacacacaaatacacacacacacacacacacaaatacacacacacacaaatttagaatatttaaatttagaatagacacttagatcgaatagggctactatgacaaatttcaaaaagctttaagccaatactctggaaatttagacactaagttccattctgc

SEQ ID NO: 2580 - DNA, 188 bp, Homo sapiens
  Z67621
  Located on chromosome 2
  Distance between a terminus base of telomere on chromosomal short arm and 5'-terminus of this base sequence : 38347589
  Distance between 3'-terminus of neighbour sequence of sequence listing upward to telomere on chrosomal short arm and 5'-terminus of this base sequence : 159801
tcagacacaaatgtcccagccttcacagggtctatctgttcatagagaggaaaaaaataaaacagaaaacggaaagcattcataatgccaccatccagagtcaacctgtgcatgctaggatatatccttctgcgtgcatatgtgtgtgtgtgtgtgtgtgtgtgtaaacagcctcattgagattatca

SEQ ID NO: 2581 - DNA, 466 bp, Homo sapiens
  AC074366.3_86615
  Located on chromosome 2
  Distance between a terminus base of telomere on chromosomal short arm and 5'-terminus of this base sequence : 38394152
  Distance between 3'-terminus of neighbour sequence of sequence listing upward to telomere on chrosomal short arm and 5'-terminus of this base sequence : 46375
tgttgattaaattgcctgattctgattgtctgcatatgtgaaaaacacaaaaagaaaatactctataaagaaagttaaaatatacattaaagcccatttaattatcaaacatgcattccctccacttaacacttgggcctaagatagtgtctgtgtgaaaataatacttctcccaatgctactaaacctatcccatgtattcttgcccagttacacaagtataggtatcccatatgttatctcccagaccaaatgtggaatgttttgttttgttttgttttgttttttactgtgatcaaatggttgacaaaattcttgtttcataattctgaagggttgcttcctcagatcaagaagctttagaattaatgaactaagaactaaatgtagcaacttttcaagccatgttcccctcccacgcatagtgactcacatgctgcaagaacttactgttgcaaagaacact

SEQ ID NO: 2582 - DNA, 131 bp, Homo sapiens
  D2S2331
  Located on chromosome 2
  Distance between a terminus base of telomere on chromosomal short arm and 5'-terminus of this base sequence : 38539465
  Distance between 3'-terminus of neighbour sequence of sequence listing upward to telomere on chrosomal short arm and 5'-terminus of this base sequence : 144847
agtttatgctgtgattaatacctggtctctgtattaagggagtgtgtgtgtgtgtgtgtgtgtgtgtgtgtgtgtgtgtgtataaaagagagtgagagagtacacacactatgtgccaggtaagtgctaat

SEQ ID NO: 2583 - DNA, 390 bp, Homo sapiens
  chr2.fa.O7frz.40494974
  Located on chromosome 2
  Distance between a terminus base of telomere on chromosomal short arm and 5'-terminus of this base sequence : 38690493
  Distance between 3'-terminus of neighbour sequence of sequence listing upward to telomere on chrosomal short arm and 5'-terminus of this base sequence : 150897
ataagcacttctacctcaggactaatatttagtgaatgtctctgatacagatttctaaactaaagatgtacatcataaacacatggagaagtgtcaaaatacacatgtctaggctttaatcctagattctcatttggttaggtctaatttagagttttatttatttatttatttatttatttagagatggagtcttgctctgtcgcccaggccggatgatctcagctcactgcaacctctgcctcctgggttcaagcaattctcctacctcagcctctggagtagctgggactacaggcgcctgccaccacgcccagctaatatttgtatttttagtagagatgggatttcaccatgttggccaggctggtctcgaactcatgacctcaa

SEQ ID NO: 2584 - DNA, 437 bp, Homo sapiens
  AC019171.3_18406
  Located on chromosome 2
  Distance between a terminus base of telomere on chromosomal short arm and 5'-terminus of this base sequence : 38766621
  Distance between 3'-terminus of neighbour sequence of sequence listing upward to telomere on chrosomal short arm and 5'-terminus of this base sequence : 75738
cactcagtggccattagagaaatgacacagggctgatataactctggacctgggccttattattcatgtgggtgatcttatggtactgagtaatgcatgggtgtgtgtgtgtgtgtgtgtgtgtgcgcgctcatagggtctgccacctgttgtaacagcacgctttcccaatgccgcaacactccacctatatctgttcatagtctagatttttttctgtttccctctctgttgagagaaagcaggaaggaggaaagtaagacttggtgaaaaagattaatgtaatgaatatataataatccagaaaaattgaagaaaaggccaatccaaaagaatggaaagtctggattatggactactgtggacatatgtggcattattactttaaacattccattgggtaatatacactggtggttcataaattctgaatctac

SEQ ID NO: 2585 - DNA, 429 bp, Homo sapiens
  AC037489.2_151405
  Located on chromosome 2
  Distance between a terminus base of telomere on chromosomal short arm and 5'-terminus of this base sequence : 38916268
  Distance between 3'-terminus of neighbour sequence of sequence listing upward to telomere on chrosomal short arm and 5'-terminus of this base sequence : 149210
gatcacgaggtcaggagttcaagaccagcctgaccaagatggtgaaaccccgtctctactaaatatacaaaaattagccaggtgtggtggcgagagcctgtaatcccagctactcaggaggctgaggcagagaactgcttgaacccgggaggctgggaggcgcaggctgcagtgagccgagactgtaccactgcactccagcctggacgacagagcaagactcggtctcaaataaataaataaataaataaataaataaagactgtgagggggttctgagaccgaaaaacttgagaactactatctaccaatctaagataaccctggaataacattcccaattagcagtaaaaatttctaaggactctttgtttggttaactatgaaaaatctatttacaaataacttagccacatacagcctctttat

SEQ ID NO: 2586 - DNA, 356 bp, Homo sapiens
  AC019171.3_179695
  Located on chromosome 2
  Distance between a terminus base of telomere on chromosomal short arm and 5'-terminus of this base sequence : 38927798
  Distance between 3'-terminus of neighbour sequence of sequence listing upward to telomere on chrosomal short arm and 5'-terminus of this base sequence : 11101
acacctgtaatcctagcaatttgggaggcccaggcgggtgaatctcctgagctcaagagtttgagaccagcctgggcaacatggtaaaaccctgtctctaacaaaaaatacaaaaaaattagccgcgcatggtggtacgtgcctgtggtcccagctacttcggaggctgatgtgggaggttcacttgagcctaggaggtggaggctgcagtgagctgagactgtgctactgtacacacacacacacacacacacacacaaatcagcatgaagcattaaagtagcattaaaggttcctcaagtaatcttcctgttacagttttaaaaaaaaaactttcttaaataacatctgagtgg

SEQ ID NO: 2587 - DNA, 373 bp, Homo sapiens
  AC007684.3_124825
  Located on chromosome 2
  Distance between a terminus base of telomere on chromosomal short arm and 5'-terminus of this base sequence : 39155566
  Distance between 3'-terminus of neighbour sequence of sequence listing upward to telomere on chrosomal short arm and 5'-terminus of this base sequence : 227412
gtcataggtaaatctactgtccactttttaggcaacttgactatctttataaaatgttctgccttgcaaaaaagctgctactaacatagtatgaatgttaatataaaagtgatatattagttttcatcaaaatgttatttcctcattgatcaaacactatcaccacactataatgtaaccgtacaatgcattttcaactgtttacattacactttaaacttgattattgtttcccatttttgtgtgtgtgtgtgtgtgtgtgtgtgtgtgtgtgtgtgtttttaaaagaacctccctttctaggaactcaccatcaattgaaccagggttggtatgtgagactgtaccttgctgcttagtacatgaggttgtc

SEQ ID NO: 2588 - DNA, 106 bp, Homo sapiens
  AC007684_116671
  Located on chromosome 2
  Distance between a terminus base of telomere on chromosomal short arm and 5'-terminus of this base sequence : 39163916
  Distance between 3'-terminus of neighbour sequence of sequence listing upward to telomere on chrosomal short arm and 5'-terminus of this base sequence : 7977
gcttcatctctgaaaatgcacttctttgtctttctagtattattattattattattattattattattattattattattattttgagacagagtctcgttctgtt

SEQ ID NO: 2589 - DNA, 295 bp, Homo sapiens
  AC007684.3_63466
  Located on chromosome 2
  Distance between a terminus base of telomere on chromosomal short arm and 5'-terminus of this base sequence : 39217077
  Distance between 3'-terminus of neighbour sequence of sequence listing upward to telomere on chrosomal short arm and 5'-terminus of this base sequence : 53055
taccaaagaaatttagcaacatagcttgctgctgacaaatctaagcaagtacataaaaagtggattttaccaaacaacctacatgcacgtacacatacacacacacacacacacacacacacacacatttttaaaataatggttttattcaggctacacagcaagtattaataagcttttccactatctgataatgctggctttttaatctgaaaaagaaaatggaatgcttctgaaactcttctgttatacaatagagaaattacataatttgacctcatgaggctaaactatc

SEQ ID NO: 2590 - DNA, 182 bp, Homo sapiens
  AC007684.3_320
  Located on chromosome 2
  Distance between a terminus base of telomere on chromosomal short arm and 5'-terminus of this base sequence : 39280271
  Distance between 3'-terminus of neighbour sequence of sequence listing upward to telomere on chrosomal short arm and 5'-terminus of this base sequence : 62899
aatgtttatgaccttgtatttcacaagtatttcttaaatactacacacacacacacacacacacacacacacacacacaaactacacaaatattacacataaatataaaagaaggccaggcacagtggctcacactgtagtaccagcacattgggaggctaaggtagaaggataccttgaag

SEQ ID NO: 2591 - DNA, 290 bp, Homo sapiens
  AC073403.1_139855
  Located on chromosome 2
  Distance between a terminus base of telomere on chromosomal short arm and 5'-terminus of this base sequence : 39353859
  Distance between 3'-terminus of neighbour sequence of sequence listing upward to telomere on chrosomal short arm and 5'-terminus of this base sequence : 73406
gtctaagtcagtagcatagccaaggtgcaagcccaggcagtttggcagagccagagattttcactgctatgctatgctatgctgtgctgtgctgtgctgtgctgtgctgtgctgtgctgtgctgtgctgtgctgtgctatgctatgctatgctatgctatgctatgctatgctatgatatgccacttctgtagttagccaacggttatgtaaacacttccagggatgggaacccactcgatggtgagctgagtacttaggctaaaattgtctcctataacttcaagccgt

SEQ ID NO: 2592 - DNA, 352 bp, Homo sapiens
  AC007253.2_202156
  Located on chromosome 2
  Distance between a terminus base of telomere on chromosomal short arm and 5'-terminus of this base sequence : 39608335
  Distance between 3'-terminus of neighbour sequence of sequence listing upward to telomere on chrosomal short arm and 5'-terminus of this base sequence : 254186
cattaccagtgagcctcacgtgactcagaaatgagcaatgtgggggaaaaggctctttccacaattcattttacttcctggggtattgttggggtgtctgaccttcaggaacagcttcatgaacaggattgagttcctgaggcagaagtggaactgctgggggtggtggtagtagtggcagcagttagttttctggtcaggccagtttctgaaagcttagcttccagattggttttccagactgcccaacaaatgagtcatacacacacacacacacacacacacacacacacacacacatacacacacacacacacgcacgctttactttgcttaatcagttaaagttagc

SEQ ID NO: 2593 - DNA, 274 bp, Homo sapiens
  AC007253.2_145946
  Located on chromosome 2
  Distance between a terminus base of telomere on chromosomal short arm and 5'-terminus of this base sequence : 39664599
  Distance between 3'-terminus of neighbour sequence of sequence listing upward to telomere on chrosomal short arm and 5'-terminus of this base sequence : 55912
ctgaagcaggtaaaccttatttggcaaggcacagtggaggcaggaagtcatgtggcaggtagtctggccacagtatctatcctggggatgtgtgaaagtgcttggccttccggatttgcagggcagtggcagctggtgctgggttgctcaggaatcaaaagcctatgggaatccatgtggcttttggttggtgcctctgcacagtctcccggtagctctcgtgtgtgtgtgtgtgtgtgtgtgtgtatgtgtgactaggattttaaaggttcat

SEQ ID NO: 2594 - DNA, 389 bp, Homo sapiens
  AC007253.2_143705
  Located on chromosome 2
  Distance between a terminus base of telomere on chromosomal short arm and 5'-terminus of this base sequence : 39666925
  Distance between 3'-terminus of neighbour sequence of sequence listing upward to telomere on chrosomal short arm and 5'-terminus of this base sequence : 2052
gatattcattgagcattacttgacagaggtaggtattgagaggaaacataggagaatggataggcaatatatatatatgtgtgtgtgtatatatatgtgtgtgtgtgtgtgtatgtgtgtatatatgcatcccgtacatatatatatatatatatatatatctcatatatttatatatatttatttattttttatttttttgagaccaggtcacccaggctggagtgcagtgatgtgaacaccactcactgcaggctctacctcccaggcttaagcgatcctcctgcctcagcctcccaagtagctgggaccacaggtgtgtgccaccatgcctggctaattttttgttttttttttcattatttgtaaagacagagtctcaacatgtt

SEQ ID NO: 2595 - DNA, 347 bp, Homo sapiens
  AC007253.2_120148
  Located on chromosome 2
  Distance between a terminus base of telomere on chromosomal short arm and 5'-terminus of this base sequence : 39690471
  Distance between 3'-terminus of neighbour sequence of sequence listing upward to telomere on chrosomal short arm and 5'-terminus of this base sequence : 23157
aacttctggtagaactcctatgtctaattttcacactgtacttgaaggacaaaaattttaaatgtaaatgctacctttaagtcattcagagaagtactcacctactacataatcacatcacacacacacacacgcgcgcgcacacacacacacacacacacacacacacacatacatgctgacttcaaactgtctttcactctgaccagaagagtaaaagaaagaaaaaacaaagggaaagaggtaccttgaatttataggtgattgctttgtaattcttattttttcttatatggaggtgagcgcctcagggagctataaagggtgtcaattatcggtatgacgag

SEQ ID NO: 2596 - DNA, 241 bp, Homo sapiens
  AC007253.2_34506
  Located on chromosome 2
  Distance between a terminus base of telomere on chromosomal short arm and 5'-terminus of this base sequence : 39776070
  Distance between 3'-terminus of neighbour sequence of sequence listing upward to telomere on chrosomal short arm and 5'-terminus of this base sequence : 85252
cagctttcttaatacagcaaagatgaagtaggcaagaaataaggagattgaaaacctaaacaacataatcactacaggagatcttgtagatatactgtatgtcaaactctacaccatgtcaatagagaatacatcttctcaagagctcatgcaacatccacataatttgattatatattactacacacacacacacacacacacacacacacacagagtaagtttagtggcatactggtaa

SEQ ID NO: 2597 - DNA, 185 bp, Homo sapiens
  D2S2238
  Located on chromosome 2
  Distance between a terminus base of telomere on chromosomal short arm and 5'-terminus of this base sequence : 39776213
  Distance between 3'-terminus of neighbour sequence of sequence listing upward to telomere on chrosomal short arm and 5'-terminus of this base sequence : -98
agctcatgcaacatccacataatttgattatatattactacacacacacacacacacacacacacacacacagagtaagtttagtggcatactggtaaacaagtagtttgggttggggtcgggggatctgatttatatcatttactgatttctttgatgtaaatccttcagtggtcaattagagc

SEQ ID NO: 2598 - DNA, 419 bp, Homo sapiens
  AC007254.3_47325
  Located on chromosome 2
  Distance between a terminus base of telomere on chromosomal short arm and 5'-terminus of this base sequence : 39899399
  Distance between 3'-terminus of neighbour sequence of sequence listing upward to telomere on chrosomal short arm and 5'-terminus of this base sequence : 123001
cttggtagaaatagtgttgaatctgtagattgctttgggcagaatggccattttaacaatattgattcttccaatttatgagcatggaatgtttttccatttgtttgtgtcatctatgatttttttctctttttctttttctttttttttagaatgctataaattgtttattatgttacagatggaaataattacaacaataacataaaggatgagctcttccatagcatgcttgtcctggttcagaggataaattatttatttatttatttatttatttattttttaatttttttactatatctttttttttatactttaagttctggggtacatgtgcagattgtgcaggtttgttacctaggtatacacgtgccatggtggtttgctgcacccatcaacctgtcatctacattagg

SEQ ID NO: 2599 - DNA, 346 bp, Homo sapiens
  chr2.fa.O7frz.41818550
  Located on chromosome 2
  Distance between a terminus base of telomere on chromosomal short arm and 5'-terminus of this base sequence : 40019306
  Distance between 3'-terminus of neighbour sequence of sequence listing upward to telomere on chrosomal short arm and 5'-terminus of this base sequence : 119488
aactaaggtctcaggttaatgatttacatggaaaattgctatcacattacattatcttctacagtatttgcaggagaactggtgagagaattacaaccaagatgatataatgaaatgaaaatttacaagttgaggtgtgggaaagggtaaaaggataacactgagcgatcactaagaaaaatgactcaggttactcagtaagcaatgtgtgtgtgtgtgtgtgtgtgtgtgtgtgtgtgtgtgcgcgcgcaaagaaaacgagagggagaaggaaagagaaatttaaagacagagatagaataaaatgtcttgagttttatgataagaaatagccacttaatattgg

SEQ ID NO: 2600 - DNA, 381 bp, Homo sapiens
  AC007281.3_167567
  Located on chromosome 2
  Distance between a terminus base of telomere on chromosomal short arm and 5'-terminus of this base sequence : 40102572
  Distance between 3'-terminus of neighbour sequence of sequence listing upward to telomere on chrosomal short arm and 5'-terminus of this base sequence : 82920
gcatctgaaatgtcataaacagtcaacaaataatggctgtaataaaatcaataatacttatcatttgactacataaataaaccaaaaactaggaacaaaagcaatatacgtacatataaacatatgtataaatatatatatatgtgtgtatatatatatatatatatatatatatatatatatatttgtaacatatggttgcttactatgtgcagggcactgtcctaaggatataaaagctttacatctaaaatgtatttaattttaacaccaacatcataacataaatatgttgttatccccattttacatacagagaaaccaaggcaaagtaacttatgtaagtctacatgatagaactaggatttgaccaggttatct

SEQ ID NO: 2601 - DNA, 307 bp, Homo sapiens
  AC007281.3_138227
  Located on chromosome 2
  Distance between a terminus base of telomere on chromosomal short arm and 5'-terminus of this base sequence : 40131840
  Distance between 3'-terminus of neighbour sequence of sequence listing upward to telomere on chrosomal short arm and 5'-terminus of this base sequence : 28887
aatgaagagtatcactgcatttactatagtaaaggcttgttctgttttagtccataagttgaaaaaaatcaatatatagcattcatatatccaaaatattcacaagaaaggtcttcaagaaatatttgctcatccatgttcatagcagcactgtccacaatagccaagaggtgaaagcaaacaagtgtcagtaaacagataaacagatgactggctaaagaaaatgtgatatacacacacacacacacacacacacaaacacatacacacacacacaccaatataacagaatgttattcagccttaa

SEQ ID NO: 2602 - DNA, 259 bp, Homo sapiens
  AC007281.3_116297
  Located on chromosome 2
  Distance between a terminus base of telomere on chromosomal short arm and 5'-terminus of this base sequence : 40153930
  Distance between 3'-terminus of neighbour sequence of sequence listing upward to telomere on chrosomal short arm and 5'-terminus of this base sequence : 21783
ccttatggtttcaactcacactacttctctattttcatctcctcacactacaacctcacacacacacacacacacacacacacacacacacacacacgcactggactatttaaaattcactgaaaacagacaaactttcactcggccaaacctttattcctgcagtttcccttgaatgaatactctcatattctctggcccattgaaaccttacgcaaccgttaggtccaaccaaatgttatcagttccaacaatcctt

SEQ ID NO: 2603 - DNA, 173 bp, Homo sapiens
  Z67641
  Located on chromosome 2
  Distance between a terminus base of telomere on chromosomal short arm and 5'-terminus of this base sequence : 40253315
  Distance between 3'-terminus of neighbour sequence of sequence listing upward to telomere on chrosomal short arm and 5'-terminus of this base sequence : 99126
gatgcacagactcacattcataaacacactgaaccacacacacacacacacacacacacacacatatataatatagaacttacacaatttcatcattctggaattcgagctctccacaagtgtcctcaaaatcctcccctccacctctggcagtcccttcgatggttttatat

SEQ ID NO: 2604 - DNA, 134 bp, Homo sapiens
  D2S2328
  Located on chromosome 2
  Distance between a terminus base of telomere on chromosomal short arm and 5'-terminus of this base sequence : 40322004
  Distance between 3'-terminus of neighbour sequence of sequence listing upward to telomere on chrosomal short arm and 5'-terminus of this base sequence : 68516
ccgagcaatttcactctgggaagcgcggacacccagaaaaatgtgcaggcgcgcacacaccacatcacacacacacacacacacacacacacacacacacacacacaaatttagaagccgctcgtttgccaaag

SEQ ID NO: 2605 - DNA, 315 bp, Homo sapiens
  AC007877.3_48911
  Located on chromosome 2
  Distance between a terminus base of telomere on chromosomal short arm and 5'-terminus of this base sequence : 40416658
  Distance between 3'-terminus of neighbour sequence of sequence listing upward to telomere on chrosomal short arm and 5'-terminus of this base sequence : 94520
aacaagactgaaactccatctcaaaaaaaaaaagtctatatacatacacacacacacacacacacacacacacacacacacacacatatattctagtataaggagaaaggtgtataaccgatatttaaaatgtagcaatagtaaatactcaatgctaaaggaaccctgaatttaatctaggcattgtggatgaaaccaagagagagatggggaaaaccatgattatctgagtagaatgaaaagcatatgttcaatctgtcctccctcatcatttttcttactaccactctaatgtgtaaagtctaatccaatcac

SEQ ID NO: 2606 - DNA, 215 bp, Homo sapiens
  AC007877.3_37565
  Located on chromosome 2
  Distance between a terminus base of telomere on chromosomal short arm and 5'-terminus of this base sequence : 40427944
  Distance between 3'-terminus of neighbour sequence of sequence listing upward to telomere on chrosomal short arm and 5'-terminus of this base sequence : 10971
ataaatgagttcactggaggtcgagtgatttgccacatacctgaatgaactgtagaaaagaagtgctataaaattctttttgtgtatccattggtactcactcctacacccacaaatacacacacacacacacacacacacacacaaatacatatatatgctcttattttaacataaccaagctttaaaagctgtttgtcatctttaagctctac

SEQ ID NO: 2607 - DNA, 210 bp, Homo sapiens
  D2S2272
  Located on chromosome 2
  Distance between a terminus base of telomere on chromosomal short arm and 5'-terminus of this base sequence : 40539396
  Distance between 3'-terminus of neighbour sequence of sequence listing upward to telomere on chrosomal short arm and 5'-terminus of this base sequence : 111237
agtcaaagtaggagtgtgtacaagaattactgatttccagatcgtgtgtgtgaatgtgtgtgtgtgtgtgtgtgtgtgtgtgtgtgtgtgtgacagagagagacagagggagagagagagagagaatgagagagagagaggacagagagagagagagactgcatgggcaaaaactggagaaataaaaggaacctaagtgcttatttgccc

SEQ ID NO: 2608 - DNA, 219 bp, Homo sapiens
  AC007317.3_51440
  Located on chromosome 2
  Distance between a terminus base of telomere on chromosomal short arm and 5'-terminus of this base sequence : 40614573
  Distance between 3'-terminus of neighbour sequence of sequence listing upward to telomere on chrosomal short arm and 5'-terminus of this base sequence : 74967
gcatgtgttacctgtcagtaactcagttatctttttctgaaacttctattaaatatatgtataaaacttatttaagtcctttatatcacaacatttcaatctctgtgtgtatatatatatatatatatatatatatatatatatatatatacacacacacacatataattcagataactaacaatcttaccaatgccctaatttgctgtgaaattcatc

SEQ ID NO: 2609 - DNA, 382 bp, Homo sapiens
  chr2.fa.O7frz.42796369
  Located on chromosome 2
  Distance between a terminus base of telomere on chromosomal short arm and 5'-terminus of this base sequence : 40937418
  Distance between 3'-terminus of neighbour sequence of sequence listing upward to telomere on chrosomal short arm and 5'-terminus of this base sequence : 322626
tcacctaattataatgaatcgaagaataatttgaattaattgctttttcaatatttataattcacatttcattgggcttttcattttctgtaaggttaatttcccttcactttttaagtcattatttagtatgtgctttagagagttgagttttccaaacagaactgtaaataaaagactgagaaaacattccacaatcaatgagtgacaagtgtttgctataatttgggtataaaatcaaatatagtttagacaattaatctaacaaatgtgtgtgtgtgtgtgtgtgtgtgtgtgtgtgtgtgtgtgtgtgtgtgtggctgttacttttgacttccctcacagaaaaactttaaagagaggttgactcaatcttagtatg

SEQ ID NO: 2610 - DNA, 290 bp, Homo sapiens
  chr2.fa.O7frz.43104974
  Located on chromosome 2
  Distance between a terminus base of telomere on chromosomal short arm and 5'-terminus of this base sequence : 41221383
  Distance between 3'-terminus of neighbour sequence of sequence listing upward to telomere on chrosomal short arm and 5'-terminus of this base sequence : 283583
tgagtgcagtactctattgctacctatttgatgaattttattaactgggctttaagtcttctgtatcctaattttttaggagggcatctagatatataagttaatgagaggttgttaaagactccactataacatatatttatttctatttaaagttctattggtcagatagatagatagatagatagatagatagatagatagatagatagatagatagataaaggttatagtctttcttggattcaaattttagttattatactttcttggtgaactgaaattaaatg

SEQ ID NO: 2611 - DNA, 135 bp, Homo sapiens
  chr2.fa.O7frz.43231243
  Located on chromosome 2
  Distance between a terminus base of telomere on chromosomal short arm and 5'-terminus of this base sequence : 41360740
  Distance between 3'-terminus of neighbour sequence of sequence listing upward to telomere on chrosomal short arm and 5'-terminus of this base sequence : 139067
gcaatacaaggtttgataaagtacttaaaaatggataaccataagttggttgcagatatatatatataaatatatatatatacacacacataaaatggaggaatacttttcttctcgtaaccattaatgtttctg

SEQ ID NO: 2612 - DNA, 126 bp, Homo sapiens
  D2S2305
  Located on chromosome 2
  Distance between a terminus base of telomere on chromosomal short arm and 5'-terminus of this base sequence : 41508467
  Distance between 3'-terminus of neighbour sequence of sequence listing upward to telomere on chrosomal short arm and 5'-terminus of this base sequence : 147592
acccaggtgagatacaatcaactgtggtgagaaaccacacacacacacagtaagaaatcacacacacacacacacacacacatacacacacacatcctaagaatctgttctccatctcctataatg

SEQ ID NO: 2613 - DNA, 262 bp, Homo sapiens
  D2S2172
  Located on chromosome 2
  Distance between a terminus base of telomere on chromosomal short arm and 5'-terminus of this base sequence : 41627481
  Distance between 3'-terminus of neighbour sequence of sequence listing upward to telomere on chrosomal short arm and 5'-terminus of this base sequence : 118888
caaaggggttgacactgactaccacgagatttatgctctagaaccagcccacacgcccccccaacaaccctcacccccacgatacacacacacacacacacacacacacacacgtcagtggacttttcctgagattacatcatttttcaactctttcctctgcccatcctgattcactttctccctgataggttttcttaagaccacaatctcaataaatcacaagcaccaaaacctctttcttaggctctgcgtctggaaa

SEQ ID NO: 2614 - DNA, 400 bp, Homo sapiens
  chr2.fa.O7frz.43616271
  Located on chromosome 2
  Distance between a terminus base of telomere on chromosomal short arm and 5'-terminus of this base sequence : 41725700
  Distance between 3'-terminus of neighbour sequence of sequence listing upward to telomere on chrosomal short arm and 5'-terminus of this base sequence : 97957
aaatgtctaacctgaatccaaccatgagaatgcaatctgacaaatccagctgtgggacattctataacacaacaggcctgaattattttaaaaagtcagtatcatttaaaaagaaagaaagaaagaaagaaagaaagaaagaaagaaagaaagaaagaaagagagagagagaaagagaagaaagaaaagaaaagaaaatttgaccaggtgcagtggctcacgcctgtaatcctagcactttgggaggccgaggcaggcagatcacctgaggtcaggagttggagaccagcctggccaacatgatgaaaccctatctctactaaaaatacaaaaattagccaggcgtggcaggtgcctgtaatccgagctactagagaggctaaagcaggagaatcacttg

SEQ ID NO: 2615 - DNA, 288 bp, Homo sapiens
  AC013480.10_103242
  Located on chromosome 2
  Distance between a terminus base of telomere on chromosomal short arm and 5'-terminus of this base sequence : 41835722
  Distance between 3'-terminus of neighbour sequence of sequence listing upward to telomere on chrosomal short arm and 5'-terminus of this base sequence : 109622
ctgcaataaagaaatttgtttaactcagtgtgatctaaacatgtttcacaaaagaatcattttttggtgacagcgatgggtatcccttgatagcagtgttacattgagtgcctttggggaaagctgcctttagaaatgtgtgtgtgtgtgtgtgtgtgtgtgtgtgtgtgtgtgtgtgtgtgtgtgtcccttacctgcagagcttcctgaggcttggtctagggggaggaacacttctctaccttctgcctccctgtcttccagttcccaagtcttaagctggccaac

SEQ ID NO: 2616 - DNA, 474 bp, Homo sapiens
  AC013480.10_118037
  Located on chromosome 2
  Distance between a terminus base of telomere on chromosomal short arm and 5'-terminus of this base sequence : 41850501
  Distance between 3'-terminus of neighbour sequence of sequence listing upward to telomere on chrosomal short arm and 5'-terminus of this base sequence : 14491
ggattcaaactgaaacatcagctctctctgggtcttgagcctgcaggcattcagactgaaactacaccatcatctctcctgggtctccggcttgctgactacaggtcttgggatttgtcagcctccatacccacatgattcaattccttatttcatatatatatatatatatatatatatatatatatatatacacatatatatattttttttaagtactgatttttaaaaatatagatgatagatagatagatagatagatagatagatagatagatagatagttagacagacagacagatagatagatcctattggttctatctctctggagaaccctgactaataccaccaggtagccaccaaaaaacatgcacatgaatgtttatagcagctttatttgtaatagtcaacaaactggaagcaatccaaatgcccatcaacagtgctacacagtgctagatttctaccatg

SEQ ID NO: 2617 - DNA, 453 bp, Homo sapiens
  AC013480.10_14698
  Located on chromosome 2
  Distance between a terminus base of telomere on chromosomal short arm and 5'-terminus of this base sequence : 41878486
  Distance between 3'-terminus of neighbour sequence of sequence listing upward to telomere on chrosomal short arm and 5'-terminus of this base sequence : 27511
cattcaataagcactcatttaataaattaatgaatgaagatacagagctcccatgttctcaaacacctactatttggttggtgcaaagtacttgtggtttttcccattatgtgtgtgtgtgtgtgtgtgtgtgtgtgtgtgtgtgtgtgtgtgtgtgtttgagacagagttttgctcttgttgcctaggctggaacgcagtggcatgatctgggctgactgcaacctccgcctcccgggttcaagcgattctcctgcctcagcctcccgagtagctgggattacaggtgcctgccaccacgcccagctaattttttgtattttaagtagagacagcgtttcaccatgttggccaggctggtctcaaactcctgacctcaggtgatcagcctgcctgggccaccacatgcatccagccattacttttaatgactattacaaagcaaatacgttg

SEQ ID NO: 2618 - DNA, 101 bp, Homo sapiens
  DISD22_0001580
  Located on chromosome 2
  Distance between a terminus base of telomere on chromosomal short arm and 5'-terminus of this base sequence : 42080500
  Distance between 3'-terminus of neighbour sequence of sequence listing upward to telomere on chrosomal short arm and 5'-terminus of this base sequence : 201561
tacataaatccagtgaggctgggaaagctggaggatctctctctctctctctctctctctctctctctctctctctccatacatgaatcttgtgtttgtgt

SEQ ID NO: 2619 - DNA, 410 bp, Homo sapiens
  chr2.fa.O7frz.44061894
  Located on chromosome 2
  Distance between a terminus base of telomere on chromosomal short arm and 5'-terminus of this base sequence : 42222269
  Distance between 3'-terminus of neighbour sequence of sequence listing upward to telomere on chrosomal short arm and 5'-terminus of this base sequence : 141668
gccagtcctcaataattcaccaaaaaaaaagtaagaaaggaggtaatggggaaatcaccctgagttttctgagacatttcccctggggattggcagggcaacatgtcctttctcttgttcattcacctcccctaaacacactggaacaacaccttatacttctctctctctctctctctctggagtccttgcatcagaccatgaaaatcaccctaagtgatttatgaataagggaatccctgttcgtgtgctcagaaagacccgatttacatatctgccttccccaataagctttccctgggctagcacagtgtctggcatttgctattagctgtttgaaaactatttgtcaaacattaaggaaataactttcatcttaactttgggtgtcaatgtaggagtaaaagttg

SEQ ID NO: 2620 - DNA, 197 bp, Homo sapiens
  D2S2306
  Located on chromosome 2
  Distance between a terminus base of telomere on chromosomal short arm and 5'-terminus of this base sequence : 42303470
  Distance between 3'-terminus of neighbour sequence of sequence listing upward to telomere on chrosomal short arm and 5'-terminus of this base sequence : 80791
ttgtatgtcatcaaggtcttgctctctttacacacacacacacacactctaatgcacatgtgcatgagcacactcgccttatcaatatatcccatttgtatgtgacataatttattttaaacaggttcctacttatcaacaattgttttccactccatcactataaccagtgttataataaatacctttgggccagg

SEQ ID NO: 2621 - DNA, 435 bp, Homo sapiens
  chr2.fa.O7frz.44270578
  Located on chromosome 2
  Distance between a terminus base of telomere on chromosomal short arm and 5'-terminus of this base sequence : 42378658
  Distance between 3'-terminus of neighbour sequence of sequence listing upward to telomere on chrosomal short arm and 5'-terminus of this base sequence : 74991
ggctgaatagtactccattgtgtgtaagtaccacatttcctttatacattcaactgggtgtgtgtgtgtgtgtgtgtgtgtgttttgagatgaagtctcactctgtcacccaggctggggtgcagtggtgtgatctagactcactgcaacctgcgcctccagggttcaagagattctcctgcctcagcatcttgagcagctgggactacaggtgcatgctaccatgccggggtaatttttgtatttttagtagagatggggtttcaccatgttggccaagctggtctcgaactcctgacctcaggcaatctgcctgcctcagcctcccaaagtgctgagattacaggcgtgggccactgtgcctggccacattcatttgttgatgacacttaggttgcttccaaatcttggctaacatgaatagtgctgtaacaa

SEQ ID NO: 2622 - DNA, 444 bp, Homo sapiens
  chr2.fa.O7frz.44377064
  Located on chromosome 2
  Distance between a terminus base of telomere on chromosomal short arm and 5'-terminus of this base sequence : 42544517
  Distance between 3'-terminus of neighbour sequence of sequence listing upward to telomere on chrosomal short arm and 5'-terminus of this base sequence : 165424
acaactaaatgtcacaagtgattcacaaggaaatcttgggccagaattttttttttcttttgccataaagaacattactgggacaactaacaaatctgaataaagtctctagattagacaacagtactgtaacaaggttaatttcctgagtccgattattatactgaactaatatatgagaatatccttggtttttatttttaggaaatactctttcaaatatttagcagtagagggacatttattctgaaattttactttcaaactgttaagaactatatatatatatatatatagtgttagagtttatggaaggccattattttggactgagctctcgcactaggccccagcagatcagactagaaagcagtcacttgtgcttagtgccaagattcacagcaaccaatcagaaggggccagtttacctgagtaggcataagg

SEQ ID NO: 2623 - DNA, 228 bp, Homo sapiens
  AC013396.4_164
  Located on chromosome 2
  Distance between a terminus base of telomere on chromosomal short arm and 5'-terminus of this base sequence : 42659535
  Distance between 3'-terminus of neighbour sequence of sequence listing upward to telomere on chrosomal short arm and 5'-terminus of this base sequence : 114574
aaatgttcagactgcagacatcaactcttttaaaaatcaaagtgtagtcttgaatttggtatattatctagtccttacccaaaagaatgttccaggattcagaggctcaaagcttcttctttgatgttactgtactaccttattccttgctttatttatttatttatttatttattttatttatttattttttttgagacggaatctcactcttctgtccaagctgga

SEQ ID NO: 2624 - DNA, 243 bp, Homo sapiens
  D2S2259
  Located on chromosome 2
  Distance between a terminus base of telomere on chromosomal short arm and 5'-terminus of this base sequence : 42709030
  Distance between 3'-terminus of neighbour sequence of sequence listing upward to telomere on chrosomal short arm and 5'-terminus of this base sequence : 49267
gcagagccatcgccttctgcgtcagggagggagcacaaaggcctatgctcatgtctacaacctctgaaatgtgtgtgtgtgtgtgtgtgtgtgtgtgtgtgtgtgagtgtgtgtgtgaaagagagagagagagaggcagtgagagagagactggttcccattttccagggctgctgtgggaggatgccccggatgccccaggactacattacctgggtctcataggtgtccccaaacaggctg

SEQ ID NO: 2625 - DNA, 386 bp, Homo sapiens
  AC013396.4_29951
  Located on chromosome 2
  Distance between a terminus base of telomere on chromosomal short arm and 5'-terminus of this base sequence : 42728774
  Distance between 3'-terminus of neighbour sequence of sequence listing upward to telomere on chrosomal short arm and 5'-terminus of this base sequence : 19501
ggtgcctagcatatagtaagcactatttaagtatttgataaaataaataaacccggccgggcgtggtggctcatgcctgtaatcccagcactttgagaggcagaggcggatgtattgcttgaggccactagcctggccaacatggtgaaaccctgtctctactaaaaatacaaaaattagccaggcctggtggtgggcacctgtaatcccagctacctgggaggctgaagcacgagaatcgcttgaacctgagaggtgaggttgcagtgagctgagattgcgctactgcactccagcctgggtaacagggggagactctgtcttaaataaataaataaataaataaactcaatacaaccctctcattttacagccgatttagccag

SEQ ID NO: 2626 - DNA, 101 bp, Homo sapiens
  DISD22_0001587
  Located on chromosome 2
  Distance between a terminus base of telomere on chromosomal short arm and 5'-terminus of this base sequence : 42909340
  Distance between 3'-terminus of neighbour sequence of sequence listing upward to telomere on chrosomal short arm and 5'-terminus of this base sequence : 180180
ccttccactcatgtgcacacatgtgcatgagagtgtgtgtgtgtgtgtgtgtgtgtgcatgtgtgagagagtgggagtacaagggagagtgcccttgtagc

SEQ ID NO: 2627 - DNA, 167 bp, Homo sapiens
  DISD22_0001592
  Located on chromosome 2
  Distance between a terminus base of telomere on chromosomal short arm and 5'-terminus of this base sequence : 43028203
  Distance between 3'-terminus of neighbour sequence of sequence listing upward to telomere on chrosomal short arm and 5'-terminus of this base sequence : 118762
tcctctggacatcttgcctgcaggcagttaaaacagattgttttgcatctctctctctctctctctctctctctctctctctctctctctctctctctctctctctctctctcgctctctcgctctctctctcgctctcattttgtggtcttcgatgtactaatgtg

SEQ ID NO: 2628 - DNA, 202 bp, Homo sapiens
  chr2.fa.O7frz.45121845
  Located on chromosome 2
  Distance between a terminus base of telomere on chromosomal short arm and 5'-terminus of this base sequence : 43127581
  Distance between 3'-terminus of neighbour sequence of sequence listing upward to telomere on chrosomal short arm and 5'-terminus of this base sequence : 99211
ggttgtagattgtctgcgaagatggtcactgacaattcctctcctctctgtattagaatgctgttcttcccttcaaaaggtggagccagttccgcaccacacacacacacatacacacacacacacacacacacacacctgcatacccccacctcttccttggctctaggctgcccttgtgacttgctctgaccaatagaat

SEQ ID NO: 2629 - DNA, 408 bp, Homo sapiens
  AC010883.5_113270
  Located on chromosome 2
  Distance between a terminus base of telomere on chromosomal short arm and 5'-terminus of this base sequence : 43151816
  Distance between 3'-terminus of neighbour sequence of sequence listing upward to telomere on chrosomal short arm and 5'-terminus of this base sequence : 24033
gcatagatacacctggaacaggatccaggcccctggatgtcactcttttgtgttttacacttcactggcctcacttatggccacctaaaccccttagctcctgggccaagtcttcagggactccaagggagatggagatgccttgcaaggatgtctttggagacctcaattgggacaggtccctgcctggcagttgtgtgtgtgtgtgtgtgtgtgtgtgtgtgtgtgtgtgtgtacacccaccctcccgaggcattgtctagagggggcattgtccagagggctgggcggttgcctttatggccaggcataaaaggtaatcattgaccacatcaatgccgccctgcgcgtcagtgcccgcccaggctcgaccctgccaggccctggattactttacagtcacataaa

SEQ ID NO: 2630 - DNA, 284 bp, Homo sapiens
  AC010883.5_5008
  Located on chromosome 2
  Distance between a terminus base of telomere on chromosomal short arm and 5'-terminus of this base sequence : 43157909
  Distance between 3'-terminus of neighbour sequence of sequence listing upward to telomere on chrosomal short arm and 5'-terminus of this base sequence : 5685
gagacaggacctcacttgactggcccacagccaggccctggctgtgttgacaaatgggtccttccccctggcctggtgagctgagatgtggcattgttaagctgcaagtgagtcacagaacttttccttccctttcttcctctctgccctgcttgtcccacaccctgctcattttttttttctctctctctctctctctctcacacacacacacacacacacacacttgcctttcagaacctgtgaactataaataagtgctttatcaccataaatgacttgat

SEQ ID NO: 2631 - DNA, 378 bp, Homo sapiens
  chr2.fa.O7frz.45328072
  Located on chromosome 2
  Distance between a terminus base of telomere on chromosomal short arm and 5'-terminus of this base sequence : 43446082
  Distance between 3'-terminus of neighbour sequence of sequence listing upward to telomere on chrosomal short arm and 5'-terminus of this base sequence : 287889
ctatactttgaaggaatcaaacactaaattttatatacgtgtgtgtgtgtgcacacacgtgccaaaggccaggaagacagctatgaagtgggatagaatgttccacatcggtagaaaaaacgtatttaggatatctacacacacacacacacacacacacacacacacacacacacacacacacacatgcacagtgagtgaggtgattaaaggagatgaaaatggcggtatacacaatgctactctcactctcctactcacacataataagataccaatatttggttttgatgtgcccattctagtagtaaaagtagacacttctgtgaacatatacacaaagaggtgcagatgcttcaataacaagtttatttgctt

SEQ ID NO: 2632 - DNA, 229 bp, Homo sapiens
  D2S2294
  Located on chromosome 2
  Distance between a terminus base of telomere on chromosomal short arm and 5'-terminus of this base sequence : 43637648
  Distance between 3'-terminus of neighbour sequence of sequence listing upward to telomere on chrosomal short arm and 5'-terminus of this base sequence : 191188
ctgaatggacacactggttaagtgaacaggggaggtgacctaaatgtaattacattcgtgtgtgtgtgtgtgtgtgtgtgtgtgtgtgtgtgtgtgtgacggggtcccactctgttgcccaggctggagtgcagttgcgcaatcttggctcactgcaacctccacctcctggattcaagtgattctcccacctcagcctcccaagtagctggcattacagtcatgggcc

SEQ ID NO: 2633 - DNA, 326 bp, Homo sapiens
  AC011242.4_160059
  Located on chromosome 2
  Distance between a terminus base of telomere on chromosomal short arm and 5'-terminus of this base sequence : 43743211
  Distance between 3'-terminus of neighbour sequence of sequence listing upward to telomere on chrosomal short arm and 5'-terminus of this base sequence : 105334
gaaatcgcttggtagtctaataggagtaagtccttgaaaaggctagagcactttcttttatttgcctattgtatcagctaggattaagttcaatcttctacacacacacacacacacacacacacacacacacacacacaaaattaatactgacttaatcagaatagaagtatatttagcgctcacatagagagcgaggcatcctggcacctctgtgaagccattagggtcatgggctttatcctgttctctcttctgccatccctagggtgtcatcaccatggtcctgggagtctgccagagtgccagctaatgtcagtgttccg

SEQ ID NO: 2634 - DNA, 222 bp, Homo sapiens
  D2S119
  Located on chromosome 2
  Distance between a terminus base of telomere on chromosomal short arm and 5'-terminus of this base sequence : 43835954
  Distance between 3'-terminus of neighbour sequence of sequence listing upward to telomere on chrosomal short arm and 5'-terminus of this base sequence : 92417
cttggggaacagaggtcattctcatcatgttccacctttctttctccctaccagtttggaagcattttcagaggaaggtgttcaaactccctactcctcagtgtgtctagagtatcctcctgcacgcgcgcgtgcacacacacacacacacacacacacacacacactcccctccatttgacagatgaggagactcaaatccaaagaaattgagggattctc

SEQ ID NO: 2635 - DNA, 194 bp, Homo sapiens
  D2S2298
  Located on chromosome 2
  Distance between a terminus base of telomere on chromosomal short arm and 5'-terminus of this base sequence : 43904237
  Distance between 3'-terminus of neighbour sequence of sequence listing upward to telomere on chrosomal short arm and 5'-terminus of this base sequence : 68061
cttgagtccagaaggcagaggttgcgccactgcactccggcctgggcaacagaacaagactctctctctctctctctctctctctctctcacacacacacacacacacacacacacacacacacacaagttcatcagaacatttacatagtattaatcaagcttaattttatacttcgctttcaaagatgcata

SEQ ID NO: 2636 - DNA, 435 bp, Homo sapiens
  chr2.fa.O7frz.45953438
  Located on chromosome 2
  Distance between a terminus base of telomere on chromosomal short arm and 5'-terminus of this base sequence : 44111158
  Distance between 3'-terminus of neighbour sequence of sequence listing upward to telomere on chrosomal short arm and 5'-terminus of this base sequence : 206727
ggtgaaagctaaggtgactatctatgatctgctaataagaaaactatagcatttaaaatcaggactgtttcagaaatcctggaatattattactgataacaatttagcaagtggttaaaaaacaaatggcatggtgttccaataaatatgtattaatttgttttaaataaaaaattgtttcagtgagagcaaaaaaagccttattttcagacaagtaagataataggctagagaagtgtgtgtgtgtgtgtgtgtgtgtgtgtgtgtgtgtgtgtgtggtggcatgattatcgaggaaggatcttgaggggtagtctgaagagtttgaattagatacaaaaagagttctgggccaagtgtggtggctcatgcctataatcccaggattttgggaggtcaaggcaggaagattgcttaaggctaggagtttgagac

SEQ ID NO: 2637 - DNA, 475 bp, Homo sapiens
  chr2.fa.O7frz.45859314
  Located on chromosome 2
  Distance between a terminus base of telomere on chromosomal short arm and 5'-terminus of this base sequence : 44121746
  Distance between 3'-terminus of neighbour sequence of sequence listing upward to telomere on chrosomal short arm and 5'-terminus of this base sequence : 10153
tactttgctgaagtcttcaaaggaaattcatctaaaaaatatcgattaatgattccaactccacggtcaaaaattcttagacttgataaactgaagtcctcttatcctacacaattttacgatgagactttgtccctgatctaaaagtatcatgtgtatgattttcttatcaagagacaattaactaacaccagacaccagcacctctctcaacctctttaaacaattagcatcaaattatgtcttttcttttggaaattaaaaaggaaatcactaacaaatgctacccaattaccaattacaagattttgtttttcctatttgatagtgggcttacaaatactagtgggttgttgttgttgtttttgttgttgttgttgtttttcctggctataccatcaggagtctgacaattttgatggaacattttccatcagcaacaaaagtattggttcacctaatttgacactatcaa

SEQ ID NO: 2638 - DNA, 318 bp, Homo sapiens
  AC016703.4_28524
  Located on chromosome 2
  Distance between a terminus base of telomere on chromosomal short arm and 5'-terminus of this base sequence : 44370555
  Distance between 3'-terminus of neighbour sequence of sequence listing upward to telomere on chrosomal short arm and 5'-terminus of this base sequence : 248334
gaactccaaagcatctagaattaagtttgtttgtttgtttgtttgtttgtttgttttgagacagagtcttgctctgtcaccaggctggagtgcagtggtgcaatcttggctcactgcaacctccgcctcccgggttcaagcgattctcctgcctcagcctcctgattagctgggactacaggcatgtgccaccacgcccagctaatttttgtatttttagtagagacggggtttcaccatgttggccaggatggtctcgatctcttgacctcatgatccacccaccttggcctcccaaagtgctggtattacaggcgt

SEQ ID NO: 2639 - DNA, 406 bp, Homo sapiens
  AC016703.4_171241
  Located on chromosome 2
  Distance between a terminus base of telomere on chromosomal short arm and 5'-terminus of this base sequence : 44392870
  Distance between 3'-terminus of neighbour sequence of sequence listing upward to telomere on chrosomal short arm and 5'-terminus of this base sequence : 21997
gtatcttcgagaaagcgtatttttgaaacatacttatttgagttaaaattgtgaaatgcatttaaaaattgaaattgaaagtagaactactggagaagttttaaatatttgtgagtacatgtatgtgtgtatgtgcatgtatacttatgtgtgtgtatatatatatatatatatatatatatatatgtatgtacataaaatacatagttaacttgttcttcatttggttcttgtttatttatagattggaacagaaagagcaatctccacaagtgtttattaagttcctattatgtgctgtcctgcattttcaattctcaaatgatttatcaactttgaagtacaaagtagtaaaacattctttctacacatgttgaagaaactactgcaagttaaatttggataa

SEQ ID NO: 2640 - DNA, 406 bp, Homo sapiens; identical to SEQ ID NO: 2639
  AC019184.2_7794
  Located on chromosome 2
  Distance between a terminus base of telomere on chromosomal short arm and 5'-terminus of this base sequence : 44392870
  Distance between 3'-terminus of neighbour sequence of sequence listing upward to telomere on chrosomal short arm and 5'-terminus of this base sequence : -406

SEQ ID NO: 2641 - DNA, 436 bp, Homo sapiens
  chr2.fa.O7frz.46285086
  Located on chromosome 2
  Distance between a terminus base of telomere on chromosomal short arm and 5'-terminus of this base sequence : 44534543
  Distance between 3'-terminus of neighbour sequence of sequence listing upward to telomere on chrosomal short arm and 5'-terminus of this base sequence : 141267
cactcaagttgcttagagtctaactcaggaggtaagacacatacacatacacacacacacacacacacacacacacacacacacacacactctctctctctctctctctttctctctccatatatgtatatatttctatacatgtgtaaagaaacttggctggcaattcaaggcattatatagaaagatctaaatgagttagttgcaagataagaagaggtcagagaaagaaggaagagggagaggggaggtttcctggaagaggcagaaccactgtcaggcctagaagcagggacagtattccgagaaactggggtctcaggatagcagttatggggtacttaagacagagaccagataaaagatcatcccagaatggcttcatctggtgagctgtgtgtgggagataaaactggaaacctagactaatttaggt

SEQ ID NO: 2642 - DNA, 475 bp, Homo sapiens
  AC019184.2_94813
  Located on chromosome 2
  Distance between a terminus base of telomere on chromosomal short arm and 5'-terminus of this base sequence : 44538141
  Distance between 3'-terminus of neighbour sequence of sequence listing upward to telomere on chrosomal short arm and 5'-terminus of this base sequence : 3162
ggtaagattagcaaattgcatcttttatatagagagttatcttttgtctataacattcatcagtatctgatcatattcttttggatctggctatcttagactgctaggacacacacacacacacacacacacacacacacacacacacacacacacatacatgcacatacccctatacctatgaccaatttcacatctaagttctgacatttagccctaaaatctccttcttagcccaaagccgctgttggccttgtcctggaaattccaacttttagcattttcttcagtggtcacttgtgtgatgcatctctcctgaggtctacatcagagcaggctcagcctcattctgccacgaccatttccatcatcacaagtacttgatctgtttcacgttttatggaatcgataaatctcatccctaaagagtccagcaggcctttgattcctgacctgacatttgctaatgctattc

SEQ ID NO: 2643 - DNA, 275 bp, Homo sapiens
  AC019184.2_82010
  Located on chromosome 2
  Distance between a terminus base of telomere on chromosomal short arm and 5'-terminus of this base sequence : 44550954
  Distance between 3'-terminus of neighbour sequence of sequence listing upward to telomere on chrosomal short arm and 5'-terminus of this base sequence : 12338
tcgtacaccaaaccttagtgacacttgaattactcatgtaacaaacttgaatacataccccctgaacctaaaataaaagtctggaaaatgtgtctctgtgtgtgtgtgtgtgtatgtatgtatggatagatagatagatagatagataaacagacagacattatctgtctatctaactatctatctatcatctatctagaatccaaaataaaattaattctcagtttctacaacagatggttcttcaaaggcttagatccactaaagctatccaa

SEQ ID NO: 2644 - DNA, 219 bp, Homo sapiens
  Z66794
  Located on chromosome 2
  Distance between a terminus base of telomere on chromosomal short arm and 5'-terminus of this base sequence : 44717216
  Distance between 3'-terminus of neighbour sequence of sequence listing upward to telomere on chrosomal short arm and 5'-terminus of this base sequence : 165987
agcattgtcttgctttctggacgtgtgtgtgtgtgtgtgtgtgtgtgtgtgtgtgtgtgtacctgtatgcatgtgagtgctatatcggtcttacatacattcttctttaaataagggcatggaattgatttttctaatgaataaaagttttttgcctaaaatattttactaagttgctattctagtccaacttttattattcagttcagtgcaatgaaa

SEQ ID NO: 2645 - DNA, 291 bp, Homo sapiens
  AC067957.4_103713
  Located on chromosome 2
  Distance between a terminus base of telomere on chromosomal short arm and 5'-terminus of this base sequence : 44727952
  Distance between 3'-terminus of neighbour sequence of sequence listing upward to telomere on chrosomal short arm and 5'-terminus of this base sequence : 10517
agctgagatcatgctactgtactcgagcctgctctgtctcaaacaaaacaaaacaaaacaaaacaaaacaaaacaaaacaaaaccttacagtagtatactgccattggtcccctgccagtctttatgctactattgtcctactttttatctatacatatattatcaccccacaatacttgcttgtttaaccaattatatttaaagaggtttaagtaataagaaacagtcatatatatatttacctatatagttagtatttctgattccttcatgtacatttccatctgata

SEQ ID NO: 2646 - DNA, 434 bp, Homo sapiens
  AC067957.3_166333
  Located on chromosome 2
  Distance between a terminus base of telomere on chromosomal short arm and 5'-terminus of this base sequence : 44837300
  Distance between 3'-terminus of neighbour sequence of sequence listing upward to telomere on chrosomal short arm and 5'-terminus of this base sequence : 109057
caattgctcaaagtcaagtaacttgtcttttctccaagtcaggtttgtaacgaagcctctggctttgcagctaaggctagttcttgcccactatgctcttctgtccgtgtgtgtgtgtgtgtgtgtgtgtgtgtgtgtgtgtttgggggctgggtggggggcagcaaattactcctttaatccgtgacctcctgccctttcatgtgcctccttctttcttccctttccctaaactttcactactgaaaaagaagtttggtggcatgttatcaaaactgcagtggcaaccccagctacttttatatttaaaagctgttatgagaaggtgatattgccaaatgggctaccgaagagattgtgttgtaacatattagaaaagaaacttaaaatagctgaatgtgcccctgccacggtgagcttgacttgtaaatgac

SEQ ID NO: 2647 - DNA, 350 bp, Homo sapiens
  chr2.fa.O7frz.46820987
  Located on chromosome 2
  Distance between a terminus base of telomere on chromosomal short arm and 5'-terminus of this base sequence : 45055447
  Distance between 3'-terminus of neighbour sequence of sequence listing upward to telomere on chrosomal short arm and 5'-terminus of this base sequence : 217713
cacttaggataatggcctctagctgtattcatgttcctgcaagggacatgatttttttttttttaatcacacacacacacacacacacacacacacacacatgcactatctttatccagtacatcactgatgggcatctgggttgattccatgtctttgctattgtgaatgctgttgcaagtgaatgtgtcttttggtagaactaggtaactgtttaaaacatactgtaattaatatgccgttggtccatgcataatgagatgagcacacaggataactggcccatttgaaagtagacgtgtgtatcccagagcagagagagccacctaaggtcattgagtactcaccta

SEQ ID NO: 2648 - DNA, 400 bp, Homo sapiens
  chr2.fa.O7frz.47004853
  Located on chromosome 2
  Distance between a terminus base of telomere on chromosomal short arm and 5'-terminus of this base sequence : 45159608
  Distance between 3'-terminus of neighbour sequence of sequence listing upward to telomere on chrosomal short arm and 5'-terminus of this base sequence : 103811
ggactagatcataggtctcctaactccttgttcagtacttaagacttatcactcaaaaattaatttttgagggttaacaatgtgtaatggacagctcttattcctcactcaatttcacagaccttggaataacagatgtgatgtgtgtgtgtgtgtgtgtgtgtgtgtgtgcacgcacgcttgtgtatgtgtgttaacagccacggggaaggatcattgtcctgccatgggcctgagagggcacaggtgtttcatgacaacatcacatccacctccatggattccttgtcagaggaaacagagcatagtatgccgatcccacacctaccacctcctgaagtcattcatgccttaacgaggggcatagactgagacctggtcttatctgtcagctgtcaaa

SEQ ID NO: 2649 - DNA, 315 bp, Homo sapiens
  chr2.fa.O7frz.46931351
  Located on chromosome 2
  Distance between a terminus base of telomere on chromosomal short arm and 5'-terminus of this base sequence : 45177024
  Distance between 3'-terminus of neighbour sequence of sequence listing upward to telomere on chrosomal short arm and 5'-terminus of this base sequence : 17016
gtagaacacaagacctacatgaactccagaaccttccaccgatcccttctgctgcctcaatttcaagtccctcaccccagctttctgtctgccccacctttaatcccatttatctctctcactcatcctctggagggggcatgttcattcctgcttacctgcctgtgctcatgggatgccccctgtctggaatgtcctccctcatcccattttccttcttttatttatttatttatttatttatttatttatttattttttcagacaggatctcactatgtcgcccaggctggagtgtagtgatgcaaatacggc

SEQ ID NO: 2650 - DNA, 401 bp, Homo sapiens
  AC009236.3_114111
  Located on chromosome 2
  Distance between a terminus base of telomere on chromosomal short arm and 5'-terminus of this base sequence : 45239663
  Distance between 3'-terminus of neighbour sequence of sequence listing upward to telomere on chrosomal short arm and 5'-terminus of this base sequence : 62324
ggaaagagtagctaagtcttcattctgtcttcttgaccagtttggctctgggcgaaacttgccaacccctcgggaaaaaatgtgttgcaactatctatcgggagtccttgagcatctctcgcagccacactttgcttctcatgagatagatcagagtttaatgcttccccttcacagtctccgggaagaatccagtaaatatgttttccatcgtgtgtgtgtgtgtgtgtgtgtgtgtgtgtgtgtgtgtgtgtattagatcaacatcctggggaaaggccttggctgacccatcttttaatcagtataattatatcttatgcacctacactacatactagcccaatgctgacaaaacatgctctttgccttcagcaagctttccatcttcataaggaaag

SEQ ID NO: 2651 - DNA, 472 bp, Homo sapiens
  AC009236.3_81473
  Located on chromosome 2
  Distance between a terminus base of telomere on chromosomal short arm and 5'-terminus of this base sequence : 45332115
  Distance between 3'-terminus of neighbour sequence of sequence listing upward to telomere on chrosomal short arm and 5'-terminus of this base sequence : 92051
acatttggtcctttaatctgtccaacccaataatgaactatttctatctctcctctgccaaccaatccaaatccagtcacttcagaatgcaactcaagggcacccttccccacaccttcctgtccatgcatgcctctgagtctctcttctgctcactgcttattttgctcaatttctgccttattagccacagcacaaagcacctgccataggtccctcaacaatgacatgagtaaattggttgcaaaaaagtgggcaaatgaatgagtaaaaagtgtatgatgcagatacaaccccccacccgagagagagagagagagagagagagagagagagagagagagagagagagagagagagagagagagagagtcctgtttgcctattttgtgtttctttttcatagatacatgtcttgtgtgtttaaccagctataagacttctgccttactactttagttaagacctggcc

SEQ ID NO: 2652 - DNA, 451 bp, Homo sapiens
  AC009236.3_206653
  Located on chromosome 2
  Distance between a terminus base of telomere on chromosomal short arm and 5'-terminus of this base sequence : 45332115
  Distance between 3'-terminus of neighbour sequence of sequence listing upward to telomere on chrosomal short arm and 5'-terminus of this base sequence : -472
acatttggtcctttaatctgtccaacccaataatgaactatttctatctctcctctgccaaccaatccaaatccagtcacttcagaatgcaactcaagggcacccttccccacaccttcctgtccatgcatgcctctgagtctctcttctgctcactgcttattttgctcaatttctgccttattagccacagcacaaagcacctgccataggtccctcaacaatgacatgagtaaattggttgcaaaaaagtgggcaaatgaatgagtaaaaagtgtatgatgcagatacaaccccccacccgagagagagagagagagagagagagagagagagagagagagagagagagagagagagagagagagagagtcctgtttgcctattttgtgtttctttttcatagatacatgtcttgtgtgtttaaccagctataagacttctgccttac

SEQ ID NO: 2653 - DNA, 444 bp, Homo sapiens
  AC009236.3_13717
  Located on chromosome 2
  Distance between a terminus base of telomere on chromosomal short arm and 5'-terminus of this base sequence : 45400084
  Distance between 3'-terminus of neighbour sequence of sequence listing upward to telomere on chrosomal short arm and 5'-terminus of this base sequence : 67518
gttgtagcatgcacctgtagtcccagctactcgggaggctgaggtaggattgcttgacccaggaggttgaggctgcagtgagtggtgatagcaccagtgcacttcagcctgtgtgtgtatatatttatacacacacacacacacacacacacacacacaattattttactaccctttttgtggttcccctagagattacaacatgcatcttaatttgctaggatcagatataaatttatatttttaccaatgaagggactacagaatattttagttccctttactcttttcctgctttttgtgttattattgtcatgaaggttttttttttttacataaacaccttaatataagtgtttttatacagtcagtattcattatatatatatatccacatacttttctggttttggtatcaaggtaatgctggtttcatagaattag

SEQ ID NO: 2654 - DNA, 172 bp, Homo sapiens
  D2S2280
  Located on chromosome 2
  Distance between a terminus base of telomere on chromosomal short arm and 5'-terminus of this base sequence : 45544134
  Distance between 3'-terminus of neighbour sequence of sequence listing upward to telomere on chrosomal short arm and 5'-terminus of this base sequence : 143606
tgagcagagattgcaccactgcactccagcctggaggacacagcaagactccgtctcaaaacacacacacacacacacacacacacacacacacacacacacacacacgcaaagaagaaactaaaggtcatattttccctttcttccaatctactccccaggcttagaaacc

SEQ ID NO: 2655 - DNA, 235 bp, Homo sapiens
  D2S2291
  Located on chromosome 2
  Distance between a terminus base of telomere on chromosomal short arm and 5'-terminus of this base sequence : 45631401
  Distance between 3'-terminus of neighbour sequence of sequence listing upward to telomere on chrosomal short arm and 5'-terminus of this base sequence : 87095
tgtcaacagtggctaatcatcacctagatttataaatttacattctaaagctgaaccctgaagtagacatcttctggcccagaaatgccctccttttctcagagaacacccccccacaaccctaacacacacacacacacacacacccacaaccctaacacacacacccacacccacaaccctcacacacacacacacacacacacacacacagccctggcagccatatttctaa

SEQ ID NO: 2656 - DNA, 388 bp, Homo sapiens
  U51244.1_33376
  Located on chromosome 2
  Distance between a terminus base of telomere on chromosomal short arm and 5'-terminus of this base sequence : 45706728
  Distance between 3'-terminus of neighbour sequence of sequence listing upward to telomere on chrosomal short arm and 5'-terminus of this base sequence : 75092
gtttcctgattcctagtaaggtacttacattgctatatcatgctgcatccagtcaccattcatccatcatgcttccatcattcatccatctctacatccatccatctgtctatgcatccatccatccatccatccatccatccatccacccacccatccattcatccatctctatatccatccatccatccacccatcaattcgtccatccatctcttcattcatccattcattcatccatctctacatccatccatccatccatctatgtatccatccatccatctattcatctatctctccatccatccatccagccagccagccagccagctggacagccaggcagccagacagcctgtcagtttattggtcatatagttgatgc

SEQ ID NO: 2657 - DNA, 329 bp, Homo sapiens
  U51244.1_53838
  Located on chromosome 2
  Distance between a terminus base of telomere on chromosomal short arm and 5'-terminus of this base sequence : 45727085
  Distance between 3'-terminus of neighbour sequence of sequence listing upward to telomere on chrosomal short arm and 5'-terminus of this base sequence : 19969
tgaacttgattactctgcaaaggccatatttccaaatcaggtcacattcatcagtaccgagggctaggacttctacatacatttttaggggacacaattcaacccataaaaccatttgtcctcaagatgcttccaattcagtgagggagactgatggaaaagatgatggaatcagtgctacaaggggccggagcactgtgctgaagagtccaagggaggacacacacacacacacacacacccatgcacacacacccccacacacaccccactccaccccacactaaacacacatctatcacatgatgtagaatcggtccattctaaat

SEQ ID NO: 2658 - DNA, 298 bp, Homo sapiens
  AC017078.7_51772
  Located on chromosome 2
  Distance between a terminus base of telomere on chromosomal short arm and 5'-terminus of this base sequence : 45846210
  Distance between 3'-terminus of neighbour sequence of sequence listing upward to telomere on chrosomal short arm and 5'-terminus of this base sequence : 118796
cagtaggtgttactaaacatccacagagacacagaacattggggacaaagagatcgttgtgtaaagaaatgactcaaattatatactgtaagtagagtgtgtgtgtgtgtgtgtgtgtgtgtgtgtgtgtgtgtgtgtgttgtgggtagggacatgccccagggggagcgacctcttttgggcaacgctttgcagccctgcctgcaaccctaggccttgtcatgatagcagcagctcatttcttattgagctttgcagttgatgtgtaatcaggcttcacagtttatcaagtaccaac

SEQ ID NO: 2659 - DNA, 183 bp, Homo sapiens
  D2S2240
  Located on chromosome 2
  Distance between a terminus base of telomere on chromosomal short arm and 5'-terminus of this base sequence : 45846215
  Distance between 3'-terminus of neighbour sequence of sequence listing upward to telomere on chrosomal short arm and 5'-terminus of this base sequence : -293
ggtgttactaaacatccacagagacacagaacattggggacaaagagatcgttgtgtaaagaaatgactcaaattatatactgtaagtagagtgtgtgtgtgtgtgtgtgtgtgtgtgtgtgtgtgtgtgtgtgttgtgggtagggacatgccccagggggagcgacctcttttgggcaacgc

SEQ ID NO: 2660 - DNA, 464 bp, Homo sapiens
  AC017078.7_121394
  Located on chromosome 2
  Distance between a terminus base of telomere on chromosomal short arm and 5'-terminus of this base sequence : 45963949
  Distance between 3'-terminus of neighbour sequence of sequence listing upward to telomere on chrosomal short arm and 5'-terminus of this base sequence : 117551
caaattcacattacttcacaagtatctttaatttttgctccactagaaagaaaccacaattgggctgggcatggtggctcacacttataatctgaatactttgggaggttgaggcagtaggattgcttgagcccaggagtcaagaccagcgtgggcaacatggagagaccatgtctctacaaaaaaaaaaaaaaaatttaaattagccaggcatggtggcatgtgcctgtagtcccagctacttgtgaggctgaggcaggagcattgcttgatcgtgggaggttgaggctgcagtgagccatgatcatactactgcactccagcctgggcagcaaagcgagacactcactctctctctcacacacacacacacacacacacacatagaaaatggaaatggaaatcatagataatgtttgtctgtaagagatgatgagggggaccataccttaaagaaattggcc

SEQ ID NO: 2661 - DNA, 238 bp, Homo sapiens
  D2S2182
  Located on chromosome 2
  Distance between a terminus base of telomere on chromosomal short arm and 5'-terminus of this base sequence : 46067769
  Distance between 3'-terminus of neighbour sequence of sequence listing upward to telomere on chrosomal short arm and 5'-terminus of this base sequence : 103356
gctcgaaaaatgatttgatccacaaaggttctcacctcccaaatgttctaccaatacttgtcatggtctttggtgtagtattaaatatatacaatgatggaattaaggcatagtaacaacttcacacacacacacacacacacacacacacacacacacacacacacacacacattttccagatatttccttgcgaatgaccatcttattccattacatcaagcatctaggcttagcc

SEQ ID NO: 2662 - DNA, 185 bp, Homo sapiens
  DISO7_00011366
  Located on chromosome 2
  Distance between a terminus base of telomere on chromosomal short arm and 5'-terminus of this base sequence : 46180451
  Distance between 3'-terminus of neighbour sequence of sequence listing upward to telomere on chrosomal short arm and 5'-terminus of this base sequence : 112444
gtcagcatcttgaaagctgtgagtcactgcccctcacccatggctgtgctctcctgggctcctccccctacacacacacacacacacacacacacacacacacacacacacactcccttctccctttctctgtccagctttctccctcccacctctgctcatcaccacggaatgggaaggattaa

SEQ ID NO: 2663 - DNA, 315 bp, Homo sapiens
  chr2.fa.O7frz.48251972
  Located on chromosome 2
  Distance between a terminus base of telomere on chromosomal short arm and 5'-terminus of this base sequence : 46293763
  Distance between 3'-terminus of neighbour sequence of sequence listing upward to telomere on chrosomal short arm and 5'-terminus of this base sequence : 113127
tcaaagcacttctagtgacaagaaaagaggcaaaaaatggacaagtgaatgagtggtcagtgtggagcttggagaagcaccaggcagtgcaggatcccggtggaggtagtcctaacccagccaccagaggacagctggaggcctgtgggagccgtggaggaggggaaaagggtattagacagtggttgttcaaaatcagccactttttaaaaagaatcatttgtgtgtgtgtgtgtgtgtgtgtagacatatattcatgataaaaatcattacataatacaattgttgcttctaatcctaaactcaaatgcttta

SEQ ID NO: 2664 - DNA, 276 bp, Homo sapiens
  D2S288
  Located on chromosome 2
  Distance between a terminus base of telomere on chromosomal short arm and 5'-terminus of this base sequence : 46347198
  Distance between 3'-terminus of neighbour sequence of sequence listing upward to telomere on chrosomal short arm and 5'-terminus of this base sequence : 53120
agggccttgctctggattagactttggcttaagggaatattatgcctggtttgatcttctcactaagcttaatcattccttaacttttgatttaaagtgagagatgtgactcttcctttcattcgaacacatagagcccattgtagagttattaaaattggtctaatttcaatattgttgtgtctcagggaataggaaggattggggagggggagagagagatacacacacacacacacaaacacacacacgcacacagaggaacaatcactggac

SEQ ID NO: 2665 - DNA, 318 bp, Homo sapiens
  chr2.fa.O7frz.48343771
  Located on chromosome 2
  Distance between a terminus base of telomere on chromosomal short arm and 5'-terminus of this base sequence : 46400543
  Distance between 3'-terminus of neighbour sequence of sequence listing upward to telomere on chrosomal short arm and 5'-terminus of this base sequence : 53069
gctgtatgtgaacatggttaacccactcttaaggagtgagatctttcttttcttttattggttcctctgcctcttcctcatggcttttgggtttgatttgacagtacaacagggcccattatgatatctcagagaagtttctcactgtgctctctggcaaaacacacacgcgcacacacagacacacacacacaaacaacctagattcagccccactcaggaacccagagatggggtaggagtggaggtactcttttatgcctgtgaatgtgaccccaccttagcctgcccaagctttgaaattgtaacatctggttc

SEQ ID NO: 2666 - DNA, 392 bp, Homo sapiens
  AC018682.3_127466
  Located on chromosome 2
  Distance between a terminus base of telomere on chromosomal short arm and 5'-terminus of this base sequence : 46547860
  Distance between 3'-terminus of neighbour sequence of sequence listing upward to telomere on chrosomal short arm and 5'-terminus of this base sequence : 146999
aaatgtcattagaagtcagaaagaaaatttatttgggccatccactcctcattactttaggatgtacttttaaaaaaaacctgcattttgtaactacagcaaaagcattttctgctcctaaataagacaagtcaattttgtgtgtgtgtgtgtgtgtgtgtgtgtgtgtgtgtgtgtgtgtgtgtgtgtgttttaaggctccccgggtaaccgtgatgctgaccagctttaggaaccactgtcaatgaaagcagacatagtacaaggtctaggaagccccaggttacgtgtatataggaagaaatatatcaggtgaagccttaccagtcccctgccaggggcctgcctttgctctggcgttgggagtctgcacacagaatgtggaacttgga

SEQ ID NO: 2667 - DNA, 459 bp, Homo sapiens
  AC016722.8_5908
  Located on chromosome 2
  Distance between a terminus base of telomere on chromosomal short arm and 5'-terminus of this base sequence : 46918013
  Distance between 3'-terminus of neighbour sequence of sequence listing upward to telomere on chrosomal short arm and 5'-terminus of this base sequence : 369761
tatttgtattggtgcaagaaagcacagtggcaagggagctgacagggcgtggattccctctccgaggtctaggtgcaaactgctttggacacttcagggtttacagggtccacagcaccaccatcacctctcccttgtctgaccatcacttatgtttggggaaaggctaataattcctttccccaaagcaggtaagtctgagcgttttgattcttttcacattcttattcattttcgagtgattttggggtgtgtgtgtgtgtgtgtgtgtgtgtgtgtgtgtgttgtggagtttttctggtggccattttatacagggagaggtgaagaggagtcattcctggcatttgcaggaatgaaagagaagtgacacgtaaaaaccctggatgggatactaaggcctggaaaaggacattctgtgggacactgccgccatctagaggttcatctgtaaatgac

SEQ ID NO: 2668 - DNA, 209 bp, Homo sapiens
  D2S2227
  Located on chromosome 2
  Distance between a terminus base of telomere on chromosomal short arm and 5'-terminus of this base sequence : 47216083
  Distance between 3'-terminus of neighbour sequence of sequence listing upward to telomere on chrosomal short arm and 5'-terminus of this base sequence : 297611
cacgctgtccttctctgaatgtctggcactgtgttccattagcacttaattactttatacatatatatacacacacacacacacacacacacacacttggggctcaggacacaccaccctaaaatatgactgtttgagaccagaatatgccaccccaaaatatactttggcatattttatattttgagttggttattccgagaaactgc

SEQ ID NO: 2669 - DNA, 209 bp, Homo sapiens
  DISD22_0001599
  Located on chromosome 2
  Distance between a terminus base of telomere on chromosomal short arm and 5'-terminus of this base sequence : 47626237
  Distance between 3'-terminus of neighbour sequence of sequence listing upward to telomere on chrosomal short arm and 5'-terminus of this base sequence : 409945
gattccacctctagtgctttcttttagatttctttctctctttactttctttctttctttctctttctttctctctctctctctctctccctccctccctccctccctccctctctctctctctctctctctctctctctccctccctctctctccctctctctctctctctcctttctctctctctcttcttaagactgggtctcgca

SEQ ID NO: 2670 - DNA, 102 bp, Homo sapiens
  DISD22_0001604
  Located on chromosome 2
  Distance between a terminus base of telomere on chromosomal short arm and 5'-terminus of this base sequence : 47696652
  Distance between 3'-terminus of neighbour sequence of sequence listing upward to telomere on chrosomal short arm and 5'-terminus of this base sequence : 70206
cctaccaggtataaagcagtgtactataaactgtgtgtgtgtgtgtgtgtgtgtgtgtgtgtgtgtgtgtgtgtgtgtgtgatgaaccttactctccctgca

SEQ ID NO: 2671 - DNA, 451 bp, Homo sapiens
  chr2.fa.O7frz.49560558
  Located on chromosome 2
  Distance between a terminus base of telomere on chromosomal short arm and 5'-terminus of this base sequence : 47807718
  Distance between 3'-terminus of neighbour sequence of sequence listing upward to telomere on chrosomal short arm and 5'-terminus of this base sequence : 110964
tctatcttggcaaatacttcacccacttcagggagaaaggaaagaaagaggtgagaaatgaagaaccctttcttgccagagtgatattgagcacgttttcaaactccacatccggaaggcttaggatatgtacatggggtgtgtgtgtgcgtgtgtgtgtgtgtgtgtgtgtgtatgtgaatgtgcacatgagacacacatatatgttttttgttcctgcgatttctgggcaccatgtgcagtaaccaaagcagaatattcatcctgtgaatctgaacagcattaatgaagaatgtaggtctcctattccagccgggactcagagcggaacaatggcatagcgtgcatatttatttaggccttggcatctcagcaatgaaaaagttcatggaataaatgagcaaaagatggagaacttttctgctctgtgtttataggtttcagctgttcc

SEQ ID NO: 2672 - DNA, 202 bp, Homo sapiens
  DISO7_00001011
  Located on chromosome 2
  Distance between a terminus base of telomere on chromosomal short arm and 5'-terminus of this base sequence : 48075748
  Distance between 3'-terminus of neighbour sequence of sequence listing upward to telomere on chrosomal short arm and 5'-terminus of this base sequence : 267579
agcaggatttcaacctcggggagcctcagcccttagacaatggtggttaccagacagtgctaaacagttgggtccaaatgacacatttcactaggccttggacacaacacacacacgcgcgcgcgcgcaaacacacacacacacacacacacacacacacacacacacacaaaatatcccaaggggccagttctaagcaagg

SEQ ID NO: 2673 - DNA, 122 bp, Homo sapiens
  DISD22_0001607
  Located on chromosome 2
  Distance between a terminus base of telomere on chromosomal short arm and 5'-terminus of this base sequence : 48294887
  Distance between 3'-terminus of neighbour sequence of sequence listing upward to telomere on chrosomal short arm and 5'-terminus of this base sequence : 218937
aaggttattgaataatatcactcccccctttctctttcacacacacacacacacacacacacacacacacacacacacacacacacacacagtcttaagtgactattctactaaggccttga

SEQ ID NO: 2674 - DNA, 296 bp, Homo sapiens
  AC023103.3_2404
  Located on chromosome 2
  Distance between a terminus base of telomere on chromosomal short arm and 5'-terminus of this base sequence : 48399325
  Distance between 3'-terminus of neighbour sequence of sequence listing upward to telomere on chrosomal short arm and 5'-terminus of this base sequence : 104316
aggcaatggctaatctacttacatctctgtagatttgcctattctgggcatttcatacaaatagaatcatacagtatgtatttgtgtgtgtgtgtgtgtgtgtgtgtgtgtgtgtgtgtgtgactggcttctttcactgagcatgttttcaaggttcatccatgttgtagcatgtatcagaattttgttcctttttatgattgaataatgttccattgcatggatataccatattttctttatccattcaccaggtgacggacatttgggttgtttctactttctgactgctatga

SEQ ID NO: 2675 - DNA, 467 bp, Homo sapiens
  AC064831.3_168642
  Located on chromosome 2
  Distance between a terminus base of telomere on chromosomal short arm and 5'-terminus of this base sequence : 48428419
  Distance between 3'-terminus of neighbour sequence of sequence listing upward to telomere on chrosomal short arm and 5'-terminus of this base sequence : 28798
tccagttaggctgtattacaagagagattcccctgggggatttggagactgtaaatgaagcaacagccattttgaaacacacataccttgtctgtttccttgttggtgtgggcagtggccaggactggaactgctccatcttcccctggatcctccttcagcttctctgactcttgggccaggagtgtgtgtgtgtgtatctgtgtgtgtgtgtgtgtgtgtgtgtgtgtgtgtgtgtgcgcctaatttcatgacaaagggccctggcttctgcatgaccaaggtcagaggcaacaagtacaaacacaggtttttgcctgtcttattggctcaagcttgtgcttatgggttccagcttgttcttgctctccctattttacatcttgactgcctgccctgaggacttccagctccagcatcagatgcaatgacaatacccttacagagactagtattcaaccagcaac

SEQ ID NO: 2676 - DNA, 467 bp, Homo sapiens; identical to SEQ ID NO: 2675
  AC023103.3_105827
  Located on chromosome 2
  Distance between a terminus base of telomere on chromosomal short arm and 5'-terminus of this base sequence : 48428419
  Distance between 3'-terminus of neighbour sequence of sequence listing upward to telomere on chrosomal short arm and 5'-terminus of this base sequence : -467

SEQ ID NO: 2677 - DNA, 365 bp, Homo sapiens
  AC064831.3_125883
  Located on chromosome 2
  Distance between a terminus base of telomere on chromosomal short arm and 5'-terminus of this base sequence : 48470397
  Distance between 3'-terminus of neighbour sequence of sequence listing upward to telomere on chrosomal short arm and 5'-terminus of this base sequence : 41511
gtcagatcaactttgctgtaagtatttctttagaaatggctctgcagtttaagttttctcagctttcagaactcattgtttgctagcaagctaggctgctttaaccacctcccattagggaggagaggaagggagagaagggaagagaaaaagagatacataacacttacacacatacttaaacacacacacacacacacacacacacacatacacacacacacacagagacagacagagagacagagagaattgtccatgagaacattttaaaaatcaggatagatctacacaaagtagggctatggcagcatggttgcaatcactctacttaggagaaaatgtatgtgctacattcaccaatt

SEQ ID NO: 2678 - DNA, 365 bp, Homo sapiens; identical to SEQ ID NO: 2677
  AC023103.3_120517
  Located on chromosome 2
  Distance between a terminus base of telomere on chromosomal short arm and 5'-terminus of this base sequence : 48470397
  Distance between 3'-terminus of neighbour sequence of sequence listing upward to telomere on chrosomal short arm and 5'-terminus of this base sequence : -365

SEQ ID NO: 2679 - DNA, 242 bp, Homo sapiens
  AC023103.3_171949
  Located on chromosome 2
  Distance between a terminus base of telomere on chromosomal short arm and 5'-terminus of this base sequence : 48521482
  Distance between 3'-terminus of neighbour sequence of sequence listing upward to telomere on chrosomal short arm and 5'-terminus of this base sequence : 50720
agttacttcacttagagtgatggtctccaactccatccaggttgcagtaaatgccattattttgttcctttttatggccgagtagtattccatggtgtatatatatatatatatatatacatatatatatcacatgttctttagtctgttcgttggttgatggacatttagactggttccatatttttgcaactgtgaattgttctgctataaacacgtgtatgcgagagtcttatgacttc

SEQ ID NO: 2680 - DNA, 380 bp, Homo sapiens
  chr2.fa.O7frz.50213306
  Located on chromosome 2
  Distance between a terminus base of telomere on chromosomal short arm and 5'-terminus of this base sequence : 48607157
  Distance between 3'-terminus of neighbour sequence of sequence listing upward to telomere on chrosomal short arm and 5'-terminus of this base sequence : 85433
cttccaacttgttaaactctgtatgtaagtgttggaagcctccttataatcagccaaattaaatacaataattatgacagtggctgccatttagatcatatatatatatcatctaaatatatatatatatataatatatatatatatatatatttaagggacaggccttctcaaatttgggaggaaaattaaatgatgaaactcagccaaaaaaagtcaaatcaaaataatatagaaatagggactatagaagccattagggaagtattaataaagaaaatttaatttacttaaatataaaactaagattaaatgagaattatgattacagacgaaaggtgataaaattgagagtatggtacaatggtgaatatgctgat

SEQ ID NO: 2681 - DNA, 270 bp, Homo sapiens
  AC073082.3_4484
  Located on chromosome 2
  Distance between a terminus base of telomere on chromosomal short arm and 5'-terminus of this base sequence : 48878570
  Distance between 3'-terminus of neighbour sequence of sequence listing upward to telomere on chrosomal short arm and 5'-terminus of this base sequence : 271033
gagttattgctcaaggcattactttatctttagggactggaaaacctaaacacataactgaaattcaacttgagtcctttttgttcaacctctaagtgagcaattgtatggttggcattcactctttttcttttctttttacttaaaaaaaattttttgtaactattttttctttcttttactggtttctgtatttattattattattattattttttcaacttttagatcattttagatctaggggggtacatttgcaggtttgttacc

SEQ ID NO: 2682 - DNA, 386 bp, Homo sapiens
  AC073082.4_167643
  Located on chromosome 2
  Distance between a terminus base of telomere on chromosomal short arm and 5'-terminus of this base sequence : 48918198
  Distance between 3'-terminus of neighbour sequence of sequence listing upward to telomere on chrosomal short arm and 5'-terminus of this base sequence : 39358
tctagctatgtcagtggtacagtaatttaatctggttcttgaaattactctttatctcatacatttatttaagtaaagatagccacattagatatggagatgctatgaacaatgcaacagaatcatggaatgtttgtaaagctgctgcagtgattacaatgaaaatattgatcatttccttataacacacacacacacacacacacactatatgacccccatctaaaatctttgaaatatatccagtatctctgggtctggcactgaacctggcctggcatagcacagatgctcaataagtgacaaattgagtgaaaaccaatattagattaaaatattaaaggccaatatgcccatttctactctgtatagctgttccagtcaaa

SEQ ID NO: 2683 - DNA, 384 bp, Homo sapiens
  AC073082.3_143446
  Located on chromosome 2
  Distance between a terminus base of telomere on chromosomal short arm and 5'-terminus of this base sequence : 48920141
  Distance between 3'-terminus of neighbour sequence of sequence listing upward to telomere on chrosomal short arm and 5'-terminus of this base sequence : 1557
ctttaggaaatgctgagttactctattatggtagttttcagtttttttttttttaagacggcatctcactctgtcacccaggctggagtgcagtggcattatcttggctcactgcaacctccgcctcctgggtccaagcgattctcctgcctcagcctctcaagtaactgggattacagccacccaccaccacacccagctattattattattattattattattattattattattctatttttagtagagatggggttttgccatgttggccaggctggtctcaaactcccgaccttaggtaatctgaccctctcggcctccccaagtgctgggattacaggcgtaagccaccatgcctagcctattggtagcttaaagttt

SEQ ID NO: 2684 - DNA, 423 bp, Homo sapiens
  AC073082.4_91182
  Located on chromosome 2
  Distance between a terminus base of telomere on chromosomal short arm and 5'-terminus of this base sequence : 48994148
  Distance between 3'-terminus of neighbour sequence of sequence listing upward to telomere on chrosomal short arm and 5'-terminus of this base sequence : 73623
gtttcaccatattgaccagactggtcttgaactcctgaccttgtgatctgcccacctcggcctgccagatagacaccatatggttgggtcttgctaatttaacccagtatgataatctctatcttttaaatgagatgtttaggccatttatattcaatatagttattaatcaacttgtcagggtgtgtgtgtgtgtgtgtgtgtgtgtgtttgtgtgtgtgtgtgtttgtgttcttccttttttctgttttcctgaatgcttttgattcttttttgctgtgtcacatctactgatgaccccttcacatgaaatttttactctcatattgtggtttttattgttagaattttgtgctaaaattcttgtttttcttttttctttattttcctaactccccaaacttgttatctgtgctgaaattc

SEQ ID NO: 2685 - DNA, 109 bp, Homo sapiens
  DISO7_10000883
  Located on chromosome 2
  Distance between a terminus base of telomere on chromosomal short arm and 5'-terminus of this base sequence : 49188145
  Distance between 3'-terminus of neighbour sequence of sequence listing upward to telomere on chrosomal short arm and 5'-terminus of this base sequence : 193574
aggatagttcactccttgagaacaacacacacacacacacacacacacacacacacacaccacttttttccctttatatttatttccaaagagaccacagctaatatga

SEQ ID NO: 2686 - DNA, 101 bp, Homo sapiens
  DISO7_10000884
  Located on chromosome 2
  Distance between a terminus base of telomere on chromosomal short arm and 5'-terminus of this base sequence : 49207772
  Distance between 3'-terminus of neighbour sequence of sequence listing upward to telomere on chrosomal short arm and 5'-terminus of this base sequence : 19518
tagacagccacactgtgttgtgtgcacgcacgcacacacacacacacacacacacacacacacacacacacactctgcagacgacctctgagttagagaaa

SEQ ID NO: 2687 - DNA, 419 bp, Homo sapiens
  chr2.fa.O7frz.51503712
  Located on chromosome 2
  Distance between a terminus base of telomere on chromosomal short arm and 5'-terminus of this base sequence : 49361370
  Distance between 3'-terminus of neighbour sequence of sequence listing upward to telomere on chrosomal short arm and 5'-terminus of this base sequence : 153497
ggcttatgtctgtaattccaacactttgggaagctgaggagggagaactgcttgagcccaggaggccaagaccagcctgggcaacacagcgagaccccatcgccacaaaaaaattaaaaattagccaggggtggggatgcacacctgtagccccagcgacttggggggatgagggaggaggattgcttagagccaggagatagaggctgcggtgagccgtgatcatgccacactgcactccagcctgggtgacacagtgagactgtctcactctctctctctctctctctctctctctctctctctctctctctctctctctctgtgtgtgtgtgtgtgtgtgtgtgtgtgtgtgtgtatatatatatatatatatatatatgctttgcaatcagtgagctatttactagctatatgcc

SEQ ID NO: 2688 - DNA, 398 bp, Homo sapiens
  chr2.fa.O7frz.51631090
  Located on chromosome 2
  Distance between a terminus base of telomere on chromosomal short arm and 5'-terminus of this base sequence : 49457289
  Distance between 3'-terminus of neighbour sequence of sequence listing upward to telomere on chrosomal short arm and 5'-terminus of this base sequence : 95500
tgttatcctcaaagaatgtgactatataaacaaattttcttatatttctgaagagtttctcatatttgttccatggaagagaagaccaatatgccatctaaattttggttcagatgttgaaatagagaatactgcacatgtgccaaaaggaaaagatatttaatatgttacttatgtaatgaggccctggagagagaaaggcagccacctgagcaggttaaaaaatatctcgagagagtaaggaggagcatggcttgggggtcctattgtttctttgtgtaaacacttcatgaacggtgagttcaatacacacacacacacacacacacacacacacacacagacacccttctcatggagttcttttggaagccctgtatggctaacatgtctttaat

SEQ ID NO: 2689 - DNA, 470 bp, Homo sapiens
  AC009971.7_143131
  Located on chromosome 2
  Distance between a terminus base of telomere on chromosomal short arm and 5'-terminus of this base sequence : 49669881
  Distance between 3'-terminus of neighbour sequence of sequence listing upward to telomere on chrosomal short arm and 5'-terminus of this base sequence : 212194
aatgttggatgtcgattctactcttctcttttccagctgagaggctaccaaacagcactggcctctgtttgcaatactgtgggtcttctagagcaagagtaaactggccagctctcttttgttcttagtagcccctaggcatctagaatatgctggtttccattaattctttgaaacaggtgagacagaagctaatttcttgggcagtctctcaaaaagccaaaacattgaacattttctccaaatatttttctccccaggttaaagatagaagttgggcattttctccctctcattctatgctgagacagaagaagggaatacggtgagtgagtgagtgtgtgtgtgtgtgtgtgtgtgtgtgtgtgtgtgtgtgtatgtgtgagagttttaagtattgcctttgttttcagtgggattctacctggcaccttttcctgtcagtgcttagattctggcaagactagcta

SEQ ID NO: 2690 - DNA, 234 bp, Homo sapiens
  Z66621
  Located on chromosome 2
  Distance between a terminus base of telomere on chromosomal short arm and 5'-terminus of this base sequence : 49670081
  Distance between 3'-terminus of neighbour sequence of sequence listing upward to telomere on chrosomal short arm and 5'-terminus of this base sequence : -270
tgggcagtctctcaaaaagccaaaacattgaacattttctccaaatatttttctccccaggttaaagatagaagttgggcattttctccctctcattctatgctgagacagaagaagggaatacggtgagtgagtgagtgtgtgtgtgtgtgtgtgtgtgtgtgtgtgtgtgtgtgtatgtgtgagagttttaagtattgcctttgttttcagtgggattctacctggcacctt

SEQ ID NO: 2691 - DNA, 436 bp, Homo sapiens
  AC009971.7_182820
  Located on chromosome 2
  Distance between a terminus base of telomere on chromosomal short arm and 5'-terminus of this base sequence : 49709787
  Distance between 3'-terminus of neighbour sequence of sequence listing upward to telomere on chrosomal short arm and 5'-terminus of this base sequence : 39472
gtacattactgcaggttgtagatcagagttctacattcatatatggtctggtcattgtccatttgcatattcagtctattaggagttcaggatctggggctagagtatgtatatatgtgtttgtgtgtgtgtgtgtgtgtgtgtgtgtgtgcatatatatatatatgtcgtataacttatgatgtggggctttggaaaaattggtaaatctctctgtgcctcattttattaaactgtcaaaagagatcaaaatggtaattaactgatgtaattattgtgataattaaatgagttatatacataaagcacttaaaacagtgtctggcacagagtattagattttatacttactatatgattgatgacatacaacatccacaggatgtaattcatgggattcaccagattcattgtgagaattagttggagaaataca

SEQ ID NO: 2692 - DNA, 454 bp, Homo sapiens
  chr2.fa.O7frz.51160928
  Located on chromosome 2
  Distance between a terminus base of telomere on chromosomal short arm and 5'-terminus of this base sequence : 49816534
  Distance between 3'-terminus of neighbour sequence of sequence listing upward to telomere on chrosomal short arm and 5'-terminus of this base sequence : 106311
gtaaatcacagcataaagcaagagcaagtgaaaattatcatggagataatcacagacgcagagaaattccaagctcaaagtaaatacatgaaacaaaacataaaaaaaactaaaagtgcccctggagcaatccatcagaactatttaatattaaagaactctatttaaagtaatagtgctatttgacctctacacacacacacatgcgcactcacacacacacacacacacactgagcagtggggacaaaaacacttttccccaggctaaaatccaaaaagtgaagaaaatatgttgactacaaggggaaggctcagactcaatctgagggataagtccaattcttatgagaaagagacagctctattggtgagagaaacacactaaatttctctactaccagaataaatctcttcttctttggcaataggtagatctaaacctgaggaaactc

SEQ ID NO: 2693 - DNA, 428 bp, Homo sapiens
  chr2.fa.O7frz.51047300
  Located on chromosome 2
  Distance between a terminus base of telomere on chromosomal short arm and 5'-terminus of this base sequence : 49925917
  Distance between 3'-terminus of neighbour sequence of sequence listing upward to telomere on chrosomal short arm and 5'-terminus of this base sequence : 108929
cagtagccattatagatgtagtcaaagcaaggcagaaaacaaatcactttgctccctaactcttccatattaaagtatacagatacacacgcacacacacacacacacacacacacacacacacaccacacacacacacgaagtaagtgtgtatgctcttgtggctttgtttggaatcctatctttgcattcagcatttgttcggcagataccatgtggtcccaggccctctgttgaacattcagtggcaaaaggcatatttattctcagctctaaagaggtagcagacgaatgttctccaacaggaagaagcttacagacactcttcttttacctattaccttttacctatttctcctttaccttaattccatttatcccaaacatacattttcataaaagctctatcatagtcctatcacttctgc

SEQ ID NO: 2694 - DNA, 101 bp, Homo sapiens
  DISO7_10000889
  Located on chromosome 2
  Distance between a terminus base of telomere on chromosomal short arm and 5'-terminus of this base sequence : 50000940
  Distance between 3'-terminus of neighbour sequence of sequence listing upward to telomere on chrosomal short arm and 5'-terminus of this base sequence : 74595
tatgtcttgaggctctttgctaaaggaatagcaagtgtgtgtgtgtgtgtgtgtgtgtgtgtgtgtgtgtgtgtgtgttattggaggctgtcctgtccact

SEQ ID NO: 2695 - DNA, 176 bp, Homo sapiens
  DISO7_10000891
  Located on chromosome 2
  Distance between a terminus base of telomere on chromosomal short arm and 5'-terminus of this base sequence : 50020470
  Distance between 3'-terminus of neighbour sequence of sequence listing upward to telomere on chrosomal short arm and 5'-terminus of this base sequence : 19429
aattacagatctcaagaactctgctttctttatcagactcatatagcccctactctaatatatatatatatatatatatatataataaaaaccaaacccaaataaaagaaagaagcaaaaattccaaacatataaatacaaagctaataaattattccccttctgatctgggcagt

SEQ ID NO: 2696 - DNA, 154 bp, Homo sapiens
  DISO7_10000892
  Located on chromosome 2
  Distance between a terminus base of telomere on chromosomal short arm and 5'-terminus of this base sequence : 50034742
  Distance between 3'-terminus of neighbour sequence of sequence listing upward to telomere on chrosomal short arm and 5'-terminus of this base sequence : 14096
aaagtggtaaggcatgaagagtttgtgtgtgtgtgtgtgtgtgtgtgtttgcacatgcatggtggggcaaatatggaagatgacataatcagttatgaatttagaaaatattactctatgttgaaaatggatgagggagagggaagagcatgct

SEQ ID NO: 2697 - DNA, 102 bp, Homo sapiens
  DISO7_10000893
  Located on chromosome 2
  Distance between a terminus base of telomere on chromosomal short arm and 5'-terminus of this base sequence : 50124108
  Distance between 3'-terminus of neighbour sequence of sequence listing upward to telomere on chrosomal short arm and 5'-terminus of this base sequence : 89212
tcagtcacagtgggttgggaaaacaaaacaaaacaaaacaaaacagtagactgtgagtcaaaaggcccgatttctacttttggctccatctcaactcatcac

SEQ ID NO: 2698 - DNA, 358 bp, Homo sapiens
  AC008247.3_75590
  Located on chromosome 2
  Distance between a terminus base of telomere on chromosomal short arm and 5'-terminus of this base sequence : 50672440
  Distance between 3'-terminus of neighbour sequence of sequence listing upward to telomere on chrosomal short arm and 5'-terminus of this base sequence : 548230
ggattctaggtgatgtcaatagacaccactagcagatagtggttagtccatatccacctcactcattttgttaatgcaaacaatattattattattattattattattttattattattttgagacaaaatcccactctgtcacccaggctgaagtgcagtggcgtgatcttggctgactgcaacctctgcctccaagattcaagtgattctcctgcctcagcctcctgagtagctgggattacaggtgcacagcaccacacctggctgatttttctatttttggcagggacagggttttggcatgttggccagggtggtctcaaactcctgaccgcaagtgatctgcctgactcagg

SEQ ID NO: 2699 - DNA, 338 bp, Homo sapiens
  chr2.fa.O7frz.51974623
  Located on chromosome 2
  Distance between a terminus base of telomere on chromosomal short arm and 5'-terminus of this base sequence : 50793314
  Distance between 3'-terminus of neighbour sequence of sequence listing upward to telomere on chrosomal short arm and 5'-terminus of this base sequence : 120516
tactccagtttcatcttgaactacttttctctgactctttaaattagtcactttgtaattttttcaattcctttagctaagccaatccactttgaacccgacattctcctttgcattgcgaatttcttgcatccctgtgtactcaacatctctgcccacctcaacagacacacacacacacacacacacacacacacacacacacacatctaaggctggctaaattttttcttttttaaatatcagcttatacatttctcaaggaagcattccctgtgtcccctactgctccaccaaattattctacttaatgaattcttccactatgcattcttaaa

SEQ ID NO: 2700 - DNA, 368 bp, Homo sapiens
  AC068055.4_105675
  Located on chromosome 2
  Distance between a terminus base of telomere on chromosomal short arm and 5'-terminus of this base sequence : 50907542
  Distance between 3'-terminus of neighbour sequence of sequence listing upward to telomere on chrosomal short arm and 5'-terminus of this base sequence : 113890
ttatttaatcttgctcagcaatttgatgcaaacgcctaaatacaaaaagtggtttagtaggtactacaaaggaaggaagaaggaaggaaaagacttaatactctagaatgtttcctgaaaatcagaaaacaagtagcattcaattgtagctaaactaactaactaactctctctctctctctctctctctctctctctctctcctcctctccctccctccctccctctctgtcacacacaaaaacacacaccacaaccctgattaaatacctgttggaagaaaggaaggaagcatatgaggcagcatggaagagagaaagagagtgacaacctcaagagacatcattgacttgagttctagtcctatg

SEQ ID NO: 2701 - DNA, 442 bp, Homo sapiens
  chr2.fa.O7frz.52205604
  Located on chromosome 2
  Distance between a terminus base of telomere on chromosomal short arm and 5'-terminus of this base sequence : 50935829
  Distance between 3'-terminus of neighbour sequence of sequence listing upward to telomere on chrosomal short arm and 5'-terminus of this base sequence : 27919
gaattagcaaaggaatatggagaaaaagtagtagttgtctagggcttgggagaaggagagagaagggatgtctttcagggggttccaaatttgattatggtgatggttgcacaactccgtgaatatactaaaaatcattaaattgtacacattgagtaaatcacattgtgtatgaattatatcctcataaaacaaatgaaaagttcaccaccacctcccaaagaaatactagaaaacttatttatttgcaaaattttcaactgcaaaaattatatgtgtgaattcattaaacacttatacagtacaataagttatacatgcatacacacaaatacacacacacacacacacacacacacacacacacaacaatttttttcctaactagacattttgaaaaccagttttaggacaggttgttgtaaacaaaagtattcacgag

SEQ ID NO: 2702 - DNA, 415 bp, Homo sapiens
  chr2.fa.O7frz.52295891
  Located on chromosome 2
  Distance between a terminus base of telomere on chromosomal short arm and 5'-terminus of this base sequence : 51026323
  Distance between 3'-terminus of neighbour sequence of sequence listing upward to telomere on chrosomal short arm and 5'-terminus of this base sequence : 90052
atacgagtgcagatttgttaaatggatatattgtataatggttgggcttctagcgtgcccatcacctgaatagttcccagtgtctgtcacttccctctgcatatccatgtgtacccattgcttagcttctattattattattattatcattattattattacttgaactcctgggttcacacaattttcccacctcagcttcttgagtagttggaacaacaggcatgcactactggctggctatttttaaaatacatttgtagagacagaatctcactatgttgcccaggctggtcttgaactcctggcttcaaatgattctcccacctcagactctgaaagtgctgggattacaggtattagccacgctgctcagccagctgccacttataagtgagaacatgcagtatgaatt

SEQ ID NO: 2703 - DNA, 377 bp, Homo sapiens
  AC007462.2_115356
  Located on chromosome 2
  Distance between a terminus base of telomere on chromosomal short arm and 5'-terminus of this base sequence : 51202574
  Distance between 3'-terminus of neighbour sequence of sequence listing upward to telomere on chrosomal short arm and 5'-terminus of this base sequence : 175836
atactggcactaggagacatttctaaaagctatttccatagacaactaaagtaattccatattatgtggtcaaattgaaggaatgtgggctagctatagagatgcatacccttgcgtggaaatccaggcctggttatttgcaagccctacagccttgtgtgtgtgtgtgtgtgtgtgtgtgtgtgtgtgtatatatatatataagtttctctgattattagtatcattgtttctaaaatgggaacaataaaaacctatgccagagggtttcatgatgattaaatgagatgaaatatatcaagcatccacaagagcaaaagtataaagtggacacacagtcaacaggcattattattaaattcaccttctgcttagag

SEQ ID NO: 2704 - DNA, 178 bp, Homo sapiens
  AC007462.2_86760
  Located on chromosome 2
  Distance between a terminus base of telomere on chromosomal short arm and 5'-terminus of this base sequence : 51231299
  Distance between 3'-terminus of neighbour sequence of sequence listing upward to telomere on chrosomal short arm and 5'-terminus of this base sequence : 28348
ggttaaccatgactcgtgtatgtgtgtgtgtgtgagtgtgtgtgtgtgtgtgtgtgtgtgtttattccctttgtgggtgcaagagattggagagtgaactagggcagttatagtagaaatgaaaatcatcaacaaaaagataatttcacagatataatttccaggatttactaatgat

SEQ ID NO: 2705 - DNA, 424 bp, Homo sapiens
  AC007462.2_54057
  Located on chromosome 2
  Distance between a terminus base of telomere on chromosomal short arm and 5'-terminus of this base sequence : 51263766
  Distance between 3'-terminus of neighbour sequence of sequence listing upward to telomere on chrosomal short arm and 5'-terminus of this base sequence : 32289
gttctttcagcatttaggtctctgctcaaatgttactccagagagacctgctacccactccagttattcaatatatattcatcatttcactttgttgaaatgaccatttcttgtttgtagagtattatctgtatatgccctttagaatacaagtaccttgagggcagagatcagtctctcatatgcattgctctatcagcagcaagtgcccccacaatgccaggcccacagcagagcctccataaatattaattgaatcaataattgcacacacacacacacacacacacacacacatacacacacagtgagctaatttcaatttgaataccaagcttacataaaagcttaccaaagaaattaagtatttattctgcttattgcaagtgaaatctaatttcagtactgtgcatgaacgaaatat

SEQ ID NO: 2706 - DNA, 304 bp, Homo sapiens
  AC007462.2_27730
  Located on chromosome 2
  Distance between a terminus base of telomere on chromosomal short arm and 5'-terminus of this base sequence : 51290102
  Distance between 3'-terminus of neighbour sequence of sequence listing upward to telomere on chrosomal short arm and 5'-terminus of this base sequence : 25912
gtctagcataggacatgattctagcaaaaatgtcaaacactgttgagcttaactgaccaagagagactaataggattttagcttttctgggaatgtcactccatagaaattttcatgtgtagtgtgatatgtccacaggagacaggtgggcatccagtacagtacctacaactgtggagtggctgcgggagggctagtggatagggaagacagtgtagaaaatgaacaagccctgtacaaagtagtctgatgtatgtttatttatttatttatttatttatttatttacttagaagccgtctca

SEQ ID NO: 2707 - DNA, 112 bp, Homo sapiens
  D2S1352
  Located on chromosome 2
  Distance between a terminus base of telomere on chromosomal short arm and 5'-terminus of this base sequence : 51336509
  Distance between 3'-terminus of neighbour sequence of sequence listing upward to telomere on chrosomal short arm and 5'-terminus of this base sequence : 46103
agtgggtagatcctatgtgagctgctcatacaataataataataataataataataaaataaaacttctttcatatattagaatatattcatttggctagatgacatagtta

SEQ ID NO: 2708 - DNA, 254 bp, Homo sapiens
  AC007560.3_109390
  Located on chromosome 2
  Distance between a terminus base of telomere on chromosomal short arm and 5'-terminus of this base sequence : 51489731
  Distance between 3'-terminus of neighbour sequence of sequence listing upward to telomere on chrosomal short arm and 5'-terminus of this base sequence : 153110
aatgcttagcactatcaatctaactaagctgtgtgtgtgtgtgtgtgtgtgtgtgtgtgtgtgtgtgtgtgtgacttaatcaatacctaacaaagatccctggggtgaagatcactcctatattatacctagtaccaccagttatttggagggacaggtgttatccactgatcaaatcttaggaagctgcccctcggagaattacagctctggcacaagcagatcatagactcagtttacacttcaagaaactc

SEQ ID NO: 2709 - DNA, 419 bp, Homo sapiens
  AC007560.3_79097
  Located on chromosome 2
  Distance between a terminus base of telomere on chromosomal short arm and 5'-terminus of this base sequence : 51519830
  Distance between 3'-terminus of neighbour sequence of sequence listing upward to telomere on chrosomal short arm and 5'-terminus of this base sequence : 29845
gaggaattcctcaagtcctacgttttcaaaattatgtctcttaaagaattagtagctttgcaaatcaaagcaggattggctcttatcatctcagtttatctctgtcagtgctcctggtggtggtgacatgctggcctctcatatttctgtaagcctggccctttggattttcccacagtatcagcctaaaaggccaaggagttgtaaacctgcttttaactctccttattccctcccaccacacacacacacacacacacacacacaaacagggtctacctgtcccatggcttccgaattatgaaatgtgccccattcagttcttgcaactcttcccacttatccactctgttcatcctctctggggaatccaatcttgacccaaagagaccaagtaatctttaaaatcagaaactgct

SEQ ID NO: 2710 - DNA, 122 bp, Homo sapiens
  D2S2316
  Located on chromosome 2
  Distance between a terminus base of telomere on chromosomal short arm and 5'-terminus of this base sequence : 51595448
  Distance between 3'-terminus of neighbour sequence of sequence listing upward to telomere on chrosomal short arm and 5'-terminus of this base sequence : 75199
cagagtgtatttacccattggaattattctgtctctgccttctctaagtggctccaaatatataaatgtgtgtgtgtgtgtgtgtgtgtgtgtgtgtgtgtagtagcacctggcacacagta

SEQ ID NO: 2711 - DNA, 256 bp, Homo sapiens
  chr2.fa.O7frz.53100537
  Located on chromosome 2
  Distance between a terminus base of telomere on chromosomal short arm and 5'-terminus of this base sequence : 51711602
  Distance between 3'-terminus of neighbour sequence of sequence listing upward to telomere on chrosomal short arm and 5'-terminus of this base sequence : 116032
tccattacgatatctttgacagcttttggctcagaaattagaaaatgaaatgataaccaccaacaaagggattctgcagctgagtatggatttcctcccagtgacaggcatttttgtaagcacagagcctaataattgtttgaataaacaatgtgtgtgtgtgtgtgtgtgtgtatgtgtgtgtgtgtgtgtgtggtgtgtaatctacacagaaaattgaaaaaaaattttcacaatggttaatggtattaatagg

SEQ ID NO: 2712 - DNA, 170 bp, Homo sapiens
  D2S2156
  Located on chromosome 2
  Distance between a terminus base of telomere on chromosomal short arm and 5'-terminus of this base sequence : 51760412
  Distance between 3'-terminus of neighbour sequence of sequence listing upward to telomere on chrosomal short arm and 5'-terminus of this base sequence : 48554
ggtatcccacttcaagttcctcccagatgaaattgatgactggttctctctctttcaacacacacacacacacacacacacacacacacacacagtgtgggtgtgcgcacatacacactgcccactagcaaaaggaaataaaaatctcagttgcttatttattatggctg

SEQ ID NO: 2713 - DNA, 257 bp, Homo sapiens
  AC007680.2_8152
  Located on chromosome 2
  Distance between a terminus base of telomere on chromosomal short arm and 5'-terminus of this base sequence : 51876547
  Distance between 3'-terminus of neighbour sequence of sequence listing upward to telomere on chrosomal short arm and 5'-terminus of this base sequence : 115965
ttgtaacattgctactttggacttgctgatgtttccattgtgctcaagaaaatgataaacttttgtgaaacttccatgtgagtatctatctatctatctatctatctatctatctatctctctgtctgtctgtctgtgtgtctatctatcttgagataggatctcattctgttgcccattctggagagcagttgcatgatcacagctcaatgccgcctcaacttcccaaccttaagcagtccttccacttcagcttt

SEQ ID NO: 2714 - DNA, 268 bp, Homo sapiens
  AC007680.2_46826
  Located on chromosome 2
  Distance between a terminus base of telomere on chromosomal short arm and 5'-terminus of this base sequence : 51915216
  Distance between 3'-terminus of neighbour sequence of sequence listing upward to telomere on chrosomal short arm and 5'-terminus of this base sequence : 38412
cattgatttccaaatgttaaaccaatttgcattctaaaatataccaaatttgttcatgatggataatcctttaaaaatataaatgtatgtgtgtgtgtgtgtgtgtgtgtgtgtgtgtgtgtgtgtgtgtatttcaaaatgtatttaaccttttattttctacttctggcttttaattatatgtttgtttccaaaattaatctatttttttaaatgtccttcacctgtttattaccacggttatatcaacagcttaagataggttaga

SEQ ID NO: 2715 - DNA, 256 bp, Homo sapiens
  AC007402.3_35490
  Located on chromosome 2
  Distance between a terminus base of telomere on chromosomal short arm and 5'-terminus of this base sequence : 52049893
  Distance between 3'-terminus of neighbour sequence of sequence listing upward to telomere on chrosomal short arm and 5'-terminus of this base sequence : 134409
tattaactctttgacaaccagaagataaatatatgtaaagttatgtaaactttgtgtgcattggttgcatcatagacaaagtaggggaaatgcccatcttaccagaggattaaatatctatcaatgtataagtacttagatgtaaatatatatgtatgcatatacatgtgtgtacacacccagacatatatatgtgtgtatatatacatatatatatatatatatatataatatacttactgtttctgaaaccatg

SEQ ID NO: 2716 - DNA, 250 bp, Homo sapiens
  AC007402.3_88180
  Located on chromosome 2
  Distance between a terminus base of telomere on chromosomal short arm and 5'-terminus of this base sequence : 52102757
  Distance between 3'-terminus of neighbour sequence of sequence listing upward to telomere on chrosomal short arm and 5'-terminus of this base sequence : 52608
caacatcacataggaccagtattccaggaagaaacacacacacacacacacacacacacacacacacacacacacacatcccacagacacacattatatcctgaaaacaatttaaaaactctaaagtttaaaaagaaagttattaacttccctaacataaataatcaaacaacaaaaaactgataagttttagaaacaggatttggggacttatctttattattccaagacagcatcaagtaattcctct

SEQ ID NO: 2717 - DNA, 332 bp, Homo sapiens
  AC007402.3_156739
  Located on chromosome 2
  Distance between a terminus base of telomere on chromosomal short arm and 5'-terminus of this base sequence : 52171134
  Distance between 3'-terminus of neighbour sequence of sequence listing upward to telomere on chrosomal short arm and 5'-terminus of this base sequence : 68127
aatgaggatgaatatgacagtaagggagaagtatcccacagctgtagtacacagcttccctttaaatcactagaaattattagcagctgccttctaaattgtaatgtttgattggactttctgaaaattctgaaaggagaaatctgtgctccatagaaaacataataaaaaaatttctgtgggcaaatagaaaggcatatagcaatagtgtgtgcatatatatatatatatatatatatatatagttgttcagatttccttagtttttttgtttgtttgttttactttaagttctgggatacatgtgcagaacatgcaggtttgttacatag

SEQ ID NO: 2718 - DNA, 154 bp, Homo sapiens
  AC007402.3_172113
  Located on chromosome 2
  Distance between a terminus base of telomere on chromosomal short arm and 5'-terminus of this base sequence : 52186703
  Distance between 3'-terminus of neighbour sequence of sequence listing upward to telomere on chrosomal short arm and 5'-terminus of this base sequence : 15237
ggatctgtttatcaagacttacacacacacacacacacacacacacacacacacacacacacacacacacacaagacttctaagtgatgctgatgcatgctaaaatctgggaaccactacagcagaatagtagttcttgatcctggctacatat

SEQ ID NO: 2719 - DNA, 413 bp, Homo sapiens
  chr2.fa.O7frz.53705258
  Located on chromosome 2
  Distance between a terminus base of telomere on chromosomal short arm and 5'-terminus of this base sequence : 52316684
  Distance between 3'-terminus of neighbour sequence of sequence listing upward to telomere on chrosomal short arm and 5'-terminus of this base sequence : 129827
ctgaccatttatccatttactattcttttgcaaaaactactgtaccctagaagtctgaatccaaatttgcaaaaagtttccaagcttagaaaatgatttttagctctcatttattcccagcatctacagaaaaatagataaattataaagtcttattattagtaacttcatggatgttatctagaatcagtcatgagctaaattggaacacacacacacacacacacacacacacacacacacacacgttttcttatgatggatgtaacatgagaccagaaaatatagataacataatcagtctctcgcaaatggattcagaatttacatgtgatgggatctcatgcgtttccaggcaagagatcaggtacagctaaaaacataggtttgttgagagtaggcagatacctatt

SEQ ID NO: 2720 - DNA, 355 bp, Homo sapiens
  chr2.fa.O7frz.53816782
  Located on chromosome 2
  Distance between a terminus base of telomere on chromosomal short arm and 5'-terminus of this base sequence : 52463223
  Distance between 3'-terminus of neighbour sequence of sequence listing upward to telomere on chrosomal short arm and 5'-terminus of this base sequence : 146126
aaaccttatgaaactcatggttagcaataatataaatgatttgaaaattacattacagctttcacaatttttaatgtttattataaacctacattaagagaataattttctaattaccttaaaagagcactttataaaagcttaggtgtgttttctgggtctacattgaagagttttactgcatttaccttttctacctttttaaaaataatttataagataaactaggaacagagaaacacacacacacacacacacacacacacacacacacacactacatcactttacattcatggcccctttccttggatgattttggtggagaggggaattacataccaattacgaactg

SEQ ID NO: 2721 - DNA, 329 bp, Homo sapiens
  chr2.fa.O7frz.53942784
  Located on chromosome 2
  Distance between a terminus base of telomere on chromosomal short arm and 5'-terminus of this base sequence : 52536914
  Distance between 3'-terminus of neighbour sequence of sequence listing upward to telomere on chrosomal short arm and 5'-terminus of this base sequence : 73336
tgaagtccagtctgtcaataagttggctacttattttcattatcacaaaattttatctatcaattccacccacctattttagtaaggccttagattttatgacctatcattgctttctcttataaaaataccaaattaagactactctgtaagggtttttgtttgtttgtttgtttatttgtttgtttgtttgttttggtttttatatcccaaccactcatgccagaacataggctgtttggttctttttttcttttttttagacatggtctcactcctgttgtccaggctggagtgccgtggcatgaacttggtagctcactatagcc

SEQ ID NO: 2722 - DNA, 266 bp, Homo sapiens
  chr2.fa.O7frz.54043491
  Located on chromosome 2
  Distance between a terminus base of telomere on chromosomal short arm and 5'-terminus of this base sequence : 52603327
  Distance between 3'-terminus of neighbour sequence of sequence listing upward to telomere on chrosomal short arm and 5'-terminus of this base sequence : 66084
tgagtgcttaaggtcttagaatacagaaaagaggtagaagaatattgttcaaattttagtgggcagcagtaactactacagacctagctagagcgtagattccagagaaatgacatcagcaaaatggcaaagtaggtggctccaagctcttgtgcccttatagaaaaatatatatgaaatacatacacacacacacacacacacacacacacacacagacacacacacaccaaggcagaaatgtcagtatcaacattgtcagaact

SEQ ID NO: 2723 - DNA, 436 bp, Homo sapiens
  chr2.fa.O7frz.54127678
  Located on chromosome 2
  Distance between a terminus base of telomere on chromosomal short arm and 5'-terminus of this base sequence : 52723288
  Distance between 3'-terminus of neighbour sequence of sequence listing upward to telomere on chrosomal short arm and 5'-terminus of this base sequence : 119695
aggtagacaaggtactctggattaactggctaaatttgttttattttattttattttattttattttattttttgagatggagtctagctctgtcacctgggctggagtacagtggtgcagtctctgcttactgcaagctccgcctcccgggttcacaccattctcccccctcagcctcccgagtagctgggactacaggtgcccgccaccacacctgactaatttttttttttttttgtattgttagtagagacagggtttcactgtgttaaccaggatggtctcgatctcctgaccttgtgatccacccgcctcagcctcccattactggctaaatttaaaaggttgaactgaacttagccagttagagtaatagaaagaagaacataaggaaggaaggataaaaggtaagatagctcattctaaacagattgg

SEQ ID NO: 2724 - DNA, 101 bp, Homo sapiens
  DISD22_0001618
  Located on chromosome 2
  Distance between a terminus base of telomere on chromosomal short arm and 5'-terminus of this base sequence : 52800748
  Distance between 3'-terminus of neighbour sequence of sequence listing upward to telomere on chrosomal short arm and 5'-terminus of this base sequence : 77024
gtcatcatgtaactgaagggcactaaatggttttatttatttatttatttatttatttatttatttatttatttatttttgatgcaggctctgagttaggg

SEQ ID NO: 2725 - DNA, 293 bp, Homo sapiens
  chr2.fa.O7frz.54359297
  Located on chromosome 2
  Distance between a terminus base of telomere on chromosomal short arm and 5'-terminus of this base sequence : 52984015
  Distance between 3'-terminus of neighbour sequence of sequence listing upward to telomere on chrosomal short arm and 5'-terminus of this base sequence : 183166
actaaagccagtcctagcttttaactactcagaatacaaaacaacacaaaacaagaaaaactcaccttatatccacacgatttttgtgtgatgctttaattttgaaatattgtaattacaaatgaataattcacagagatattacccattgacaagacttccagaataatggttttatatatatatatatatatatatatatatatatatatatatatatatatatatatatttatttatttatttatttatatatatatatatttggagagtaaattctggtcactgtcaaa

SEQ ID NO: 2726 - DNA, 345 bp, Homo sapiens
  chr2.fa.O7frz.54484426
  Located on chromosome 2
  Distance between a terminus base of telomere on chromosomal short arm and 5'-terminus of this base sequence : 53048137
  Distance between 3'-terminus of neighbour sequence of sequence listing upward to telomere on chrosomal short arm and 5'-terminus of this base sequence : 63829
atccagttaatcaatgagtcatataaatatatctccccaccaacccatacagaggtgcatgcgtgcgtgcatgtgtgcacacacgaacacacacacacacacacacacacacacacacacacacacacatgctctttgcttcctctctactctcactgctaatgcagtatctttctttccttggtcaataaacttccaaatgatagctggtttccagatgttctctggttagctcctcctctacactgctacctatattagttctctagaagacagttttataaagatattcttagtgattcttctttggttaaaagacaaatctcaatttctgaacagatgaga

SEQ ID NO: 2727 - DNA, 169 bp, Homo sapiens
  chr2.fa.O7frz.54603965
  Located on chromosome 2
  Distance between a terminus base of telomere on chromosomal short arm and 5'-terminus of this base sequence : 53138947
  Distance between 3'-terminus of neighbour sequence of sequence listing upward to telomere on chrosomal short arm and 5'-terminus of this base sequence : 90465
tacatttaaggactgacaccacatgattgtactggatgatctttagtaaaatcattcaatcacttttcccctctgctctcccccaaaaaccaacacacacacacacacacacacacacacagtctctctctctctctctcagatgcttgtatcttaaatgcagatgact

SEQ ID NO: 2728 - DNA, 170 bp, Homo sapiens
  DISD22_0001624
  Located on chromosome 2
  Distance between a terminus base of telomere on chromosomal short arm and 5'-terminus of this base sequence : 53221337
  Distance between 3'-terminus of neighbour sequence of sequence listing upward to telomere on chrosomal short arm and 5'-terminus of this base sequence : 82221
tcctcaaatggtaataattctattgttgaatttgaaaacattttgcacttactttaacttaaccaaaacagttcagcaaggggtttaaaacacacacacacacacacacacacacacaaacgtacacacacgtactaataaaattatagcttaattcaacaagtttcagc

SEQ ID NO: 2729 - DNA, 194 bp, Homo sapiens
  DISD22_0001625
  Located on chromosome 2
  Distance between a terminus base of telomere on chromosomal short arm and 5'-terminus of this base sequence : 53298547
  Distance between 3'-terminus of neighbour sequence of sequence listing upward to telomere on chrosomal short arm and 5'-terminus of this base sequence : 77040
acctgggatgacgataggtcatatatatgtgtgtgtgtgtgtgtgtgtgtgtgtgtgtgtgtgtgtatatgtgtgtgtgtgtgtgtatatatatatagatataatttatataatggtactctgtgtcttctcttaaaaggaagaaatgagagaaatcagaaaatatggttagtaaataagaagtccacattggc

SEQ ID NO: 2730 - DNA, 219 bp, Homo sapiens
  chr2.fa.O7frz.54902790
  Located on chromosome 2
  Distance between a terminus base of telomere on chromosomal short arm and 5'-terminus of this base sequence : 53436822
  Distance between 3'-terminus of neighbour sequence of sequence listing upward to telomere on chrosomal short arm and 5'-terminus of this base sequence : 138081
agttagtatctgctggaaggactgaggcaacttcaagtcaaataagtataacctggtgctattagaataaattgtgacccctcctaaaatatacgtgtgtgtgtgtgtgtgtgtgtgtgtgtgtgtgtgagttctgaagctctagccaccaatgtgactgtatttggagatagggcatatgaggaggtgataaaggttaaatgaggtcataaccataga

SEQ ID NO: 2731 - DNA, 421 bp, Homo sapiens
  AC019196.9_150740
  Located on chromosome 2
  Distance between a terminus base of telomere on chromosomal short arm and 5'-terminus of this base sequence : 53569653
  Distance between 3'-terminus of neighbour sequence of sequence listing upward to telomere on chrosomal short arm and 5'-terminus of this base sequence : 132612
gagctgaagatactccttgatcctctaaaattactgatcctctctgctctctccagtcagaaaaaaagagatgtctgcagtaaaacactcttgaacacacacacacgcacacacacacacacacacacgttatacactttgttttattgactcttctgcctgcattagttttttgtgacatttactcaatctctttttctatgttaaaaaaaaggcatgaagaagtaactataagagctattttactaaaacatttccaagtgattgggccttgtaagtagtgtaagataaaacttgaagaaggcattctctacagaaaagccaaagaagttttttgacctcttttaaaaagttaaaactaaatccattactgccatgcctaaaatcccccggtggcttcctaccattcttagaataacag

SEQ ID NO: 2732 - DNA, 402 bp, Homo sapiens
  chr2.fa.O7frz.55188586
  Located on chromosome 2
  Distance between a terminus base of telomere on chromosomal short arm and 5'-terminus of this base sequence : 53722222
  Distance between 3'-terminus of neighbour sequence of sequence listing upward to telomere on chrosomal short arm and 5'-terminus of this base sequence : 152148
aaactcctttcatccttcataggcattgttagctctgcctgtgctcttttcatgcttgattctttctcttcaagtctcattttaaaatatcaccacttggacttctctttcttggatcactgtacctaaaaatgtatcctctttggtcatattactttctagtgaagttccctttttgcttcctttaaatcagttaccatttcaattttcaagtgtatgtttcatatcatttgctgccttaaccattttatcttcagaaaccagcacatgcctgagatcatgtcgaacagatgaatgaatgaatgaatgaatgaattctgaacatcgcagatgccaaatatccactaacctaaatatactgtgcttcttcctctaaacacgatttatctggtccatgaagtt

SEQ ID NO: 2733 - DNA, 383 bp, Homo sapiens
  AC037488.2_68136
  Located on chromosome 2
  Distance between a terminus base of telomere on chromosomal short arm and 5'-terminus of this base sequence : 53749587
  Distance between 3'-terminus of neighbour sequence of sequence listing upward to telomere on chrosomal short arm and 5'-terminus of this base sequence : 26963
cttcattaacaattctatttgcacttttttctccgtattatttgctcatatcatgattttgatttccctgtaccaattaacagtaggaatttctctttctcaagccaaaaattttcattgcagtatagatagagatcatacaaatatatacacacacacacacacacacacacacacacacacacacatatagaggtctgatctttttttctgaactggctagtcatggttatttctatagtaaaatatttaataagaaacaaagaaacagtaataaataccattagataattggttgctttaaggtagaaagtctatgatttcccctttgataattagctctacatatccaattgtgggactttacactgaagtcaattgag

SEQ ID NO: 2734 - DNA, 398 bp, Homo sapiens
  AC037488.2_185675
  Located on chromosome 2
  Distance between a terminus base of telomere on chromosomal short arm and 5'-terminus of this base sequence : 53802464
  Distance between 3'-terminus of neighbour sequence of sequence listing upward to telomere on chrosomal short arm and 5'-terminus of this base sequence : 52494
gcactgttaaatgcagaataagtaagtctggaattataaataaataattcataattactgaatgagaccagccgatctgaaaaagaagaaaaggaaagcattatcaacacaagagatggacaaagaaaagttgaggattgaggtcatcagtcaaacccttggacccaaccactcctggagctggtctacctccagatcttcagccaagttaagcagtaaattccctttacagaaaacacacacacacacacacacacacacacacacacacacacacacattgagttgggtttctgtcttttgcacctaaattatccacctaataatacacttattaatctttataaagtttagactgagtaaggcctttgatccagtctcctggattcataggttaa

SEQ ID NO: 2735 - DNA, 254 bp, Homo sapiens
  D2S2369
  Located on chromosome 2
  Distance between a terminus base of telomere on chromosomal short arm and 5'-terminus of this base sequence : 53814555
  Distance between 3'-terminus of neighbour sequence of sequence listing upward to telomere on chrosomal short arm and 5'-terminus of this base sequence : 11693
tggggctttccacattgggacaagaagaacataaaaacaaaaaagtaatttagcctgcttataatttactgtattcctccagtgattgctaatcatcagaattcgtgtgtgtgtgtgtgtgtgtgtgtgtgtgtgtgtgtatgtgtgtgtgtgtgtgtgtggacaaaccgtctctagcagcctcactttctcctgtttctccatcctgaagtcaatgcacagcacatttcaactgtggcacaagttcaggtcag

SEQ ID NO: 2736 - DNA, 260 bp, Homo sapiens
  D2S2292
  Located on chromosome 2
  Distance between a terminus base of telomere on chromosomal short arm and 5'-terminus of this base sequence : 54128968
  Distance between 3'-terminus of neighbour sequence of sequence listing upward to telomere on chrosomal short arm and 5'-terminus of this base sequence : 314159
ccagtctggcatatttccaagcattttctctcacttgtgttcataataaatacatgaagtctactccctcttgtatatcataaaatggactgttttcccttttactttcaaactaacagatctacctttccctttctaccttcttccttctcccttccttctctctccctctctttccctccctccctccttctctctcatacacacacacacacacacacacacacagagccagtcctgagaacaatcaggactcagcc

SEQ ID NO: 2737 - DNA, 196 bp, Homo sapiens
  AC009241.3_94893
  Located on chromosome 2
  Distance between a terminus base of telomere on chromosomal short arm and 5'-terminus of this base sequence : 54129073
  Distance between 3'-terminus of neighbour sequence of sequence listing upward to telomere on chrosomal short arm and 5'-terminus of this base sequence : -155
tttcaaactaacagatctacctttccctttctaccttcttccttctcccttccttctctctccctctctttccctccctccctccttctctctcatacacacacacacacacacacacacacagagccagtcctgagaacaatcaggactcagccaaagacagcccctcccctctaatgactaaggctttctgact

SEQ ID NO: 2738 - DNA, 320 bp, Homo sapiens
  chr2.fa.O7frz.55813033
  Located on chromosome 2
  Distance between a terminus base of telomere on chromosomal short arm and 5'-terminus of this base sequence : 54345493
  Distance between 3'-terminus of neighbour sequence of sequence listing upward to telomere on chrosomal short arm and 5'-terminus of this base sequence : 216224
cctttatttccagctactcaagaggctgaagcatgagaatcacttgaacccaggaggtgaaggttgcagtgatctaagattctgccactgcactccagtctcgaaaacagagcaagactctgtctaaataaataaataaataaataaataaataaaaataaaataattcagtgtggcagtgacttcttaacatcatctcctagatgtaaaagataatgaaggaatgccattaaaataacgatggaaaaaaaatttccaacctaaaattctatacccagccaaattatcgattcagtgtgaagacagaataaagacatgtt

SEQ ID NO: 2739 - DNA, 181 bp, Homo sapiens
  chr2.fa.O7frz.55933107
  Located on chromosome 2
  Distance between a terminus base of telomere on chromosomal short arm and 5'-terminus of this base sequence : 54437740
  Distance between 3'-terminus of neighbour sequence of sequence listing upward to telomere on chrosomal short arm and 5'-terminus of this base sequence : 91927
ccacttaaatagtttaaagcaagaagagtaatgcaatgtgcaggatggactgcagtgtgtgtgcgcgtgtgtgtgtgtgtgtgtgtgtgtgtgtgtgtgtgtgtgggagagagagagagaacatttaatgtgtcaggactcgcctctgtgtccaacacactatgcatttagacaggttctg

SEQ ID NO: 2740 - DNA, 452 bp, Homo sapiens
  chr2.fa.O7frz.56025421
  Located on chromosome 2
  Distance between a terminus base of telomere on chromosomal short arm and 5'-terminus of this base sequence : 54529766
  Distance between 3'-terminus of neighbour sequence of sequence listing upward to telomere on chrosomal short arm and 5'-terminus of this base sequence : 91845
aaatggtcaattagtgttactgactgattttgtagaaatcaaaggagaaaaaagggtctgccccctaaaatttcaactaatcttggaaaatccagaaacctatttaagatctttcccacctaatttcatttatccgaatctacagaaggcatgaaacatactgcccagctcccaaggaatatcattaattttaaggtgtttcagagttaacaggggtactacattatatggcttaattcaaactacacttataaggtgatgaggcgtgagcttagctgctgtgaccagaaggaccaaaaacattgttcatccaaaagataagatgaaggccaaaaaagaccatcatcatattgaacacacacacacacacacacacaggcgcgcgcgcgcgcgcaatccaaaatcattatattctggtctaataagaaatgttcagttctgtaacggactta

SEQ ID NO: 2741 - DNA, 340 bp, Homo sapiens
  AC073340.1_150381
  Located on chromosome 2
  Distance between a terminus base of telomere on chromosomal short arm and 5'-terminus of this base sequence : 54715871
  Distance between 3'-terminus of neighbour sequence of sequence listing upward to telomere on chrosomal short arm and 5'-terminus of this base sequence : 185653
caagccagaatgaaagtagacaggtgaacagagatgctgggaaaagctcatgaaaggctaggaagagtgaactcaacttttcctgaatggacatgcacaagtaactctgtaagtagtaatcaattaattgggagtggcacacacacacacacacacacacacacacacacacacacgatacaccaggtttctgaaatatattaggtaggctataagagtttattatttatagacattttagaaaacaacaaagaggtatattcatatactaattataaggcaaagacaaaatcaagttaggaagactcttgcttgagtgttatcagtgaagcatttaagt

SEQ ID NO: 2742 - DNA, 436 bp, Homo sapiens
  chr2.fa.O7frz.56821277
  Located on chromosome 2
  Distance between a terminus base of telomere on chromosomal short arm and 5'-terminus of this base sequence : 54891649
  Distance between 3'-terminus of neighbour sequence of sequence listing upward to telomere on chrosomal short arm and 5'-terminus of this base sequence : 175438
ttcaaggttataatgagctatgattgggccactacactccagcctgggtgacagtgggagatcacatctctaaaaaataaataaataccaaggtgggaggatcacatgagtccaggagttcgagaccaacctggacaatacaatgagacctcatctctactttattttaaataagtaaataaaaaaccaaattgattgtggtgatggttgcacaactctgtgaatattataaaaatcactgaattgtacattttaaatgggtgaattttatggtatgttaattatatataaatagaacagaatttgtgtgtgtgtgtgtgtgtgtgtgtgtgtgtgtgtgtgtgtgtaactgtattagacaggattctccagagaaacagaacaaacaggatgtatttatatacagaaagaaatgtattttaaggaattcgctcac

SEQ ID NO: 2743 - DNA, 238 bp, Homo sapiens
  AC073879.4_181750
  Located on chromosome 2
  Distance between a terminus base of telomere on chromosomal short arm and 5'-terminus of this base sequence : 55174772
  Distance between 3'-terminus of neighbour sequence of sequence listing upward to telomere on chrosomal short arm and 5'-terminus of this base sequence : 282687
aatcagtctttggaatttggtctacttaaattattgaaataatttgtgtaaaataatatcaaagcatgctgggcacagtgacttgacgcctgtagtcccagctactctggaagctgaggtaggaggatcacttgagtttgaggccagcctgggcaacatagcaagtctcatttctaataacaataataataataataataataataatagtaataatatcaaagcagtttgacaaatg

SEQ ID NO: 2744 - DNA, 412 bp, Homo sapiens
  AC069373.2_41908
  Located on chromosome 2
  Distance between a terminus base of telomere on chromosomal short arm and 5'-terminus of this base sequence : 55316248
  Distance between 3'-terminus of neighbour sequence of sequence listing upward to telomere on chrosomal short arm and 5'-terminus of this base sequence : 141238
actcataggtggcaactgaacaatgcaaacacttggacacaggaaggggaacatcatacaccgaggcctgttgtggggtggggggaggggggagggatagcattaggagatatacctaatgtaaatgacgagttaatgggtgcagcacaccaacatggcacatgtatacatatgtaacaaacctgcatgctgtgcacgtgtaccctagaacttaaagtataataaataaataaataaataaataaataaataaataagtaaattaaagtcctttcacattctctccagattatattttaaacccataaaagaaaatctgtctcataatgaaatagtaatatgttgattttaatagaaagtgctattgtggtattagagccccatattaattactagaactttcaagccactg

SEQ ID NO: 2745 - DNA, 277 bp, Homo sapiens
  chr2.fa.O7frz.60531143
  Located on chromosome 2
  Distance between a terminus base of telomere on chromosomal short arm and 5'-terminus of this base sequence : 55505855
  Distance between 3'-terminus of neighbour sequence of sequence listing upward to telomere on chrosomal short arm and 5'-terminus of this base sequence : 189195
tatcaacctgctttactttcagaacggtttttaggaatctaattttatctttaaaccaaattcacaaatttaaaggagaaaagaatgagagagacagagagagagagagagagacatgcaaactgcaaatgttgtattctttagattacatcatagcacaattctaatttattgctttgagaatagtgacatctagtggttataaggtattaataccatgggtacctttgtgtcaaaattcaactgcaactgcaagtaaagtcgaattctatcgaca

SEQ ID NO: 2746 - DNA, 438 bp, Homo sapiens
  chr2.fa.O7frz.60730513
  Located on chromosome 2
  Distance between a terminus base of telomere on chromosomal short arm and 5'-terminus of this base sequence : 55746584
  Distance between 3'-terminus of neighbour sequence of sequence listing upward to telomere on chrosomal short arm and 5'-terminus of this base sequence : 240452
agacatccacaatgaacattacccagcatgatggttaagagtctgggctgtggaatcagagatccagatttgaagaactactgccctttactgatggtttgatttaggactagttacaaatctatccttggatgccaactaaacatgggatcagaatgaccagtatataaagcagctttaaagaatcaatgtattgataccacatagctaccatcaatcaatcaatccctgcaaagcacttagcaatatgtggtacaaaatgatcaattaataagtggtggttataattctttttaaagagatttttagcccaacaaagtatagctcacacatatggactgctgaagcacacatacacacacacacacacacacacacacacacaagtaagaaaagtagctaaatccagagagctgtctggaaacattgagttcttaa

SEQ ID NO: 2747 - DNA, 369 bp, Homo sapiens
  AC068193.5_60759
  Located on chromosome 2
  Distance between a terminus base of telomere on chromosomal short arm and 5'-terminus of this base sequence : 55883064
  Distance between 3'-terminus of neighbour sequence of sequence listing upward to telomere on chrosomal short arm and 5'-terminus of this base sequence : 136042
catacttcaaattccacagtctacacatgtggactctgagcccattccacatagggggttgcttagtgttgttcacacatgtttaaatacatgtagggttcattaagagtgtcctttaagaagatccttttggaagaataatttgccacattagctaaaacaatgtaccttggactttttcttttctatatacacgctgtatacatatacattatatatatatatatatatatatatatatatatatatatatattcattttggctgaattcaggaatgagtctgtgggctgaacgaatcgatctgtcacagagcaacagattgcagctatagactgccaacaaatcacaagcaacagtaggtaatgac

SEQ ID NO: 2748 - DNA, 195 bp, Homo sapiens
  D2S2279
  Located on chromosome 2
  Distance between a terminus base of telomere on chromosomal short arm and 5'-terminus of this base sequence : 55915490
  Distance between 3'-terminus of neighbour sequence of sequence listing upward to telomere on chrosomal short arm and 5'-terminus of this base sequence : 32057
atttgggtcctccagtgtcctccagtgtcacatatatatatacatatatatatgtgtgtgtgtgtgtgtgtgtgtgtgtgtatagtgtatatatatacaattatatatatatatagtgtgtgtatatatatagtgtgtgtgtgtatatatatagagagagagaattgttttatcctcttgctgaacttacccctt

SEQ ID NO: 2749 - DNA, 459 bp, Homo sapiens
  AC068193.5_165968
  Located on chromosome 2
  Distance between a terminus base of telomere on chromosomal short arm and 5'-terminus of this base sequence : 55979708
  Distance between 3'-terminus of neighbour sequence of sequence listing upward to telomere on chrosomal short arm and 5'-terminus of this base sequence : 64023
tgtctagtgttacagtagagctcacacatatggaagcaatcattcaatcaattaaagagaagaactcattaaataaaaacttttgtccattttttgctgagcactattgtgaaaatgagagaagtatatcttacatttcaataatacttcgttgtttagaaaatactttgatagctgttcacatgggaaaagactcagtatgtaatctgttcctcttattttcccattatgatagtcacacacagacatacacacacacacacacacacacacacacacatgcacacacacaattaaacaaaagtagagaacacaaaccatatgttaagtttatgaagagttgggaataggaattttatgaattcccatgtccatagggatagatgggaaaaaaagacatacttgaatattccaaaattcacttcctgaaagagaatgtcaagaattgctttaaacaaa

SEQ ID NO: 2750 - DNA, 215 bp, Homo sapiens
  D2S2388
  Located on chromosome 2
  Distance between a terminus base of telomere on chromosomal short arm and 5'-terminus of this base sequence : 55979925
  Distance between 3'-terminus of neighbour sequence of sequence listing upward to telomere on chrosomal short arm and 5'-terminus of this base sequence : -242
attttcccattatgatagtcacacacagacatacacacacacacacacacacacacacacacatgcacacacacaattaaacaaaagtagagaacacaaaccatatgttaagtttatgaagagttgggaataggaattttatgaattcccatgtccatagggatagatgggaaaaaaagacatacttgaatattccaaaattcacttcctgaaag

SEQ ID NO: 2751 - DNA, 292 bp, Homo sapiens
  AC073215.1_136986
  Located on chromosome 2
  Distance between a terminus base of telomere on chromosomal short arm and 5'-terminus of this base sequence : 56070830
  Distance between 3'-terminus of neighbour sequence of sequence listing upward to telomere on chrosomal short arm and 5'-terminus of this base sequence : 90690
tctaccgtattctagattgcagttttacatttgtgtatgagtatttgatgaacatgtatttaatgatgcatcttataatccaagacatcttagatttctccaccagacagcaaaagcatataccatgtccgtgtgtgtgtgtgtgtgtgtgtgtgtgtgtgtgtgtgtgtgtttcgtcatttaatttcactagctataatggggcttggcttacagtagaaaataattgttttattaattgaatatttattctactataaaaagacccccgtggtaaccagaacaatctctt

SEQ ID NO: 2752 - DNA, 237 bp, Homo sapiens
  chr2.fa.O7frz.61205386
  Located on chromosome 2
  Distance between a terminus base of telomere on chromosomal short arm and 5'-terminus of this base sequence : 56187015
  Distance between 3'-terminus of neighbour sequence of sequence listing upward to telomere on chrosomal short arm and 5'-terminus of this base sequence : 115893
taccattcactgctttctacagagttctttggaatttaaatttaaaggaaaatgtctgtcaaaagtgcttctgcatgtttactgaaaatgaagcataaatatctacaggctggatggtgtgtgtgtgtgtgtgcgtgtgtgtgtgtgtatttatgcatgggtgtgggtgtgagtgggtgtgtttgtgtgtgcatgtagagagggagaaagaaaatggacattaactgtaaggaaata

SEQ ID NO: 2753 - DNA, 316 bp, Homo sapiens
  AC007238.3_84541
  Located on chromosome 2
  Distance between a terminus base of telomere on chromosomal short arm and 5'-terminus of this base sequence : 56407806
  Distance between 3'-terminus of neighbour sequence of sequence listing upward to telomere on chrosomal short arm and 5'-terminus of this base sequence : 220554
cagttaacgttttgataggtagatagattatagatagatagatagatagatagatagatagatagataactgggtgggaagatgaatgaatagatgggtgggtggatggatggacagatggatgaatggatgggtaagtgggtaggtgggtgaatggatggatggatgaatagatagatgatagaaagataggtagatagatagatagatatagatgtgttttcttgaatggcaagcaaggggctgcagttcgtcttgagcaagcaaaggtgaatgatgcagctataatttgtgttcattaatggtatcacagtga

SEQ ID NO: 2754 - DNA, 203 bp, Homo sapiens
  DISD22_0001651
  Located on chromosome 2
  Distance between a terminus base of telomere on chromosomal short arm and 5'-terminus of this base sequence : 56893413
  Distance between 3'-terminus of neighbour sequence of sequence listing upward to telomere on chrosomal short arm and 5'-terminus of this base sequence : 485291
tggtagagattactcaatcaaacacacacctctctctcccatgtgtgagatatatatatatatatatatatatatatatgagataaacatgatatgtatgcatcatatatgtatatatacaaaaatataacattgcacaggaatttcttttcatacaaaaaacgaagaatattaaaattagttcctctcaatcttagcctaca

SEQ ID NO: 2755 - DNA, 162 bp, Homo sapiens
  DISD22_0001653
  Located on chromosome 2
  Distance between a terminus base of telomere on chromosomal short arm and 5'-terminus of this base sequence : 56992929
  Distance between 3'-terminus of neighbour sequence of sequence listing upward to telomere on chrosomal short arm and 5'-terminus of this base sequence : 99313
acactgggtggtgagtcccccagttatatatgaagatacctattactgttccctaattgtatgtacacacacacacacacacacacacacacatacacacacacacacacacacacacatatctataaataaagggcttctggaagctggctgcctattact

SEQ ID NO: 2756 - DNA, 477 bp, Homo sapiens
  AC040988.4_56233
  Located on chromosome 2
  Distance between a terminus base of telomere on chromosomal short arm and 5'-terminus of this base sequence : 57065217
  Distance between 3'-terminus of neighbour sequence of sequence listing upward to telomere on chrosomal short arm and 5'-terminus of this base sequence : 72126
gccaggagtttcagaccagcttggccaacatggtgaaaccccatctctatgaagcatacaaaaatagccaggcctggtggtatgtgcctgtaatcgcagctattggggaggctgaggcacgagcccaggaggcagaggttgcagtgagctgagatcacgccactgtacttcagcctgggtgatagaacgagactctgtctcaatataataacaataataataataataataataataataatgtgttgtatatcatctttggtcatggaatggaggagataaagtcacgttattagcattcagtattccgttgccccagttgagactatttcagcatgtaacatttattgcttaattcccatgaaacccttgtaatgtacacaacctaggggtcgttgttgattttattgagcagtaacttcatgtggaaagactgtgtgtattgagtgaatggttaaatcacagatcaaatgtcct

SEQ ID NO: 2757 - DNA, 241 bp, Homo sapiens
  DISO7_00001013
  Located on chromosome 2
  Distance between a terminus base of telomere on chromosomal short arm and 5'-terminus of this base sequence : 57166312
  Distance between 3'-terminus of neighbour sequence of sequence listing upward to telomere on chrosomal short arm and 5'-terminus of this base sequence : 100618
tagaaggatgggaatgcatgtgtataacacaacacacacacgtacacacacacacacacacacacacacacacacacacacacacacacacacacacacaccctgccatgcaggccttcccagtgagggagtgagggaaagaaggcattgtggggtgcggagaagagggcctgcctgcctgcacactggtttgggggagtctttacaagagaagggatgctggaggcgagtctttaaggca

SEQ ID NO: 2758 - DNA, 475 bp, Homo sapiens
  chr2.fa.O7frz.57450701
  Located on chromosome 2
  Distance between a terminus base of telomere on chromosomal short arm and 5'-terminus of this base sequence : 57233185
  Distance between 3'-terminus of neighbour sequence of sequence listing upward to telomere on chrosomal short arm and 5'-terminus of this base sequence : 66632
ctggtcaacatggtcaaaccccatctctacaaaaaaataaaaaaattagccagacatggtggcatgtgcctatggtcccagctactcgagaggctgagatgggaggatcactgagccctgggaaggtcgaggctgtcatcatgccactgcacttcagcctgggcaacagagtgagaccctgtctcatactactactactactactactactactactactactgctactactactactaccaataataataataatttagttgctctgataaaaggccatgttactttacttatggctactatttgagtgcccactgtgtctcacaccctgtgctgagcgttcccatttaccccatttggcagatgaaaactacagcatgttctcaactcagtagagagacacactcttacacatggaatcttaaaaaggttttaattagtcacttacaccaagttctgtgatagttccacagtg

SEQ ID NO: 2759 - DNA, 153 bp, Homo sapiens
  chr2.fa.O7frz.57571211
  Located on chromosome 2
  Distance between a terminus base of telomere on chromosomal short arm and 5'-terminus of this base sequence : 57354057
  Distance between 3'-terminus of neighbour sequence of sequence listing upward to telomere on chrosomal short arm and 5'-terminus of this base sequence : 120397
atgtagagcatggtgactgtatttaattatactgtattactttaaatttgctaacagagtagatcctaagtgtcctcaccaaacgcacacacacacacacacacacacacacacacacacacaatggtaactatgtcatgattaatgcattaa

SEQ ID NO: 2760 - DNA, 114 bp, Homo sapiens
  DISO7_10000894
  Located on chromosome 2
  Distance between a terminus base of telomere on chromosomal short arm and 5'-terminus of this base sequence : 57438896
  Distance between 3'-terminus of neighbour sequence of sequence listing upward to telomere on chrosomal short arm and 5'-terminus of this base sequence : 84686
accagttaatcggcaagcaaacacacacacacacacacacacacacacacacaccaccttttaaagaacactgaaatcagagcatctctcaaatctgtcactatgctatactgg

SEQ ID NO: 2761 - DNA, 104 bp, Homo sapiens
  DISO7_10000895
  Located on chromosome 2
  Distance between a terminus base of telomere on chromosomal short arm and 5'-terminus of this base sequence : 57453628
  Distance between 3'-terminus of neighbour sequence of sequence listing upward to telomere on chrosomal short arm and 5'-terminus of this base sequence : 14618
acctgaactgctattcctctgaaattctaaattcaacatccaacacacacacacacacacacacacacacacacaccctgctctcccgcacatgcattctttct

SEQ ID NO: 2762 - DNA, 309 bp, Homo sapiens
  AC012358.6_81719
  Located on chromosome 2
  Distance between a terminus base of telomere on chromosomal short arm and 5'-terminus of this base sequence : 57720432
  Distance between 3'-terminus of neighbour sequence of sequence listing upward to telomere on chrosomal short arm and 5'-terminus of this base sequence : 266700
tctaagttccatttcaatttaaacatgctctcttttttattgatggtcttttggaaattagactgtgaacacaacattgctactggcctacgaaagagagagagaaagagggagagagaaagagagagagagagagagagagagagagacttttcttatggttactgggttagtgatgaaacccacaactcataaaccacacactatggaatatggaattattccaaaaagttcttcagagctggtaatgaaagcctaagaagtacactgttaaaattttaaaaagtcagtatgtttctcatttcagac

SEQ ID NO: 2763 - DNA, 333 bp, Homo sapiens
  chr2.fa.O7frz.58266073
  Located on chromosome 2
  Distance between a terminus base of telomere on chromosomal short arm and 5'-terminus of this base sequence : 57877898
  Distance between 3'-terminus of neighbour sequence of sequence listing upward to telomere on chrosomal short arm and 5'-terminus of this base sequence : 157157
caaaggtcctgtaacaatacagtatatattttcaaagaataaaaaaagagaaaacattttctaactctttatataaagctaatataaccttgattttttttcctttcttccttctttctttctttctttctttctttctttctttctttctttctttttctctctctctctctctttttttttttttaagttttttctattgcccaggctggaatgcagtggtgcaatcactactcactgcagccttgacctcttgggctcaagcgagcctcccacctaagcctcctgaatagctgggactacaggtgtgcaccatcatgcctggttaatttg

SEQ ID NO: 2764 - DNA, 425 bp, Homo sapiens
  chr2.fa.O7frz.58372131
  Located on chromosome 2
  Distance between a terminus base of telomere on chromosomal short arm and 5'-terminus of this base sequence : 57990556
  Distance between 3'-terminus of neighbour sequence of sequence listing upward to telomere on chrosomal short arm and 5'-terminus of this base sequence : 112325
gtatttaggcctcagtgaactattttgaaatttaaattgatggccaggcgcagtggctcatgcctgtaatcctagcattttgggaggccaaggtaggtggatcacctgaggtcaggagttggagtccagcctgaccaacatggtgaaaccccatctctactaaaaataaaaaaattagccaggagtggtggcgcatgcctgtaatcccagctgcttcagaggctgaggcaggagaattgcttgaacccgggaggcagaggctgcagtgagccaagattgcaccactgcactccagcctgggcaacaagagcaagactccatctcaaaaataaataaataaataaataaatagataaccaaacatctaaagcacttcagcacagtgcttcgtatgtagttagtgttcaataagtgctattagctgc

SEQ ID NO: 2765 - DNA, 372 bp, Homo sapiens
  AC015982.6_10228
  Located on chromosome 2
  Distance between a terminus base of telomere on chromosomal short arm and 5'-terminus of this base sequence : 58148112
  Distance between 3'-terminus of neighbour sequence of sequence listing upward to telomere on chrosomal short arm and 5'-terminus of this base sequence : 157131
aggtcatgctgtagtctttgaaatgtttacatttaaaataaaacctcgagggccgggccgggtggctcacgcctataatcccctcactttgggaggttgggacgggtggatcacgaggtcaggagttcaagaccagcctggccaagatggtgaaacccccgcctccactaaaaatacaaagattagctgggcctggtggcaggtgcctgtaatcccagctacttgggaggctgaggcaggagaatcgcttgaacctgtggggcgtaggttgcagtgaccccaatgcactccagctgggtgacagagtgagcctccatctcaataaataaataaataaataaataaagcctctgcttattcttgtgaatcaat

SEQ ID NO: 2766 - DNA, 391 bp, Homo sapiens
  AC010895.6_108335
  Located on chromosome 2
  Distance between a terminus base of telomere on chromosomal short arm and 5'-terminus of this base sequence : 58199209
  Distance between 3'-terminus of neighbour sequence of sequence listing upward to telomere on chrosomal short arm and 5'-terminus of this base sequence : 50725
ggcgattagaaaccttcattagatcattaacatccttttaccatgtaatgaaccataaccatagaagtaatcccaggggcaaagattaaaatgcatgccaaaattctgcataccacaacattttagatgttaaataagaaaagaaaagctggcttcaaaatttgggaagatattattagaagttgtaattttttttatctgttcacattactggctgcaggctttatttatttatttatttatttatttatttatttatttatttaagagacagtgtctcactgcattgcccaggcgagtctcgaactcctgggcacaagcaatactctgagtagctgggactacatatgtgtgccattgtggctggcttactggctacagtctttgagtt

SEQ ID NO: 2767 - DNA, 330 bp, Homo sapiens
  AC010895.4_72895
  Located on chromosome 2
  Distance between a terminus base of telomere on chromosomal short arm and 5'-terminus of this base sequence : 58210275
  Distance between 3'-terminus of neighbour sequence of sequence listing upward to telomere on chrosomal short arm and 5'-terminus of this base sequence : 10675
agtggcatacatgtttctaattacattcctttggggagaactcaatcacattgtcagagtctaattgtgagggagcctggaaaatgtacaccaccatattcccagaaaagaggcaatcgtttgatgaacagctggccagtatctgtcaaagtgtttatatacaacaccacacacacacacacacacacacacacgggatcctgtgaattacaatatttatttgaaaagaagagaaaggactgtaaaatctttgagcttatttcacttctgtcttaatacactaacccacttttaacctacccatttctttgaatttcacgtacttagaaa

SEQ ID NO: 2768 - DNA, 436 bp, Homo sapiens
  AC010895.4_152628
  Located on chromosome 2
  Distance between a terminus base of telomere on chromosomal short arm and 5'-terminus of this base sequence : 58311962
  Distance between 3'-terminus of neighbour sequence of sequence listing upward to telomere on chrosomal short arm and 5'-terminus of this base sequence : 101357
aataaagatgctgtttaggtacagggaaaactaatacttatttgttatatggagtccaacagaagcaaaagacaaccttataatttcatttattacttccattaatgtagagcctagcataatcatcaccttaatcattctggaagatttttcagaaattaatactctcaaaatatttgatgagtgtgtgtctatgtgtatgtgtattcttttgtctctctgtctctctctccacacacacacacacacacacacacacacacacacagttttcatttgtataggcctgtgaaatgagaacagttatttcatccacaaaataagtcttttagagaaagttaagaatccaaaactttcaatttcattttattcctgtggacaaggctcagaaggaacgatttccgtaggagaaagcaattgctttatactttagaag

SEQ ID NO: 2769 - DNA, 403 bp, Homo sapiens
  chr2.fa.O7frz.58764503
  Located on chromosome 2
  Distance between a terminus base of telomere on chromosomal short arm and 5'-terminus of this base sequence : 58369988
  Distance between 3'-terminus of neighbour sequence of sequence listing upward to telomere on chrosomal short arm and 5'-terminus of this base sequence : 57590
gcaaatgtagaaactctattcaaggtaagaggttaaaagtttatatatccacagagagatattgcaaggaaattgcttggatttaagtgtgtgtgtgtgtgtgtgtgtgtgtgtgtgtgtgtgtgtgtgttttgtaaagaactctgttcaagaagatgcttcaattatagttaatttttaaaagggccaagagttataaaacacttgaatttgttcaattcatttggaaaaatgctgggatcagaaagaacttttcaatctgattttaaaattggtgaatttcgttttatgattaaaaagaaaaagaacaaaaaggagatcttggcagccattttctccaactccctcatgaaatttaaagcttagacgacttatccaagttaacactagtaagtggcagaac

SEQ ID NO: 2770 - DNA, 367 bp, Homo sapiens
  chr2.fa.O7frz.58952593
  Located on chromosome 2
  Distance between a terminus base of telomere on chromosomal short arm and 5'-terminus of this base sequence : 58478767
  Distance between 3'-terminus of neighbour sequence of sequence listing upward to telomere on chrosomal short arm and 5'-terminus of this base sequence : 108376
gaagtgagtaactgtttcctgtctcttcagtgaagaactgagttcctgttccacccctataacaagtggcactttttaatttaagcacctttgtgtgggatgaggattaggtgtgtggaatgggaaggagtaaagtagagaaagagagtggcctatgtgtagtgtgtgtgtgtgtgtgtgtgtgtgtgtgtgtgcgcgcgcgtgcgcatgcctacttcccaaatatctttctcccagagacccagaataagtccaatatactctaggcaaataggaaagaatacaaatttcccttaaatctttctctgaagtggggggtaaagtggccaaaggatttccccacttctcagtcttgcacttactggta

SEQ ID NO: 2771 - DNA, 265 bp, Homo sapiens
  chr2.fa.O7frz.58872403
  Located on chromosome 2
  Distance between a terminus base of telomere on chromosomal short arm and 5'-terminus of this base sequence : 58553625
  Distance between 3'-terminus of neighbour sequence of sequence listing upward to telomere on chrosomal short arm and 5'-terminus of this base sequence : 74491
catttcagtgagctagaattctagtgtggttaaagtaatataataaacaagaaaacttttggaagtgatgaatatgtttattaccttgattgtgataatgctaatatcagtgtgtatatatatatatatatatatatgtccaaacttaccagattatatacatgaagattctgtataccaattatacctcaataaagctggcagggaggaaaacataataaacttatcttgaaaatgaaatacagtttatcctaatcaatgaatc

SEQ ID NO: 2772 - DNA, 234 bp, Homo sapiens
  AC007743.3_62122
  Located on chromosome 2
  Distance between a terminus base of telomere on chromosomal short arm and 5'-terminus of this base sequence : 58689325
  Distance between 3'-terminus of neighbour sequence of sequence listing upward to telomere on chrosomal short arm and 5'-terminus of this base sequence : 135435
gaatcttagttatttaggccttctgtaggcttttccatgagacaggagatatctaagggaaaaagagtggatttggtaattgctcaaaaactatttcaattatttcatctctctccacacacacacacacacacacacacacacacacacacacacacacacacgtacatacacacagcatttagtgttcttgtatgtatatttaaaaatgttaaatgcattacgtttaaagat

SEQ ID NO: 2773 - DNA, 243 bp, Homo sapiens
  chr2.fa.O7frz.59290474
  Located on chromosome 2
  Distance between a terminus base of telomere on chromosomal short arm and 5'-terminus of this base sequence : 58903749
  Distance between 3'-terminus of neighbour sequence of sequence listing upward to telomere on chrosomal short arm and 5'-terminus of this base sequence : 214190
gtctatgatccatttgaaactaacttttgtgtggggtgtaaggtatgggttcaatttgtgtgtgtgtgtgtgtgtgtgtgtgtgtgttgatatccatttaactcaagcctctatattgaaaagaatattctttcccctaataaattatctttgtacccttgtcaaaagcctattgaccataaatgtataggtttatttctgtagtgtatttcattgttctttatgcctatcttatgcgagtac

SEQ ID NO: 2774 - DNA, 400 bp, Homo sapiens
  chr2.fa.O7frz.59498964
  Located on chromosome 2
  Distance between a terminus base of telomere on chromosomal short arm and 5'-terminus of this base sequence : 59112174
  Distance between 3'-terminus of neighbour sequence of sequence listing upward to telomere on chrosomal short arm and 5'-terminus of this base sequence : 208182
tcaaacattggactccaagttcttcagctttgggacttgaactggcttccttgctcctcagcttgcagatgacatattgtgggaccttgtgatcgtgtgagttaatactacttaataaactcacacacacacacacacacacacacacacacacatatatatatatcttattagttatgtctctctagagaaccctgaataacacaactgtttaaaaccttcttgtggcatctgattgtctaaatgtaaagggcaaagtttgccagcttggtatagtaggccacccatacttcttaccctcacaacttctccagtcgtatatcttgcttattttcccccttttctcatcacattttgaatttatttatgatttcatgaaggtcttgtatgaattcctact

SEQ ID NO: 2775 - DNA, 399 bp, Homo sapiens
  chr2.fa.O7frz.59589337
  Located on chromosome 2
  Distance between a terminus base of telomere on chromosomal short arm and 5'-terminus of this base sequence : 59202500
  Distance between 3'-terminus of neighbour sequence of sequence listing upward to telomere on chrosomal short arm and 5'-terminus of this base sequence : 89926
gttacaattagctgtggcatagctgctgcttgtggattgagatgtgtagttgagaagtgctgtactaaaacatatcatcaactctagagacttaaaacaggctatctatgggttttattgtttctcctgttcctttcctcctttgccataaataatctctgaatagactgtgtgtgtgtgtgtgtgtgtgtgtgtgtgtgtgttttaactactaaaatgaattgataaaatttctcactctgtctttaactcattttaaatgtacccagtttttcctaaggggacagcaaaaggattgaacagagatgagacagaggaaatccgaaaaaaaaaaaaatcaggaactccaattcaggaacacagccgttgtttccagaatctatgtcagcggttactatg

SEQ ID NO: 2776 - DNA, 187 bp, Homo sapiens
  AC007971.2_7517
  Located on chromosome 2
  Distance between a terminus base of telomere on chromosomal short arm and 5'-terminus of this base sequence : 59273521
  Distance between 3'-terminus of neighbour sequence of sequence listing upward to telomere on chrosomal short arm and 5'-terminus of this base sequence : 70622
atcctctattcgtgttattgaataattcatttcttctcattgctgtaaaatatgttatcctgatgaaatttcaaagttgtttatcctttatcctactcatgcaaatatatatttgtatgtgtgtgtgtgtatatatatatatatatatatataatgaaccatgctatcatgagcattcttatgtaca

SEQ ID NO: 2777 - DNA, 396 bp, Homo sapiens
  AC007971.2_111868
  Located on chromosome 2
  Distance between a terminus base of telomere on chromosomal short arm and 5'-terminus of this base sequence : 59377858
  Distance between 3'-terminus of neighbour sequence of sequence listing upward to telomere on chrosomal short arm and 5'-terminus of this base sequence : 104150
gatttattgaggtctaactgacaaaattgttatggtgtgtgatgtaatttgatacatatatgtatatacacatatacatatatataaatgattgccatatttaagttaattaaaacatctatttctttacctagttactattctgtgtgtgtgtgtgtgtgtgtgtgtgtgtgttttatggtgagaatatttaaaatcttctcttagcaaatttcaagtttacaatgcagcattattaactatagttaccatgctgtacattagatcctcccagaacttattgatcttataaatgaaatttgtaccatttgaaaaatatgtccccagtttgcgcaccccccaggccctagcaacccccagaactctctgtttgtatgagtttgacttagattccac

SEQ ID NO: 2778 - DNA, 162 bp, Homo sapiens
  AC007971.2_124503
  Located on chromosome 2
  Distance between a terminus base of telomere on chromosomal short arm and 5'-terminus of this base sequence : 59390555
  Distance between 3'-terminus of neighbour sequence of sequence listing upward to telomere on chrosomal short arm and 5'-terminus of this base sequence : 12301
ggaatatccaagattcttgataacacaagccaggcaaagtgtcagttttggttcctcatactgatgcaactgtgactacagacacacacacacacacacacacacacacacacacaatgagagagagatttctaccacctgcagaaactaaagttaacagac

SEQ ID NO: 2779 - DNA, 327 bp, Homo sapiens
  Z24365.1_227
  Located on chromosome 2
  Distance between a terminus base of telomere on chromosomal short arm and 5'-terminus of this base sequence : 59564856
  Distance between 3'-terminus of neighbour sequence of sequence listing upward to telomere on chrosomal short arm and 5'-terminus of this base sequence : 174139
caacagatttagtcacgtagaatatgtgggctggtcagatattccaggtgaatattcaacttttctacttcatagaattctgtagacttaaatacaggaataggattgattttgctgatcaaccagaaaaatattttctttggaggaagagtgcttactatagatgcaaatacacacacacacacacacacacacacacacacacacacacatacattagcaaaacatagtgatcctagcgctggtaagcagtgtaataaaaaacagagcaattaagtaaaatcaaattttctgctcaatttgaactcattggcatgtaaagtctac

SEQ ID NO: 2780 - DNA, 217 bp, Homo sapiens
  D2S378
  Located on chromosome 2
  Distance between a terminus base of telomere on chromosomal short arm and 5'-terminus of this base sequence : 59564880
  Distance between 3'-terminus of neighbour sequence of sequence listing upward to telomere on chrosomal short arm and 5'-terminus of this base sequence : -303
tgtgggctggtcagatattccaggtgaatattcaacttttctacttcatagaattctgtagacttaaatacaggaataggattgattttgctgatcaaccagaaaaatattttctttggaggaagagtgcttactatagatgcaaatacacacacacacacacacacacacacacacacacacacacatacattagcaaaacatagtgatcctagcg

SEQ ID NO: 2781 - DNA, 244 bp, Homo sapiens
  AC007367.3_187150
  Located on chromosome 2
  Distance between a terminus base of telomere on chromosomal short arm and 5'-terminus of this base sequence : 59762555
  Distance between 3'-terminus of neighbour sequence of sequence listing upward to telomere on chrosomal short arm and 5'-terminus of this base sequence : 197458
agatgtgaagtattgatttaccacaagcactctttgaccttcagaaatctgttgatagtttcttcccttaatgatatgtccttgttaaggttatttcctcaactggtatcagccatcttctagaaatcacacacacacacacacacacactcttacacttacacaaacattcagagatgtccatgttgccccatgggcaattgttctcatattatttctcctccatctagtacatacttgcagt

SEQ ID NO: 2782 - DNA, 396 bp, Homo sapiens
  AC007367.3_43900
  Located on chromosome 2
  Distance between a terminus base of telomere on chromosomal short arm and 5'-terminus of this base sequence : 59905736
  Distance between 3'-terminus of neighbour sequence of sequence listing upward to telomere on chrosomal short arm and 5'-terminus of this base sequence : 142937
tagtcagtaaccttctgcttgtggtatgtttctttgtctcacttgttctgaatcttcatgctcctgaacgtaatttggatgtctcatgtggcacaggacagttgggatacaatacccagttctttactagttttcacactaaaaaaaagactaccagcatcaagcagttaataagtttgtagtttgtgtgtatgcgtgtgtgtgtgtgtgtgtgtgtgtatgtgtgtgcaagcacgtgtgtgttgtgggaggggtaaggagtaacggaggagaaggtcattatgctgtctatggggactttcaccaatttcttttctgctctctaaaattcacctcattcacttgaggttgaggcaagtgtcattcagaaaacttccattcctgtttactgtaata

SEQ ID NO: 2783 - DNA, 158 bp, Homo sapiens
  AC007252.2_113056
  Located on chromosome 2
  Distance between a terminus base of telomere on chromosomal short arm and 5'-terminus of this base sequence : 59996478
  Distance between 3'-terminus of neighbour sequence of sequence listing upward to telomere on chrosomal short arm and 5'-terminus of this base sequence : 90346
tgctttctgtctacttagcctaagtgtgtgtgtgtgtgtgtgtgtgtgtgtgtgtgtgtgtgtgtgtgtgtgtatgtgtctacaggcatgtgttctaaccctccagtcccaggtagaaattggtggggtcagttctgggatggtgatagaatctggca

SEQ ID NO: 2784 - DNA, 310 bp, Homo sapiens
  AC007252.2_6595
  Located on chromosome 2
  Distance between a terminus base of telomere on chromosomal short arm and 5'-terminus of this base sequence : 60102836
  Distance between 3'-terminus of neighbour sequence of sequence listing upward to telomere on chrosomal short arm and 5'-terminus of this base sequence : 106200
catccattctatttcttagttcacatgatgggaagagaagctatcttgctgtctccctacctggtttctctttatttgtgtttgtaattcactttctcataccatgtctatatttcattttatgtatacatgcatatatatatatacacatacacacacacacacacacacacacatatattatttcacattttcatctgtgttttgctgtaacactggaggtttattattttagattgttgtgaggcacctgaatattttgcaagacaatgagcctctagaatcttggtatccaaggaactaatttcgt

SEQ ID NO: 2785 - DNA, 238 bp, Homo sapiens
  D2S2183
  Located on chromosome 2
  Distance between a terminus base of telomere on chromosomal short arm and 5'-terminus of this base sequence : 60106712
  Distance between 3'-terminus of neighbour sequence of sequence listing upward to telomere on chrosomal short arm and 5'-terminus of this base sequence : 3566
aggacatttataccctatgctcttctttaaggcctgattttgtgtgtgtgtgtgtgtgtgtgtgtgtgtgtgtgtgtgtgtgtgtgtgtgtgtgaatataatacgtctcaacctcaacttgctccgaaaactcggaattccttccttgtttctgaacagccccaaccgcagacctggggcctattatatcctctgaaatgatggttaaagtaaatttggagacaaagccaggttctgg

SEQ ID NO: 2786 - DNA, 369 bp, Homo sapiens
  AC007077.2_101051
  Located on chromosome 2
  Distance between a terminus base of telomere on chromosomal short arm and 5'-terminus of this base sequence : 60190253
  Distance between 3'-terminus of neighbour sequence of sequence listing upward to telomere on chrosomal short arm and 5'-terminus of this base sequence : 83303
agaatggtttaaaatacctggtagaatataaaacattgagacaagagaccacctctcttctctctctctcttgcaccctctctctctgtctctttcacacacacacacacacacacacacaccacacacactcttctcacacttcacagactatgttaacagaaatttacttgaaatgtagggctgtttttaagggaaaaaaaaccccaattaaggatttagaataaatacactattataaccactgtctttttaaaaatgagttttcttttagcttttaaggtttatagaaatcacttatctgctccttaaaagatttttattcttttttcccttctcttttttataagtatagcgaatgtgaaacat

SEQ ID NO: 2787 - DNA, 165 bp, Homo sapiens
  AC007077.2_33886
  Located on chromosome 2
  Distance between a terminus base of telomere on chromosomal short arm and 5'-terminus of this base sequence : 60257470
  Distance between 3'-terminus of neighbour sequence of sequence listing upward to telomere on chrosomal short arm and 5'-terminus of this base sequence : 66848
aaaccaaatccaaacatatgtgagggtgtgtgtgtgtgtgtgtgtgtgtgtgtgtgtgtgtgtgtgtgtgagagagagagagagagaatgtgtctctgaatgttgaatgagaaaggggagagaagaaataatgatatcattattaccataccttaaccactcaac

SEQ ID NO: 2788 - DNA, 96 bp, Homo sapiens
  D2S393
  Located on chromosome 2
  Distance between a terminus base of telomere on chromosomal short arm and 5'-terminus of this base sequence : 60515444
  Distance between 3'-terminus of neighbour sequence of sequence listing upward to telomere on chrosomal short arm and 5'-terminus of this base sequence : 257809
acacacatatggttggagagtgaaaagtgtgtgtgtgtgtgtgtgtgtgtgtgtgtgtgtgtgagtgtgggtgtatatgccttccagacagtgtag

SEQ ID NO: 2789 - DNA, 344 bp, Homo sapiens
  AC007179.3_24078
  Located on chromosome 2
  Distance between a terminus base of telomere on chromosomal short arm and 5'-terminus of this base sequence : 60793816
  Distance between 3'-terminus of neighbour sequence of sequence listing upward to telomere on chrosomal short arm and 5'-terminus of this base sequence : 278276
aatgtagcatcaatagatttcaagcagagtagtaagaagcactgccattagagcatcatgtgtcctctaactgcagataaccgttcttgattctgaaaaggaacatggtccagagagcaactgataatccctgggaacttttatttatttatttatttatttatttatttatttatttatttatttttgagacggagtctcgctctgtcgcccaggctagagtgcagtggcttgatctcggctcactgcaagctccacctcatccctgggaactttttaactgtcaatgcctcagatatggcaagggcaagtcatacctgtgtactcagctacttcactatcat

SEQ ID NO: 2790 - DNA, 158 bp, Homo sapiens
  Z67171
  Located on chromosome 2
  Distance between a terminus base of telomere on chromosomal short arm and 5'-terminus of this base sequence : 60908260
  Distance between 3'-terminus of neighbour sequence of sequence listing upward to telomere on chrosomal short arm and 5'-terminus of this base sequence : 114100
cagaattgctcataggatagaacctagcaatgagtaattggattcaattgtgtatactttaaggtgtgtgtgtgtgtgtgtgtgtgtgtgtgtgtttctcagaagaattgtggaacatggggtgtggcgcaatttggagccagtccagtacatatttg

SEQ ID NO: 2791 - DNA, 181 bp, Homo sapiens
  AC007006.3_12842
  Located on chromosome 2
  Distance between a terminus base of telomere on chromosomal short arm and 5'-terminus of this base sequence : 60916935
  Distance between 3'-terminus of neighbour sequence of sequence listing upward to telomere on chrosomal short arm and 5'-terminus of this base sequence : 8517
ctaacaatgatccaagcaatattgccctcaaaatcagattcccaaagttagtattgacacttccaagccctgtaccctgaccctggttcccctacacacacacacacacacacacacacacacacacacaattacaagactacaaaatgaaatagcttctctagctttcatgtaccaaagg

SEQ ID NO: 2792 - DNA, 414 bp, Homo sapiens
  AC007006.3_11563
  Located on chromosome 2
  Distance between a terminus base of telomere on chromosomal short arm and 5'-terminus of this base sequence : 60918163
  Distance between 3'-terminus of neighbour sequence of sequence listing upward to telomere on chrosomal short arm and 5'-terminus of this base sequence : 1047
aggcagaacatctagaacctagatgttctagacacttgagaaatgcatttttgccgattttgcaaacctataaaaaataatctatggaataaaaatctaccaaaaaaagcaaaatcctccattcagaatttagcatggatgtatgcatgtgtgtgtgtgtgtgtgtgtgtgtgtgtgtgtgagagagagagagagagagagagagacagagaggaggagtaggggagacagagagaaagagggagaaatggaggcataaaaaacggtgataaaaatgacgtcctgagttttaaaaaatattttatctccagtatatacatctctttctggagtaactattactgttatgtgagatgccagaacagtgccagaggtgaaagtgcatgataggcctaatagaacatgcaaacgtct

SEQ ID NO: 2793 - DNA, 362 bp, Homo sapiens
  AC007006.3_4967
  Located on chromosome 2
  Distance between a terminus base of telomere on chromosomal short arm and 5'-terminus of this base sequence : 60924827
  Distance between 3'-terminus of neighbour sequence of sequence listing upward to telomere on chrosomal short arm and 5'-terminus of this base sequence : 6250
cttaactgcatagagactcagaatccttttcaccattgatttcagggaagctattacaaattaatcagagttagtatacaaacacacacacacacacacacacacacacacaccccactctgtccctaatttataaaaacaatagaggtacatattaatgtaatataatatttagaaaaagatgaatgaaaaaatctcagaaaaaccattcacatttgcacatacaccacatgcacacacacactttttaccaacaagggtctccatagacccagaatgcttaaagattggggaaaattctttagttaattcaagcccatgaatgatatgctgggatacttaatgacaaagtctatcagaaa

SEQ ID NO: 2794 - DNA, 216 bp, Homo sapiens
  D2S370
  Located on chromosome 2
  Distance between a terminus base of telomere on chromosomal short arm and 5'-terminus of this base sequence : 61073209
  Distance between 3'-terminus of neighbour sequence of sequence listing upward to telomere on chrosomal short arm and 5'-terminus of this base sequence : 148020
gacgagcatgtttttgtctactgatgtttcattttacaaactatatatatgcatacacatacgtatgtacgtatgtatattatacatgtattacacacacacacacacacacacacacacacacacatttcaattttactaatggtactgagccaaaatttttcttctgcactaaatctaaaaggcacaataatgaggcttctaagggatggggcc

SEQ ID NO: 2795 - DNA, 364 bp, Homo sapiens
  chr2.fa.O7frz.63013880
  Located on chromosome 2
  Distance between a terminus base of telomere on chromosomal short arm and 5'-terminus of this base sequence : 61199049
  Distance between 3'-terminus of neighbour sequence of sequence listing upward to telomere on chrosomal short arm and 5'-terminus of this base sequence : 125624
aagaatccttcagaagtgagagaagcttgagatggctgcagcttttttagcttttcaaggacactttgtgtttgattgtgtgtgtgtgtgtgtgtgtgtgtgtgtgtgtgtgtgtttgaaaggtccacatattcagttcctttcacattaatagaaggcacatggttccttcacgagggaaaatatctttcagaaacagcataatttgctctagtggataacaaatagttggaagtcttctcagcgagcaaccattgtatctggtttcaaattcctttttcaagccaaagaaaatgatgatgatctctaagtcatagctgttttttgacacagacctgaactcagaattctaaacaggactatg

SEQ ID NO: 2796 - DNA, 170 bp, Homo sapiens
  HUMUT2032
  Located on chromosome 2
  Distance between a terminus base of telomere on chromosomal short arm and 5'-terminus of this base sequence : 61326854
  Distance between 3'-terminus of neighbour sequence of sequence listing upward to telomere on chrosomal short arm and 5'-terminus of this base sequence : 127441
cgtggcaaagtatctggggacatatggatgtccaataaatgttttccttccttccttccttccttccttccttccttccttccttctaacgacaaatgacttcagccacttctttctccaagagcataaaagtgctctttatcttccactggacacaaggcccagttgcc

SEQ ID NO: 2797 - DNA, 251 bp, Homo sapiens
  HUMUT5047
  Located on chromosome 2
  Distance between a terminus base of telomere on chromosomal short arm and 5'-terminus of this base sequence : 61503624
  Distance between 3'-terminus of neighbour sequence of sequence listing upward to telomere on chrosomal short arm and 5'-terminus of this base sequence : 176600
ctttacagtatgaagctgggtgtcttcctggaatgggagaaggtaacagaataacaacagaacacaaattaatatctctataaattatcctgctatagatgaatagataaatggacagattagactgatggaagattagatagatagatagatagatagatagatagatagatagatagatggacagatagataatatagagtattagtcaggattctttagagaaagagaaccaacaggatgtgtagaga

SEQ ID NO: 2798 - DNA, 214 bp, Homo sapiens
  Z67365
  Located on chromosome 2
  Distance between a terminus base of telomere on chromosomal short arm and 5'-terminus of this base sequence : 61504437
  Distance between 3'-terminus of neighbour sequence of sequence listing upward to telomere on chrosomal short arm and 5'-terminus of this base sequence : 562
ggaaagattcattcccacactgaatactctgggggagaattgggaatatatttcttaatcattcaaattttttatagtgaaaatgtactgataaattatttgctctgtgtgtgtgtgtgtgtgtgtgtgtgtgtgcacgtatgtttaaaggacaaggattctggagggaagaaagggaaaagaatgctatttattccttcaaactgctggcaaa

SEQ ID NO: 2799 - DNA, 474 bp, Homo sapiens
  AC048389.2_110858
  Located on chromosome 2
  Distance between a terminus base of telomere on chromosomal short arm and 5'-terminus of this base sequence : 61595400
  Distance between 3'-terminus of neighbour sequence of sequence listing upward to telomere on chrosomal short arm and 5'-terminus of this base sequence : 90749
gaatctcaccagtgttcagatcccaaactctgctgaagggaaagccatgaccctttcttcaaattgtttgaagccagttgcaaaataagtctaagaaaaaaagtggaatgttaacaaggaaaatgtattttttcttcttttttttgagatagcagccaagtactttccaaaatcaacccatggatccaggaagctcagtgaacccaaatagataaatacaaggaaaaccatacctagacatcacacacacacacacacacacacacacacagacacacacacaatatgtatatttccaacttctgtagaaaaaaaagactcactgttaaaagcaaaaatgataatatattatggagtttatagcataaatagaagtaaaatatatgaaaacaatagcataaagggcaagaagcaggtgaatgtaattatattgctgtttcttgcattgccattcattaggaatgtatttgaaag

SEQ ID NO: 2800 - DNA, 442 bp, Homo sapiens
  AC048389.2_52284
  Located on chromosome 2
  Distance between a terminus base of telomere on chromosomal short arm and 5'-terminus of this base sequence : 61622620
  Distance between 3'-terminus of neighbour sequence of sequence listing upward to telomere on chrosomal short arm and 5'-terminus of this base sequence : 26746
aacctactgttaaatcaagtcctacccttcgctacagaaatctcagcccacccagagtcaaggaagagggttattgcagaaaggaggcattaagttggaaggatacttggggagcctctagcctagtggtcgtcaaacctgagtgtgtctctgaatcaacgaaggagaagatgccccagcccagagactctgattcagcggatctggggagcagcctgggaatatatatacacacacaggacattcacacacacacacacacacacacacacacacacacacacacactctctctctcacgtaactttgtcacaggtggcccaagcacagcactttgagaaacactgctgtagttcaatatcctctgagggtcaacgcagttgcccaagacacatgaaccattggcagtagagttaggagtagcattcaagtctgtagactc

SEQ ID NO: 2801 - DNA, 422 bp, Homo sapiens
  AC009970.6_54675
  Located on chromosome 2
  Distance between a terminus base of telomere on chromosomal short arm and 5'-terminus of this base sequence : 61701701
  Distance between 3'-terminus of neighbour sequence of sequence listing upward to telomere on chrosomal short arm and 5'-terminus of this base sequence : 78639
ggtggtacgcacctgtaatcccagccactcaggaggctgaggcaggagaaccacttgaacccgggaggtagaggttgcagtgagccaagatcgtgccattgcactccagcctgggcaatagagtgagactccatctcaacaataataataataataataataataataataataataataataataatctgaacagcccacaaaaggcttgggaaagtaaaaacaatgccctgtatttggtctcctccatccaagtggctgggactctgtcctctagtctgtgctcatgtcaggcaaccaatttatctctctgcaatctgaagttccactctgcagagaggacacagtgagaacccctggcagatttgtgagcctcttccctgcttctgccattcatggataaccatgatcttgactcatca

SEQ ID NO: 2802 - DNA, 399 bp, Homo sapiens
  AC040935.2_39831
  Located on chromosome 2
  Distance between a terminus base of telomere on chromosomal short arm and 5'-terminus of this base sequence : 61773220
  Distance between 3'-terminus of neighbour sequence of sequence listing upward to telomere on chrosomal short arm and 5'-terminus of this base sequence : 71097
gatattgatgtgccaacagtagaaagaagaaaaaattattccagctctgtacacaacctttgtcaacccagcatgataaaaccaagtctgggaaactatttgtctaaacactttttggaaagggatgaaatggagaggaaaggaaaaggaagtgtagcctagtggtcagcacacacacacacacacacacacacacacacactcacacacacacacacacacacactcacacaaatccttgagggtgccaggttacatttctacaacagctgccttccattgtctactgccagtgaagccaaaccagcctaaaatttaatttaatctgctgtaaacccaagtatcaggcacttagatggcagctaaaagcgccactctcagataactgagtgacacttg

SEQ ID NO: 2803 - DNA, 235 bp, Homo sapiens
  D2S2198
  Located on chromosome 2
  Distance between a terminus base of telomere on chromosomal short arm and 5'-terminus of this base sequence : 61790905
  Distance between 3'-terminus of neighbour sequence of sequence listing upward to telomere on chrosomal short arm and 5'-terminus of this base sequence : 17286
aaacctcaagcaatgtggactcaaaaatataatggtgaaatattttaatggaattccagttgaaagttgttttttaaaaaaagtacaaatgaaggtacagaagtcctttagatcagtactagatttaaactgaatgtctctctctctctctctctctgtgtgtgtgtgtgtgtgtgtgtgtgtgtgtgtgtgtgtgtgtgtaatggggaaagaggggtgttgcaaatcaccacaa

SEQ ID NO: 2804 - DNA, 179 bp, Homo sapiens
  D2S2160
  Located on chromosome 2
  Distance between a terminus base of telomere on chromosomal short arm and 5'-terminus of this base sequence : 61820972
  Distance between 3'-terminus of neighbour sequence of sequence listing upward to telomere on chrosomal short arm and 5'-terminus of this base sequence : 29832
tctaatgctgcaaattcatttttaacaactcactggcttttatctaggatttgtgtgtgtgtgtgtgtgtgtgtgtgtgtgtgtgcacatgtgcctttctttaataaaaatctaccaaagcaacggatagtatcaaagataccaaaatcaaatctgacttgaatatcctacatctccac

SEQ ID NO: 2805 - DNA, 216 bp, Homo sapiens
  D2S386
  Located on chromosome 2
  Distance between a terminus base of telomere on chromosomal short arm and 5'-terminus of this base sequence : 61894890
  Distance between 3'-terminus of neighbour sequence of sequence listing upward to telomere on chrosomal short arm and 5'-terminus of this base sequence : 73739
taaccttcgacggtgcctcttggcctagtcacaacagatttttatcttaacaaaaaaaattaaacaggaacaattgtgactaaagttaacaagattgattgtttagcatagaggttaatcttggctgcacattaaaatcacacacacacacacacacacacacacacatcaatgcctgggctccaccctaagccagttgaatctgaatgtctaggg

SEQ ID NO: 2806 - DNA, 105 bp, Homo sapiens
  DISD22_0001658
  Located on chromosome 2
  Distance between a terminus base of telomere on chromosomal short arm and 5'-terminus of this base sequence : 61996355
  Distance between 3'-terminus of neighbour sequence of sequence listing upward to telomere on chrosomal short arm and 5'-terminus of this base sequence : 101249
ctatgtcctggctccctcctatctgtctacaagacagacagctttggctctctctttctctctctctctctttctcggccacgtcaagccatgttgagccaaact

SEQ ID NO: 2807 - DNA, 336 bp, Homo sapiens
  AC010733.2_5873
  Located on chromosome 2
  Distance between a terminus base of telomere on chromosomal short arm and 5'-terminus of this base sequence : 62245884
  Distance between 3'-terminus of neighbour sequence of sequence listing upward to telomere on chrosomal short arm and 5'-terminus of this base sequence : 249424
tttcattaatccatgagtcacttcacgtactggcttcaaaaaaaatttattagaaaagcctaaatagctatgtgtgtgtgtgtcttttacaaatctcaagaagatatttttgttctgtttcagaatatagccatataccaaacacccaaatgtaaattaatgagtgttttctcaagctgaaaataaaacatgactgatcacaatcttgtgtgtgtgtgtgtgtgtgtgtgtgtgtgtggaggggaggcaagttgtagtgcttaaaaagctccacaagtgattccagtgggcagtcagtgttgagaaacactggcctgtgagtctttgacactccta

SEQ ID NO: 2808 - DNA, 354 bp, Homo sapiens
  AC010733.2_60735
  Located on chromosome 2
  Distance between a terminus base of telomere on chromosomal short arm and 5'-terminus of this base sequence : 62325627
  Distance between 3'-terminus of neighbour sequence of sequence listing upward to telomere on chrosomal short arm and 5'-terminus of this base sequence : 79407
tggcctaattcatttctttataggcagactgccttctccttagtagccttgatacgtttggtcctctagctttattatattgtaaccaggtaggaatatacagacacacacacacacacacacacacacatattttttttttcttcctgcttagtatccacagtattcagtctgaggattcatttctttttttaattcaggaaaatgctcatcaattatacctttaaatattattttaagttttgtttgaacactagtctttactgtctcttcttctgtcaagcattatatcgggactagtgtctgctataagtaacattatctgactcactgtgatttggactattaagacat

SEQ ID NO: 2809 - DNA, 477 bp, Homo sapiens
  AC018889.2_135965
  Located on chromosome 2
  Distance between a terminus base of telomere on chromosomal short arm and 5'-terminus of this base sequence : 62586138
  Distance between 3'-terminus of neighbour sequence of sequence listing upward to telomere on chrosomal short arm and 5'-terminus of this base sequence : 260157
tactggaattaggccaattaacaaccctacaatggcctctctgtatccagtaaaaggaggagtcacacatctttcaccttaaatcaaaagctagaaatgattaagcttcctcactttaaatgagggccctgtcacacacacacacacacacacacacacacacacacacacacacacacacacagaagtttgagaaccactgatgtaaataaacaaaatacatcatcattgtaaaggttttatttaaaatttcattttacttcacaagtgggctaattgtcattaaacactgttgggtacttatataaagcaaggtctagatttgtctaatatctttagggcaaaaggctgtgcacaaaaatgattcaaattaattgtggttatgatgatgattgagataaatttttatacaaataggtaagtttagtagcttcaaatctaatgaagccatttataatgaataccatctaattcagc

SEQ ID NO: 2810 - DNA, 354 bp, Homo sapiens
  AC016894.4_119034
  Located on chromosome 2
  Distance between a terminus base of telomere on chromosomal short arm and 5'-terminus of this base sequence : 62768580
  Distance between 3'-terminus of neighbour sequence of sequence listing upward to telomere on chrosomal short arm and 5'-terminus of this base sequence : 181965
cttatcagctttcttactgtttctttatatattgctagtgtcttctctttaatcccaagaaatcttgcctggatcactgtatcacattaacgtgaggaggggaaatcccctatgaagcagtaatatgtcctactataccagtaagtttcctgtaccaaatatatatgaggttagtttacatttaaaacacacacacacacacacacacacgcgcgcgcgcgcaccttctacttaatcagactacatacacaatgttgagacttacagcacacttcctcaactcagctccagaaatgctggtaagctgaactaggaggttggaagattcctctctggtaatactgattaaccaaa

SEQ ID NO: 2811 - DNA, 241 bp, Homo sapiens
  D2S337
  Located on chromosome 2
  Distance between a terminus base of telomere on chromosomal short arm and 5'-terminus of this base sequence : 62789787
  Distance between 3'-terminus of neighbour sequence of sequence listing upward to telomere on chrosomal short arm and 5'-terminus of this base sequence : 20853
gtctgcattcccacgattacagcactattcacagtagccaagatacaaaatcaacctacgtgttcaacgatagatgaatggataaacaaaatgtgatgtgtgtacacacacacacacacacacacacacacacacacacagaggaatattatacatccattaaaaataatgaaatcctgtcatttgcagcaacatacatggaactggaggacattatcttatgtgaaataagccaggagca

SEQ ID NO: 2812 - DNA, 435 bp, Homo sapiens
  chr2.fa.O7frz.64721247
  Located on chromosome 2
  Distance between a terminus base of telomere on chromosomal short arm and 5'-terminus of this base sequence : 63006721
  Distance between 3'-terminus of neighbour sequence of sequence listing upward to telomere on chrosomal short arm and 5'-terminus of this base sequence : 216693
attcaactgcattagcaactagagctaacctaaatacacacacacacacacacacacacacacacacacacacagagagagagagagagagagagagagagagagagagagagagagagagagagctacattgccagagaattgtgttagggcaataagattattttatcctatttttcaaaatactgcttttgaaattttttaaatgggattttagtaaatatagatcacctctaagtattgtgtgattaatttgtatcttaaaactccacgaagaagaaacaactattctataagggagattttttttatttcagtgcatcaatgtaacatgtagccattaagatatgagtagactggtgagtaacccagaaaatattcaggatatattgtaaaatgaaaaaacaatgggtaccatacaatgccattaaatac

SEQ ID NO: 2813 - DNA, 375 bp, Homo sapiens
  AC074251.4_59472
  Located on chromosome 2
  Distance between a terminus base of telomere on chromosomal short arm and 5'-terminus of this base sequence : 63240334
  Distance between 3'-terminus of neighbour sequence of sequence listing upward to telomere on chrosomal short arm and 5'-terminus of this base sequence : 233178
tcctttgaacaattattgagctactatgttgaatttattaatgaaagcgattccttgtcatttaatatttttatctccatgggctgccaagtgcttggtacatagtgggcattcaataaactttggattcattagtaaataagtcagcaaatagtattgtattgtattgtattgtattgtattgtattgtattgtattgtattgtattcagccaagcaaaccttttttttgtggggcggggggatgtaatgctaaattaattgcagagcaattaatttgaggaagagatgaaaacttcattctttgtgaaggggtcactgtgctggtcagatacctgagcaaacaggccaggcctccaggcaattagatcaagta

SEQ ID NO: 2814 - DNA, 178 bp, Homo sapiens
  D2S2225
  Located on chromosome 2
  Distance between a terminus base of telomere on chromosomal short arm and 5'-terminus of this base sequence : 63917763
  Distance between 3'-terminus of neighbour sequence of sequence listing upward to telomere on chrosomal short arm and 5'-terminus of this base sequence : 677054
gggatgtttgctttgggcatttttctacctcctttctacacctttcctaggatgtcctgtgctctgattgtaaacacatacacacacacacacacacacacacacacacaccacccctcttctagaagtatgccatgctctagaattatctactcttctttccccagcaaacaaaatt

SEQ ID NO: 2815 - DNA, 462 bp, Homo sapiens
  chr2.fa.O7frz.65521966
  Located on chromosome 2
  Distance between a terminus base of telomere on chromosomal short arm and 5'-terminus of this base sequence : 63993299
  Distance between 3'-terminus of neighbour sequence of sequence listing upward to telomere on chrosomal short arm and 5'-terminus of this base sequence : 75358
tattgtcaaagtgttcaggaagctgacactcacaaactttgcctccttcttcctctgcagtgcaatgctgcaagaaaaagttctagaaactgaggccctggaaaatgtcattgggtttttacatctctctctcttctctcttctctctctctctctctctctctctgtctctctttctctctttctctcttctctctctctctctctctctctctctcctaaacacatatttgagctctgaagagtttctctggaatagagaatgtgtttttgttccattttacaaatcttaggctaggatactggagactgtcatgtgagactctcagtatattacatatggaaggtattgtgacaagttctgatggtttatgttaggtgctacattcccttgattgtgacttttagaaagaaagcacaatataaatacaatgtcatcttattgaatctaacagttcaagg

SEQ ID NO: 2816 - DNA, 256 bp, Homo sapiens
  D2S2320
  Located on chromosome 2
  Distance between a terminus base of telomere on chromosomal short arm and 5'-terminus of this base sequence : 64159214
  Distance between 3'-terminus of neighbour sequence of sequence listing upward to telomere on chrosomal short arm and 5'-terminus of this base sequence : 165453
accagcctaaaagctcattgaccaatgagtggattaaaaatatgtggtgcatatatatatatatatatagacacacacacacacacacacacacacacacacacacacacacatatatatacacatatacacacacacacatacacacaatatggaatactactatatatataatatatatagcttggattacaggcgcatgccaccacgcccggctaatttttgtgtttttagtagagatggggtttcaccatgt

SEQ ID NO: 2817 - DNA, 388 bp, Homo sapiens
  AC007098.3_33398
  Located on chromosome 2
  Distance between a terminus base of telomere on chromosomal short arm and 5'-terminus of this base sequence : 64238475
  Distance between 3'-terminus of neighbour sequence of sequence listing upward to telomere on chrosomal short arm and 5'-terminus of this base sequence : 79005
tcaacatagtactggaagtcctagccagagcattcacacaagagaaagaaatagaaacaatccaaataggaagagaagtcaatcacttttcctaaatgacatgatcttgtattgagaaaacctcatagttgctgctccaaagctcctagatccaataaaaagcttcagtaaggtttcaggatacaaaatttctgtacaaaaatccataacatttctatacaactacaagtctatataacattcaagctgaaagccaaattaagaacacagtcctattcacaataacacacacacacacacacacacacacacacacacacacacacacagagacagagagagagagagagggagagagggagagagagcctatgaatacagctaactg

SEQ ID NO: 2818 - DNA, 344 bp, Homo sapiens
  chr2.fa.O7frz.65750287
  Located on chromosome 2
  Distance between a terminus base of telomere on chromosomal short arm and 5'-terminus of this base sequence : 64254279
  Distance between 3'-terminus of neighbour sequence of sequence listing upward to telomere on chrosomal short arm and 5'-terminus of this base sequence : 15416
tatcattctacttacatggcattccagaaaaggcagaattataggaacagataactagtggttgcccaggggtagggaggggtacagaggagttttgggaagtaaaagaatagtgctgtatccagtgtggtggaggttatacaagtgtatgcatttgtcaaaacttgcataactgcacactgaatggatgcattttactgtatgtaaattctatcatcatcatcatcatcatcatcatcatcatcatcatcatcgctgcagaagcagagaatatcctgagcaacagagccctcctataataatgcatagcacttccagaggagcttgtcttaacattcctatct

SEQ ID NO: 2819 - DNA, 472 bp, Homo sapiens
  chr2.fa.O7frz.65852437
  Located on chromosome 2
  Distance between a terminus base of telomere on chromosomal short arm and 5'-terminus of this base sequence : 64356401
  Distance between 3'-terminus of neighbour sequence of sequence listing upward to telomere on chrosomal short arm and 5'-terminus of this base sequence : 101778
gaatactatctggttactgatgctccacaatttttttttcaagagaacaggtttttaaaagtctgtaatactttgtgtcacagttgcatttgaaaggattacagtatatagcaaggtttgtaaagataggttagagcaccaagttagctcctaaccagagggcagattggctttcaatgctgattgccaatggtgattgaatagatctaagagcacaataagcaattggaaaggaactcatgtgtgtgtgtgtgtgtgtgtgtgtgtgtgtgtgtgtgtgtgtgtgtgtaaaatgctgcccctacaaagagattaaaatgtgaaataaattaaatcattcataccaaattataagttatattaagaaaaaaagtcaaaaaatacaagtggaaaatttattcctgtaatctaattaattgctttaattttatggcagtgttaaaatacagtagattagcatgatttaggattg

SEQ ID NO: 2820 - DNA, 327 bp, Homo sapiens
  chr2.fa.O7frz.65982671
  Located on chromosome 2
  Distance between a terminus base of telomere on chromosomal short arm and 5'-terminus of this base sequence : 64486697
  Distance between 3'-terminus of neighbour sequence of sequence listing upward to telomere on chrosomal short arm and 5'-terminus of this base sequence : 129824
catctcaaccaatacttgaagatactgtattccatcaagtaaattgataaacttatgatagaagtagtagcaaacacaaaaattgctactttatcatttttagaggttatacacttatacttcaagatgctctattaatgtaattgtcaacatgtaaataccgtgtatgtgtatgtgcatatatatatatatatatatatatatatatatacgcacacacacacatatatatatgcacacactccctattctatatgtattactcccctctttgggtgatagtaaaaacaggaagtgcagcaggttgctatatctaccataattcca

SEQ ID NO: 2821 - DNA, 316 bp, Homo sapiens
  AC067953.2_71039
  Located on chromosome 2
  Distance between a terminus base of telomere on chromosomal short arm and 5'-terminus of this base sequence : 64680491
  Distance between 3'-terminus of neighbour sequence of sequence listing upward to telomere on chrosomal short arm and 5'-terminus of this base sequence : 193467
gaacaatatcagtctgaagtactgaagtgtgtctctattatcagagtatatatatatatatatacattttgatatgtactttgtgtgtatagacatatatatacactctgtgtgtgtgtgtgtgtgtgtgtgtgtgtgtgtgtgtgtatccacccacatgagagctccttattgttactttgctgatttatttcctcatttttgtcattctggcccatcttagactgaaaatgttacgtgcaaattaactactggtttgcttttgtctgtttcttcttatatctcctacaatttctgctttacgaagattcctatc

SEQ ID NO: 2822 - DNA, 461 bp, Homo sapiens
  chr2.fa.O7frz.66286621
  Located on chromosome 2
  Distance between a terminus base of telomere on chromosomal short arm and 5'-terminus of this base sequence : 64789098
  Distance between 3'-terminus of neighbour sequence of sequence listing upward to telomere on chrosomal short arm and 5'-terminus of this base sequence : 108291
taaattcactgcagtgctattcacaatagcaaaaacatggaatccacccaggtgcccatcgaatggtggactggataaagaaaatgttatacacacacacacacacacacacacacacacacacacacacacacacaccatgaaatactatgcagccataaaaaagaacaaaagtatgtcctttctagcaacagggatacagctggaggccactaagtgaattaatgcaggaacagaaaggtaaatacaacagttctctcttataagtgggagctaaacactgggtatacacggacataaagagggaaacaatatacagtggggactaatagtagagcagggagagagggaggaggacaaggactaaaaaactacctactgggtactatgctcactacctgggtgatggtttcgatcataccccaaaccacagcaacctgcaatatacctttgttaacaag

SEQ ID NO: 2823 - DNA, 470 bp, Homo sapiens
  AC016734.6_177758
  Located on chromosome 2
  Distance between a terminus base of telomere on chromosomal short arm and 5'-terminus of this base sequence : 64863310
  Distance between 3'-terminus of neighbour sequence of sequence listing upward to telomere on chrosomal short arm and 5'-terminus of this base sequence : 73751
gaaatatctcatgcaacttgatagttgtatacttttaaatatttcttttccaaaagagacctgaaaaccttttttctatggcttctagaaaaacttagaagctaaagaaccctcctaacatggggaatagaaacgtgggtaacattttaaaatacctactaaatgcactttatattcattatttcatttaatcctcacaagagccttctgaaattacgtactaaattgtgtgtgtgtgtgtgtgtgtgtgtgtgtgtgtgtgtgtgtgtgatgtattttattcacatattcttaaaaatatttttctgggcagggaatagcagtttctccagagtccatgtatctcctctcccataaatcaactctgagagaccctaaaccccttaatttataaatatggaaactgaaatctatgagggtaaagtaatttgcacaaattcaatcatctcattagaggaacaattaggact

SEQ ID NO: 2824 - DNA, 380 bp, Homo sapiens
  chr2.fa.O7frz.66461800
  Located on chromosome 2
  Distance between a terminus base of telomere on chromosomal short arm and 5'-terminus of this base sequence : 64885015
  Distance between 3'-terminus of neighbour sequence of sequence listing upward to telomere on chrosomal short arm and 5'-terminus of this base sequence : 21235
gagctttacactggtaaagtacactggagtactttaatgtaatttcctcctgggcaaggctgcctttccttttcattttttcctcccatctgtgtctgtaatataggtaagtcccaagtcacttcaggttatgctttcctcaggttgcaacagccacaccagaagtctttcccagataagtggcttaccttatgtatgtacggcttttgaatttcaggaaagggcaaatacttctgttgttgctgttgctactgtgtgtgtgtgtgtgtgtgtgtgtacacacacatacatgtgctctcccatgcacgtgcataacttgagaacagaggaggaactgagaaaaaaagccataccagcccttctatttaaggcacagatcc

SEQ ID NO: 2825 - DNA, 474 bp, Homo sapiens
  AC019320.3_23123
  Located on chromosome 2
  Distance between a terminus base of telomere on chromosomal short arm and 5'-terminus of this base sequence : 65093755
  Distance between 3'-terminus of neighbour sequence of sequence listing upward to telomere on chrosomal short arm and 5'-terminus of this base sequence : 208360
acaatacctcgagtaaatcttcacttcactggattaaaacttgtatgttccatctacagagttagtgttgatctttctcagagttgcatcagctttaacaaacatttgaacatcacagtatgcaaacaaatgtgaacctaaaccattgttgaaagctgaccatggcaaaatgcatgaaagaaaggagctggataaaaattacttgctaaacctgcagtttaagttattgcacctttttattttttttcttagttttcctcactgaaaccaaacataggctgagaaattttaagttgcagaaggatagatagatggagatagatagatagacagacagacagacagacagacagacagacagacagatagatagatgatagacagatgaagaaatttcccacttaaaaaatatgccctgtgagtggttctaatttagttgaaggagtttgggtaagttcagatttccatggtaac

SEQ ID NO: 2826 - DNA, 363 bp, Homo sapiens
  AC013466.2_89854
  Located on chromosome 2
  Distance between a terminus base of telomere on chromosomal short arm and 5'-terminus of this base sequence : 65299013
  Distance between 3'-terminus of neighbour sequence of sequence listing upward to telomere on chrosomal short arm and 5'-terminus of this base sequence : 204784
gcttcaactaattctgaaattgagttttccctagataatagtgtggaaattaatactccattctgtgagtttggcccaagaaagtttcacagtcgtacatattgctagtcatatctaagccagctaaaaacatttaaatatccatatgaacaagaaattcagtcataaaatattatcactattcttcttaaaataatagaataggaatttttcttttctttctttctttctttctttttttttttttttgagacaggctcttacttccttgtgcaggctggaatgcagtggcacaatcatggctcactgaagcctggacctcccaggctcaaaccatcctcctaccttagcctcctgagtagc

SEQ ID NO: 2827 - DNA, 422 bp, Homo sapiens
  chr2.fa.O7frz.66760167
  Located on chromosome 2
  Distance between a terminus base of telomere on chromosomal short arm and 5'-terminus of this base sequence : 65375516
  Distance between 3'-terminus of neighbour sequence of sequence listing upward to telomere on chrosomal short arm and 5'-terminus of this base sequence : 76140
ttattcctgttacttgactgagatacttggagtgtgtatgataattaataccttctaattctgacttcagcctggtttcacaggacttgcaactttaaaccaataaaacacagtccacaagaaagggaaggtcttagtatataaatataaagacacacacacacacacacacacacatatattttaggaagaaaaagatcctcaatcctttgagtgcttgtgacttaattttgggaagattttattcaatgttgaaattcttgcctaaaaataaatttcaagcatttataagacatagtatgttttaacaaatcaaaagtgaaaatgtaactcttatagttggggggttgaaaaaaatgttgatccaagtttcacttctaagaagtcactttgaaaactgcaaacataacttttatgaaata

SEQ ID NO: 2828 - DNA, 471 bp, Homo sapiens
  chr2.fa.O7frz.66969078
  Located on chromosome 2
  Distance between a terminus base of telomere on chromosomal short arm and 5'-terminus of this base sequence : 65454488
  Distance between 3'-terminus of neighbour sequence of sequence listing upward to telomere on chrosomal short arm and 5'-terminus of this base sequence : 78550
cttcattagatggtgaagacattgtttcagaattcaggatgcctggtttaatttcagttttgcccccaagtaactctatcatctttaactcacaagatttcagttaacctcatctacaaaagataagcggtaaacaaataaatataacgtactttctgaagctaaaattctagcctgtgaccaaatatcttggagatacacacacacacacacacacacacacacacacacacatatatatttatctatattttattaaagagacgaagtctcactatgttgcccaggctggcctcaagctatcctcccacctcagccccctgagtaactgagactacaggcctagtagcatcttgattttaaaaaaaagctaagctcattcattttcactgcttgtcagtgaaacaaaatgtgaaaaatcatcctaaagctttgtgttcggtttttcttggatctaaacattaatcttcc

SEQ ID NO: 2829 - DNA, 330 bp, Homo sapiens
  chr2.fa.O7frz.67283038
  Located on chromosome 2
  Distance between a terminus base of telomere on chromosomal short arm and 5'-terminus of this base sequence : 65714124
  Distance between 3'-terminus of neighbour sequence of sequence listing upward to telomere on chrosomal short arm and 5'-terminus of this base sequence : 259165
ggttaaaggcagatcagtaatcttcaaaatcaattttacacacatccaaacaaatactagatagtcattaacaattattttctgtatcataatttttatgacctgataattgtctgtaatattacagctttaaaaatcagtaacaaaataggatctacagcattaaacagggaaaaaagaaggatttaaacatggcaaatgtatacacacacacacacacacacacacacacacacagagagagagagagagagagataaagaatagaaagaataaaagaatataaactgttaactgtctatttctaggtggtataatttgactgctttg

SEQ ID NO: 2830 - DNA, 186 bp, Homo sapiens
  D2S2397
  Located on chromosome 2
  Distance between a terminus base of telomere on chromosomal short arm and 5'-terminus of this base sequence : 65714277
  Distance between 3'-terminus of neighbour sequence of sequence listing upward to telomere on chrosomal short arm and 5'-terminus of this base sequence : -177
tctacagcattaaacagggaaaaaagaaggatttaaacatggcaaatgtatacacacacacacacacacacacacacacacacagagagagagagagagagagataaagaatagaaagaataaaagaatataaactgttaactgtctatttctaggtggtataatttgactgctttgtgcttacgc

SEQ ID NO: 2831 - DNA, 286 bp, Homo sapiens
  AC008074.2_152727
  Located on chromosome 2
  Distance between a terminus base of telomere on chromosomal short arm and 5'-terminus of this base sequence : 65792658
  Distance between 3'-terminus of neighbour sequence of sequence listing upward to telomere on chrosomal short arm and 5'-terminus of this base sequence : 78195
gcatcttgcagtataacaggagttgtttgcttttattttattttattttattttattttattttttattagagggactggggatgccctccttggggctgagccaaggtgcaaaggtagagctccccctgctggctgacttttgctcctgcagccctcgggcgtctgacgctttcgcgtttatgaagtcttgtagtttcacaggggagaaaatcagtgtcgctcagcttcaggaggttcgcttgctttcagaaacaacggtcagtgtgactgttggactgaacatg

SEQ ID NO: 2832 - DNA, 354 bp, Homo sapiens
  AC008074.2_185240
  Located on chromosome 2
  Distance between a terminus base of telomere on chromosomal short arm and 5'-terminus of this base sequence : 65825323
  Distance between 3'-terminus of neighbour sequence of sequence listing upward to telomere on chrosomal short arm and 5'-terminus of this base sequence : 32379
agatatccagtactccaggaagtactataacaccaaattgtaatttttattatttatgcaataaatttgataagcaaatccaagaaagatcagtgggaatgattaagaaacaaaatctctgttgctcatcacactttgggaaagtcgctcattattattattattattattattattgagaaggggtcttgctctgtcagccagggtggagtgcagtggcgcaatcacaactcactgcattcttgacctcatgggctcaggtgatcctcctacctcagcctcccgagtagctgggactacaggagcatgccacctcacctggctaattttttgtaaagatggagtttcaccatg

SEQ ID NO: 2833 - DNA, 439 bp, Homo sapiens
  AC008074.2_54744
  Located on chromosome 2
  Distance between a terminus base of telomere on chromosomal short arm and 5'-terminus of this base sequence : 65900682
  Distance between 3'-terminus of neighbour sequence of sequence listing upward to telomere on chrosomal short arm and 5'-terminus of this base sequence : 75005
atgactcaatactcatagctgaagaaatggaagcctaaataagaaaactgactggcacatcattacatatctataaccaggggcaggacctgaacccagtttcccttactcttggcttttttgtttataccctcctgcatccccaccccacccccaacccccgtctgaatagctggctggccaccttttgcctgaacatttgcagggacactgagtgggctcaggacttcaccaggaagtctccttgcccacctccaatgcacacgtacacacacacacacacacacacacacacacacacacacgcttggctggcagcacagattgctaggaccttgagcggaaacctggtttctcataaccggttgctcattggttcaagttaccttctctcaagctgcagggatgaacctagactcttccatgaatatctgaagat

SEQ ID NO: 2834 - DNA, 444 bp, Homo sapiens
  AC036192.2_142953
  Located on chromosome 2
  Distance between a terminus base of telomere on chromosomal short arm and 5'-terminus of this base sequence : 66080842
  Distance between 3'-terminus of neighbour sequence of sequence listing upward to telomere on chrosomal short arm and 5'-terminus of this base sequence : 179721
ttcagttgagtagcacttctaatttcttcaagaacttttcttttgaattcacagcttggcaaaagaagccttgctttcagtgtattttggcttttgatgtgccttcctcactaagtttattcatttttagctttttatttaaagggagagatatgtgactctttctttcgcttgaacactttgaggccattgcagggttactaattggcctgattttaatattgttgtgtctcagagaatagggagacccaaggcaggagaaagagagagagagagagagagagacaggggaatgtctggtcagtggggtagatcactataacaaatagagtaactacaaaacatttgaaatactgtgagaattgccagtatgtgacacaaagacacaaagggagcacaccctgttgggaaaatggcactgatagacttgctgaagataaggtt

SEQ ID NO: 2835 - DNA, 463 bp, Homo sapiens
  AC036192.2_85581
  Located on chromosome 2
  Distance between a terminus base of telomere on chromosomal short arm and 5'-terminus of this base sequence : 66129770
  Distance between 3'-terminus of neighbour sequence of sequence listing upward to telomere on chrosomal short arm and 5'-terminus of this base sequence : 48484
tgcctagaatagtcaaattcatacagactcaggtagaatggtggttgccaggggctgggggatagggggaatggaaagttattgtttaataggtacatagtttaagtttgggatgatgaaaatgatctgtggatggatggtggtgatggttgtacaacagtgtgaatatacttaatgtacaacactgtgaatatacttaacgtgaatatacaaataatgaattgtaaacttaagaagatgattacaatggtaaattttgtgttacgtatattttaaccacacgtgcacacacacacacacacacacacacacacacacacacacacaatatcagggaggtaatatagggcttttcttgtgttgggtacagctgaggcctctaatttaaaagggaagtgagaagaacatcccctttttaaaagaaaggttctggaccttctgagcaggacttgttaaatttaca

SEQ ID NO: 2836 - DNA, 206 bp, Homo sapiens
  AC007386.3_119224
  Located on chromosome 2
  Distance between a terminus base of telomere on chromosomal short arm and 5'-terminus of this base sequence : 66263687
  Distance between 3'-terminus of neighbour sequence of sequence listing upward to telomere on chrosomal short arm and 5'-terminus of this base sequence : 133454
agtagcagttagtacatttgcattgctgtgcaccatcaccactctctctctctctctctctctctctctctctctctccagaatttcacctgcccaagttgaactctgtacccatgcagcagtaactccctattccccccggctccagcccctggcaaccccactctactttttgtctctaggagtttcgctattctaggtacctc

SEQ ID NO: 2837 - DNA, 277 bp, Homo sapiens
  AC007318.3_96395
  Located on chromosome 2
  Distance between a terminus base of telomere on chromosomal short arm and 5'-terminus of this base sequence : 66441866
  Distance between 3'-terminus of neighbour sequence of sequence listing upward to telomere on chrosomal short arm and 5'-terminus of this base sequence : 177973
agccttgtaatcctagcactttaggaggcagagatgggaggattgcttgaggccagaagttccatgagaccagtctggtcaacataggtagactcccatctctataataaataaataaataaataaataaataaataaataaataaataagaaaaaaaggtaattagattcattcaggcaagagatgttgtatcctgacctagggcagttgcatcaagaagggaaagaaggggagatgccagagaggaggaggtagactctaaaggcatgaaaggag

SEQ ID NO: 2838 - DNA, 440 bp, Homo sapiens
  chr2.fa.O7frz.72077890
  Located on chromosome 2
  Distance between a terminus base of telomere on chromosomal short arm and 5'-terminus of this base sequence : 66979393
  Distance between 3'-terminus of neighbour sequence of sequence listing upward to telomere on chrosomal short arm and 5'-terminus of this base sequence : 537250
tatgagtagcacgatactccaccctcagccattgtaaaaacccagagccctcgagagaatcttttggagggagctattgcctctagttgagacctattggacaaaaggaattttaagtttcttttcaattctgaagccaattctattaaaatagggtaaatgactacttttgaaactattgaacacactttgaatttctcttttgccgtgtgtgtgtgtgtgtgtgtgtgtgtgtgtgtgtgtacatctacttaggtattacagatgtccttaaatatgttggattagacaaatgtttgtgaccacatggagaaattagaagagctgggggttggagcagggaaaataaaacagacataggaaacaaccctcatattttcctggccaccttgttgcaaattaagaaatcttgaaatctttactagttgatagtgctttgc

SEQ ID NO: 2839 - DNA, 248 bp, Homo sapiens
  Z67508
  Located on chromosome 2
  Distance between a terminus base of telomere on chromosomal short arm and 5'-terminus of this base sequence : 66979470
  Distance between 3'-terminus of neighbour sequence of sequence listing upward to telomere on chrosomal short arm and 5'-terminus of this base sequence : -363
tgcctctagttgagacctattggacaaaaggaattttaagtttcttttcaattctgaagccaattctattaaaatagggtaaatgactacttttgaaactattgaacacactttgaatttctcttttgccgtgtgtgtgtgtgtgtgtgtgtgtgtgtgtgtgtgtacatctacttaggtattacagatgtccttaaatatgttggattagacaaatgtttgtgaccacatggagaaattagaagagc

SEQ ID NO: 2840 - DNA, 132 bp, Homo sapiens
  D2S2152
  Located on chromosome 2
  Distance between a terminus base of telomere on chromosomal short arm and 5'-terminus of this base sequence : 67212881
  Distance between 3'-terminus of neighbour sequence of sequence listing upward to telomere on chrosomal short arm and 5'-terminus of this base sequence : 233163
tttggggtacaactgatcccatcactcaggtactgaacatagtacccaatagttattcaacttttgttcccctccctcaaacacacacacacacacacacacacacacacgtccacacacacacgtttagag

SEQ ID NO: 2841 - DNA, 394 bp, Homo sapiens
  AC036184.2_154811
  Located on chromosome 2
  Distance between a terminus base of telomere on chromosomal short arm and 5'-terminus of this base sequence : 67349921
  Distance between 3'-terminus of neighbour sequence of sequence listing upward to telomere on chrosomal short arm and 5'-terminus of this base sequence : 136908
cctggtacagtctttacactgaaaaacggatgcacctaccacagtataaagatgggagtttactttggagacagaagacaggaatgaactgcatcaaaatgataggctcagagttaaaaatatgagaaccgtcagtgatttcacacacacacacacatgcacacacacacacacacacacacacagacgcatgcacatatgcatgcctatagcttatttctttagaaactagccacagaacccattgaaacccagagagctgtggaacacaattagaaaaggcctgggacaggagggctggagtgagccttctgagcagcccagacctcacattagcaggacagaagttagcagcgtagaagcagctggcaggactagagctgcctagccatta

SEQ ID NO: 2842 - DNA, 380 bp, Homo sapiens
  AC019206.3_49196
  Located on chromosome 2
  Distance between a terminus base of telomere on chromosomal short arm and 5'-terminus of this base sequence : 67418517
  Distance between 3'-terminus of neighbour sequence of sequence listing upward to telomere on chrosomal short arm and 5'-terminus of this base sequence : 68202
ttccaaagtgctatgattacaggcatgagccaccgtgcccagcccacaactatgctttattaattaaagcaatgtattagtcagaattcttaagaggaacagaaccaatagagagagagagcgagagagacacagaggggtgtgtgtgtgtgtgtgtgtgtgtgtgtgtgtgtgtgtgtgtgtgtgtgtgagagaaagagagagaggatggagttgggcaagtaccaggatcttcagagggaatcagcaagctggagatgcaggccagcctatggttttgttccagtctgagtccaaaggcctgagaactaggagcagttcccatctgaaggccagcaggctggaaacccatgaagagctgatgttccagttcaagtcca

SEQ ID NO: 2843 - DNA, 480 bp, Homo sapiens
  AC019206.3_180547
  Located on chromosome 2
  Distance between a terminus base of telomere on chromosomal short arm and 5'-terminus of this base sequence : 67497153
  Distance between 3'-terminus of neighbour sequence of sequence listing upward to telomere on chrosomal short arm and 5'-terminus of this base sequence : 78256
atagcttaatagatgcaaggcttaatgggttgataggtgtagcgaaccaccatggcacacatttacctatgtaacaaaactgcacatcctgcaaatgtaccctggaacaaaataaaataaaataagaaatagaggtttgagtctttcctggtaagcatatttatgctctaccacagacggttcagccttggggcaagacagtctttctcctaatttttgtagttttgaacattctaaagtttttgttgttgttgttgttgttttccctgaggacagaggcaactttggggaagtactttgtcgggtaggatggaatctggggcctttagttttccttccaagagcccataggaggttttgggtgccttctcaatgctggcatgagaaaatataaagcagatggacagtgaactttggtatattcactccttatgaatgttatgtggaaaagtggaagaacataagctgtttgtctatgct

SEQ ID NO: 2844 - DNA, 458 bp, Homo sapiens
  AC019206.3_137449
  Located on chromosome 2
  Distance between a terminus base of telomere on chromosomal short arm and 5'-terminus of this base sequence : 67528822
  Distance between 3'-terminus of neighbour sequence of sequence listing upward to telomere on chrosomal short arm and 5'-terminus of this base sequence : 31189
tactctatgttatcaggactccactgtaaggatattatacccaacaccaacactttgaagtatcttcgcattggtgggacaataaaagaaaagacttctagaatggtggtggtggtagtattttctactcaacagaataggtgttgagcacctaagatgccgtgtagtaggtgctgggactacagaatccagtaaagactacgcactgctgtggaggagctcagattaatatcactctacagggggtttgtcagtcagcacatggcctgtgtttctctgcattttagctaattttctgggtctgatctcctaagaaaacacccttgggagggtggggtatgtgtgtgtgtgtgtgtgtggtttttcttttctttttttaaactaatcttgcagaaaattttgagaaatatagaaaataatactaaaaatttaaattgtccatagttctagcactcaga

SEQ ID NO: 2845 - DNA, 230 bp, Homo sapiens
  AC019206.3_161455
  Located on chromosome 2
  Distance between a terminus base of telomere on chromosomal short arm and 5'-terminus of this base sequence : 67553037
  Distance between 3'-terminus of neighbour sequence of sequence listing upward to telomere on chrosomal short arm and 5'-terminus of this base sequence : 23757
gtattttacctgcttgatgttcacacggacctctgccggagcagaccctgcaggccccctgcggctctgacccaatgcccaggaccatgcctgtgtgtgctcagcgatggccacttggggatggatgggcgaatgaatgaatgaatgaatgaatgaatgaatgaacgaatgaacgaacgaattaacactttttaagagagacagaggagaactttaggctcagagctaag

SEQ ID NO: 2846 - DNA, 90 bp, Homo sapiens
  D2S2115
  Located on chromosome 2
  Distance between a terminus base of telomere on chromosomal short arm and 5'-terminus of this base sequence : 67582898
  Distance between 3'-terminus of neighbour sequence of sequence listing upward to telomere on chrosomal short arm and 5'-terminus of this base sequence : 29631
ccccatgcccatgtaacatcacacacacacacacacacacacacacacacgtttgcttttgttttccaagatggcatctagtaggcgctt

SEQ ID NO: 2847 - DNA, 381 bp, Homo sapiens
  AC016700.5_54924
  Located on chromosome 2
  Distance between a terminus base of telomere on chromosomal short arm and 5'-terminus of this base sequence : 67763998
  Distance between 3'-terminus of neighbour sequence of sequence listing upward to telomere on chrosomal short arm and 5'-terminus of this base sequence : 181010
tttaaatacaaggtactgaggacagggagaaactaaattataattatagatgattcagataataactttaaatgttatcaaacattaatttaaaaaattgcatattccttttattatttatttatttatttatttatttgtttgtttgtttgtttttgagacagagtctggccctctcgcccaggctgaagtgcaatggcacgatctcggctcactgcaacctccacctcctgggttcaagcaattcccctacctcagcctcccgagtagctgtgactacaggcacacaccaccacacccagctaatgttttgcattttagtagagatggggtttcaccatgttggccaggatggccttgatctcctgacctcgtgatctg

SEQ ID NO: 2848 - DNA, 132 bp, Homo sapiens
  D2S303
  Located on chromosome 2
  Distance between a terminus base of telomere on chromosomal short arm and 5'-terminus of this base sequence : 67820618
  Distance between 3'-terminus of neighbour sequence of sequence listing upward to telomere on chrosomal short arm and 5'-terminus of this base sequence : 56239
ttttatacctattatgattcagggttaacaccaattagatgaatgagtgtgtgtgtgtgtgtgtgtgtgtgtgtgtatgtgtgtgtgtttaatacattgtctcataaataggaattgcctaaatacaagaaa

SEQ ID NO: 2849 - DNA, 424 bp, Homo sapiens
  AC022201.3_86415
  Located on chromosome 2
  Distance between a terminus base of telomere on chromosomal short arm and 5'-terminus of this base sequence : 67965237
  Distance between 3'-terminus of neighbour sequence of sequence listing upward to telomere on chrosomal short arm and 5'-terminus of this base sequence : 144487
tattcatccattgacggacatttgggttgtttccacctttttgatattataaataatgctgctataaatatccgtgtacaagtttttatgtgggtatatgttctcattcctcttgtatgtatgtgtgtatatatattatatatatatacaaactttgtacatatttatacacacatatatacattacacacacacacacacacacacacacacacacacgggagtggaattgatgggtcatgtggtaattctatatttaacttttaaaggaactgccaaactgttttctatagtggctgctttattttacatacccaccagtaatgcatgagagttctaattcctccacatcctcatcaatacttatcttctgttttttaaaaaaaagttattatagccatcctcataggtattaagtggtatg

SEQ ID NO: 2850 - DNA, 123 bp, Homo sapiens
  DISO7_10000906
  Located on chromosome 2
  Distance between a terminus base of telomere on chromosomal short arm and 5'-terminus of this base sequence : 68227296
  Distance between 3'-terminus of neighbour sequence of sequence listing upward to telomere on chrosomal short arm and 5'-terminus of this base sequence : 261635
ggcaaattccttaacctgagttttggttttgttttgtttaaaaatggaaataataataataataataataataataataataataataaacaggaactttgggaagcacttggctccaggtat

SEQ ID NO: 2851 - DNA, 262 bp, Homo sapiens
  chr2.fa.O7frz.73731864
  Located on chromosome 2
  Distance between a terminus base of telomere on chromosomal short arm and 5'-terminus of this base sequence : 68450992
  Distance between 3'-terminus of neighbour sequence of sequence listing upward to telomere on chrosomal short arm and 5'-terminus of this base sequence : 223573
atactgcaacatggtgagtaagtccaaagaatgagaaatgctaaggacaacggctctagttacacacacacacacacacacacacacacacacactcatacataaagagtaagatgaatggtcacagattttaaaagccttaaagatgtatcaaacaaacacaatgtatggcatttgtttggatgctgattgaaacaaggtacctgttaaagaaaacacatgtgagacaaaagagcaaatgtgaacaatgactggctattag

SEQ ID NO: 2852 - DNA, 233 bp, Homo sapiens
  chr2.fa.O7frz.73872524
  Located on chromosome 2
  Distance between a terminus base of telomere on chromosomal short arm and 5'-terminus of this base sequence : 68591554
  Distance between 3'-terminus of neighbour sequence of sequence listing upward to telomere on chrosomal short arm and 5'-terminus of this base sequence : 140300
gtctttactcaccagcactctccatgcaccttcagggggagggggctgggggtgggcaatggtagtgatgtgagtctgaaaccacagccagagaccagtaagagaccaaaatcaatgtgtgactaattttagggctgctgccttgactggctgcatgtagtgtgtgtgtgtgtgtgtgtgtgtgtctgtgtgtctgtgtgtctgtgtgtgtgtaatgacagtgaagacaaagc

SEQ ID NO: 2853 - DNA, 394 bp, Homo sapiens
  AC007881.3_98494
  Located on chromosome 2
  Distance between a terminus base of telomere on chromosomal short arm and 5'-terminus of this base sequence : 68691062
  Distance between 3'-terminus of neighbour sequence of sequence listing upward to telomere on chrosomal short arm and 5'-terminus of this base sequence : 99275
agtatgtccaatagatatctgcactcccatatttgttgcagcatcattcataatagccaagacacagaatcaacctaagtgtccatcaatgcatgaatggataaagaaaatgttacacacacacacacacacacacacacacacagtggaatactactcagccttaaaaaagaaggaagtcctgtcatttgtgacaacatggatgaatctggaggatgttatactaagtgagataagccaggcacagaaagaaaaatactgcatgctctcacttatacaaggactctaaaaaggttgaacccatagaagcagagagtagaaatgccagggactgaagaaggtggggggaagagggagatgttggtctaaaagtatgaagtttcagttaggaaga

SEQ ID NO: 2854 - DNA, 407 bp, Homo sapiens
  AC007878.2_55871
  Located on chromosome 2
  Distance between a terminus base of telomere on chromosomal short arm and 5'-terminus of this base sequence : 68845216
  Distance between 3'-terminus of neighbour sequence of sequence listing upward to telomere on chrosomal short arm and 5'-terminus of this base sequence : 153760
gaggaaactagcagtaaagaattcctggctggtgcggtggctcatacctgtaatcccagcactttgggaggccaaggcaggtggatcacctgagatcgggagttcgagaccagcctgaccaacaaggagaaacctcgtctctactaaaaatacaaaattagccgggagtggtggtgcatgcctgtaatcccagctactcgggaggctgaggtagaagaatcgcttgaacctggaaggcggagtttgcagtgagccaagatcgcaccattgcactccagcctgagcaacaagagtgaaactctgtctcaaaaacaaacaaacaaacaaacaaacaaacaaaaacaaaacagaatccctgtgattgtgagtctcacttagggctggaccgaaagtattagaccatttac

SEQ ID NO: 2855 - DNA, 397 bp, Homo sapiens
  AC016700.5_30114
  Located on chromosome 2
  Distance between a terminus base of telomere on chromosomal short arm and 5'-terminus of this base sequence : 69024088
  Distance between 3'-terminus of neighbour sequence of sequence listing upward to telomere on chrosomal short arm and 5'-terminus of this base sequence : 178465
aagcaaagtccatttcttgagctgccatcatcagtactagaagcttcatctgttatgcaaaatttatatgccatttatttctgtattttcatcttttgatcccttaccaaattgtctcatataaaaaacaacttggctgggggcagtggctcacacctataatcccagcatgttgggagggtgaggcaggattgcttgaacccaggagtttgaaaccagcttgggccttttttagagaccctgtctcgaaaaaaataaaaaataaaacaacaacaacaacaacaacaacaaaactcagaccaaaactgagcataagatagaatgcacaaaatcaaattttctttttttctcaacttttactttagattgggggaacatgtgcagctttcttacctgg

SEQ ID NO: 2856 - DNA, 120 bp, Homo sapiens
  DISD22_0001670
  Located on chromosome 2
  Distance between a terminus base of telomere on chromosomal short arm and 5'-terminus of this base sequence : 69092614
  Distance between 3'-terminus of neighbour sequence of sequence listing upward to telomere on chrosomal short arm and 5'-terminus of this base sequence : 68129
aggcattcatgaatgattctagtggataggcagatggatcaatggatggatggaagcatggatggatggatggatggatggatggatggatagatgaagaccacagatccagaaattcag

SEQ ID NO: 2857 - DNA, 190 bp, Homo sapiens
  D2S291
  Located on chromosome 2
  Distance between a terminus base of telomere on chromosomal short arm and 5'-terminus of this base sequence : 69351733
  Distance between 3'-terminus of neighbour sequence of sequence listing upward to telomere on chrosomal short arm and 5'-terminus of this base sequence : 258999
ccccctagccatcctagacgtgtgtgtgtgtgtgtgtgtgtgtgtgtgtgtgtgtgtgtgtgtgttaccttaaagagtttttccacctgccctccacccctcactgtgtttccccagcaagactttgggaggggctggttgccaggaccaactctaaatgtcaaggcctggaaaatccaacttggggcca

SEQ ID NO: 2858 - DNA, 394 bp, Homo sapiens
  chr2.fa.O7frz.74663001
  Located on chromosome 2
  Distance between a terminus base of telomere on chromosomal short arm and 5'-terminus of this base sequence : 69424699
  Distance between 3'-terminus of neighbour sequence of sequence listing upward to telomere on chrosomal short arm and 5'-terminus of this base sequence : 72776
gagccttaaccagtacagaaagtaagtgtgatcagagagtgtgggagaccttgaagtttagcatcagagctttgcacaggcttcccacaactgagaacaccattgtcgcctagtggatctccattcctcttgcagggcactcattaaggaaggaagactctgctgtctatcctgtatcacctaaggctggaaagagcatcagctctcaatggtgcaatttcatccttgtatgggacaattgcgtgtgtgtgtgtgtgtgtgtgtgtgagagagagagagagagagggagagggagagaaggagagagaggagagaaaggtggggagagagagcgagagatcagaaggcactgtacgtatcttccaagaagatgtgctaagcatctcctagaagt

SEQ ID NO: 2859 - DNA, 159 bp, Homo sapiens
  DISD22_0001682
  Located on chromosome 2
  Distance between a terminus base of telomere on chromosomal short arm and 5'-terminus of this base sequence : 69529160
  Distance between 3'-terminus of neighbour sequence of sequence listing upward to telomere on chrosomal short arm and 5'-terminus of this base sequence : 104067
tcaatcacctttcattcaggtttttaccaaaataccagttcaaagtacctttcagtttccctggatatttctatttttttttctttgctggcgtgtgtgtgtttgtgtgtgtgtgtgtgtgtgtgtgcacgcgtgtgtgtggtgctggtgatggttgtg

SEQ ID NO: 2860 - DNA, 403 bp, Homo sapiens
  chr2.fa.O7frz.69292083
  Located on chromosome 2
  Distance between a terminus base of telomere on chromosomal short arm and 5'-terminus of this base sequence : 69690766
  Distance between 3'-terminus of neighbour sequence of sequence listing upward to telomere on chrosomal short arm and 5'-terminus of this base sequence : 161447
gttgacaactagttgcaaagaggaaaacactgttggctaaatacagaataatgtatgctgcttttagctacctgctttaagagaagtgtgtgtgtgtgtgtgtgtgtgtgtgtgtgtgtgtttctgtgtgtgtctgtatctgtctgtgtagaaatgggaagaaaaactaagttggagaaacagaaatacctcaagaaaagtgaaattgcaagagaaatcctagataagacagggcacattcagaaacgaggcttttcttactattatcaatgataatgtcaagtctagggcacaacagggcatttaacagggtcattgatgtatcccattttgtagagagaagtcattcagctctgtatccaggttttcctttgatattattaccatgtgatatggtttctag

SEQ ID NO: 2861 - DNA, 331 bp, Homo sapiens
  chr2.fa.O7frz.69087521
  Located on chromosome 2
  Distance between a terminus base of telomere on chromosomal short arm and 5'-terminus of this base sequence : 69883173
  Distance between 3'-terminus of neighbour sequence of sequence listing upward to telomere on chrosomal short arm and 5'-terminus of this base sequence : 192004
gacagagtgagatcctgtcagaaagaaagagaaagaaagaaagaaagaaagaaagaaagaaagaaagaaagaaaggaaggaaggaaggaaggaaggaaggaaggaaggaaggaaggaaggaaggaaggaaggaaggaaggaaggaaggaaggaagaaagaaagaaagagggagggaaggaaggaaagaaagaaggaaagaaagaaaggaaggaaggaaggaagaaagactgaatcgtgtttacaagtgatgtgagccaattattatcagagttagaaaataaagacagcaaacaaaatatacttgagctctcagtgcaagactaaagtttg

SEQ ID NO: 2862 - DNA, 156 bp, Homo sapiens
  D2S296
  Located on chromosome 2
  Distance between a terminus base of telomere on chromosomal short arm and 5'-terminus of this base sequence : 69977642
  Distance between 3'-terminus of neighbour sequence of sequence listing upward to telomere on chrosomal short arm and 5'-terminus of this base sequence : 94138
atactctgttaatggcttcaggctctaaagaaaccctggcccaggctctaaaggaggagtgtgaggtcaaacacacacacacacacacacacacacacacacacatgggtcaagaaaggcactcccgcgcccatcccattccaccgtacctgcgag

SEQ ID NO: 2863 - DNA, 107 bp, Homo sapiens
  D2S136
  Located on chromosome 2
  Distance between a terminus base of telomere on chromosomal short arm and 5'-terminus of this base sequence : 70086724
  Distance between 3'-terminus of neighbour sequence of sequence listing upward to telomere on chrosomal short arm and 5'-terminus of this base sequence : 108926
agcttgagacctctgtgtcctcactgaatgagtattattcacacacacacacacacacacacacacacacacacacaccatttaaaccatcactgtttcttctgaat

SEQ ID NO: 2864 - DNA, 172 bp, Homo sapiens
  D2S2235
  Located on chromosome 2
  Distance between a terminus base of telomere on chromosomal short arm and 5'-terminus of this base sequence : 70188250
  Distance between 3'-terminus of neighbour sequence of sequence listing upward to telomere on chrosomal short arm and 5'-terminus of this base sequence : 101419
tgcaattcaatgtgtgtgtgtagatatatatatatacgtgtgtgtgtgtgtgtgtgtgtgtacacaacattttgcctacagtttcaaggggcgctcagatgagaaccaatgtcctaaaagaatatggagaatgtgacacattaaggtaggagggagaaccccctgaaaacct

SEQ ID NO: 2865 - DNA, 436 bp, Homo sapiens
  AC023893.8_179305
  Located on chromosome 2
  Distance between a terminus base of telomere on chromosomal short arm and 5'-terminus of this base sequence : 70220833
  Distance between 3'-terminus of neighbour sequence of sequence listing upward to telomere on chrosomal short arm and 5'-terminus of this base sequence : 32411
tactggttcaagcttctagcaggtaattctgcatatctgagcaacttttttatagaacattttttctttaaatcaggataggcaaagggaagaacattagatttggagtaagaagtcctgggttctacatccagtttatgaaaaaaacaaatgggatggcctagaatgtgttagtcatgtctctgagtctcagactgtgtgcatttgtgtgtgtgtgtgtgtgtgtgtgtgtgtgtgtgtgtattatgtgtacatacaagggtaaactagtaccttcaaaactaaggcttgacacatctagtgtgggggtgacacccatgcctccagacatctattcgcaggtgtcgatagatgttccttcgctagaaaagtaggagttggcgaacatgggtctgacagaaggaacagaagagtagaaggttcctttaatctcact

SEQ ID NO: 2866 - DNA, 143 bp, Homo sapiens
  Z66980
  Located on chromosome 2
  Distance between a terminus base of telomere on chromosomal short arm and 5'-terminus of this base sequence : 70344759
  Distance between 3'-terminus of neighbour sequence of sequence listing upward to telomere on chrosomal short arm and 5'-terminus of this base sequence : 123490
aggtctgccttgcacagaccttgtgtgcacacgcgtttgtgtgtgtgtgtgtgtgtgtgtgtgtgtgtgtgtgtccagggacacccatgaactcaccctccaatccaatccaatattaaaagtgcaacagtcctaaaagggtt

SEQ ID NO: 2867 - DNA, 417 bp, Homo sapiens
  AC021014.2_1537
  Located on chromosome 2
  Distance between a terminus base of telomere on chromosomal short arm and 5'-terminus of this base sequence : 70373642
  Distance between 3'-terminus of neighbour sequence of sequence listing upward to telomere on chrosomal short arm and 5'-terminus of this base sequence : 28740
tagatcacctgaggtcaagagtttgagaccagcctgggcaacatggtgaaaccctgtttctactaaaaatacaaaaattagccgggcgtggtggcacacacctataatcccagctactcgggcggacgagatgggagaatcgcttgaacccaggaggcgaaggttgcagtgagctgagatcatgccactgcactccagcactccagcctgggtgacagagcaagactctgtctcaaaacacacacacacacacacacacacacacacacacacacacacacacacataatttaacacaatgcttctgccacaaaaaaaaatggaaaatacatcttgaaaccttaaaattcctttttgctgaagatttcaaaaggaaaataaaaaaaaaattcctttgactcactaatcacttctaga

SEQ ID NO: 2868 - DNA, 417 bp, Homo sapiens; identical to SEQ ID NO: 2867
  AC021014.2_41599
  Located on chromosome 2
  Distance between a terminus base of telomere on chromosomal short arm and 5'-terminus of this base sequence : 70373642
  Distance between 3'-terminus of neighbour sequence of sequence listing upward to telomere on chrosomal short arm and 5'-terminus of this base sequence : -417

SEQ ID NO: 2869 - DNA, 458 bp, Homo sapiens
  AC021014.2_76452
  Located on chromosome 2
  Distance between a terminus base of telomere on chromosomal short arm and 5'-terminus of this base sequence : 70425868
  Distance between 3'-terminus of neighbour sequence of sequence listing upward to telomere on chrosomal short arm and 5'-terminus of this base sequence : 51809
tcattgtatcctcacttctgagaacaatgctcagaacacaataaacagtgctcaaaagataagagaccaatgagtgagtgagtgagggagggaccacaatgtcttgatctgctaagggtgccataacaaatgccatagactgggtggcttcaacaacagacattgatttctcatagttctggagtctaggggaaagtccaagattaaggggctggcagattctattcctggggaggggtcttttcctggcttgcagatggcagctttcccattccagcctcacaaaaaacacatgcacatgaacacacacacacacacacacacacacacacacacacacacacacagacaaagagatagacagaaagaaagcaagagcatgctctatgatgtctcttccggtgagggcactaatcccatcatgagagccccaacttcatgacttcatctaaacctaa

SEQ ID NO: 2870 - DNA, 237 bp, Homo sapiens
  D2S380
  Located on chromosome 2
  Distance between a terminus base of telomere on chromosomal short arm and 5'-terminus of this base sequence : 70535802
  Distance between 3'-terminus of neighbour sequence of sequence listing upward to telomere on chrosomal short arm and 5'-terminus of this base sequence : 109476
caagtcgtttttaggtatgagagaaagaatgagtgagggtaagagagagagagagagagagagagagagagagtgtgtgtgtgtgtgtgtgtgtgtgtgttgtacatacaagcacgtacacattcacacatggatggaatatgtccaaccgtcaagtgtccacataccacaggtgaggaaaagattctgagagggccctgtcttgcctgaggtctcacacacacagcaggatttgtt

SEQ ID NO: 2871 - DNA, 255 bp, Homo sapiens
  D2S2231
  Located on chromosome 2
  Distance between a terminus base of telomere on chromosomal short arm and 5'-terminus of this base sequence : 70555981
  Distance between 3'-terminus of neighbour sequence of sequence listing upward to telomere on chrosomal short arm and 5'-terminus of this base sequence : 19942
gaattacctaagacaaattaacaggtgtgtgtgtgtgtgtgtgtgtgtgtgtgtgtgtgtgcgcgcgcgcgctaatattctgatcgttttacaatttataatctgagtagtgtagatgttagcatatagttaactaaaatattgaccaactgttagtagtaaatacttccttttttatttatttatttatttattttttgagacagagtctggctctgtcgcccaggctggagtgcagtggtgcgatcttggctc

SEQ ID NO: 2872 - DNA, 275 bp, Homo sapiens
  AC068404.2_102064
  Located on chromosome 2
  Distance between a terminus base of telomere on chromosomal short arm and 5'-terminus of this base sequence : 70703310
  Distance between 3'-terminus of neighbour sequence of sequence listing upward to telomere on chrosomal short arm and 5'-terminus of this base sequence : 147074
ttgtatacaatgctgacaggtaactcagtggaatatctttaaagccataaacattttaacatctactaaagatattaaaaggaattctaacttccagatatttatctaataatataggtaatataaggagatccatataatctacacacacacacacacacacacacacacacaatatgccctatagcttaatttgcaattgtaaaaaaataaaacttgagacaaactattcaaaaatagagtgtacatgactacattatgccataactaagctt

SEQ ID NO: 2873 - DNA, 195 bp, Homo sapiens
  D2S134
  Located on chromosome 2
  Distance between a terminus base of telomere on chromosomal short arm and 5'-terminus of this base sequence : 70727518
  Distance between 3'-terminus of neighbour sequence of sequence listing upward to telomere on chrosomal short arm and 5'-terminus of this base sequence : 23933
gacgtctgctcgtcagagtcattcaatgaagatatagccgtgttcgccaaacaggtcagcaaaatagatgttaaaaagtaaaagaaacaaaaagagagcccccccttcgccaacacacacgcgcgcgcgcgcgcgcgaacacacacacacacacacacacacggcacactttcaaaagtagccagcacgtagtcg

SEQ ID NO: 2874 - DNA, 205 bp, Homo sapiens
  D2S290
  Located on chromosome 2
  Distance between a terminus base of telomere on chromosomal short arm and 5'-terminus of this base sequence : 70743673
  Distance between 3'-terminus of neighbour sequence of sequence listing upward to telomere on chrosomal short arm and 5'-terminus of this base sequence : 15960
cacagagatagaggattcaatgtttgaaaaattatcatttttgtaggttttatttgtggtacgtgagaactgggaaatatggaactctatttaacagatgctatgtctacctatacaaactacccacagtgactatcatatgatttttatacacacacacacacacacacacacacgtttatttgcaagcaattcaccagagtcg

SEQ ID NO: 2875 - DNA, 242 bp, Homo sapiens
  D2S166
  Located on chromosome 2
  Distance between a terminus base of telomere on chromosomal short arm and 5'-terminus of this base sequence : 70839675
  Distance between 3'-terminus of neighbour sequence of sequence listing upward to telomere on chrosomal short arm and 5'-terminus of this base sequence : 95797
aaaagatcatcccagcaaaatgcaattaacagcgaaacacacacacatacactcacacactcggcggtgcggaatttttttaaaggacgtgttgttctgagttgaagaaaggtgagaagttcaccgtcccttcaccatcagtagcctcgctgcggctctcctctctctctctctctctctctctctcacacacacacacacacacacacacttggaggtttggtccctagttctatctgtga

SEQ ID NO: 2876 - DNA, 358 bp, Homo sapiens
  AC007392.3_127304
  Located on chromosome 2
  Distance between a terminus base of telomere on chromosomal short arm and 5'-terminus of this base sequence : 70921513
  Distance between 3'-terminus of neighbour sequence of sequence listing upward to telomere on chrosomal short arm and 5'-terminus of this base sequence : 81596
cagacttcatgtaaatggaaacatagagtgtatatatatatatatatatatatatatatatatatatatatatatatatatgtgtgtgtgtgtgtgtgtgtgtgtgtgtgtgtgtgtgtgtttctctcttctttgtatcagtatgataattttgaggttcattcatgatgttttgtgtaacagtatattgtgcctttttattgttgtgtagtattccattgcacagatttgcttgcattttaaaggggctttgcaggaagaagagccttttctcaaaatatgaattagaatataatgactgaaagagaagtgtagaactaaagggcataatgatctgtgttgagtactcactgtggat

SEQ ID NO: 2877 - DNA, 325 bp, Homo sapiens
  AC007392.3_190045
  Located on chromosome 2
  Distance between a terminus base of telomere on chromosomal short arm and 5'-terminus of this base sequence : 70984263
  Distance between 3'-terminus of neighbour sequence of sequence listing upward to telomere on chrosomal short arm and 5'-terminus of this base sequence : 62392
agcaatagctaatctgatatttgtctatgaattaacaggtaagaaggaaaaaaggttgctgagtgtgtgtatgtgtgtgtgtgtgtgtgtgtgtgtgtgtgtatttatgtttgtttgtttataaacaatccggcgcattcatgcccagtgaagggttaattacttttgacgttttgttaatggcaatgtcgttctcttacttattattgcttatctttttagatcagctatttttaaacttctatcagactttgaatgaacttatcaattttcagttaataaaacgttgaatttgatatccttacaaacttaccagtggtaaata

SEQ ID NO: 2878 - DNA, 313 bp, Homo sapiens
  AC007392.3_192491
  Located on chromosome 2
  Distance between a terminus base of telomere on chromosomal short arm and 5'-terminus of this base sequence : 70986716
  Distance between 3'-terminus of neighbour sequence of sequence listing upward to telomere on chrosomal short arm and 5'-terminus of this base sequence : 2128
tcaagctacaggttatgtgaagaaagctttgcttagaagaacatggtattatgcccctaatcattgtgtgtgtgtgtgtgtgtgtgtgtgtgtgtgtgtgtgtgtatgtatgtttatatgtagctaagcttatatttctttaagagtattagagaatctgtagacagtaattacctggggaaggaaattagaggtctgattgagacaaagacattttcactaattgatttttaaaaaaacaagcatatatactacattttcacttaaaatactacttataaaagaacttattcttggtttcagaacttgagta

SEQ ID NO: 2879 - DNA, 247 bp, Homo sapiens
  D2S1336
  Located on chromosome 2
  Distance between a terminus base of telomere on chromosomal short arm and 5'-terminus of this base sequence : 71024432
  Distance between 3'-terminus of neighbour sequence of sequence listing upward to telomere on chrosomal short arm and 5'-terminus of this base sequence : 37403
gacagggttgaaaacacagctcttttataaagttattgttaaaagagacaggatctctgttataaagttgctataaagttcaatatatgtaacaaataagataagagtgtctggctcatagaaagctatctgtctatctatctatctatctatctatctatctatctatctatctatcttatttaagtggatatgtccagtatttgaacatagggctgagttatgcccaagcccatgctcattattt

SEQ ID NO: 2880 - DNA, 182 bp, Homo sapiens
  D2S379
  Located on chromosome 2
  Distance between a terminus base of telomere on chromosomal short arm and 5'-terminus of this base sequence : 71051248
  Distance between 3'-terminus of neighbour sequence of sequence listing upward to telomere on chrosomal short arm and 5'-terminus of this base sequence : 26569
ggtaatatgtggatgtatggcatctactattttgttctatgcacacacacacacacacacacacacacacaaacattcctatactcagattttgatctaggaatcaaagagatataaaaattgttttattttcctaagcatttttagacaaaatttgatttgcagtcactattactcaagat

SEQ ID NO: 2881 - DNA, 185 bp, Homo sapiens
  G08170
  Located on chromosome 2
  Distance between a terminus base of telomere on chromosomal short arm and 5'-terminus of this base sequence : 71082580
  Distance between 3'-terminus of neighbour sequence of sequence listing upward to telomere on chrosomal short arm and 5'-terminus of this base sequence : 31150
taattcaattctttcctgtcaggaaatcagtgaaaactatctatgtatctatgtatctatgtatctatgtatctatgtatctatgtatctatctatctatctatctatctatctatctatctgtctatctgtctatcatccatctatctatattcttaaacccaaagaagactctttacttagaa

SEQ ID NO: 2882 - DNA, 194 bp, Homo sapiens
  D2S2349
  Located on chromosome 2
  Distance between a terminus base of telomere on chromosomal short arm and 5'-terminus of this base sequence : 71174444
  Distance between 3'-terminus of neighbour sequence of sequence listing upward to telomere on chrosomal short arm and 5'-terminus of this base sequence : 91679
cctccttgtgaataacccttaaactttatcaatatctttcactttcaatttggtataggctcaaacttatagcacttccataataaaggttaatctctctctctctctctctctctccccgtctctctgtgtgtgtgtgtgtgtgtgtgtgtgtgtgtatgtgtctgagaaagaaagttcctcagtaaaaagct

SEQ ID NO: 2883 - DNA, 92 bp, Homo sapiens
  D2S2368
  Located on chromosome 2
  Distance between a terminus base of telomere on chromosomal short arm and 5'-terminus of this base sequence : 71245088
  Distance between 3'-terminus of neighbour sequence of sequence listing upward to telomere on chrosomal short arm and 5'-terminus of this base sequence : 70450
cgaccatagcctggtgactataccttgtgtgtgtgtgtgtgtgtgtgtgtgtgtgtgtgtgtggtttggaagatgctttaagattcaaatac

SEQ ID NO: 2884 - DNA, 461 bp, Homo sapiens
  AC019040.4_83227
  Located on chromosome 2
  Distance between a terminus base of telomere on chromosomal short arm and 5'-terminus of this base sequence : 71299010
  Distance between 3'-terminus of neighbour sequence of sequence listing upward to telomere on chrosomal short arm and 5'-terminus of this base sequence : 53830
agtgagtcattgctgtaatcacaaagcaaatgttcaggttctcatctccttggcagcaaatgttttgttctctaggttagactatcttctctaaactctcatcatatgccactgccttcccctgctggtctatctccaagaaagatacacacacacacacacacacacacacacacacacacacacacacgctttacctattcatcccatccctcccctatcctcccaactatccacccactagtcatcatccatcccatctaggattgtcagttttaagaaaatcaagacacccagtgaaatttcaattcagataaacaacaaataatactttagtataagtcccatgcaatacttaggacacattttttctgaaatatcattcaccatttattttacattcaaatttcactggatgcctgtattttatctggcaaacctaatccgatcacaaatgtcta

SEQ ID NO: 2885 - DNA, 370 bp, Homo sapiens
  AC019040.4_39043
  Located on chromosome 2
  Distance between a terminus base of telomere on chromosomal short arm and 5'-terminus of this base sequence : 71343175
  Distance between 3'-terminus of neighbour sequence of sequence listing upward to telomere on chrosomal short arm and 5'-terminus of this base sequence : 43704
acatctacatccaagtgaactaaggttaaagtgaaaataaaagttaagcttgaatgaacagatgctctaaatcagagcttgtgtgtgtgttgggggctggggaatgggtaggagggagatgcagttaagtaaggaagaatgaacctttacctttgtgcacacttctctctctctctctgtgtgtgtgtgtgtgtgtgtgtgtgtgtgtgtgtgtacaggagaccattgcattcatatgaatagcaagatctttcatgctccagctgttgaatcacatcattctctgcttctatggtcttcaagagttgcaacctggccaccattgattagctcaggctataaaaagattctcttcagtgattgtactgtt

SEQ ID NO: 2886 - DNA, 212 bp, Homo sapiens
  D2S282
  Located on chromosome 2
  Distance between a terminus base of telomere on chromosomal short arm and 5'-terminus of this base sequence : 71379081
  Distance between 3'-terminus of neighbour sequence of sequence listing upward to telomere on chrosomal short arm and 5'-terminus of this base sequence : 35536
ttttgtatttcattgactcctgctctaaactttactatttcctgttcctattttctgcttatgttgggttgaatttgactttctttttctgtgtgtgtgtgtgtgtgtgtgtgtgtgtgtgtgtgtgtgtgtgtgtgtttaagttgagactattgatttcagaccttttttctgttctactttaggcatttattaggttggattttcccgct

SEQ ID NO: 2887 - DNA, 434 bp, Homo sapiens
  chr2.fa.O7frz.70316824
  Located on chromosome 2
  Distance between a terminus base of telomere on chromosomal short arm and 5'-terminus of this base sequence : 71487229
  Distance between 3'-terminus of neighbour sequence of sequence listing upward to telomere on chrosomal short arm and 5'-terminus of this base sequence : 107936
catcttgaatcgcaggtaccacccaggaggaggaggagccaagctcctccccactgcaaagggtgcgaacttctgtggctccaccctggtgcacactcctcccagtgcataggcaggttggaatttttccagcgagtccttcccacctggctgtcttagatagatagatagataggttatagatagacagatagacagattagatagatagatagatagatagatagatagatagatagatagataggtacatacatacatacatacatacatacatacatacatacatacgtagatacatagatagatacatagatagagacaattatgggaattagctcacacaattacagaggctaagaagccccacaatctgctgtctgcaagctggagactcaggaaactcagtggtataattcagtctgagtccaaag

SEQ ID NO: 2888 - DNA, 345 bp, Homo sapiens
  AC023668.2_134175
  Located on chromosome 2
  Distance between a terminus base of telomere on chromosomal short arm and 5'-terminus of this base sequence : 71609765
  Distance between 3'-terminus of neighbour sequence of sequence listing upward to telomere on chrosomal short arm and 5'-terminus of this base sequence : 122102
aaccatcagatctcataagaactaactcaccaccatgaaaacatgataaaccaccccccatgattcaactatctctacctggtcactcccataacatgtggggattatgggaactacgcttcgagatgagatttcattggggacacaactttgttctcttttttgtatttcaccaacagcagaacattaactaaaacacacacacacacacacacacacacacacacacacacacacacactatgatccaaaatccctttaatgaaaaaacccagcacttcccaagaagaatgtgttatatggtgtgaaccactgactctctgagtcctttcactgtcctttatt

SEQ ID NO: 2889 - DNA, 207 bp, Homo sapiens
  D2S285
  Located on chromosome 2
  Distance between a terminus base of telomere on chromosomal short arm and 5'-terminus of this base sequence : 71677885
  Distance between 3'-terminus of neighbour sequence of sequence listing upward to telomere on chrosomal short arm and 5'-terminus of this base sequence : 67775
tgtagaaatcacagggcaggctggatgtggtggttcatgcctgtaatcccaacactttgggaggctcaggtgggaggatcatttgaggccaggaattcaaggccagcctaagcaacattgtgagaccctatctacacacacacacacacacacacacacacacacacacacacacacacacacacaaattagccatgtgcagtggtg

SEQ ID NO: 2890 - DNA, 242 bp, Homo sapiens
  D2S2171
  Located on chromosome 2
  Distance between a terminus base of telomere on chromosomal short arm and 5'-terminus of this base sequence : 71867524
  Distance between 3'-terminus of neighbour sequence of sequence listing upward to telomere on chrosomal short arm and 5'-terminus of this base sequence : 189432
gcttggctttcagactgatgataacaaaagtctaaccttactgaaaaagcagggtacgtatatataaccaatattaatattatgttgagaatgcatttatacatctaaactcacaggagcgcacccacacacccacgtacacacacacacacacacacacaccccacttactttatgtgaaagaccctgccattttattctcaagcttaggaaaattgaagacataaaagcaagcatgttct

SEQ ID NO: 2891 - DNA, 264 bp, Homo sapiens
  chr2.fa.O7frz.70805564
  Located on chromosome 2
  Distance between a terminus base of telomere on chromosomal short arm and 5'-terminus of this base sequence : 71992517
  Distance between 3'-terminus of neighbour sequence of sequence listing upward to telomere on chrosomal short arm and 5'-terminus of this base sequence : 124751
tctatcagatactggctccagaagagatttgttccagagaaaaggtgtccagggaaatgcaatacattttaattgaattttagcaaatttcaaaataattatactatgctctataaaagttttatttatgtatgtatgtattcattcattcattcattcattcattcattcataagagacagggtttcactctgtcactcagactggagtgcagtggtatgatcatagctcactgcaatctcaaactcatggccttaagtaatc

SEQ ID NO: 2892 - DNA, 369 bp, Homo sapiens
  chr2.fa.O7frz.70891998
  Located on chromosome 2
  Distance between a terminus base of telomere on chromosomal short arm and 5'-terminus of this base sequence : 72029251
  Distance between 3'-terminus of neighbour sequence of sequence listing upward to telomere on chrosomal short arm and 5'-terminus of this base sequence : 36470
ctaagacatgcacttcaaagactctttggtacattttacagcctaaagcaggttggacaggagggaagaactggaaatcaaaaccttctaaatgagccccttatgagtcaaattcaaatgtactttaaaggctcaaatgatagataatcggttgatggatagatagatagatagatagatagatagatagatagatagaaagaaatagatgggtagggataactagagataaaaagatatcagtatgacccctttttcccaagaactgattccatatatgttttctactgctctgggtcaatacagaaggcctatggcttctattctccttccaaatatgtctctggctattcatggcagatactgatc

SEQ ID NO: 2893 - DNA, 283 bp, Homo sapiens
  chr2.fa.O7frz.70969299
  Located on chromosome 2
  Distance between a terminus base of telomere on chromosomal short arm and 5'-terminus of this base sequence : 72171460
  Distance between 3'-terminus of neighbour sequence of sequence listing upward to telomere on chrosomal short arm and 5'-terminus of this base sequence : 141840
ggtactaaaggagtctgaggaggcttaagacataatctgttttcacagatttacaatctggtagaaatagaaacattaatttttatgatgcactatattttagacagatagacagatagatgatagatagatagatagatagatagatagatagatagatagatagacagatgtgagagttcaaataggggaaatgtcccatccagttgggcagggagggagagccaaactaagaaccagagttccttggggctcaacaaagtatgatcaggttaacgatgaa

SEQ ID NO: 2894 - DNA, 160 bp, Homo sapiens
  G08184
  Located on chromosome 2
  Distance between a terminus base of telomere on chromosomal short arm and 5'-terminus of this base sequence : 72270476
  Distance between 3'-terminus of neighbour sequence of sequence listing upward to telomere on chrosomal short arm and 5'-terminus of this base sequence : 98733
tgcacccaacattctaacaaaaggctgtaacaagggctacaggaatcatgagccaggaactgtggctcatctatgaaaacttctatctatctatctatctatctatctatctatctatctatctatctatatcataacaccacagccacttagctccaat

SEQ ID NO: 2895 - DNA, 142 bp, Homo sapiens
  G08191
  Located on chromosome 2
  Distance between a terminus base of telomere on chromosomal short arm and 5'-terminus of this base sequence : 72270494
  Distance between 3'-terminus of neighbour sequence of sequence listing upward to telomere on chrosomal short arm and 5'-terminus of this base sequence : -142
aaaaggctgtaacaagggctacaggaatcatgagccaggaactgtggctcatctatgaaaacttctatctatctatctatctatctatctatctatctatctatctatctatatcataacaccacagccacttagctccaat

SEQ ID NO: 2896 - DNA, 449 bp, Homo sapiens
  AC017083.5_86096
  Located on chromosome 2
  Distance between a terminus base of telomere on chromosomal short arm and 5'-terminus of this base sequence : 72366152
  Distance between 3'-terminus of neighbour sequence of sequence listing upward to telomere on chrosomal short arm and 5'-terminus of this base sequence : 95516
aagctaaagtcaaggctgattcttctggaggctgtaggaatgatgttcccttgccttttctagcttctaggggcttccatcattccatggccaatgaccccttccttgcatcattccatactccaacctgttgcatcttctactttatttatttatttatttatttatttatttatttatttatttttgtaaaatgagatgaggtcttgctatgttgcctaggctggtcttgaactcctgagctcatgcgatcctcccacctcagcctcccaaagtgctgggactacatgcatgagccaccctgcttagccaacatcctctacttctgtagtcacactttcctctgcctccctcttataagaacacttgtgattacatctaggacccatttggataatacagaataatctcttcattcaagatccttaacttaatcacacctgcaaagt

SEQ ID NO: 2897 - DNA, 334 bp, Homo sapiens
  AC017083.5_50351
  Located on chromosome 2
  Distance between a terminus base of telomere on chromosomal short arm and 5'-terminus of this base sequence : 72421918
  Distance between 3'-terminus of neighbour sequence of sequence listing upward to telomere on chrosomal short arm and 5'-terminus of this base sequence : 55317
gatcacctaaggtcaggagttcgagaccagtctggccaacatggtgaaaccctctctctactaaaaatacaaaaattagccgggcatgtggcatacgcctttagtcccacctactcgggaggctgaggcaggagaatcacttgaacctaggaggaggaggttgcagtgagccgagatcatgccactgcactccagcctgggcgacagagtgagactctgtctcaaataaataaatacatacatacatacatacatacatacatacatacatacatacttactcaagggaatctattaaatcactaggggagaacaagcaatcactatttcagat

SEQ ID NO: 2898 - DNA, 272 bp, Homo sapiens
  AC017083.5_126574
  Located on chromosome 2
  Distance between a terminus base of telomere on chromosomal short arm and 5'-terminus of this base sequence : 72512102
  Distance between 3'-terminus of neighbour sequence of sequence listing upward to telomere on chrosomal short arm and 5'-terminus of this base sequence : 89850
agaaataaagctgtcaggagaggtgtgatgaggataacgaagaaaacattttgcaactattttaaccagttattcctttacaagccttgataatcgcccgcactcgtgtgtgtttgagagtgtgtgtgtgtgtgtgtgtgtgtgtgagagagagagagaggatgttttctgagtgatcggaaactccttattgataaagcctttgagtcattttataaaaagccattgtgttgtttttttttaaaaaagtcttaatgatccttacatgagaa

SEQ ID NO: 2899 - DNA, 405 bp, Homo sapiens
  AC015969.6_9745
  Located on chromosome 2
  Distance between a terminus base of telomere on chromosomal short arm and 5'-terminus of this base sequence : 72597231
  Distance between 3'-terminus of neighbour sequence of sequence listing upward to telomere on chrosomal short arm and 5'-terminus of this base sequence : 84857
catagttagaattcattaggccaggagtggtggcttactcctgtaatcccagcactttgggaggttgaggtgggcagatcgcttgagcccaggagttcgagaccagcctgagcaacaaggtgaaatgctgtctctacaaaacaaaaaattcaaaaattggctgggcatggtagtgaacacctgtggtcccaactactagtgagactgaggtgggagcattgcttgagcccagaggtagaggctgcagtgagctgtgattatgccagtgtactccagcctgggtgacagagccagaccctgtcacaaaacaaaacaaaacaaaacaaaacaaaacaaaacaaaacacatcatccacagtggtagtttgtggtggatatcccggtatccacagtggtagttcatgtt

SEQ ID NO: 2900 - DNA, 101 bp, Homo sapiens
  DISO7_10000901
  Located on chromosome 2
  Distance between a terminus base of telomere on chromosomal short arm and 5'-terminus of this base sequence : 72639703
  Distance between 3'-terminus of neighbour sequence of sequence listing upward to telomere on chrosomal short arm and 5'-terminus of this base sequence : 42067
gaggaggcgaatggagtacaaattccctcatactgggtaccagagagagagagagagagagagagaaagaaacatcatcattgcatttataacatagccat

SEQ ID NO: 2901 - DNA, 115 bp, Homo sapiens
  DISO7_10000903
  Located on chromosome 2
  Distance between a terminus base of telomere on chromosomal short arm and 5'-terminus of this base sequence : 72642724
  Distance between 3'-terminus of neighbour sequence of sequence listing upward to telomere on chrosomal short arm and 5'-terminus of this base sequence : 2920
ttactgagtcccagactattgggctggtttttttcttcttgttctccttctccttctccttctccttctccttctccttctccttctcctccttcttcctcttgttcttattctt

SEQ ID NO: 2902 - DNA, 451 bp, Homo sapiens
  AC015976.5_91895
  Located on chromosome 2
  Distance between a terminus base of telomere on chromosomal short arm and 5'-terminus of this base sequence : 72750325
  Distance between 3'-terminus of neighbour sequence of sequence listing upward to telomere on chrosomal short arm and 5'-terminus of this base sequence : 107486
cagtggataaacattgaagagtttgaagcaggaaaacttagtaattattctcacctagactttttttcctacacatgagcagacttctgtatgtgtgtctgtgtgtgtgtgtgtgtgtgtgtgtgtgtgtgtgtgtgtgtgtgtgttttcttagtggtaacatgctgtgtatataatatgcaacttgtttttcatttaccaataatatcttggtcatctctgaaaggaagacttataaagaaaaataaggtttgccacgaactatataacaaatttagacatgcaaaaatgtgaagctgtgatggaaaattagtttcttaggaataaaaaaggaaggagagtgcttgtttttaatgtctgttatacctatgaattccctgtaataatttaaggacattaaaaatgtattctaacttgattcttgattttctcataaacttgccatgattag

SEQ ID NO: 2903 - DNA, 458 bp, Homo sapiens
  AC015976.5_86058
  Located on chromosome 2
  Distance between a terminus base of telomere on chromosomal short arm and 5'-terminus of this base sequence : 72755973
  Distance between 3'-terminus of neighbour sequence of sequence listing upward to telomere on chrosomal short arm and 5'-terminus of this base sequence : 5197
agtcctcatcttttggatgtacacatggaaatatttacagttgaaattatatgatatctgaataggcttcaaaattatccagtgggaagggatgatggttatggatgaaacaagattggccatctattggccattgttgaagctgaatgatagatacatggggatttgttacactaatctacttttgtgtgtttttgaaattttctataataaaaagtttttaaaataggcttaggtaaatcccagatttgccacttgtaaatttgtgatcgtggacaaattcattagcctccataagtctcagtttttgtgtgtgtgtgtgtgtgtgtgtgtgttatttctggttagggcgttgcctataaaataggtacaaggttattttcccagtttaccacctggtccgggttgttgtgccaaacttaataatatgtatgatgttactttgtaaattgccacaa

SEQ ID NO: 2904 - DNA, 379 bp, Homo sapiens
  chr2.fa.O7frz.74865909
  Located on chromosome 2
  Distance between a terminus base of telomere on chromosomal short arm and 5'-terminus of this base sequence : 72918744
  Distance between 3'-terminus of neighbour sequence of sequence listing upward to telomere on chrosomal short arm and 5'-terminus of this base sequence : 162313
ttgacaagttgacctgctataggggaaggttcagaacagaagatgagcaaatgcctgccttcaaagacctcctagcctgttctccagtggtggtctgggacagtaaggcagggaagtggaccaaatggcatggagagggagacatcaaggctgaggtgagggatcagggggagttgggtggggcctcctggtgtgcgtgtgtgtgtgtgtgtgtgtgtgtgtgtgtgtgtgtgtgtgtgtgtggtggggagatggagttagcctttccctgccttgggagttcattggaactgctagctctgcttccacttcctactatttgacctcatataagtgtccacagctttctaggactcttcctaacatgaaagtaatttca

SEQ ID NO: 2905 - DNA, 353 bp, Homo sapiens
  HUMUT768
  Located on chromosome 2
  Distance between a terminus base of telomere on chromosomal short arm and 5'-terminus of this base sequence : 72942357
  Distance between 3'-terminus of neighbour sequence of sequence listing upward to telomere on chrosomal short arm and 5'-terminus of this base sequence : 23234
atacctaagacgacttttgcatttttcccaagcctgagctcattttgaaatcttattttcttgagacagaccattcttcgtctttgcttctttctttctttctttctttcttttctttctttctttccttctttctttctctttcttccttccttccttccttccttccttccttccttccttcctttctttctttctttcttttcttttctttcctttctttcttttctttgagatggaatctcagcctgacacccaggctggagtgcaatggtgcaatcttagctcactgcaacctccacctcccgggttcaagcaattctcctgcctcagcctcccgagtagctggtatt

SEQ ID NO: 2906 - DNA, 318 bp, Homo sapiens
  AC007002.2_14212
  Located on chromosome 2
  Distance between a terminus base of telomere on chromosomal short arm and 5'-terminus of this base sequence : 73128486
  Distance between 3'-terminus of neighbour sequence of sequence listing upward to telomere on chrosomal short arm and 5'-terminus of this base sequence : 185776
gtagccagtaattctcttccacagctattatatttcagtgagataaaatagtgagataatactatttttagatattagatttacttgttacattttgcattgatgagaaaacagagggccagagtccctcaatgcccactcccgccacacatacacacacacacacacacacacacacacacacacacacacacacacactgtattgtcctgtttcccctcccaccacacaagcacacatctccaggagccatgagatcctgtccattcggcagctttctctttgtttaatgtccatgcttctgacaactaaagccga

SEQ ID NO: 2907 - DNA, 132 bp, Homo sapiens
  D2S2112
  Located on chromosome 2
  Distance between a terminus base of telomere on chromosomal short arm and 5'-terminus of this base sequence : 73128620
  Distance between 3'-terminus of neighbour sequence of sequence listing upward to telomere on chrosomal short arm and 5'-terminus of this base sequence : -184
cccactcccgccacacatacacacacacacacacacacacacacacacacacacacacacacacactgtattgtcctgtttcccctcccaccacacaagcacacatctccaggagccatgagatcctgtcca

SEQ ID NO: 2908 - DNA, 347 bp, Homo sapiens
  AC006461.2_37032
  Located on chromosome 2
  Distance between a terminus base of telomere on chromosomal short arm and 5'-terminus of this base sequence : 73286716
  Distance between 3'-terminus of neighbour sequence of sequence listing upward to telomere on chrosomal short arm and 5'-terminus of this base sequence : 157964
taagtatgatgcttcctttgatacctaagatatgtcaatgttggctttaatttttattacagtaatcactatcatttattaagcctctaccatatgccaggcattttacatgtgttatttcatttaacacacacacacacacacacacacacacacacacacacagagctagtattaatattatagccattttcaagagaaaagaaacaagcaaactcaaaaaggtattttctcaaagtcattcagctaagatataacagaagcaagattcaaactcagctctgtctaaatgcacagaccacactcttttcctctcttctatactgcattctgctattgtatagaat

SEQ ID NO: 2909 - DNA, 418 bp, Homo sapiens
  chr2.fa.O7frz.75239064
  Located on chromosome 2
  Distance between a terminus base of telomere on chromosomal short arm and 5'-terminus of this base sequence : 73427346
  Distance between 3'-terminus of neighbour sequence of sequence listing upward to telomere on chrosomal short arm and 5'-terminus of this base sequence : 140283
atcttagaacagttaaagacggtaaatcattcaattgcagaaatctataaaggcaataagataatcctacatgacataaaaataacaagtggatgtccttaacagaaacactttaaaaaatatgtaacataatgcattcagggatgtattgcagggtagaaaattcactttttgtctttgtgcctgtgtgtgtgtgtgtgtgtgtgtgtgtgtgtgtgtgtgtgtatccctaatcactttttaagaaggtagtttttccttaggaagagagtggacttcatctatcaccaaggagctaaagaccaagaagcctgcaacggctaattcaaagacagggaggtcccgggggcaagtacgtactgtgatttccaacattgtgtgttatttgtttggagaagttcaagcacttactgaagta

SEQ ID NO: 2910 - DNA, 213 bp, Homo sapiens
  AC016770.8_82396
  Located on chromosome 2
  Distance between a terminus base of telomere on chromosomal short arm and 5'-terminus of this base sequence : 73494276
  Distance between 3'-terminus of neighbour sequence of sequence listing upward to telomere on chrosomal short arm and 5'-terminus of this base sequence : 66512
cactgagaacagtacctgtacttactgaatttatagactatggaagactgacaaacaagcaattatattaaaatgaactacagaatcctatggattaaagtagggtgtgtgtgtgtgtgtgtgtgtgtgtgtgtgtgtgtggtgggtgggggaagtgtcaacgaaagcttcttcgaaaaatgatgtttatacttctaattgacgaatgagtca

SEQ ID NO: 2911 - DNA, 426 bp, Homo sapiens
  AC016770.8_45336
  Located on chromosome 2
  Distance between a terminus base of telomere on chromosomal short arm and 5'-terminus of this base sequence : 73642557
  Distance between 3'-terminus of neighbour sequence of sequence listing upward to telomere on chrosomal short arm and 5'-terminus of this base sequence : 148068
taaaggacttcagtaaagtttcaggatacaaaatcaatggacagaaatcagtagcatttctatacaccaattacattatagcagagaagcaaatcaagaatgcaatcccatttacaatagacacacacacacacacacacacacacacacacacacacacacaaagaaatgcctaagtatacatctgataaaagagaggaaagatttttctttttttttctcagtggagtctcactctgtcacccaggctggagtgcaatggcgccatctcagctcactgcaacctccacctcccgggttcaagcgattctcctgcctcagcctcccgagtagctgggaccacaggtgcatgccaccacagccagctaatttttttgtatttttagtagagatggggtttcaccgtattagccaggatggtaactt

SEQ ID NO: 2912 - DNA, 101 bp, Homo sapiens
  DISO7_10000911
  Located on chromosome 2
  Distance between a terminus base of telomere on chromosomal short arm and 5'-terminus of this base sequence : 73676109
  Distance between 3'-terminus of neighbour sequence of sequence listing upward to telomere on chrosomal short arm and 5'-terminus of this base sequence : 33126
cctgttagatacaaagaccacagaaacacacacacacacacacacacacacacacacacaaagttatccgtgtcaaccaccagactagaagactttgagag

SEQ ID NO: 2913 - DNA, 135 bp, Homo sapiens
  D2S2110
  Located on chromosome 2
  Distance between a terminus base of telomere on chromosomal short arm and 5'-terminus of this base sequence : 73815639
  Distance between 3'-terminus of neighbour sequence of sequence listing upward to telomere on chrosomal short arm and 5'-terminus of this base sequence : 139429
gcttaccatatgatcaggggagaaaaagggatgtgtgtgtgtgtgtgtgtgtgtgtgtgtgtgtgtgtgtgtgtaaaatctcagatagttgcagaggctatttaaagaattaaaatggagtgacatactaccctt

SEQ ID NO: 2914 - DNA, 111 bp, Homo sapiens
  DISO7_10000914
  Located on chromosome 2
  Distance between a terminus base of telomere on chromosomal short arm and 5'-terminus of this base sequence : 73889665
  Distance between 3'-terminus of neighbour sequence of sequence listing upward to telomere on chrosomal short arm and 5'-terminus of this base sequence : 73891
aataaagatcctccactggccctacacacacacacacacacacacacacacacacacacacgtttcaattatttgtctttcccggagaaaagagagttgcatttgttggag

SEQ ID NO: 2915 - DNA, 407 bp, Homo sapiens
  chr2.fa.O7frz.75860749
  Located on chromosome 2
  Distance between a terminus base of telomere on chromosomal short arm and 5'-terminus of this base sequence : 73974602
  Distance between 3'-terminus of neighbour sequence of sequence listing upward to telomere on chrosomal short arm and 5'-terminus of this base sequence : 84826
catagcttcatagcaagctagagaatcaggtctcctggttcctggcttgggggcccggactctgattttagggtactccttctccagctcatccccttgagcgcagagagaggggagatccaatcagcactctgcatccatttatgaggagctgcttctacgtaccaagttccttgctgctcccaatggagaaagccagaggagaggaatgagtgcgcgcgcacacacacacacacacacacacacacacacacacactccttaaccacaataaaaacaaaaaccagacaagaaaatggaggatgacatcctttataacaccgaggcttgaaaatgacaagatggtttaatgaggtatttggttatgtgtaaagttgataaattttaacatccaaacaggagtttag

SEQ ID NO: 2916 - DNA, 408 bp, Homo sapiens
  AC012366.8_159953
  Located on chromosome 2
  Distance between a terminus base of telomere on chromosomal short arm and 5'-terminus of this base sequence : 73982953
  Distance between 3'-terminus of neighbour sequence of sequence listing upward to telomere on chrosomal short arm and 5'-terminus of this base sequence : 7944
tatttctgaactccaaagataaagagaaaaaatatcaaacgattccaggggaagggggaagtttacctagaaaggaaaagaaaatcaggccaactattgttcatgtatgaaagagaaaaaaagatctccagatatgcaaagattcagaaaggcatattacccctatattctgaatattgttctaaagggtattctagccaaacaacacacacacacacacacacacacacacacacacacacacacacacacacacacagcctaaataattgttaagtataatacaggtgttaagaaaggctttataaatctgatgaaattccagatgatttccaaaaacttggcaggtgtgtggagggaggtaaaatgatcaagtagagagtagagtgaaattacatgctacaggtc

SEQ ID NO: 2917 - DNA, 363 bp, Homo sapiens
  AC012366.8_199661
  Located on chromosome 2
  Distance between a terminus base of telomere on chromosomal short arm and 5'-terminus of this base sequence : 74022728
  Distance between 3'-terminus of neighbour sequence of sequence listing upward to telomere on chrosomal short arm and 5'-terminus of this base sequence : 39367
gtagcagtatttagaaaccaagatctgggtgctacatgtgttcatagttactgtggtgtcaaaagttctaggccctttcagaaaacagagccagaaaattagaaaatgtaagagagagagtgtgtgtgtgtgtgtatgcgtgtgtgtgtgtgtgtgtgtgtgtgtgtgtgtgatgagtgcatattggtacctccaattcaaatacaacatcacatagttctttgtcttttcccctactctgtatttgtatctctcatctcccacagtgaaaatgctggttctccccatcagtataattatttattctatcctataatataccccaaatagtttcagattgtgacacgagttctagtattgaat

SEQ ID NO: 2918 - DNA, 217 bp, Homo sapiens
  D2S2111
  Located on chromosome 2
  Distance between a terminus base of telomere on chromosomal short arm and 5'-terminus of this base sequence : 74060354
  Distance between 3'-terminus of neighbour sequence of sequence listing upward to telomere on chrosomal short arm and 5'-terminus of this base sequence : 37263
caggaatgctagtgcatacactcatgtatgtatacacacacacacacacacacacacacacacacacctcactcacacactgactcaccccaagccctgtcaggaatacctctacaagatgcaggaacagacaagaatggcagaaagagacccaggaaagacgaagagcgctcatatctgttgagcatctatggtgcattacgaccagcatgagggt

SEQ ID NO: 2919 - DNA, 408 bp, Homo sapiens
  AC010913.8_163064
  Located on chromosome 2
  Distance between a terminus base of telomere on chromosomal short arm and 5'-terminus of this base sequence : 74129445
  Distance between 3'-terminus of neighbour sequence of sequence listing upward to telomere on chrosomal short arm and 5'-terminus of this base sequence : 68874
ctattagcaagtcactaagtccaacccaaactcaaggggagtggaagtaagtgccatctcctgaagggaggagtatcaaataaatgtgagatatttaaaaactaccacaacatgaggcaggagaattgcttgaacctgggaggcggaggttgcagtgagccgagatcatgccactgcactccagcctggacgacaagagactccatctcaaaaaccaaaccaaaccaaaccaaaccaaaccaaaccaaaccaaaacaaaataaaactaccacaacaaaagatctctgagaaaatacataagatactaataaaatttggttcctgtgaggaaaagaactgtgtggctgggagacgggaagaagggaggattttactttgtactcactttatcttaaggatttctgaggc

SEQ ID NO: 2920 - DNA, 248 bp, Homo sapiens
  D2S145
  Located on chromosome 2
  Distance between a terminus base of telomere on chromosomal short arm and 5'-terminus of this base sequence : 74158817
  Distance between 3'-terminus of neighbour sequence of sequence listing upward to telomere on chrosomal short arm and 5'-terminus of this base sequence : 28964
agcttatggcaagattgtcctcttcccctgcccaacactatctacctgcaagacacagacacacacacaccaccaccaccaccaccaccacaaccaccaccgcctgtttttcctgagcacagaaacttatttctaggtggttcttgcatcctctcccctctctgactccatctatttatggcacttggagaggtcacacacacaacacaacccaactctctttgtgtctgtccatttcaacaatgccc

SEQ ID NO: 2921 - DNA, 340 bp, Homo sapiens
  AC010913.4_121259
  Located on chromosome 2
  Distance between a terminus base of telomere on chromosomal short arm and 5'-terminus of this base sequence : 74222679
  Distance between 3'-terminus of neighbour sequence of sequence listing upward to telomere on chrosomal short arm and 5'-terminus of this base sequence : 63614
cttctggcttgtattaggacttttgcttaaagtcactttacctctgtgtctcacttgcctcatctgtaaaatcgggctatttgaagcaatgagatgaaagatgggatagtatttttgttattcctgtttatcttgagaactcattgtttgatatatatatatatatatatatatatagtcctcaggtgacctgaggatggggccgccccaaaacacaacagcttgcctgggagaagatcccagaggtcttgtgtggtatgtccagggctaaggggaggagttggcgggagtaggggtgtttccaggttcctggcatgctcataggaagatgcagtattct

SEQ ID NO: 2922 - DNA, 476 bp, Homo sapiens
  AC010913.4_46470
  Located on chromosome 2
  Distance between a terminus base of telomere on chromosomal short arm and 5'-terminus of this base sequence : 74246940
  Distance between 3'-terminus of neighbour sequence of sequence listing upward to telomere on chrosomal short arm and 5'-terminus of this base sequence : 23921
taattgtttcaacatcaccatcctttaggtatattaaaacccaaaatgtagccttgagaagtaaatccaaaacatggttctttgaaaagaccagcaaaataaacagctctctggcaaatctattcagagagagagagagagagagagagagagagagagagagagagagggagagagggagagagggagagaatgcatttatatataacacatgggggaaaaaaaaagataactgctggcacagagaagattttcttaaattactaccaggtacaactcttggccaaaatttttgaaaatctgggtaaactgaatgcttttctaggaaaatataaattatcaaaattgactcaagaagaaatagaaaacttgaatagactaataactatagacaaaactgaagaagttggcaaagtgaccagagatattctagagttcacacacatacagaactgttcaagaacaaggatattcta

SEQ ID NO: 2923 - DNA, 428 bp, Homo sapiens
  AC069404.2_88429
  Located on chromosome 2
  Distance between a terminus base of telomere on chromosomal short arm and 5'-terminus of this base sequence : 74267178
  Distance between 3'-terminus of neighbour sequence of sequence listing upward to telomere on chrosomal short arm and 5'-terminus of this base sequence : 19762
gtcaaatgacgtgatcgacaccacacttctagtcagtggtagagctgagagtcaagtccaggctagcctactctataagacaatttaggaaaagataattaattttacaaaaggattcactgttggatggctttagatggaggatctccctgtagctttcaaataggatgtgatgtgcaaacttgagctggctggtgcccatccctgcaagaattccctggagtgatggccatggataggaaaacagtgggtcacaactagtgctgagaagtagcacatataaggttctttggagctgttgtgtaagttggtgtgtgtgtgtgtgtgtgtgtgtgtgtatgtgtgatcttggggaaggtgagagcgaattttctatttccatgggaaaaggtgcaaaggagaatcactttctagacaagcactgaaca

SEQ ID NO: 2924 - DNA, 226 bp, Homo sapiens
  D2S2109
  Located on chromosome 2
  Distance between a terminus base of telomere on chromosomal short arm and 5'-terminus of this base sequence : 74321129
  Distance between 3'-terminus of neighbour sequence of sequence listing upward to telomere on chrosomal short arm and 5'-terminus of this base sequence : 53523
aattggatcatacatggtgaattctgtttggtgccaggaccctgaatgacgtacacacacacacacacacacacacacacacacacacacacacttttcatgtggatgcatacgcatgatcgtattatacatacaattattaaaaagttttatacaattgaattattctaatacaattctatttccttttcttagattaccaggttctgaaactcacagggacttc

SEQ ID NO: 2925 - DNA, 231 bp, Homo sapiens
  chr2.fa.O7frz.76553723
  Located on chromosome 2
  Distance between a terminus base of telomere on chromosomal short arm and 5'-terminus of this base sequence : 74444701
  Distance between 3'-terminus of neighbour sequence of sequence listing upward to telomere on chrosomal short arm and 5'-terminus of this base sequence : 123346
aagttattcctgccgtaaatactgtggtaatttatatatttaaaaaattgagaatttttttaaaacaagtgtttccaaaagcttattgatttttaagtaagttttgtatcacatggtaatacgtttcttttatttgtagaaagtagatttttactttttagtgcttgttgactctgtgtgtgtgtgtgtgtgtgtgtgtgtgtgtgtgtgtgtctattggtttacatgacg

SEQ ID NO: 2926 - DNA, 432 bp, Homo sapiens
  AC069346.2_72235
  Located on chromosome 2
  Distance between a terminus base of telomere on chromosomal short arm and 5'-terminus of this base sequence : 74486170
  Distance between 3'-terminus of neighbour sequence of sequence listing upward to telomere on chrosomal short arm and 5'-terminus of this base sequence : 41238
caagattgacagaccactaactaaattgttaaagaaaaaagaagacaaaataagtacaatcagaaatgacaaaggtgacattatcactgactccacagaaatacacacacacacacacacacacacacacacacacacaaactcagagactattatgaacacctattcacacacaaactaggaaacctagaagaaatggataaattcctggaaatatacaatctcccaagattgagccaggaagaaatggaaatcatgaacagaccaataatgagttctgaaattgagtcagtaataaaaaacttcttcacgacaaaagaaaccgtcagcatagtaaatgaacaacgtacagaatgggacaaaatatttgcaaactgtgcatccaacaaaggtctaatatccagaatctgtaaggaacttaagcagttcaac

SEQ ID NO: 2927 - DNA, 245 bp, Homo sapiens
  DISO7_00011569
  Located on chromosome 2
  Distance between a terminus base of telomere on chromosomal short arm and 5'-terminus of this base sequence : 74614537
  Distance between 3'-terminus of neighbour sequence of sequence listing upward to telomere on chrosomal short arm and 5'-terminus of this base sequence : 127935
gttcaggcaaagcaatcactccctctccctctctgtcattcctttcttttcctttcactatctctctaccctcctcttccccactctctgtttcctctctctctctgtctctctctctcccccaccatctcctctctctttctctccccctgccttctctgtctctctctctgacacacacacacacacacacacacacacacacacacacacacacacacaccgcagcaacattctacctcagc

SEQ ID NO: 2928 - DNA, 446 bp, Homo sapiens
  D00649.1_2351
  Located on chromosome 2
  Distance between a terminus base of telomere on chromosomal short arm and 5'-terminus of this base sequence : 74879365
  Distance between 3'-terminus of neighbour sequence of sequence listing upward to telomere on chrosomal short arm and 5'-terminus of this base sequence : 264583
atttgacaagtggctgactagttctcttctcccgcaaatcccaaggtgctccagtccccagctcactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccaggtgcgtgctcatctggataccaccaggctttgagccactaggagtaagcgctgcactgtggagaccctgctgagctgggggttaggggaaggaaatgtgtgtgtgtgtgtgtgtgtgtgtgtgtgtgtgtgtgtgtgtgtgtgtctgtgcgtgtgtgtgtgtgtgtgtctgtgcatgcacatgcgtgtgtgcacgccaggtgtagggagttcttttctgattaactgatagagcaggac

SEQ ID NO: 2929 - DNA, 446 bp, Homo sapiens; identical to SEQ ID NO: 2928
  AC073046.3_117287
  Located on chromosome 2
  Distance between a terminus base of telomere on chromosomal short arm and 5'-terminus of this base sequence : 74879365
  Distance between 3'-terminus of neighbour sequence of sequence listing upward to telomere on chrosomal short arm and 5'-terminus of this base sequence : -446

SEQ ID NO: 2930 - DNA, 368 bp, Homo sapiens
  AC073046.4_135591
  Located on chromosome 2
  Distance between a terminus base of telomere on chromosomal short arm and 5'-terminus of this base sequence : 74898613
  Distance between 3'-terminus of neighbour sequence of sequence listing upward to telomere on chrosomal short arm and 5'-terminus of this base sequence : 18802
ttaagaaaggagtagcatcgttaggaaggacattttctctccctccctctcctgttcctcctcctcctcctcctcctcctcctcctcctcccctctttatcaatttcctccctacccactaggttaattttgtttaattttacaagtatttactgaatttttggcatctggaattgccgggtaaggccacaagggatttatgtttccaacaaagatgattcctgcccattagggtctcactgcatacaggcagagatagacacatgcatacaagacagtgacacgaagtgaaacaagcgcctaaaagtactatgagaaaataagggatgataataatagctaacatgtattcaggccaggttaagagt

SEQ ID NO: 2931 - DNA, 172 bp, Homo sapiens
  DISD22_0001687
  Located on chromosome 2
  Distance between a terminus base of telomere on chromosomal short arm and 5'-terminus of this base sequence : 75021496
  Distance between 3'-terminus of neighbour sequence of sequence listing upward to telomere on chrosomal short arm and 5'-terminus of this base sequence : 122515
agagctggtgtaagaatcacctgtgtgtgtgtgtgtgtgtgtgtgcgcgtgcgcctcacccacagcaagtctgatatagttgggtccagaatggggcttgggactatggtttgtcccccccccccaggtgattcccatgtatgggctgggatcaaagtagttactggtcact

SEQ ID NO: 2932 - DNA, 395 bp, Homo sapiens
  chr2.fa.O7frz.77179638
  Located on chromosome 2
  Distance between a terminus base of telomere on chromosomal short arm and 5'-terminus of this base sequence : 75153895
  Distance between 3'-terminus of neighbour sequence of sequence listing upward to telomere on chrosomal short arm and 5'-terminus of this base sequence : 132227
caggtcacagaatagcatgtatatataatgtaatccgatttgtagttttatatagccatacatgcacacacacacacacacacacacacacacacacacatacattcaaatgtctgggtagtcatctaaacactaacaatgactaataattcacagagctccaactgctacaatatttgtaacgtgataaagaaattataactttaatatgcaaagatgacttcatgatttaaaaaatgacaagtcgtatatagtagtgggcaaaagtcataaaactcgcaaaagaaggaagacagtgagagaattgtgttaaaatgggccaaggattgattttaatcggatatggtaagacatgcagacctggataattgtcaggaaagaactttatactcaga

SEQ ID NO: 2933 - DNA, 445 bp, Homo sapiens
  AC073263.1_106459
  Located on chromosome 2
  Distance between a terminus base of telomere on chromosomal short arm and 5'-terminus of this base sequence : 75216435
  Distance between 3'-terminus of neighbour sequence of sequence listing upward to telomere on chrosomal short arm and 5'-terminus of this base sequence : 62145
gttcaaagaatctaagctccttagtgtgagaagacaggagtgtcttgtcttctcacaaacacaaacacagtcttctgtgtttgtagtcctgcctgcttagtttgccccatccattgcagtgttctttgctctttggaggtgtgtgtgtgtgtgtgtgtgtgtgtgtgtgtgtgtgtgtgtgtttgtgtgtgttttcaaatggtacttcgggcctgtgtccactgcctgaaatgccttttcttttctctgccccgctctatgtctggcagattccagtttccctttcttagattctcaaaacgaggctactccctccctgtgtactccgatattcttgcacagggtgctctgtctttgtttgcatgcctttctttccacatcctcagggattaagcatcgcacctggtagatcattgatgcttagtctttgttaaaccagatcatg

SEQ ID NO: 2934 - DNA, 123 bp, Homo sapiens
  U32618.1_91
  Located on chromosome 2
  Distance between a terminus base of telomere on chromosomal short arm and 5'-terminus of this base sequence : 75373351
  Distance between 3'-terminus of neighbour sequence of sequence listing upward to telomere on chrosomal short arm and 5'-terminus of this base sequence : 156471
gcaggtaagaaacctaacatagtacctggcacacagtaagtgcttaaaaatgctatatatatatatataagttcaatagagatggggtcttcctatgttgcctaggctagtcttgaaatcctg

SEQ ID NO: 2935 - DNA, 253 bp, Homo sapiens
  DISO7_00001027
  Located on chromosome 2
  Distance between a terminus base of telomere on chromosomal short arm and 5'-terminus of this base sequence : 75444617
  Distance between 3'-terminus of neighbour sequence of sequence listing upward to telomere on chrosomal short arm and 5'-terminus of this base sequence : 71143
cctggtctactcccatcttccaccccagacacaagacatatacaactacaatggacaaaaccatctcggatcactccagcctatgcagaatgctctgtgtgtgtgtgtgtgtgtgtgtgtgtgtgtgtgtgtgtgtgtccagcctatctgttaactccttgaaggcagaaacaccacactcttcttcatactccatcccccctccccaacacccacacacatgctcagtacctggcaatagcagactcccagt

SEQ ID NO: 2936 - DNA, 329 bp, Homo sapiens
  chr2.fa.O7frz.77829433
  Located on chromosome 2
  Distance between a terminus base of telomere on chromosomal short arm and 5'-terminus of this base sequence : 75526551
  Distance between 3'-terminus of neighbour sequence of sequence listing upward to telomere on chrosomal short arm and 5'-terminus of this base sequence : 81681
caacagacttctcaacagaaaccatacaggccatcagggagtgagatgacattttcgaagggctgaaagaaacaacaacaacaacaacaacaacaacaacaacaaaaactgcttaccaagaatagttgtaacctgcaaagctatccttccaatatgaaagagaaataaaggacacacacacacaaaaaaagaaaactgcaggccaatatccctgatgaacacagatgcaaaaatccttaaccaaaccaaattcaacaacatatttaaaaagattcaccatgatcaagtgggattcttcccaggatacaagaatagttcaacatacgcaa

SEQ ID NO: 2937 - DNA, 203 bp, Homo sapiens
  AC007387.3_158777
  Located on chromosome 2
  Distance between a terminus base of telomere on chromosomal short arm and 5'-terminus of this base sequence : 75601729
  Distance between 3'-terminus of neighbour sequence of sequence listing upward to telomere on chrosomal short arm and 5'-terminus of this base sequence : 74849
attaatactttgcaagcatttaaggacggctgcctatgtgctgggcaggcacagtgtaacgcgcgcgcgcacacacacacgcacacacacacacacacacacacacacgattatacagaaaatactaaaaatcacggcccttgccctagggagttcacactgtaatggggcttccaaatgtaagcaaataactgcaaatagat

SEQ ID NO: 2938 - DNA, 203 bp, Homo sapiens; identical to SEQ ID NO: 2937
  AC006543.7_66275
  Located on chromosome 2
  Distance between a terminus base of telomere on chromosomal short arm and 5'-terminus of this base sequence : 75601729
  Distance between 3'-terminus of neighbour sequence of sequence listing upward to telomere on chrosomal short arm and 5'-terminus of this base sequence : -203

SEQ ID NO: 2939 - DNA, 243 bp, Homo sapiens
  AC003065.1_75070
  Located on chromosome 2
  Distance between a terminus base of telomere on chromosomal short arm and 5'-terminus of this base sequence : 75685728
  Distance between 3'-terminus of neighbour sequence of sequence listing upward to telomere on chrosomal short arm and 5'-terminus of this base sequence : 83796
tgttcctagaacctttcacacacacacacacacacacacacgcatgcacacacacacatacacacacacacacaaattatctctacctcctcagtccctgttctctctcaatcctcttcctccctctctcagccatatattataaattgacttagcctctctgacataatgtagtcctcctctctctcaggtcctgtctctttctacctatttaaaatactaagaaataaagctgataaggct

SEQ ID NO: 2940 - DNA, 243 bp, Homo sapiens; identical to SEQ ID NO: 2939
  AC006544.19_52084
  Located on chromosome 2
  Distance between a terminus base of telomere on chromosomal short arm and 5'-terminus of this base sequence : 75685728
  Distance between 3'-terminus of neighbour sequence of sequence listing upward to telomere on chrosomal short arm and 5'-terminus of this base sequence : -243

SEQ ID NO: 2941 - DNA, 404 bp, Homo sapiens
  AC006030.2_41097
  Located on chromosome 2
  Distance between a terminus base of telomere on chromosomal short arm and 5'-terminus of this base sequence : 75952416
  Distance between 3'-terminus of neighbour sequence of sequence listing upward to telomere on chrosomal short arm and 5'-terminus of this base sequence : 266445
tcattggcattaggttgaccagggcctgtggcttttacagagtaaatgtgcctttgtaggagatggggtaatggtaaatcctttggaggagtccagtgtaagagatgggctatagttaaaatacaacacacacacacacacacacgcacacacacaccacatgcacaggcatacacagacacacaccacacacacacaaaaaaacacttccacatgcacacacacacacacacacacacacacacagtcctgctcaggagtgggaacatcagagaccaagaggaaagcaagcctgctgggaagacctcttgcccccgtgtgggttctggatgcctcacacatactgacatggtctctgagatgttcccctgtcacctcaccacctctcctacattcaggattga

SEQ ID NO: 2942 - DNA, 421 bp, Homo sapiens
  AC006030.2_74734
  Located on chromosome 2
  Distance between a terminus base of telomere on chromosomal short arm and 5'-terminus of this base sequence : 75986074
  Distance between 3'-terminus of neighbour sequence of sequence listing upward to telomere on chrosomal short arm and 5'-terminus of this base sequence : 33254
aaggcaagctgaataggaggtcgatcctcaggaagaaaagttgagcatcctctcaactaaaacatttggactggccgggcgcggtggctcacgcctgtaatcccagcacttttagaggcggaggtgggtggaccacctgaggtcaggaatttgagaccagcctgaccaacataatgaaaccctgtctctactaaaaaacaaacaaacaaacaaacaaacaaacaaaaaacaaacagccgggcctggtggcaggcacctgtaatcccagctactcaggaggctgaaacaggagatcacttgaaccacggaggcagaggttgcagtgagccaagcttgcaccattgcactccagcctgggcgatgagagtgaaactccgtctcaaaaaaaaaaaaattttgaacttatcctttggtctattcc

SEQ ID NO: 2943 - DNA, 252 bp, Homo sapiens
  Z67044
  Located on chromosome 2
  Distance between a terminus base of telomere on chromosomal short arm and 5'-terminus of this base sequence : 75990991
  Distance between 3'-terminus of neighbour sequence of sequence listing upward to telomere on chrosomal short arm and 5'-terminus of this base sequence : 4496
ttctagcacattggattttgccagaagtattttgcccaaaatacttttctaaaaagagttcattttaggactaaaaccattgaacacagtacttttgtgcctcctggggcagtttcatatgtactgtttatttcacttttcataagaacattgacagaaagagcagacacacacacacacacacacacacacacacacgtgcccttgaacaggaggaggccaagagttggtgatgtgcccagttttccacag

SEQ ID NO: 2944 - DNA, 279 bp, Homo sapiens
  DISD22_0001695
  Located on chromosome 2
  Distance between a terminus base of telomere on chromosomal short arm and 5'-terminus of this base sequence : 76234326
  Distance between 3'-terminus of neighbour sequence of sequence listing upward to telomere on chrosomal short arm and 5'-terminus of this base sequence : 243083
gttgctaacagatctttctaagatgaaaacctggactgggcacggtggcttaggtctgtaatcccagtgctttgggaggccgaggcaggaggatcacttgagcccaggagtttgaggttgcggtgagttatgatcactttgctgcactgcagcctaggcaaaagactggggccctatctcaaataaataaataaataaataaataaataaataaataaataagtcaaatgaaagcctgatcatatttctctgtttaaaacctttgaatggttcctcatt

SEQ ID NO: 2945 - DNA, 276 bp, Homo sapiens
  DISD22_0001703
  Located on chromosome 2
  Distance between a terminus base of telomere on chromosomal short arm and 5'-terminus of this base sequence : 76341135
  Distance between 3'-terminus of neighbour sequence of sequence listing upward to telomere on chrosomal short arm and 5'-terminus of this base sequence : 106530
gtagtcttgatccatggctgggtggtagcctggagactcatctactcattcaatcattcattcattcattcattcaaatactgagtacctatcagagccaggcactatggcaggagctgggacacagaggaagagatcataaataccacccctcctctcaggaagctccagttttatgagagtgatgcatagcaattaactaaacctacaaatacctgtgcaattacaactgtggtaagtcctatgaaaaagaacggtcatgagaacatgcaacaa

SEQ ID NO: 2946 - DNA, 442 bp, Homo sapiens
  chr2.fa.O7frz.78370078
  Located on chromosome 2
  Distance between a terminus base of telomere on chromosomal short arm and 5'-terminus of this base sequence : 76441070
  Distance between 3'-terminus of neighbour sequence of sequence listing upward to telomere on chrosomal short arm and 5'-terminus of this base sequence : 99659
actttaggagctcaaccactacaaacattattctgagctttatagaccccagtttaccttatcagcaaactgtttttaagtctcacataattttcttactgcttgatgattttatttttaactctgaaaaaccttgactttattctgagtatagtgtgacagatataaacattgtcatatttcaagtaacacatcaattgtctcagcatctcttacacaatattcctccctttcttttgaccctgaattatagcagtctcttgcgcgcacacacacacacacacacacacacacacatacacaaactcctcacttgacatggttctgatatgcatggattttagttaccatggtttgattaaatgacaccagtctcctaacaacataattaaatttcagttatcatggtatatcgtgagtgcttgtataaggtacaagtttc

SEQ ID NO: 2947 - DNA, 309 bp, Homo sapiens
  AC007380.3_68702
  Located on chromosome 2
  Distance between a terminus base of telomere on chromosomal short arm and 5'-terminus of this base sequence : 76513581
  Distance between 3'-terminus of neighbour sequence of sequence listing upward to telomere on chrosomal short arm and 5'-terminus of this base sequence : 72069
aatagactgctttcaaatagcaggttagaagttttctgtcctcaggctgcagaggcagcagctcccactgtcaccaagaactctgctctggggttggtggtacatgaagtctcaaaattatctgttcccataagcttgggtgtgtgtgtgtccttctgtgtgttctctgccattccacaggctgtgtgtgtgtgtgtgtgtgtgtgtgtgtgttgttgttgctgttgtgtgtggtgggggggtgggtcagagggaattcagagggggctcagaggctccaaaataaataagtggatgaatgtctagttg

SEQ ID NO: 2948 - DNA, 176 bp, Homo sapiens
  D2S1351
  Located on chromosome 2
  Distance between a terminus base of telomere on chromosomal short arm and 5'-terminus of this base sequence : 76552745
  Distance between 3'-terminus of neighbour sequence of sequence listing upward to telomere on chrosomal short arm and 5'-terminus of this base sequence : 38855
tatgggtaagttgctggctcattaaatttctcagtttctattcttttgtttgttttccaacaaggactacagtcatttatgctattgctcttttgtttcattcattaaataataataataataataataataataataataataataatgaaatgaagtggcacattggaagtagg

SEQ ID NO: 2949 - DNA, 307 bp, Homo sapiens
  AC007380.3_184497
  Located on chromosome 2
  Distance between a terminus base of telomere on chromosomal short arm and 5'-terminus of this base sequence : 76629347
  Distance between 3'-terminus of neighbour sequence of sequence listing upward to telomere on chrosomal short arm and 5'-terminus of this base sequence : 76426
catgacattcactgatcagataagaaaagaaaaccatacaaacgtataatcatcccattagatgccacaaaaaggtgtttgaagttttcaagagaaaatgataggttagaatttggagatagcaagtggaaactgttttgctaaccaatttggcttttcaaggaaagataatctaagagttgaaggaggacacaggatcaagggacaaagcgtgtgtgtgtgtgtgtgtgtgtgtgtgtgtgtgtgtgtgtgtttgtgtgtattagatgagacatactcaaacacattcataggctaatttggaagt

SEQ ID NO: 2950 - DNA, 392 bp, Homo sapiens
  AC007099.3_109823
  Located on chromosome 2
  Distance between a terminus base of telomere on chromosomal short arm and 5'-terminus of this base sequence : 76679702
  Distance between 3'-terminus of neighbour sequence of sequence listing upward to telomere on chrosomal short arm and 5'-terminus of this base sequence : 50048
actttgaattgtaatcctcataatccctgcatgtcaagggagggacctgtgggaggtgattgtgttatgggggctgtttcctccatgctcttcttgtgacagtgagtgagttatcacaagatctgatagttttatatgggtttgactgttcctccttctctctttctctctctccctctctcaatctctctctctctctctctctctctctctctaagagttagaagatgcttgctgccccttcgcatttcattaggattgtaagtttcctgaggcttccccagccatacagaactgtgagtcaattaaacctctttcctttataaattacccagtctttatagcagtgtgaaaatgggctaatacacacagtcttaaagatgaactttagc

SEQ ID NO: 2951 - DNA, 297 bp, Homo sapiens
  AC005034.1_3412
  Located on chromosome 2
  Distance between a terminus base of telomere on chromosomal short arm and 5'-terminus of this base sequence : 76792704
  Distance between 3'-terminus of neighbour sequence of sequence listing upward to telomere on chrosomal short arm and 5'-terminus of this base sequence : 112610
acataaatttgttagctccaataccaaagcagatcaaagcacatttttttaataaatgttgtttctacaaaacattcataggcctggtaccagtctcaattcaccttcggtgttgttaattatagaactggtatcaacaagctgagtcattatcaaaactatggaatatattcgcaatttagtctagtatgtatatccttgtcccaaaacttcaggtatgtgaagctcttggtgcctacaaagtacatatatatatatatatatatatatatgctcttggtgcatacaaagtacttc

SEQ ID NO: 2952 - DNA, 346 bp, Homo sapiens
  AC005034.1_16207
  Located on chromosome 2
  Distance between a terminus base of telomere on chromosomal short arm and 5'-terminus of this base sequence : 76805499
  Distance between 3'-terminus of neighbour sequence of sequence listing upward to telomere on chrosomal short arm and 5'-terminus of this base sequence : 12498
ctatgtcctgaggcaacttacaccgttaaactgtgcttatccaaattggtataaatacatgcaaacacagaacagacatgtgtgttgagttttgttttgcttgttcaacatttttataacgattgagtcatagtatacacattttctcataacttgcttttttcatttaatataagactagcatgtctctccatgcataaacatatatatgtaatatataacatatagattcacatgttgagaatatgtgtgtgtgtgtgtgtgtgtgtgtgtgtgtgtgtgtgtgtgtacatttttttaataggatcttgcaatttttcccaggttgatcttgaattcttggact

SEQ ID NO: 2953 - DNA, 155 bp, Homo sapiens
  D2S2114
  Located on chromosome 2
  Distance between a terminus base of telomere on chromosomal short arm and 5'-terminus of this base sequence : 76805683
  Distance between 3'-terminus of neighbour sequence of sequence listing upward to telomere on chrosomal short arm and 5'-terminus of this base sequence : -162
gtctctccatgcataaacatatatatgtaatatataacatatagattcacatgttgagaatatgtgtgtgtgtgtgtgtgtgtgtgtgtgtgtgtgtgtgtgtgtacatttttttaataggatcttgcaatttttcccaggttgatcttgaattc

SEQ ID NO: 2954 - DNA, 264 bp, Homo sapiens
  AC005034.1_105037
  Located on chromosome 2
  Distance between a terminus base of telomere on chromosomal short arm and 5'-terminus of this base sequence : 76894516
  Distance between 3'-terminus of neighbour sequence of sequence listing upward to telomere on chrosomal short arm and 5'-terminus of this base sequence : 88678
ggatgttgataatctgaaatacacatataagtaacattttgcaggtcatcgataatgaaatatatatatatatatatatatataaaagtaatatttagaagatacataagcatatttatatgcttaattctcaaagaaacattcccaatactatcacatctgaagtataaaacattgtgtgcaacagacctagctgccaatacttttaatattaaaaaatcagaaaattgacttagtctactggaactgttacaattatcagag

SEQ ID NO: 2955 - DNA, 454 bp, Homo sapiens
  chr2.fa.O7frz.81308727
  Located on chromosome 2
  Distance between a terminus base of telomere on chromosomal short arm and 5'-terminus of this base sequence : 77109029
  Distance between 3'-terminus of neighbour sequence of sequence listing upward to telomere on chrosomal short arm and 5'-terminus of this base sequence : 214249
ataatttacatttggacttttgaacattcttatgaaaaaatgagacttgccaccacagatttaattattgaagcattaattttctcatatttatcatcatataaataaacacaaaacaaaactaaatagacacagtaaaagaatgtaaaactgtaatcaaaattgtcctgtaaaaataaattctaaaatactaaataaaatattagcacattgaatcaagcattatatatatatatatatatatgcataaagttggatttttcaagaatacaaggtggtttacttgtataaactaaatcaacatagttccttacattaatagattacaggaatatagggaaaaatattgatcaatatagaatttccagagaatacatgtgaaaaaattcaatactatttctgattttaaaacactcttgacaaacggtgcatagaaaggaacttccttatccta

SEQ ID NO: 2956 - DNA, 137 bp, Homo sapiens
  chr2.fa.O7frz.81206776
  Located on chromosome 2
  Distance between a terminus base of telomere on chromosomal short arm and 5'-terminus of this base sequence : 77211159
  Distance between 3'-terminus of neighbour sequence of sequence listing upward to telomere on chrosomal short arm and 5'-terminus of this base sequence : 101676
ctatctaagtccattaccaatgacatatatacacacacacacacacacacacacacacacacacatatacacaaaaaaaatatataaatgctatctattaagactttctaacccccttcactccttcattatcatga

SEQ ID NO: 2957 - DNA, 280 bp, Homo sapiens
  DISO7_10000923
  Located on chromosome 2
  Distance between a terminus base of telomere on chromosomal short arm and 5'-terminus of this base sequence : 77321837
  Distance between 3'-terminus of neighbour sequence of sequence listing upward to telomere on chrosomal short arm and 5'-terminus of this base sequence : 110541
cctgcagagaagtattgcagaaaagcaggaaaaataagttaaaataagaaaaaataatcacaaaacagaagaaaactgtaatctacattttaaacaattaaatatactcaaaaatatattagaatatggaaaatgactttcaaacagaaattccagcacacacacacacacacacacacacacacacacacacaccaggaaaaatataaaagagctgaactcaggaataaaaccaatgaaaaaagacaaaataatctcagaattgaaagaataacttacg

SEQ ID NO: 2958 - DNA, 459 bp, Homo sapiens
  chr2.fa.O7frz.79889285
  Located on chromosome 2
  Distance between a terminus base of telomere on chromosomal short arm and 5'-terminus of this base sequence : 77584836
  Distance between 3'-terminus of neighbour sequence of sequence listing upward to telomere on chrosomal short arm and 5'-terminus of this base sequence : 262719
atgtaacaaacctgcatgtaagccctctgtatctaaaataaaagttgaaattatttttaaaagactcagtaaataatttcatacacacatgcacacaggcacacacacacacacacacacacacacacacacacacacacacaatgaccaagtggaattaataccaggggtgcaagcttgctacaatatttaaaagtcaatcattgtaatccaaccatattaagaggttgcagaagaaaaatattaccatattactacagagaaataattagacaaaattcaccacctattcataataaaaattgttggaaaaatagtgctagaaaggaacttcttcaatttattaaataagaagcctacaggtaacattatacttaatggtgaaagaccaaatgctctcccccgaagactggaaataatataaggatatccactctcaaccactctcatttaacatag

SEQ ID NO: 2959 - DNA, 427 bp, Homo sapiens
  chr2.fa.O7frz.80244736
  Located on chromosome 2
  Distance between a terminus base of telomere on chromosomal short arm and 5'-terminus of this base sequence : 77858188
  Distance between 3'-terminus of neighbour sequence of sequence listing upward to telomere on chrosomal short arm and 5'-terminus of this base sequence : 272893
ttggtaagctacacagttgaagaaatatgagactcttatgtaactccttacatcaaaatgaataattgatcaaaagatcaacctaaaaattgagatgaaatatatatgagtatgcatatacctcaagataagaaaaaactttaacaatttattcaacaaatatatatagagagagatgctgggacacagaagtgaacaaaactgcaaaaacacctgccctcatgaaacttaaattctattggagggagagaaagactaataaaccacacacacacacacacacacacacacacacacacacacacatatatatatataaactatattttataatagtgcataaatactattgagaggtagggcaaaaagtgttggaggtgaatgattttagggttgactacccatgttaagctttatggagaaggtg

SEQ ID NO: 2960 - DNA, 433 bp, Homo sapiens
  AC016758.6_43087
  Located on chromosome 2
  Distance between a terminus base of telomere on chromosomal short arm and 5'-terminus of this base sequence : 77938545
  Distance between 3'-terminus of neighbour sequence of sequence listing upward to telomere on chrosomal short arm and 5'-terminus of this base sequence : 79930
ccaaggtgctcatatgttagacaaatagaaaagtgagtacaatgtactttgagatgtgttgtgatatgtcagagagcagagatacgtgacagcacagacaatgcatatctaattcagactgcaaaactgaatttctgtatatatatatgctcttcctctatatatatatatagagagaggaagcataaaaaggcacaacaacaagggaactagcacgacattttatggtatattcatgaatctgcaagagcttggttgtgtttgaatcacagctttcaattagagtataagcgatagatagatagatagatagatagatagatgcatacatacatacatatgaaatacttgaagatgtgagtatttgaagatgtttcagctcacaccaacatggctatatattaaaatagtggagtaatgaagcagtttagat

SEQ ID NO: 2961 - DNA, 283 bp, Homo sapiens
  AC016758.5_33771
  Located on chromosome 2
  Distance between a terminus base of telomere on chromosomal short arm and 5'-terminus of this base sequence : 77970501
  Distance between 3'-terminus of neighbour sequence of sequence listing upward to telomere on chrosomal short arm and 5'-terminus of this base sequence : 31523
gctatcacattggatagaatacagctgggatagggacttattattgggattagattttacaccattattggaactggtagagaaaaccatgcaagattttaactgcatgcttattgttgagcttgatgtctctaaagtcagccaccagactggcaactaggaagaagcatttgtgtgtgtgtgtgtgtgtgtgtgtgtgtgtgtgtgtgtgtgtgtgtagaatgaagaaaatgtgaaatacatgagaacaaactgaaacatacatatgatttctagcatagcc

SEQ ID NO: 2962 - DNA, 469 bp, Homo sapiens
  chr2.fa.O7frz.80413347
  Located on chromosome 2
  Distance between a terminus base of telomere on chromosomal short arm and 5'-terminus of this base sequence : 78026675
  Distance between 3'-terminus of neighbour sequence of sequence listing upward to telomere on chrosomal short arm and 5'-terminus of this base sequence : 55891
taagtatcagatggaataccgtagaaaacagatcaatgatttagaaagttagaacaagaatctttccagaactcaggaaaaaaaaataagaagatacatattatgaaaaacataaaaagaaggattacggtgattggttttcaaagatacgtacacacacacacacacacacacacacacacatacatatttcaggaaaaatgaagaaaacggaagtcacaggagcaacaacaatccaatgtatactaatttctgagcccaaaggtagcctcacatcagaaagtctcttagtggatgtagtcaaaattaatgaaaaaatatataatacatacaattgtgaatataaaactaatcttgatgaccatcaaaaaaagggaaagtgatatattttcatgacatttcttaaagtatcataaaataaattgaaagtaaattgagctattgccttgcatactatcaatttatacgg

SEQ ID NO: 2963 - DNA, 237 bp, Homo sapiens
  AC013408.4_74282
  Located on chromosome 2
  Distance between a terminus base of telomere on chromosomal short arm and 5'-terminus of this base sequence : 78087431
  Distance between 3'-terminus of neighbour sequence of sequence listing upward to telomere on chrosomal short arm and 5'-terminus of this base sequence : 60287
aaagcagttggtatgatttgactgttttctttacttggaatttgatatctggatttagaagcataagataacaatgatagggccaaaattttgaaattctgtaacagatagatagatagatagatagatagagaaatgtcccatcaaatttaaaactaaaactttttccattgatgtacctgggcctatgtatttgtgacagtcagactctgacacaataagcaatgctacctcagt

SEQ ID NO: 2964 - DNA, 372 bp, Homo sapiens
  AC013408.4_91090
  Located on chromosome 2
  Distance between a terminus base of telomere on chromosomal short arm and 5'-terminus of this base sequence : 78104207
  Distance between 3'-terminus of neighbour sequence of sequence listing upward to telomere on chrosomal short arm and 5'-terminus of this base sequence : 16539
aattcagtatgaaagaatgacaacatgaataggaagatacatagataacagacatagagtagcaagctaaaatagataccacatttatacaaggaaaaactccaaaagtaaagggtagagcatttgacagatatgtatgtgtgtgtgtgtgtgtgtgtatatctcatagatatatatatctatatgtgtatatatatatacacatatacatagatgaaatagtaaaagtatataaaataaatacaaaagttgaaaaaattaaacacaggaaagcccttttattttttcatcgtatatattttataattttgattatatatgatcattttataacaaaagcagtgaatgaaatacagaaacaatatttgaacg

SEQ ID NO: 2965 - DNA, 300 bp, Homo sapiens
  AC013408.4_110297
  Located on chromosome 2
  Distance between a terminus base of telomere on chromosomal short arm and 5'-terminus of this base sequence : 78177457
  Distance between 3'-terminus of neighbour sequence of sequence listing upward to telomere on chrosomal short arm and 5'-terminus of this base sequence : 72878
aaacctaattgttcaaagttgagttattttggttatgttatgatagcttatttcagactttttttatctttgatgcaagttttctgcaaggaagaaacaacaagagtagagaagaaaaagttggctatttcttaccccataaatcccatctctcttaatgccatatacttccactccatgttctgctttatttatttatttatttatttatttatttatttatttattgttcctgggatattggaaatggttttaatgtctcaccaatatttaatgaaagccaaatagtttcaaagttga

SEQ ID NO: 2966 - DNA, 438 bp, Homo sapiens
  AC013408.4_986
  Located on chromosome 2
  Distance between a terminus base of telomere on chromosomal short arm and 5'-terminus of this base sequence : 78235588
  Distance between 3'-terminus of neighbour sequence of sequence listing upward to telomere on chrosomal short arm and 5'-terminus of this base sequence : 57831
gaaagaatcttgtcataggaaatatatataggcatacaactatagtgtgatatatataatatatatatgtgtgtatatagatataggctttgatttcctccaactccaatgcatttattatcgtcttgcataattagtgctaaataaatatttgttggattatttttatagaaccaaatatagcctgatgcaatcaatagaagatcagtaaatgttcttgtatataaatttgtgtacgcatatatatatatatatatatatatatatatatatatatatatatatgttttctttttatggagacatgtttatttctaaccctagctgctgaagtgatttctaaagggaaaaagcttagaaggaagaacagagaaactgaaacttttgtcttctagcgttcagaagacaggagagcttcatctgataaatgttaagtgg

SEQ ID NO: 2967 - DNA, 395 bp, Homo sapiens
  AC027376.2_55109
  Located on chromosome 2
  Distance between a terminus base of telomere on chromosomal short arm and 5'-terminus of this base sequence : 78268768
  Distance between 3'-terminus of neighbour sequence of sequence listing upward to telomere on chrosomal short arm and 5'-terminus of this base sequence : 32742
acatgactgcagtagaatccttagcaggccagaagtttagatagatagacagatgatagatagatagatagatagatagatagatagatagatagatagatagatataacaaaaggctaaaagcacgagaaatatctcaccacagcaaaaagctaaaataaaccgtcccatctccatagtatggaagattatgcagccattaaaataataatgtaggccaacttgggtaatcatgacacacaggccaattcttgcacattttctgtttgtgtcaataaagttttattggaatacagccacaccattttttttaactattgtctgtggctgcttttaccatacaatggccaacttgagcagttgtgacagagactatctaggcaacaaatcctaaa

SEQ ID NO: 2968 - DNA, 377 bp, Homo sapiens
  AC027376.2_142216
  Located on chromosome 2
  Distance between a terminus base of telomere on chromosomal short arm and 5'-terminus of this base sequence : 78306927
  Distance between 3'-terminus of neighbour sequence of sequence listing upward to telomere on chrosomal short arm and 5'-terminus of this base sequence : 37764
tattcttggtagctctggtctaaaatatgaacacataaatcatcaaataatatggcacatatatatctgtatctacatcatctatttctttatatatctacttatatctatctaagcatgtacataattaatgatgcttgaaccgtgtcatattacataattgggtgctcaataaatatttgttgaacataaaaatgctcaaacttgaaaaaaaccaaacaattaacaaaacacaagtacacacacacacacacacacacacatatttacttatatatgtttttttatttccaaagtttcataggtaggcctctttcatatacttctgcagggctggaaaatagtcaaaacctatctgagtggttaagtgagcatac

SEQ ID NO: 2969 - DNA, 336 bp, Homo sapiens
  AC027376.2_35130
  Located on chromosome 2
  Distance between a terminus base of telomere on chromosomal short arm and 5'-terminus of this base sequence : 78332023
  Distance between 3'-terminus of neighbour sequence of sequence listing upward to telomere on chrosomal short arm and 5'-terminus of this base sequence : 24719
gtgtaatagaacagctggtcagacacaatttacttgctcacagaaacaaacttaatgacttctgaataaaaaaaaaaggcttactaaaaagggtcataaggaatatcaccagatttaggatactctgggcttaaaatggcatctgcttataaactctgatgcaacacttcccactcctcaaaagcaaaccaacaattaaaaaaaaaatatatatatatatatatatacgcacacacatatatatactatatatataaactcaaaaacaaaaactaggaagatttttttaaaagatgaagagtaacttaaaatatctagaatttcaattgataggca

SEQ ID NO: 2970 - DNA, 484 bp, Homo sapiens
  AC027376.2_106896
  Located on chromosome 2
  Distance between a terminus base of telomere on chromosomal short arm and 5'-terminus of this base sequence : 78372648
  Distance between 3'-terminus of neighbour sequence of sequence listing upward to telomere on chrosomal short arm and 5'-terminus of this base sequence : 40289
ttctggaccaatcattgttacctgtggaatggacagtccatctggcttaagccaacacagtaaatgatggagaaaattttacctaaatgtaacaattagaagggtgatttctcacagcaaatatgggaagctgttgccagaaggagggagaattgatgttaagaagcaaaacacaaataaccacaaaagagctcctcttctctcctctcctctctcccccaaccagaaaaaaatgcacactatcacctaatggaatgaaattatgcagtacatatggacataagtttcataagtagaaaccaacaggcaaacattgatatttctgtctagttttatacacacacacacacacacacacacaaaaccccatatatccatatgttaaggttatgttaattccttcagagatcttctggattgtgtggatagctgtggtccttcaaacatcaatgagactttcctgtaagcagagttcactacaaat

SEQ ID NO: 2971 - DNA, 457 bp, Homo sapiens
  AC027376.2_83292
  Located on chromosome 2
  Distance between a terminus base of telomere on chromosomal short arm and 5'-terminus of this base sequence : 78385652
  Distance between 3'-terminus of neighbour sequence of sequence listing upward to telomere on chrosomal short arm and 5'-terminus of this base sequence : 12520
caaacctcatcttgaattgtagttcccataattttcacatgccctgggaggcacccagtgggaagtaattgattcatggagcagttacccccatgctactgttcttgtgagagtgagtggtttctcacaatatctgatggttttataagggccttcttttcctcccctactttgaattccctttttattaactttcacttattcctcagatttctgcatgctctctgtctctctctttttctctctctccatgtgtatgtgagtacataatatgtacacacacagaggtgtatgcacacacacacacacacacacacatgcacacacacacacacagagagagagagagggagagaaagagagataaagaaatctctccacagtgacaaatgcatattttcttataaggctatggatggctgcctgtattcccctttattctttaagctaaggctgt

SEQ ID NO: 2972 - DNA, 188 bp, Homo sapiens
  DISO7_10000919
  Located on chromosome 2
  Distance between a terminus base of telomere on chromosomal short arm and 5'-terminus of this base sequence : 78439871
  Distance between 3'-terminus of neighbour sequence of sequence listing upward to telomere on chrosomal short arm and 5'-terminus of this base sequence : 53762
actctccaacactctgacattcaaaacaaacttgctatgtgtggctgttttaggagtgtgtgtgtgtgtgtgtgtgtgtgtgtgtgtgtgtggagagagagagagagagagagagagagagagagagagagagagaaatagctctcatgcaggattttctcttttttcaagttggaccctacgtccaa

SEQ ID NO: 2973 - DNA, 149 bp, Homo sapiens
  D2S2116
  Located on chromosome 2
  Distance between a terminus base of telomere on chromosomal short arm and 5'-terminus of this base sequence : 78608237
  Distance between 3'-terminus of neighbour sequence of sequence listing upward to telomere on chrosomal short arm and 5'-terminus of this base sequence : 168178
tgcagactagcgtaagtaggagagaagcagagtaatgtgacagagaaaagtgtgtgtgtgtgtgtgtgtgtgtgtgtgtatacaagaagggagaataccaaccttttaaaaagggctttgagggaaaccctctccaaaagatgatgctt

SEQ ID NO: 2974 - DNA, 474 bp, Homo sapiens
  AC073091.1_47092
  Located on chromosome 2
  Distance between a terminus base of telomere on chromosomal short arm and 5'-terminus of this base sequence : 78824424
  Distance between 3'-terminus of neighbour sequence of sequence listing upward to telomere on chrosomal short arm and 5'-terminus of this base sequence : 216038
ctttgaacagaaaggtaggatcgtaaatgggttaaaagcaactcttcaacctctatcacttatttgatactgacattttgcaaaatgcttaacttctttgtgtccaaggttttttaatctataaaataagtgtgacaataataatacccccctttagggacaatacaaggaggggtattatgcttttgggtattggagagcagtttgggtgaagaagccctaaatccttaatgtgtgtgtatatatatatatgtgtgtgtgtgtgtgtgtgtgtgtgtgtgtgtatacatacatatatatacacagatatatatacatgtatatacagatatatatacatgtatacagatatatatatacacatatatacacatatatacagacatatatatatatatatacctcttgcagataaaattttaaatgataaaacataccaataaaaaaacaggcaaatggcatggactgatagtt

SEQ ID NO: 2975 - DNA, 339 bp, Homo sapiens
  chr2.fa.O7frz.79263797
  Located on chromosome 2
  Distance between a terminus base of telomere on chromosomal short arm and 5'-terminus of this base sequence : 78967430
  Distance between 3'-terminus of neighbour sequence of sequence listing upward to telomere on chrosomal short arm and 5'-terminus of this base sequence : 142532
tgaggtcaggtacaatttctatagaaatacagaggacttagctgagtcccacatggtcctgtcttggcttaggttgacataacaaagtaacatagactgggtggtttaagcaacagaaatttacttttcacaggtctggaggctggaaaattcaagatcaaggtgccagcaggataggtttcattctgaggacacttctctcggaaggtctgaggacctcctcactgaatgctcacatgacctcttctttgtgcagagagagagagagagagagagagcgagagagagatcttcctctaagaagaggaaggagatattagaaggcctcttcctaatagt

SEQ ID NO: 2976 - DNA, 425 bp, Homo sapiens
  AC019332.7_170440
  Located on chromosome 2
  Distance between a terminus base of telomere on chromosomal short arm and 5'-terminus of this base sequence : 79276988
  Distance between 3'-terminus of neighbour sequence of sequence listing upward to telomere on chrosomal short arm and 5'-terminus of this base sequence : 309219
gtagaatcatttgaggctttactaaatcatgtggatcactacccatttctgtctggacatttatagattcagaattcattcatttaaatatcagggctcctaagtcaaatacacacacacacacacacacacacactgagtttattacagaatttgaggtagaatatatgtcctttagttaggttgcgtttaaattactcatcctgcctatggagtctgaaacaacaatatggaagaataggatttcaaacatgtgaaacattattgttgtaaagccaaattaagtagatgggagatattaaagttaaggactgaacagaaaatgtatgggacatagattcaggagatctcagcgaactatagggaatgttggaagaagttgttgacacatacacaaaacagtactagcataatgctgagtcaat

SEQ ID NO: 2977 - DNA, 421 bp, Homo sapiens
  AC019332.7_60687
  Located on chromosome 2
  Distance between a terminus base of telomere on chromosomal short arm and 5'-terminus of this base sequence : 79331810
  Distance between 3'-terminus of neighbour sequence of sequence listing upward to telomere on chrosomal short arm and 5'-terminus of this base sequence : 54397
gcacatgtaccttagaacttaaagtataataaaaaaattaaaaaaataaacgtgatgcacttaaagtaaaaaaaaaatagttatttaaaaataactattaaacatctagtaagtaagcatattgaagaaaagtgggaaaatatctgtaaaatgtgagtctgtaataaaacatgctgcaatatattttggaaatatatatttatgtgtatatacttaacacataaacacacagaaacagagagaatgtgtgtgtgtgtgtgtgtgtgtgtgtgtgtgtgtgtgtgtgtatgtgtgttggttttaaactataaactaaagctgtttagatactataattgagatatatttagttcaaggagtggttaattatgatttaatcaatgattataattcagaagtagctatcataaatgcttcaact

SEQ ID NO: 2978 - DNA, 261 bp, Homo sapiens
  G08186
  Located on chromosome 2
  Distance between a terminus base of telomere on chromosomal short arm and 5'-terminus of this base sequence : 79338888
  Distance between 3'-terminus of neighbour sequence of sequence listing upward to telomere on chrosomal short arm and 5'-terminus of this base sequence : 6657
gagaacattggaacgaactacccttccagtcatgtatgtgtgtggagatgtataggtaggtaggtatgtaggtagggaggcagggaggtagataggtaggtaggtaggtagatagatagatagatagatagatagatagatagatagataggaaaagtaaaaatcaaattaaaatatgtattgtatctctaaattggtccaaatctacaaaagtaaaatgaatgtgattaattatcattaactcaatgctttacttgggga

SEQ ID NO: 2979 - DNA, 402 bp, Homo sapiens
  chr2.fa.O7frz.81605723
  Located on chromosome 2
  Distance between a terminus base of telomere on chromosomal short arm and 5'-terminus of this base sequence : 79397900
  Distance between 3'-terminus of neighbour sequence of sequence listing upward to telomere on chrosomal short arm and 5'-terminus of this base sequence : 58751
gaaggacagattggctagatacagaattcttggctcagtgtcttcctttgagtgttttcaggcattgctgtattcttttgtgacattaaattttgctgtgaataaatctgaaggcaatctttattttttcctctcataagttacttgatatttttatcctggccatagaaggaatctttatatttaaaagatcggaatttttgctaggttgtattgtggtgttgatgcttttgtgcctgttatccttttcagggcctctctctctctctctctctcaatctctctctctctctctctctctctctctgtgtgtgtgtgtgtttgtgtgtgtattcacttcttgaatgcactctcagatttacattttattatttggttttcttatgtttgtgctccagttag

SEQ ID NO: 2980 - DNA, 380 bp, Homo sapiens
  chr2.fa.O7frz.81520553
  Located on chromosome 2
  Distance between a terminus base of telomere on chromosomal short arm and 5'-terminus of this base sequence : 79448934
  Distance between 3'-terminus of neighbour sequence of sequence listing upward to telomere on chrosomal short arm and 5'-terminus of this base sequence : 50632
aaattgatattcaaacattcaaatagttaaactacgaaagtttaaaagtgccagtgaaaaagggcaccatgttgcttgatttaaaaaattttatttatagtatcactaagtctcatttggcatataaatggagtaaaaatgatcactgtgtgtgtgtgtgtgtgtgtgtgtgtgtgtgcgtgtttcttttgttctttctgtatgtgatggattcttttcatcactgacttcacgataaagagatgtgggcaatttacctggccaccatctttaagacagatagttaacagcagcactttctccaaaacattaaacaaaatcccaaggttagggcctgattggttctttttatggcacttactaatcaacagcgttatcat

SEQ ID NO: 2981 - DNA, 196 bp, Homo sapiens
  D2S169
  Located on chromosome 2
  Distance between a terminus base of telomere on chromosomal short arm and 5'-terminus of this base sequence : 79593641
  Distance between 3'-terminus of neighbour sequence of sequence listing upward to telomere on chrosomal short arm and 5'-terminus of this base sequence : 144327
ttctaagacttggcagaacataaaatatatactacgagcctgaagcatcttataatgccagaaagtaaggttatgtttagcatgtggttacacagacacacacacacacacacacacacacacaaaccgcatacacccttacctcacacagtaatgaggctatttaaaaaggatactgaagtcacctgaaagagct

SEQ ID NO: 2982 - DNA, 455 bp, Homo sapiens
  chr2.fa.O7frz.81934928
  Located on chromosome 2
  Distance between a terminus base of telomere on chromosomal short arm and 5'-terminus of this base sequence : 79696678
  Distance between 3'-terminus of neighbour sequence of sequence listing upward to telomere on chrosomal short arm and 5'-terminus of this base sequence : 102841
aggattgatcattatgcatttatttatttgagcatttaagtctatgaatttttttcaggatcattttagtcactatcattatgtcctattttgcaatctcaacttttatcttttttcttttattcaatagttgcttatgaaaaacatatttaattttcagttctctctgtctctcctctctctctctgtctctctgtctctctctctctctctctcagcatctagtgtttttgagagaaaatagtttatattattcctattttgagtaattaattgaacttttttatttgtgaaaatgagagatttgtagagacaaatatatatgtaaaatatagagaataaatttatgagaaacatatttgttcaaatatgtattttaagaataatgtatatgtgttaaaaatatggtataatgagacaagtaggatatattgttaggataccagatttgaagg

SEQ ID NO: 2983 - DNA, 312 bp, Homo sapiens
  AC018887.5_78957
  Located on chromosome 2
  Distance between a terminus base of telomere on chromosomal short arm and 5'-terminus of this base sequence : 79843222
  Distance between 3'-terminus of neighbour sequence of sequence listing upward to telomere on chrosomal short arm and 5'-terminus of this base sequence : 146089
aagcataagcttcacttctagacctggtgtttccagatattccaggtgcctcaatatattggagcagttatttagtaagttgatttggaaaaaacagccacatggaagagcaacgtgtgtgtgtgtgtgtgtgtgtgtgtgtgtgtgtgtctgtgcctgtgtctgtgtctctgtctgtttcctccatgtttttgtttgtttacttattcaacaaataaagttcatatatttatggtatacaacatgatgttttaaaatatgtatacatcacaacatttctaaatcaagctaattaacatatgccttacctca

SEQ ID NO: 2984 - DNA, 460 bp, Homo sapiens
  AC018887.5_138668
  Located on chromosome 2
  Distance between a terminus base of telomere on chromosomal short arm and 5'-terminus of this base sequence : 79893808
  Distance between 3'-terminus of neighbour sequence of sequence listing upward to telomere on chrosomal short arm and 5'-terminus of this base sequence : 50274
gtctgactcaaatcagttgaaggccctaagagcagagctgtggtttttctggagagtaaatgctacctgagaacagaaactccagttagtatttgagaattctagcctgtccttcctgatgggtcacccaacagatttcaaacttgccttgccagtcttcacatggtatatgccaattcttttaaataaattgcattacatatatatgtgtgtatgtatgtatatgcatatatttgcatatgtatatgtatatgcatatatatacatacacacatatgcatatatatgcagatatttctatatcaatctacatacacataaatacacacacacacacacacacacacacacacacactcagctctccatattcatgggtcctacatctgtggattcaagcaaccattagataaaaaatatttgggaaaaaaattgcgtctgtactgaacacctacagact

SEQ ID NO: 2985 - DNA, 150 bp, Homo sapiens
  D2S438
  Located on chromosome 2
  Distance between a terminus base of telomere on chromosomal short arm and 5'-terminus of this base sequence : 79901252
  Distance between 3'-terminus of neighbour sequence of sequence listing upward to telomere on chrosomal short arm and 5'-terminus of this base sequence : 6984
aggtatatgaataaacagacagtcagatagatgttagatagatagatagatagatagatagatagatagatagatagatagagatagacagataaagaaagcaagacttggtacatgtggttatgggggtgaggagttccaagatttgca

SEQ ID NO: 2986 - DNA, 207 bp, Homo sapiens
  chr2.fa.O7frz.82204318
  Located on chromosome 2
  Distance between a terminus base of telomere on chromosomal short arm and 5'-terminus of this base sequence : 79992131
  Distance between 3'-terminus of neighbour sequence of sequence listing upward to telomere on chrosomal short arm and 5'-terminus of this base sequence : 90729
tccaatttctgagtagtttgtaatttctaatatgaattcaaaagagttctctttgtatgggggtagtgtgtgtgtgtgtgtgtgtgtgtgtgtgtgtgtgtgtgtgtgtgtttgtgtgcataggcatatagatttcttattaacttttaatttaaaatattaagaattgcaaaaatcatatgtgtatcttccaatgagttagaatca

SEQ ID NO: 2987 - DNA, 408 bp, Homo sapiens
  AC017004.3_27932
  Located on chromosome 2
  Distance between a terminus base of telomere on chromosomal short arm and 5'-terminus of this base sequence : 80148483
  Distance between 3'-terminus of neighbour sequence of sequence listing upward to telomere on chrosomal short arm and 5'-terminus of this base sequence : 156145
tgtaagaaactgaattctgctatcaaccatatgagttttaaataggtttaaaaaaatctcagatgagaggacagctccaatcaacaccttgatttcagcctgatggaactaagcaaaggatccagttaactcctgatctgtggaaactgtgaggtaatacatttgtattgttttaagtccctaagcttgtggtaatttgtaatgcagcaatagaaaacaaatacaggaacagaagtcaaatttcaggcaattataagcacacacacacacacacacacacacacacacacacacacacacacagtgctcttctagctactggctgaacagactcctgataccaaacaaatccatcatttggaatcatgctgtcattccccacctgtctaaaacagcttactgctaaca

SEQ ID NO: 2988 - DNA, 291 bp, Homo sapiens
  chr2.fa.O7frz.82364008
  Located on chromosome 2
  Distance between a terminus base of telomere on chromosomal short arm and 5'-terminus of this base sequence : 80156704
  Distance between 3'-terminus of neighbour sequence of sequence listing upward to telomere on chrosomal short arm and 5'-terminus of this base sequence : 7813
tttgattacttaacgtacctcatagaagtggaatcatacaacgttgtccttttatgactggcttatttcacttaggataatttcttcaaggctcatccatattgtagcatgtgccagttttctttttttaaggctcagtaatattcattacacacacacacacacacacacacacacaccccacattttgtttatccattcatctgtgcatggacatatgggtggcttctactttttgtgtattgtaaataatgctgctgtgtacatgggtgtacaaacacctgtttgagt

SEQ ID NO: 2989 - DNA, 269 bp, Homo sapiens
  AC017004.3_66841
  Located on chromosome 2
  Distance between a terminus base of telomere on chromosomal short arm and 5'-terminus of this base sequence : 80185868
  Distance between 3'-terminus of neighbour sequence of sequence listing upward to telomere on chrosomal short arm and 5'-terminus of this base sequence : 28873
atcttattgaggaatgtccatctcttacctaataaaagacagagctagtgtgcaagcatcaatctgacagattgcaaagcttgtgcttttaaacaacatgctgtattgtctcttgtaaaacagcatttatataagaaagggccaagccagcattaaacccaaatacacacacacacacacacacacacacacacacacacacagacaccacagactcacctactcactggataaatacatgacagatagatcatcctaacctatgcttt

SEQ ID NO: 2990 - DNA, 444 bp, Homo sapiens
  AC011993.4_52690
  Located on chromosome 2
  Distance between a terminus base of telomere on chromosomal short arm and 5'-terminus of this base sequence : 80232606
  Distance between 3'-terminus of neighbour sequence of sequence listing upward to telomere on chrosomal short arm and 5'-terminus of this base sequence : 46469
gagcaatgagcatacctagaagaaggatcttgatttttagaaataattttccaataaaaggaatcagggccgtatagaaaggtgattgatttcacactgggtgagagaaaatacaagatataactaaggcattggcgatcccataatataaaaacacacatagagatgatagacagatagatagatagatgatagatagatagatagatagatagatagatagatagatagatagataatagatagatatagtatgatggttaatattaggggtcaacttggttgaaggaagcctagatagctggtaaagtattgtttctgggtgtgtctgagaggatgttgccagaagagattaacatttgagtcagtggactggaagaggaagatccaactctcaatttgggtggacactatccaattggctaccagcatggctagaataaa

SEQ ID NO: 2991 - DNA, 267 bp, Homo sapiens
  AC011993.4_115367
  Located on chromosome 2
  Distance between a terminus base of telomere on chromosomal short arm and 5'-terminus of this base sequence : 80239119
  Distance between 3'-terminus of neighbour sequence of sequence listing upward to telomere on chrosomal short arm and 5'-terminus of this base sequence : 6069
gtgaaataaacagctttactgctcacacaaagcctgtttggtggtctcttcacatgtatgctcatgaaagatagatagatagatagatagatagatagatagatagatagatagatagatataaaggaatcaagccatattaaaagggcgtaggtgccagtctgaaagagctttcaatggccaaagctggaaaaagttgagaatataaataatagtaatattgatcatagcccaaagaataaaataaatatccttgagtccaagcta

SEQ ID NO: 2992 - DNA, 457 bp, Homo sapiens
  AC017004.3_181488
  Located on chromosome 2
  Distance between a terminus base of telomere on chromosomal short arm and 5'-terminus of this base sequence : 80301093
  Distance between 3'-terminus of neighbour sequence of sequence listing upward to telomere on chrosomal short arm and 5'-terminus of this base sequence : 61707
ccagtgagaataaacaatgttaacatttgtcatctttgtttaatatcgttagtttttgtttttattttttgagacagttccctgttctatcacccaggctggagtgcagtggcacaactcactgcaacctctacttcccaagctcaaacaatcccccaccttagcctcttaagtagctgagactacaggcatgtgccaccatatctggatatatatatatatatatatatatatatatatatatatatatatatatatatatatactttttttgtagagatggggtctcgctatgttgcccaggctggtctcgaattcctgggctcaagtgatcctctcatctcagtctcccaaagtgctgggatgacaggcttgagccaccacaccaggcccatcatcagtttttatataaagaaaaaaaaaccttaaaattgttaggcaaatactatgacaaatt

SEQ ID NO: 2993 - DNA, 238 bp, Homo sapiens
  D2S329
  Located on chromosome 2
  Distance between a terminus base of telomere on chromosomal short arm and 5'-terminus of this base sequence : 80336287
  Distance between 3'-terminus of neighbour sequence of sequence listing upward to telomere on chrosomal short arm and 5'-terminus of this base sequence : 34737
atagacgctggcttttggagttgccagagttcttgcactggttctttctcatctgtgtgggctggcgttcctttaatctttgaagttgctgttttttggatggattgtgtgtgtgtgtgtgtgtgtgtgtgtgtgtgtgtgtttatcctttttgatgcccttgggggtttgattgtggtataaggtgggctcagttgactcacttcatttctggaagatgtcagtgggccaaggttca

SEQ ID NO: 2994 - DNA, 437 bp, Homo sapiens
  AC069387.5_43940
  Located on chromosome 2
  Distance between a terminus base of telomere on chromosomal short arm and 5'-terminus of this base sequence : 80384649
  Distance between 3'-terminus of neighbour sequence of sequence listing upward to telomere on chrosomal short arm and 5'-terminus of this base sequence : 48124
atatcagaaacctaactccgtttcccctgtaacctaaatttcagctcccttggtatcaacacatcttcaatgcttctgtcaccattttctttaatcctatgagagaatagctcaatattacatcccttgtactaggtgaagttccctcaatgtttccatacattttgggggtggaagggcttatggttctacgtttctttgtttgtttgtttgtttgttttgtctttactacagtctgcatctctctcccacaagcccagccattgttctcacatggctctagccatgaaagatagcatctccatatttcatccccaaaagggtcacaaattcaaagctgtgggtgcagttgcttttaacaaagctttgaggtgaaagaagagggtcctgaagcatagtaaacagagatcaatgtagtttaccagtagatccgaatg

SEQ ID NO: 2995 - DNA, 453 bp, Homo sapiens
  chr2.fa.O7frz.82658403
  Located on chromosome 2
  Distance between a terminus base of telomere on chromosomal short arm and 5'-terminus of this base sequence : 80462619
  Distance between 3'-terminus of neighbour sequence of sequence listing upward to telomere on chrosomal short arm and 5'-terminus of this base sequence : 77533
tccactagaccagtgataagatactcaacctctttgggcttaaaaactggggtaacaaagactgtaatcccacaggaatatttactgcttttagttgcccagcattcatcctgtatgctgtgtgtgtgtgtgtgtgtgtgtgtgtgtgtgtaagagaaagagagagagagagagagagaaagagagagagagagagacctatagctcccagatctctttggatgtgttctttgccatccacccttgtgcagctctttctggaggaccacccttggttggctagaacatgctgtgactgcacacctgaagaaaggaaagtgcctgggtgcctgaggatttacaggctaccctgactcctttgcccaggaaaaggccagaaccaatgacacacccgtatcatactagaaagcctgatgggatcactttgaagctctgtttgcactctacatctcc

SEQ ID NO: 2996 - DNA, 306 bp, Homo sapiens
  AC018733.7_114359
  Located on chromosome 2
  Distance between a terminus base of telomere on chromosomal short arm and 5'-terminus of this base sequence : 80566434
  Distance between 3'-terminus of neighbour sequence of sequence listing upward to telomere on chrosomal short arm and 5'-terminus of this base sequence : 103362
gctgtacaaggaaagcattacatatactttccctggtaatttgaatgcatatttcttctctctctctctctctctctctctctctctctctctctctctctctctctctctctcactttattccaaagtaaggcatcttatttcaggttttcaaaaccaactaggatgtcaagcactttgaaataaaggttataagaaatgtaggtgtcaaagtagctgtgatatatactaagtggtataaatataaacaatggatgcattaggaggtacttaggatgttaggtactcaagacaacttaaaggatg

SEQ ID NO: 2997 - DNA, 476 bp, Homo sapiens
  AC018733.7_19976
  Located on chromosome 2
  Distance between a terminus base of telomere on chromosomal short arm and 5'-terminus of this base sequence : 80625906
  Distance between 3'-terminus of neighbour sequence of sequence listing upward to telomere on chrosomal short arm and 5'-terminus of this base sequence : 59166
gtaaggctttctgtaatccattcccttaagtaccaaagaagggataaaatgtcactttcatgataataagactacaaaggatgttaagcttttatcttatttgtatacatactctctctctctctctctctctctctctctctctctctggccttctcacatgttttctctgataaagcaagctgaagaggctcatgtggcaataaattttgaatggcaacaaccagtgaagaactgaggttctcaggccaccagctctcaaggaacaaaaatgagtgagcttggaagctgatatctctacagttgagccttcagatgagacgataaccctagccaaaatcttgtttgcagcctggtgagagatcctaaaacaaaggacccagataagctgtgctcccataacatgatgagatgataagcatgtgctattttaagcaagtaaatttgggggtaagtggtctcagcacaatagataa

SEQ ID NO: 2998 - DNA, 459 bp, Homo sapiens
  AC010975.6_80836
  Located on chromosome 2
  Distance between a terminus base of telomere on chromosomal short arm and 5'-terminus of this base sequence : 80702915
  Distance between 3'-terminus of neighbour sequence of sequence listing upward to telomere on chrosomal short arm and 5'-terminus of this base sequence : 76533
ctaagttgtaaagactggcaataccaagttttggagaggatgtgaagcaactgtgatactcatacattgctggtgggaatgtaatactttgggaaacagtttggcagtttctcttaatgttaaaaatactcttaccatacgatccagaaactccactcccaggtgaaatgaaaacatatgtacaaggacttttgcatgaaaattaataacagcatactcataatagcttcaaactaaaaacaaccaaaatacctgtcaaattcctatttgaaagttacccctttgagatagaaaacaaagctgctgatatatatatatatatatatatatatatatatatatatatatatatatatatatatatataaattttaaggtgcgctatttaatatatgttacctggcagcagaggaaggggaatacattggaaaagatttctaaaatgacaagaaatgcaga

SEQ ID NO: 2999 - DNA, 175 bp, Homo sapiens
  D2S139
  Located on chromosome 2
  Distance between a terminus base of telomere on chromosomal short arm and 5'-terminus of this base sequence : 80718583
  Distance between 3'-terminus of neighbour sequence of sequence listing upward to telomere on chrosomal short arm and 5'-terminus of this base sequence : 15209
aaattgcgaaactgtggcttaaatattttttgactaataatatcataacaaggttttctaaagtttcctaagttagcatatatacacctaaatatctctaaagaagtgtgtgtgtgtgtgtgtgtgtgtgtgtttgtgttgagggtggggtacatgcatgcatttgctttgagct

SEQ ID NO: 3000 - DNA, 462 bp, Homo sapiens
  chr2.fa.O7frz.83206733
  Located on chromosome 2
  Distance between a terminus base of telomere on chromosomal short arm and 5'-terminus of this base sequence : 80942129
  Distance between 3'-terminus of neighbour sequence of sequence listing upward to telomere on chrosomal short arm and 5'-terminus of this base sequence : 223371
aagagtacagtttacggaactagacagcctacatttgaaacctgactcaataatttattaactgtgtggtgttggacaagtatttaatgtctcataggcctcagttccatcacctgtaaaatgggaataataatgattgtcatataggcaaggcatgtaaatcagtgactgatagatagaaagcattatgtaaatgctaattaagacatttgctcagaaaggccttttctaaccccttgataaataattatatatgtatattacatataaaatgtgtgtgtgtgtgtgtgtgtgtgtatataatctttagttattttagtctgagttttccagagaaagagaaccaataggttatatatgtgtgtattttaaggaattggttcatgcagttgtgggactagcaagtccaccatctataggacagtctgacaggctggaaactcaagtaggagttatgctgaa

SEQ ID NO: 3001 - DNA, 444 bp, Homo sapiens
  AC011746.5_108031
  Located on chromosome 2
  Distance between a terminus base of telomere on chromosomal short arm and 5'-terminus of this base sequence : 81104778
  Distance between 3'-terminus of neighbour sequence of sequence listing upward to telomere on chrosomal short arm and 5'-terminus of this base sequence : 162187
tgaggtcaggattcgagaccagcctggccagcatggtgaaaccccatctctactaaaaatacaaaaatagctgggcatggtggtgtgcacttgtaatcccagctacatgggaaacggaggcaggagaatcacttgaacctgggaggcagaggttgcagtgagccgagattgtgccatagtactctagcctggatgacagagtgagaccctgtctcaaaaattaaaaaataagataagttaaaataaaataaaataaaataaaataagtacccataaaagcatctttgtttctaggtttctccattcaaactatcctacccacaactatcaactttccaaaagcactccttgaatcgtctttcatttccccaggaacctctgatgatcctgatgccaatgctgtcaactctaaactcggcttcctacagtcctacagcttctgga

SEQ ID NO: 3002 - DNA, 431 bp, Homo sapiens
  AC011746.5_165866
  Located on chromosome 2
  Distance between a terminus base of telomere on chromosomal short arm and 5'-terminus of this base sequence : 81162757
  Distance between 3'-terminus of neighbour sequence of sequence listing upward to telomere on chrosomal short arm and 5'-terminus of this base sequence : 57535
gatttgatgttcattctgctaaaatattgctgcctgaagactcaactgtgaaatgcagctgtctagtgtgtttgtacttcgcaatattcccaaaacacacaggcatgcacatgtgcacacatacatgaaaatatatgcacattcacacatatacgctttttaaatatatatttaaaagtttttaaatgaaagcctgtttattatgggaggagattctgcacaattaaaggtatcattcatcctgagcaattttgaggatactagaaaaaatgtagactatacaaagctggtgtgtgtctgtgtgtgtgtgtgtgtgtgtgtgtcagagagagagacagagagagacagagattaagacaatacactctcatctaagattatttacagtctaacttcttaagccatgatctctacgttggatagttggaaac

SEQ ID NO: 3003 - DNA, 379 bp, Homo sapiens
  HUMUT6485B
  Located on chromosome 2
  Distance between a terminus base of telomere on chromosomal short arm and 5'-terminus of this base sequence : 81196187
  Distance between 3'-terminus of neighbour sequence of sequence listing upward to telomere on chrosomal short arm and 5'-terminus of this base sequence : 32999
gccttacagccttgggtaaattagggtcagtttgagactggggttgagactttggagcctgtagtttcttctgtggaagcccaagagactcactctgcattcatgttttctttctttccttcccttcctttcctttccttcctttccttcctttctttccctttctttctttctttctttccttctttctttctttctttctttctttctttctttctttctttctttctttctttctctctctctctctctctttctttctccttccttccttccttccttccttccttccttccttccttccttccttccttccttccttcctttctttctttctttctctctctctttttttttttttcagagtcttgctctgtca

SEQ ID NO: 3004 - DNA, 335 bp, Homo sapiens
  HUMUT428
  Located on chromosome 2
  Distance between a terminus base of telomere on chromosomal short arm and 5'-terminus of this base sequence : 81270195
  Distance between 3'-terminus of neighbour sequence of sequence listing upward to telomere on chrosomal short arm and 5'-terminus of this base sequence : 73629
aatccaatcccagagaagggaaaatagaagaaaatagtgtgtgtgtgtgtgtgtgtgtgtgtgtgtgtgtctatgcaaaggtatttaggctaacttattcatgtgttaacataaggctagacatacatggacacacttggaagttctgggaattgggagaaagaagatttaaaattttcttctcaaaatactgctcaaattcaagagtacctttccactatgaaggtgtcagttgtcgagatactcacaagctatttaattcctaatctgtaagagtctgtagaagctaaagaaatatctttatgttggacctttaggcaagacagaaggaccag

SEQ ID NO: 3005 - DNA, 172 bp, Homo sapiens
  D2S2191
  Located on chromosome 2
  Distance between a terminus base of telomere on chromosomal short arm and 5'-terminus of this base sequence : 81270666
  Distance between 3'-terminus of neighbour sequence of sequence listing upward to telomere on chrosomal short arm and 5'-terminus of this base sequence : 136
cgtatgtatgtggatgatctcactgactcacctacctagagtttccctggctttttttgagttctcatttaggttttttaaaattgtattttattcagcatagatggttcctgtgtgagtgtgtgtgtgtgtgtgtgtgtgtgtgtgtgtacaatgtgtccccagcaactga

SEQ ID NO: 3006 - DNA, 423 bp, Homo sapiens
  AC023348.3_184818
  Located on chromosome 2
  Distance between a terminus base of telomere on chromosomal short arm and 5'-terminus of this base sequence : 81302994
  Distance between 3'-terminus of neighbour sequence of sequence listing upward to telomere on chrosomal short arm and 5'-terminus of this base sequence : 32156
tgtagacactgaaatttccaactgctagttcctttccaagtcatgttgattaggtttcttaaagaggatcttcaactctagattcagggaatactcgattagaatggatcacacacacacacacacacacacacacacacacacacacacagtgtattcactttctgaaagtttattagacaatgacccaagatgcaaatgtttagttacaattttaagccacattcaagatcttgtttaaacacaaaaaacacatgcctgaagaatgaagagtgaacgccaaagcatccaccctaggcctgttcattatctcctgcacctccacctgcatctgttggcttcttgggtcttgtgctggtcatccccaggctccagaggccctctgcacatcttctcagggtctgattagtatggtcaagtgat

SEQ ID NO: 3007 - DNA, 210 bp, Homo sapiens
  D2S2180
  Located on chromosome 2
  Distance between a terminus base of telomere on chromosomal short arm and 5'-terminus of this base sequence : 81432327
  Distance between 3'-terminus of neighbour sequence of sequence listing upward to telomere on chrosomal short arm and 5'-terminus of this base sequence : 128910
tattggagactgaatttggttttgttccctggtacattaatgacttttacgtgtgtgtgtgtgtgtgtgtgtgtgtgtgtgtgtgtgaaacagagagagagagagagaagtgaagaaatgaagaagacagaataatgaagggaaactaggagggacagcctggagaaacattcctgaggcaagagaccttgatagcctcatgccatctgg

SEQ ID NO: 3008 - DNA, 428 bp, Homo sapiens
  chr2.fa.O7frz.83799392
  Located on chromosome 2
  Distance between a terminus base of telomere on chromosomal short arm and 5'-terminus of this base sequence : 81521949
  Distance between 3'-terminus of neighbour sequence of sequence listing upward to telomere on chrosomal short arm and 5'-terminus of this base sequence : 89412
tattcttaaggcacttacatgatacagatgttctgggagatgtcaaattttccttttgtgacagcaaactccaaatttaggggcatattctaaatatctctaactgtttttagcagcctgttttcaatggctgataggtttgccatttttagcaaaaaaaaaaagaaaagaaaagaaaagaaaatgaaaaacagtatgtgtatatatatatgtgtgtgtgtatatatgtgtgtgtgtgtgtgtgtgtatatatatatatatatttggcacgctaggctagtgggtaggaatgagaaatgatggtaggagaactggtgaagtttggaactgtcaggtcagctgggtgactgtgctccaggatattgtagtatacttttcttgaaccctatgtctaaagctatagggttagtcagctcagagcaatactt

SEQ ID NO: 3009 - DNA, 306 bp, Homo sapiens
  AC011741.8_128367
  Located on chromosome 2
  Distance between a terminus base of telomere on chromosomal short arm and 5'-terminus of this base sequence : 81759696
  Distance between 3'-terminus of neighbour sequence of sequence listing upward to telomere on chrosomal short arm and 5'-terminus of this base sequence : 237319
tattttcaactatgcaacctaaagcataactcaaaacagttgatatgtgaaaaacacatcaaacacacacacacacacacacacacacacacacacacacacacacaccccccaggatacatttattttgagattcagtgacagagtatttaaatgctactatttcacagtgactcaaaataaacggattaagtttaaacctaatcctctttgtggcattattattgtcattagctgtgaaataacttgcaatttttgataaagaaatcttcagaaaaaaatgttatcaaattctgcacctatttc

SEQ ID NO: 3010 - DNA, 469 bp, Homo sapiens
  chr2.fa.O7frz.84108789
  Located on chromosome 2
  Distance between a terminus base of telomere on chromosomal short arm and 5'-terminus of this base sequence : 81828469
  Distance between 3'-terminus of neighbour sequence of sequence listing upward to telomere on chrosomal short arm and 5'-terminus of this base sequence : 68467
tagccattcatacctggtaattttatgcactcctttcactcttcagcggtagggaatgagaaggcagactcaaattggtgagcacgcgtcctttcggagctttcatccatctatctatctatcatctatctatctatctatctatctatctatccatccatccatccatatttttttttttgagatggagtctcgctctgttgcccaggctggagtgcagtggcacgatctcagctcactgcaagctccgcctcccgggttcaagctattctcctgcctcagcctcctgagtagctgggactacaggcgcccgccaccatgcctggctaatttttgtatttttagtagagacagggcttcaccatgtgggccaggctggttttgatctcctgacctcatgatctgcccacctcggcctcccaaagtgctgggattacaggcatgagattataggcatctttaaagagtc

SEQ ID NO: 3011 - DNA, 240 bp, Homo sapiens
  chr2.fa.O7frz.84220300
  Located on chromosome 2
  Distance between a terminus base of telomere on chromosomal short arm and 5'-terminus of this base sequence : 81940434
  Distance between 3'-terminus of neighbour sequence of sequence listing upward to telomere on chrosomal short arm and 5'-terminus of this base sequence : 111496
tcaattgtggctttgattatactagtttggaaaatttatgtactagtttggaaaattaatgttttcccttgagtaatggaaagtgtgtgtgtgtttgtgtgtgtgtgtgtgtgtgtgtgtgtgagtcagagaaacagagagatagcagtgcccaaattaacagcttctttcttgacaaatcagcaattcatgctggtgaacacattttgaaacgatcttgttctacaagacttggagtac

SEQ ID NO: 3012 - DNA, 471 bp, Homo sapiens
  chr2.fa.O7frz.84305863
  Located on chromosome 2
  Distance between a terminus base of telomere on chromosomal short arm and 5'-terminus of this base sequence : 82090827
  Distance between 3'-terminus of neighbour sequence of sequence listing upward to telomere on chrosomal short arm and 5'-terminus of this base sequence : 150153
tcacctaagcagttacagtgacttttagaggtgcttcttctctccaattttcagtgattcttcacacttcagagttcaggatttttttcccggtgtagatataggcaaatagaaatagattctctctctctctctctctctctctctctctctctctttctctctctctctgtctctgtgtgtgtgtgtttgtgtgtgtgtgtctttctctctccccacatcatctttaattatctttaattacttgattaaaggaatataagcaaattctaaaggttggtgtggatatagacaaatagagatatagacattctctctctctgtctcccccctctctctctctttctgtatgtgtgtgtgtgtgtgtgtgtgtgtctttccatctccccacattgtctttagttatcttaaattacttgattaaagagatataagctaattctaatggttggcattagctgtatctagtat

SEQ ID NO: 3013 - DNA, 264 bp, Homo sapiens
  chr2.fa.O7frz.84558001
  Located on chromosome 2
  Distance between a terminus base of telomere on chromosomal short arm and 5'-terminus of this base sequence : 82249475
  Distance between 3'-terminus of neighbour sequence of sequence listing upward to telomere on chrosomal short arm and 5'-terminus of this base sequence : 158177
tttgacttctagactggtacctatgtctgcttttcaactactctatatgggatcattcttcctttccttgcttccttccctccctgcttccctccctccctccctccttcccttccttccttccttccttccttccttccttcattccccttggttttagagtagcatttatgccactaggttgtaattttatttactgttttttcttgtcattagcttgtgttttccttcaaggcagaggttatgtcatttcacctttctatc

SEQ ID NO: 3014 - DNA, 457 bp, Homo sapiens
  chr2.fa.O7frz.84649384
  Located on chromosome 2
  Distance between a terminus base of telomere on chromosomal short arm and 5'-terminus of this base sequence : 82330839
  Distance between 3'-terminus of neighbour sequence of sequence listing upward to telomere on chrosomal short arm and 5'-terminus of this base sequence : 81100
tatgtaccttatgcaaggtcatatagctggtatgattggcaattcagatccttgtgcacttaactactatactattcatttttttgagctcagaggtggagataaagtgtgaacctgactttgcaaattgcatatatatatatatatatatgaggagcccaaagagcttttgtttatactgtactcactggtgtttaccatatgagaaatcagtaacaagaaatgttttaaaagattgtttatccatttatgagtaagaatagtgaacctatacatgttaatatacaaaatatggttttacaaatttatttaatgtatagtgctttctttccttatgctgcataattgccacacacttagaggcttaacacaaccacgatttgttacctcacagtttctgtgggtcaagattccaggcatcactgaactaagttctctgcttaaggtctcatagcac

SEQ ID NO: 3015 - DNA, 420 bp, Homo sapiens
  chr2.fa.O7frz.85318259
  Located on chromosome 2
  Distance between a terminus base of telomere on chromosomal short arm and 5'-terminus of this base sequence : 82509670
  Distance between 3'-terminus of neighbour sequence of sequence listing upward to telomere on chrosomal short arm and 5'-terminus of this base sequence : 178374
gtgagtcagctatacgatgaatacattctagagatctagtgtacagaatggtgactatagttactaatgatacattgtttatttgaaatttgctagaagagtatatcttgtttcctcaccatacatacacacacacacacacacacacacacacacacacacacccacacacacactcacacggtaacagtgtggtgataaatgtgttgattaatttaattgtggtaatcattacacaacacatatgtatatcaaatcatcatattgaatagcttaaatatacacaatttttttgtcaattatacctcaaaacttatttgttttgccaggaaatcactccagatatccacttatttccttcaatgctgctacactgaaccagatatttaattaaatgttacttgtcaatcattactttcc

SEQ ID NO: 3016 - DNA, 341 bp, Homo sapiens
  chr2.fa.O7frz.85117729
  Located on chromosome 2
  Distance between a terminus base of telomere on chromosomal short arm and 5'-terminus of this base sequence : 82724791
  Distance between 3'-terminus of neighbour sequence of sequence listing upward to telomere on chrosomal short arm and 5'-terminus of this base sequence : 214701
tcatctttattgaaagtaaagcagaaggaaatgagggctatggtatagatataacatcctagaccaaagaataaacaaaaacaccatgagtgcttctgctcctgccctctctctctctctcacacacacacacacacacacacacacacacacacacacacagagggagggagggagagagagatctacttcctgatctgggttgtgaaccattttttttctacagaattttctttccaattatagaaaactaagaatatactcccagaaatgacaaatttgaatgtacctatttatgatactgtgaaggatttatacagtaatcctgcctaacttgagat

SEQ ID NO: 3017 - DNA, 138 bp, Homo sapiens
  G08139
  Located on chromosome 2
  Distance between a terminus base of telomere on chromosomal short arm and 5'-terminus of this base sequence : 82733983
  Distance between 3'-terminus of neighbour sequence of sequence listing upward to telomere on chrosomal short arm and 5'-terminus of this base sequence : 8851
ccataacatccccacatagccacagctaggatcccatcatatgatagatagatagatagatagatagatagatagatagatagatcttattttattatatttatgttactgggaagtgtggggccctcagttcttagt

SEQ ID NO: 3018 - DNA, 295 bp, Homo sapiens
  chr2.fa.O7frz.85032283
  Located on chromosome 2
  Distance between a terminus base of telomere on chromosomal short arm and 5'-terminus of this base sequence : 82770851
  Distance between 3'-terminus of neighbour sequence of sequence listing upward to telomere on chrosomal short arm and 5'-terminus of this base sequence : 36730
gactaaatcgaagctagtgctaagttaccattctgaaaatcctagggcccttgagaattatgctagatctactctccctgtgctctataaacggaacaaagcctaaatgacagcacatcagtttactgtatggtttactaatcaccaccgtgatcagtcaagcagtgatcaacatcaaaagatcctccacacacacacacacacacacacacaaaattacttgaaggctttgatgatcattaacatttttcagtaataaattttcaaataaggtatgtacatttagacataatgc

SEQ ID NO: 3019 - DNA, 431 bp, Homo sapiens
  AC012075.9_153656
  Located on chromosome 2
  Distance between a terminus base of telomere on chromosomal short arm and 5'-terminus of this base sequence : 82921467
  Distance between 3'-terminus of neighbour sequence of sequence listing upward to telomere on chrosomal short arm and 5'-terminus of this base sequence : 150321
tagcgctagtgagacttaaattatctaaagttgtcaatgccctgaaaacccatcagactatggccaggtggatttagttgaggaatatcggaaagaactattgcatgcaaggccatcattttactggtgtgtgtgtgtgtgtgtgtgtgtgtgtgtgtgtgtgtatttcttagatacatatatgtatgtctaagaaataacactagatgtgaaagacttatcggttgatttttaaatatttggagggtattaacctataaaaatgacagaaagtagtataagttgaacatttctactaggacttctagtattactataaacgaatataaatagaaagtaaattacatatccccctcctacagaaactcaaaatttactaatatatcaaagcagtaatgttaaattttgttccttacctcagaaagagtaat

SEQ ID NO: 3020 - DNA, 378 bp, Homo sapiens
  AC012075.9_23920
  Located on chromosome 2
  Distance between a terminus base of telomere on chromosomal short arm and 5'-terminus of this base sequence : 82970393
  Distance between 3'-terminus of neighbour sequence of sequence listing upward to telomere on chrosomal short arm and 5'-terminus of this base sequence : 48495
atgaaacattggcatgtagtacaacacgtgttttccaggtctagtttaagatactgatccctatatgaacatgaaaatgggcattaatttccactgcacagacaggaagtgccagtaaaattacaaatggtaacattccatttaatgaactttcactttttaaaaagttcctcacaaaattaaatagaacatttaaaaaatcttagctcctctactaccacactgtctcctactgcagacattacttgttatcagggaagtggggtgtgtgtgtgtgtgtgtgtgtgtgtgtgtgcaaagtctattgcatctagatagcagtgctatttaaattcagaagtatcacacatcatttaataatttacagtccatgtggaa

SEQ ID NO: 3021 - DNA, 404 bp, Homo sapiens
  AC012075.9_77462
  Located on chromosome 2
  Distance between a terminus base of telomere on chromosomal short arm and 5'-terminus of this base sequence : 83024038
  Distance between 3'-terminus of neighbour sequence of sequence listing upward to telomere on chrosomal short arm and 5'-terminus of this base sequence : 53267
acatgcaactggaattcagcaccaagcaaatggatgggatgatgggagccaggtttctcaatgttagagtgagaagttacaaataagcaatgtaggaagaccagaatgatctgttcggtgttggattaaagttggagaccagtataaactcatgtatagctttgtgtgtgtgtgtgtgtgtgtgtgtgtgtgtgtgtgtgtgtgtgtttgtgtgtgtgtattttatatatatatatatatatataatgtgcatacacagagggaaatatatggaaacatacatatacaaacatgcgcatatatatagtcacacccaaatgaacacataaatatttatagatatgtacacaaatatatgtacacaaatatatctcattttcctgtcacttgacctagtggagaat

SEQ ID NO: 3022 - DNA, 221 bp, Homo sapiens
  DISO7_10008956
  Located on chromosome 2
  Distance between a terminus base of telomere on chromosomal short arm and 5'-terminus of this base sequence : 83183326
  Distance between 3'-terminus of neighbour sequence of sequence listing upward to telomere on chrosomal short arm and 5'-terminus of this base sequence : 158884
agggattccacaaccaagttttacagttagaaaggcctatgtgtgtgtgtgtgtgtgtgtgtgtgtgtgtttgtgtggaagagagggagagacagagagagagagagagagatggagagaaagaaagaaagaaacccatcactttaggctttgcatgtgtttaaatgggggcatgatagccaaaacaaaagctaaaattcctgtcttcatcaacaaagatc

SEQ ID NO: 3023 - DNA, 441 bp, Homo sapiens
  chr2.fa.O7frz.85673252
  Located on chromosome 2
  Distance between a terminus base of telomere on chromosomal short arm and 5'-terminus of this base sequence : 83314594
  Distance between 3'-terminus of neighbour sequence of sequence listing upward to telomere on chrosomal short arm and 5'-terminus of this base sequence : 131047
catgaaagcttatgactatgaatcatatttccaattaactgtaggttaggccatttggaatcttcagccctatgaataattacgggggtaaaagaaatagccagttaaataaacaatgcattgatttaatgttttaaaaaccctatttaatgtgtttaaatgtaatatacattcttgttggaatagattgctaggaaatattgaggtgggatcataaccaaaagacatatttagaaagatatacaaaaagctaaaatgaagcaatcatcacaatttgtttgtaccaaaacagtttggggatcagcccatgccttatcagtatagtttgtgagactgtatagtgcgtgtgtgtgtgtgtgtgtgtgtgtgtgtgtgcgcgcgcgcctgtgtacaaaatgagataaaaatgggggcttttagttatcactaggccaatttatt

SEQ ID NO: 3024 - DNA, 471 bp, Homo sapiens
  chr2.fa.O7frz.85764535
  Located on chromosome 2
  Distance between a terminus base of telomere on chromosomal short arm and 5'-terminus of this base sequence : 83366962
  Distance between 3'-terminus of neighbour sequence of sequence listing upward to telomere on chrosomal short arm and 5'-terminus of this base sequence : 51927
ggtttaaaggatgaactctgaggattgactgaatttttttttaatcctagctttgccatttaattaacagatgagcttgggaaagttaccagtctgtgcctgcactttttcttccaaaaaagaaagaaggaaggaaggaaggaaggaaggaaggaaggaaggaaggaaggaaggaaggaaggaaggaagggaaagaaagaaagaaagaaagaaagaaagaaagaaagaaagaaagaaagaaagaaagaaagaaagaaagaaagaaagaagaaagaaagaaagagaaagaaggaaagaaggaaggaaggacggaaggaaggaaggaaggagaaagaaaaaagaaagaaagaaagagaaagaaagaagaaagaaaggagggagggagggaagaaaggaatataactattaggtctgttgtgagcattaaaatgacttaaacagataaagtagttatttcagttctggcacata

SEQ ID NO: 3025 - DNA, 462 bp, Homo sapiens
  AC010105.10_145008
  Located on chromosome 2
  Distance between a terminus base of telomere on chromosomal short arm and 5'-terminus of this base sequence : 83578726
  Distance between 3'-terminus of neighbour sequence of sequence listing upward to telomere on chrosomal short arm and 5'-terminus of this base sequence : 211293
tgttgataggaattgtatgaaatctacaaatcactttggggaatataaatattttaacattaattttttccaatccataaatatgaaatgcctttccatttattttgtgtcttcttttatttaatcaatgttttatatttttcagtgtacaagtctttcacttctttggttaatttcatttctaagtcttttgttctttttggtgctattgcaaataagattgttttcttagttccttttcagagagtttattataagtctatagaaacacaactgacctttgtatgttttttagttctaacagtttgtgtgtatgtgtgtgtgtgtgtgtgtgtgtgtgtgtgtgtgtgtgtgtagaggctttagggttttttatatataagatcatgtcatctgcaaataggaacatttggcttacttttatttatttaatttttctttcctaattactctggctaggac

SEQ ID NO: 3026 - DNA, 332 bp, Homo sapiens
  AC010105.10_180260
  Located on chromosome 2
  Distance between a terminus base of telomere on chromosomal short arm and 5'-terminus of this base sequence : 83614159
  Distance between 3'-terminus of neighbour sequence of sequence listing upward to telomere on chrosomal short arm and 5'-terminus of this base sequence : 34971
ttcagcatttctactctgctacattatgtacagaagtagtggttgaaccagctcaagtgactagcagagaagatccatcctaagcagtgagtatattgtcattaatgttgtcagcacacacatacacacacacacacacacagagagagagagagagagagagagagagactcgcactgtggtaaaattctgaatagtttctcctaatcaatattctgtggttctggctaaagacataattgaaataaaaagacacttgttgaaatacatccttactaacatctcgaaaatgttcagtgcctgggtaaatatagcaggagttgatgtacatc

SEQ ID NO: 3027 - DNA, 189 bp, Homo sapiens
  D2S289
  Located on chromosome 2
  Distance between a terminus base of telomere on chromosomal short arm and 5'-terminus of this base sequence : 83633053
  Distance between 3'-terminus of neighbour sequence of sequence listing upward to telomere on chrosomal short arm and 5'-terminus of this base sequence : 18562
cctaaggctgtctctgtactttgaattctatgtaacaaactggaacctagtgttgtacataaacaaactgaaacaatttaggagtgtgtgtgtgtgtgtgtgtgtgtgtgtgtgtgtgtgcttttgtgtatgtgtatagtaacaaatagccaggtttcagccaattataaacagcccgatcagtttcag

SEQ ID NO: 3028 - DNA, 277 bp, Homo sapiens
  chr2.fa.O7frz.86144540
  Located on chromosome 2
  Distance between a terminus base of telomere on chromosomal short arm and 5'-terminus of this base sequence : 83734938
  Distance between 3'-terminus of neighbour sequence of sequence listing upward to telomere on chrosomal short arm and 5'-terminus of this base sequence : 101696
attgctgtcgtatcataattctattttttccttctttccttccttccttccttcttcctccctccctccctcctttccttccttccttctctccctctctgtctctttttctttctttctttctttctttttttttcttctatactgttttccacagtggttgcaccatgttacatcctcaccaaaagtgtcagtgttccagtatcttcacatcttcaccaacacttttttttttaataatagccatactaccaagtgtaaggtgacatctcactgt

SEQ ID NO: 3029 - DNA, 363 bp, Homo sapiens
  AC069095.2_57411
  Located on chromosome 2
  Distance between a terminus base of telomere on chromosomal short arm and 5'-terminus of this base sequence : 83744878
  Distance between 3'-terminus of neighbour sequence of sequence listing upward to telomere on chrosomal short arm and 5'-terminus of this base sequence : 9663
ctatgaagataactcttgttccagaagaatataatagaaataaaagtaagaataacaccacacacacacacacacacacacacacacacacacacacacacagaggagttaatttgggtggcctatgtgttggcatataaacttcttgatcttgtcaaaaacagtttcgtatagaaacactgttgtatttgaacttgaacattcatctcacaaagaggcaaaaaaccctgctggcaagtaccataatatccttaaaatatatggattaaagtaaatgtggtgaactgatacttattatggtttggtgagtttgaaaatttgtttttcaaataaaaatttcttaactgtattcatctatggctg

SEQ ID NO: 3030 - DNA, 153 bp, Homo sapiens
  G08132
  Located on chromosome 2
  Distance between a terminus base of telomere on chromosomal short arm and 5'-terminus of this base sequence : 83835551
  Distance between 3'-terminus of neighbour sequence of sequence listing upward to telomere on chrosomal short arm and 5'-terminus of this base sequence : 90310
tcacttagcaagtaagatacagccatactaaatgatatatatgtatacacgcacacatagatgatagatagatgatagatgatagatagatagatagatagatagatagatagatagatagagatatatctgaggttattgtgattctagttt

SEQ ID NO: 3031 - DNA, 114 bp, Homo sapiens
  D2S1396
  Located on chromosome 2
  Distance between a terminus base of telomere on chromosomal short arm and 5'-terminus of this base sequence : 83888368
  Distance between 3'-terminus of neighbour sequence of sequence listing upward to telomere on chrosomal short arm and 5'-terminus of this base sequence : 52664
agtaggtgggactgcagttgcatgccatcacagatggattatctatctatctatctatctatctatctatctatttatttatttttgtagaaacagggtcttactatgttgccc

SEQ ID NO: 3032 - DNA, 353 bp, Homo sapiens
  chr2.fa.O7frz.86534497
  Located on chromosome 2
  Distance between a terminus base of telomere on chromosomal short arm and 5'-terminus of this base sequence : 84117480
  Distance between 3'-terminus of neighbour sequence of sequence listing upward to telomere on chrosomal short arm and 5'-terminus of this base sequence : 228998
ttgttcaccggattagttaaccaagccatttgaaaatacagtaaagagagaacatttgctgatgtgttaatattgttgagaatcaactttcctacagcactgtgcaaagtagtggatagcgtggggtgtgtgtgtgtgtgtgtgtgtgtgtgtgcatgttgtactgaaatgtgagggagaattctttaaagggatatgatacttacaattaatttttagaaagtaagtttgtttaatcatggctttcaaaaatagaagaatatgcactccattcttgaatctgtcatggagcttccatgtttgagtggctgaaaaataaactttctcaattctcttcatagaaggaaccagac

SEQ ID NO: 3033 - DNA, 314 bp, Homo sapiens
  AC010903.7_25438
  Located on chromosome 2
  Distance between a terminus base of telomere on chromosomal short arm and 5'-terminus of this base sequence : 84364362
  Distance between 3'-terminus of neighbour sequence of sequence listing upward to telomere on chrosomal short arm and 5'-terminus of this base sequence : 246529
ggtggactttctatctcttactagtaactacatagcattaacagaatatatttgttgtaaaatgatataatgatataaatctggacaatacctccacctctctaccacacacacacacacacacacacacacacacacacacacattggtatataatttatcagtacctttagctacatatacaaaccctcaagagtaatacacatttttttcagtgaaataaggatcgtggaagtaagcaattgagtgctggtgcagtggttctaattttctcacagtcattcttagcctgcttcacttacagtttcaaggtg

SEQ ID NO: 3034 - DNA, 265 bp, Homo sapiens
  Z67578
  Located on chromosome 2
  Distance between a terminus base of telomere on chromosomal short arm and 5'-terminus of this base sequence : 84395130
  Distance between 3'-terminus of neighbour sequence of sequence listing upward to telomere on chrosomal short arm and 5'-terminus of this base sequence : 30454
ttggttatctcctattgtctagcgttatttttttttaatgttgaagaatgttaaaagtaaattaaacacacacacacacacacacacacacacacacaaagtaaattaaacacatcataacatccaccactacaagcttcatgatgtgtcctaaacaataaactttccatatatggctaaatgtgatgtgctcacacttaacaagagtaattctacagtatcacccaatgggcatcccatacccaagtttacctagtttgaaatt

SEQ ID NO: 3035 - DNA, 471 bp, Homo sapiens
  AC010903.7_131686
  Located on chromosome 2
  Distance between a terminus base of telomere on chromosomal short arm and 5'-terminus of this base sequence : 84429882
  Distance between 3'-terminus of neighbour sequence of sequence listing upward to telomere on chrosomal short arm and 5'-terminus of this base sequence : 34487
tggatttatctttgactgaattacttccctttttttttatctccagtcaccaagttccccccaccccatttttcacttctatcatctgttcaaaatctggactaatcactgcattcttgtcaatttcatgacttcgcagctagtctgcgtgcttttccattccaatctgtacaccataatctttctgttctgacctctaaaacccctatttccttagttacttcttttcctcaaaactacagtatcccgatgatacacgaaaaaatttcaaattcttccaggtctcagaaaaatttaatctaattatgataaagtcactagatttgattaccaattttcaggaaacacaggaatagacgaacatgttacacacacacacacacacacacacacacacacacacacacacacacacagagtcatgaagtggcagtaggcaaagaccagactgagaaactctacaggacaaac

SEQ ID NO: 3036 - DNA, 479 bp, Homo sapiens
  AC010744.4_172156
  Located on chromosome 2
  Distance between a terminus base of telomere on chromosomal short arm and 5'-terminus of this base sequence : 84587597
  Distance between 3'-terminus of neighbour sequence of sequence listing upward to telomere on chrosomal short arm and 5'-terminus of this base sequence : 157244
ctacagacctacaaccaattgatcttcaacaaagtcagtgcgaaaatgaacaatggggaaaggacaacttattcaataaattgtgggaggaatattggatagccgtatgcagaagaataaaactagatctctatctcttactatatgcaaaaattcactcaaaatggattaaaaaattaaatatgagacctgaaactataaaaattctagaagaaaacctaagaaaaactcttcttgacattggggtaggcaaagaatgtactattaaacccacaaaagcaaataaaacaaaaacaacaaaaccaaataggacttaataaattaatgatcttctgcacagcaaacaaacaaacaaacaaacaaacaaaaaaactatccacaaattacacagacaacctagagaatgggaggaaatatttgcaagttatgcttctgacaaatgagcaatttctagaatctacaaggaactcaaactgctc

SEQ ID NO: 3037 - DNA, 423 bp, Homo sapiens
  AC010744.4_202884
  Located on chromosome 2
  Distance between a terminus base of telomere on chromosomal short arm and 5'-terminus of this base sequence : 84618403
  Distance between 3'-terminus of neighbour sequence of sequence listing upward to telomere on chrosomal short arm and 5'-terminus of this base sequence : 30327
aaatagatgaacgcaaagaatattcctctggtaattttatatatacctatattactgtctatcagttgtgacttttgaagttatggttttcagtgagtgccagattactgtcacaaatatctaatttatcatgaactcttaatattgtctattttgggtcacagtctgaatgtgaatgtgcaacctcatacatcagcagctaactaaggctgtgggaggctctaatgaaaagaagaaactccctttttggcattacagttgaaatacacacacacacacacacacacacacacacacacacacacgctccgcaacttatgatggagttacatcctgataaactcatcataagttgaaaatacatttaatacatctattgtagtaggcatcatacttagagcctagcctaccttaaacatgacc

SEQ ID NO: 3038 - DNA, 273 bp, Homo sapiens
  Z67203
  Located on chromosome 2
  Distance between a terminus base of telomere on chromosomal short arm and 5'-terminus of this base sequence : 84648721
  Distance between 3'-terminus of neighbour sequence of sequence listing upward to telomere on chrosomal short arm and 5'-terminus of this base sequence : 29895
catgtctgggtcatattttgtgtggagaaggaaaaaaaataggcaaatttctcaaactgctcagaacgaagtatactcacatactgacatacctaataatcttttttctccccagcataataatgatgatgatgataatggactggaaaaattaaacatttcaccttcatttctcccctcattttcatctgtcgttcagtacacacaaacacacacacacacacacacacacacacacacacacatcccattcttgctgctatgcgttaagct

SEQ ID NO: 3039 - DNA, 400 bp, Homo sapiens
  AC010744.4_97739
  Located on chromosome 2
  Distance between a terminus base of telomere on chromosomal short arm and 5'-terminus of this base sequence : 84667136
  Distance between 3'-terminus of neighbour sequence of sequence listing upward to telomere on chrosomal short arm and 5'-terminus of this base sequence : 18142
cttaaattcacagtggctcacacctgtaatcccagcactttcggaagctgaggcaggcagatcacctgaggtcaggagtttcagaccagcctagccaacatggtgaaactccgtctctactaaaaaaacaaaaaagaaaaagaaaaaagaaaaccccttaaattcaagaccacctactctctctctatacacacacacacacacacacacacaatatatatgcacaagtatatatacacacatacacatcatatgtccatcacaaggcaagacacatatatgtgtgtgtgtatatatatgtatgtatgtgtgtgtatatatatacctatatatgtatatatggttatatatcttacatatctatatatagtatatatatcttaccttgagatggacatat

SEQ ID NO: 3040 - DNA, 452 bp, Homo sapiens
  AC010744.4_107594
  Located on chromosome 2
  Distance between a terminus base of telomere on chromosomal short arm and 5'-terminus of this base sequence : 84676908
  Distance between 3'-terminus of neighbour sequence of sequence listing upward to telomere on chrosomal short arm and 5'-terminus of this base sequence : 9372
cctattgcaatagtctgttcaaccctctttgcaaaaattcttttgaataaagtctctacttatgaaatcccgatttgatttttgtttgatatctcatagactgttaaatatttgggcattttgatttggaatagtttctgaatatcataatggccctattattattaaagcctggtataaaaaggttcttgaagaggagctggaataaagtagacacccactaaaacggtagctatgatgatgaagatgttgatgttgttgatattgctgttgctgctgctgctgctgctgctgatgatgaaggagggagtatcctcttggatctaaatttagagctcagaagtcaggtctgcatgcgatatttgaaagacaaattaggaaagaaaagaaaaactcaactgccacttgagacctccagtgcatgagtaaaagatcaatgattcactattgcc

SEQ ID NO: 3041 - DNA, 194 bp, Homo sapiens
  G08162
  Located on chromosome 2
  Distance between a terminus base of telomere on chromosomal short arm and 5'-terminus of this base sequence : 84678325
  Distance between 3'-terminus of neighbour sequence of sequence listing upward to telomere on chrosomal short arm and 5'-terminus of this base sequence : 965
agtggagaacacaagaacactgactaatacactataccacattattaatgaaaataagagattggttaatctatcatctatctatctatagatcctatctatctatctatctatctatctatctatctatcatctatcaagagacagatacagagacaaagacagaaagaggagggagatttactatgaagaag

SEQ ID NO: 3042 - DNA, 360 bp, Homo sapiens
  chr2.fa.O7frz.87368106
  Located on chromosome 2
  Distance between a terminus base of telomere on chromosomal short arm and 5'-terminus of this base sequence : 84740435
  Distance between 3'-terminus of neighbour sequence of sequence listing upward to telomere on chrosomal short arm and 5'-terminus of this base sequence : 61916
tgtagcagttctactcttcagaagcatcgatttgaacaattatatagttttttactttacataaaacacagaaagaagttttgatgaataatgattaatatattacaaaatattaactaataaaatacccacactatgataggggcatgtaaaatgaatcaggagccagctaaaagagttccccctagccaaagctggaacaattttaacatcaaaatataacaggtagtattggattataatgtgatgtgtaaaataaatatgaatcaattctgattatgtgtgtggacacacacacacacacacacactcttggcttctctccatagacctcagtggttcatgagaacagttagcaga

SEQ ID NO: 3043 - DNA, 438 bp, Homo sapiens
  chr2.fa.O7frz.87466659
  Located on chromosome 2
  Distance between a terminus base of telomere on chromosomal short arm and 5'-terminus of this base sequence : 84897680
  Distance between 3'-terminus of neighbour sequence of sequence listing upward to telomere on chrosomal short arm and 5'-terminus of this base sequence : 156885
gcttagctatgactgcagttagttttctctagacttcaaagtaggactagccaatacattttctatttggctcaagctgttttgtgatgaattacaataaattgcagccaaagattcttgactaccatgttacctcttgtttcttatatcacagactccaaatttatttttaaatcattctgaatatacacagaagatgattctagttacactctttcttctagagaattttttaaaaatagataatcgttttaattcatttttagaactcttttctgtgcagaaatgcagatttgttttcgtgtgtgtgtgtgtgtgtgtgtgtgtgtgtgtgtgtgtgtgttttctggtatacttcttcccttcatctcttgctctcctgcctttctactctctcttaactctctcaaattatccttaattggcataaacctttct

SEQ ID NO: 3044 - DNA, 176 bp, Homo sapiens
  HUMUT2346
  Located on chromosome 2
  Distance between a terminus base of telomere on chromosomal short arm and 5'-terminus of this base sequence : 84991543
  Distance between 3'-terminus of neighbour sequence of sequence listing upward to telomere on chrosomal short arm and 5'-terminus of this base sequence : 93425
caagattgcaccactgcactccagtctggcaacagtgcatctcgaaagaaagaaagagagagaagaaaggaaggaaggaaggaaggaaggaaggaaggaaggaaggaaggaaggaaggaaggaaagagaaagaaagaaaagaaattcagtcggtagtcagataaggaggcaaagac

SEQ ID NO: 3045 - DNA, 287 bp, Homo sapiens
  chr2.fa.O7frz.87869353
  Located on chromosome 2
  Distance between a terminus base of telomere on chromosomal short arm and 5'-terminus of this base sequence : 85218223
  Distance between 3'-terminus of neighbour sequence of sequence listing upward to telomere on chrosomal short arm and 5'-terminus of this base sequence : 226504
tcttacaaagaacatctgagctagaacacaaagatctttcaaagtttttagataccagttcactttttgtcacatgtatgcccttggaaaaaaaaatatatatatatacacacacacacacacacacacacacatacacacatcaaacaagacaaaagatcatgaagaaaaagcgagatgcctccttcactcttccccaggggaatacaattccacaaaggaaaacacacataaacctgttcccttgtacccttttcttgatctgtagaagttactcatacctagca

SEQ ID NO: 3046 - DNA, 477 bp, Homo sapiens
  chr2.fa.O7frz.88008891
  Located on chromosome 2
  Distance between a terminus base of telomere on chromosomal short arm and 5'-terminus of this base sequence : 85374674
  Distance between 3'-terminus of neighbour sequence of sequence listing upward to telomere on chrosomal short arm and 5'-terminus of this base sequence : 156164
caataaatggtgagcatttaacagccagtgcgagaaactcattctcttttccctctgacgtaacaactggcagcatttaagatgttgtctcttctatcagcatggatccaaaagtcaggaaatgttgaagcagaagcctcagccgaaccaaaatggacagctagtatgagcaataaaaagcccttagctgtaataaatcactaagatctgagagttgtttgtcaccaatgtgtgatgtatcctatcctgactgatacagaattatctgcttctcccaacatttgctcctgagtcagttctcaggtgttttggtggaataaaagaacttctcagatccatcccctataccacatacgcacacgaatacacacacacacacacacacacacacgcacacacacaacacatgggccagattccttatgagctagtgcctcttctgcacatcttccttactgtgatggttaatactgagtg

SEQ ID NO: 3047 - DNA, 436 bp, Homo sapiens
  AC019281.4_148070
  Located on chromosome 2
  Distance between a terminus base of telomere on chromosomal short arm and 5'-terminus of this base sequence : 85588151
  Distance between 3'-terminus of neighbour sequence of sequence listing upward to telomere on chrosomal short arm and 5'-terminus of this base sequence : 213000
acaaggtcaggagttcaagaccagcctggccaacttggtgaaaccccgtctctactaaaaatacaaaaaaaatatattagccgggtgtggcggcaggtgcctgtaatcccggctactcgggaagctgaggcagagagaactgtttgaaccccgggaagcggaggttgcagtgagccaagatcacactactgcactccagcctgggtgacagaacaagactctgtctccaagaaaaacaaacaaacaaacaaacaaacaaaaagaacatattaaaacatacacacacataaatacacctccatttctcccactctcctcatccttcacactggaacaataataagcctccaaaaccatattgaaatcaaatagtagatttattggctgtctctgtaatacaatgtggtgaaaacatcttaattcaggacatcttcca

SEQ ID NO: 3048 - DNA, 405 bp, Homo sapiens
  AC021560.2_121014
  Located on chromosome 2
  Distance between a terminus base of telomere on chromosomal short arm and 5'-terminus of this base sequence : 85679702
  Distance between 3'-terminus of neighbour sequence of sequence listing upward to telomere on chrosomal short arm and 5'-terminus of this base sequence : 91115
gtaagtggtcagttgataatgaagataacatcttgccacattaaaaaataagcttggagagatttgatgagtagtgtttcatatagtaatatctttgtaaaactatgtctgtgtcttccaatcctcccacccccacttcaccacagtcacacacacacacacacacacacacacacacacttcttagcttttggaatgctttcagctgcacatggtaacagttgtgtacaatccaccttaatctaaaaaagggagtctaggattgaggagcaatagatttgtctccattgcataaactttgaagggaacagattaaaattttcactgcacatctgaaatgaaatctattctgaggatgtgtctaacattgcttgttattataactttatgcttcgatgtactgag

SEQ ID NO: 3049 - DNA, 204 bp, Homo sapiens
  G08177
  Located on chromosome 2
  Distance between a terminus base of telomere on chromosomal short arm and 5'-terminus of this base sequence : 85863020
  Distance between 3'-terminus of neighbour sequence of sequence listing upward to telomere on chrosomal short arm and 5'-terminus of this base sequence : 182913
tttctctcatgagttacagtgaccatgtgatgttttcataatcaaaaaataataaagccactataattttaaaatatttgaacattgttttcttcaattatcaacaatataaataaggtagatagatagatagatagatagatagatagatagatagatagatagatagatagatagatagataaatttcccagagaaggaagg

SEQ ID NO: 3050 - DNA, 137 bp, Homo sapiens
  D2S394
  Located on chromosome 2
  Distance between a terminus base of telomere on chromosomal short arm and 5'-terminus of this base sequence : 85890549
  Distance between 3'-terminus of neighbour sequence of sequence listing upward to telomere on chrosomal short arm and 5'-terminus of this base sequence : 27325
gctactttcattttgtgtcttaactgttatctgtacctctaacacacacacacacacacacacacacacagacacacacacacaaacacacacaccttcccatcctctggcctcccactgtagttatatcctgatta

SEQ ID NO: 3051 - DNA, 179 bp, Homo sapiens
  D2S2371
  Located on chromosome 2
  Distance between a terminus base of telomere on chromosomal short arm and 5'-terminus of this base sequence : 85932390
  Distance between 3'-terminus of neighbour sequence of sequence listing upward to telomere on chrosomal short arm and 5'-terminus of this base sequence : 41704
caggcatgtgaacaccatcttttcccaagttggccacagaagggtgtgatccaaggccatggccctagaccaggttgggacacctccctgcccaacagcattacatacacacacacacatacacacacacacacacacacacacacacacacagaataaggcttgtttggacagaacgg

SEQ ID NO: 3052 - DNA, 341 bp, Homo sapiens
  AC010087.3_78614
  Located on chromosome 2
  Distance between a terminus base of telomere on chromosomal short arm and 5'-terminus of this base sequence : 85978685
  Distance between 3'-terminus of neighbour sequence of sequence listing upward to telomere on chrosomal short arm and 5'-terminus of this base sequence : 46116
tttctatgatctcacttaagcaacaaggacctacctctcctgtcccagggccatagatcacatagctcacactggctgggaagatgaaaatacccatggggaacatgctttaagggaagaaacaaaatgcaatggtttaatgtttgagaaaaaaaagtgtatatatatgtgtgtgtgtgtgtgtgtgtgtgtgtgtgtgtgtgtgtatgccctgatacactgatacacatgaatttaaacataattttctgtgattgcttctatataaacacagttgaatcacaaaagcattctaaattatagaaacatcacatttaaatcctatgtatctggcttaaaca

SEQ ID NO: 3053 - DNA, 164 bp, Homo sapiens
  D2S1387
  Located on chromosome 2
  Distance between a terminus base of telomere on chromosomal short arm and 5'-terminus of this base sequence : 86019017
  Distance between 3'-terminus of neighbour sequence of sequence listing upward to telomere on chrosomal short arm and 5'-terminus of this base sequence : 39991
tctttccatggatgctgtctgcacataaaaatgatagatagatagatagatagatagatagatagatagatagatagatagacagacagacagacagacagacagacagacagacagatagatagtctccactttcgttttgctgctttggccaataaaactca

SEQ ID NO: 3054 - DNA, 260 bp, Homo sapiens
  D2S388
  Located on chromosome 2
  Distance between a terminus base of telomere on chromosomal short arm and 5'-terminus of this base sequence : 86100391
  Distance between 3'-terminus of neighbour sequence of sequence listing upward to telomere on chrosomal short arm and 5'-terminus of this base sequence : 81210
ctaaaaaaatgtgttaagcaaaaatcagaaaatgaaaataaaaataacaaggccttgaggaaaagcatagttgggatgaacatttaaacctataccccagtaataatcctcataatgatactgacaaagttgaaaagatatgttgaattcctaataaatatcccagtaaatataggattacacacacacacacacacacacacacacacacacttctgcctgtgagaaggtagtgaataggaggagtaatgcagggccaa

SEQ ID NO: 3055 - DNA, 420 bp, Homo sapiens
  chr2.fa.O7frz.88760520
  Located on chromosome 2
  Distance between a terminus base of telomere on chromosomal short arm and 5'-terminus of this base sequence : 86164192
  Distance between 3'-terminus of neighbour sequence of sequence listing upward to telomere on chrosomal short arm and 5'-terminus of this base sequence : 63541
agcactacgtaagcgtcacacctggtccaaccaatctgtgggccctacgcaaatcagacaccacctctgcaagcctgcggagcactcccattctgggccagatttcccatttggaattccctctctctcgcaagatagagagctgttctcctttctctttcttttgcctagtaaacctcggctcctaaactcactcattgtgtgtgtccgtgtccttggcatgagacgaggaaccccaagtatttaccccagacaaaaacaacaacggcacttcaccaatttcttaaaatctctttcactccgtgtgtgtgtgtgtgtgtgtgtgtgtgtgtgtgtgtatctcctattggctctgtttctctggaaaaccctgatagaaccaacgaataatttggggactcaggaaccactttagctatt

SEQ ID NO: 3056 - DNA, 398 bp, Homo sapiens
  AC011236.5_94269
  Located on chromosome 2
  Distance between a terminus base of telomere on chromosomal short arm and 5'-terminus of this base sequence : 86389192
  Distance between 3'-terminus of neighbour sequence of sequence listing upward to telomere on chrosomal short arm and 5'-terminus of this base sequence : 224580
atcatgctaagtgaaataagctagtcacaggacaaatattgtatgattctgcctgtatgtgggatcgaaaatagtcaaacttaaagaacgctggttgccagggaatgggggaagagggaaatgtgttgttcggtgggtgtaaagttacagatatgagatgagtaagctctgcagctccgctgtacaacatagtgcccatggtttagagttgggcacttacaactttattaagagggtcaatctcatgttaagtgttcttaccaaacacacacacacacacacacacacacacacaaagggacacaaggaagcttttggaggtgatgatgtgtttattaccctgaccatggtgatggtattatggatgtatgcacgtgttcaaactcatgaaattatct

SEQ ID NO: 3057 - DNA, 254 bp, Homo sapiens
  D2S2333
  Located on chromosome 2
  Distance between a terminus base of telomere on chromosomal short arm and 5'-terminus of this base sequence : 86482313
  Distance between 3'-terminus of neighbour sequence of sequence listing upward to telomere on chrosomal short arm and 5'-terminus of this base sequence : 92723
tgcagtcacctgtgtagaatttgcacatatactcaagtgttatttgttttcaattacttcctcaattattgctggtgtgtgtgtgtgtgtgtgtgtgtgtgtgtgtgtgtgtgtgtgtgtgtggtatttcatagccaaagctataaaatgtatttccaataatattagtagaattttttcagcccctaaaacccaccataaaagttaactataataacaaggcccgtaggcctgtacacaagggcatggtttct

SEQ ID NO: 3058 - DNA, 467 bp, Homo sapiens
  AC062037.2_166971
  Located on chromosome 2
  Distance between a terminus base of telomere on chromosomal short arm and 5'-terminus of this base sequence : 86503715
  Distance between 3'-terminus of neighbour sequence of sequence listing upward to telomere on chrosomal short arm and 5'-terminus of this base sequence : 21148
taataggcgtcatttatcaaatgtctcccatgtgcgaggcactgtgttcaatatgtgacaccgtccctagtccgaacaacctgtaccgtgagtgataataaccttgccttacagatgctgaaactgggactcagagttgttaatcactcattcagggtcacacagcctatgttggcagagtaagagcctgaacccatgaatgcagggctccggagcccagaagggcccttcccagtgctcctgactgctgctccactcaactcattctttctaggctcttggcaaggactgtgccatgccagagagagagagagattgtgtgtgtgtgtgtgtgtgtgtgtgtgtgtgtgtgtgtgtgtgtgtgttggggaagtactgtttggtttgggttttttgcactgacatgagaaagaatggggtgctgggtaatctttttcagggttgagagacgctataatgaaggaaag

SEQ ID NO: 3059 - DNA, 427 bp, Homo sapiens
  AC062037.2_32590
  Located on chromosome 2
  Distance between a terminus base of telomere on chromosomal short arm and 5'-terminus of this base sequence : 86612554
  Distance between 3'-terminus of neighbour sequence of sequence listing upward to telomere on chrosomal short arm and 5'-terminus of this base sequence : 108372
cttgctccagttgagatgtgaagcagccagtttatgctataaaacaggctaaagtatgtgctcccaggggagagggctgggagaactcccagagaaggcggaggccacttaatgtcctggaagtttccttggacagctggggcttgatacgggcctggaaggataagggggcttgtgtgtgtgtgtgtgtgtgtgtgtgtgtgtgtgtgtgtgtgacagattcttcctctgttgcccaggctagagtgcagtagtgccatctcggctcactgcaacctctgcctcccgggttccagcaattctcctgcctcagcctcctaagtagctgggactacaggcacgcaccaccatgcctggctaattttgtatttttagcagagatggagtttcaccatgttggccaggctggtcttgaactcctaatctc

SEQ ID NO: 3060 - DNA, 326 bp, Homo sapiens
  AC062037.2_99912
  Located on chromosome 2
  Distance between a terminus base of telomere on chromosomal short arm and 5'-terminus of this base sequence : 86675518
  Distance between 3'-terminus of neighbour sequence of sequence listing upward to telomere on chrosomal short arm and 5'-terminus of this base sequence : 62537
gcacctgtaatcctagctacttgggaggctgaggcatgagaatcgcttgaacctgggaggcagaggttgcagtgagctgagatcatgccactgcactccagcctgggcaacaagagtgaaactccatctcaaaaatatatatatatatatatacacacacacacacacacacacatatatacgcatatatatgtgtgtatatatattctttcaagtcacttgattttgctgggcctcagtttactcatctttaaaatggggtgagacgggcagggtggttggcctcaaggatccctaagggcctttccaactccagtattcctact

SEQ ID NO: 3061 - DNA, 380 bp, Homo sapiens
  AC016753.6_125721
  Located on chromosome 2
  Distance between a terminus base of telomere on chromosomal short arm and 5'-terminus of this base sequence : 86685394
  Distance between 3'-terminus of neighbour sequence of sequence listing upward to telomere on chrosomal short arm and 5'-terminus of this base sequence : 9550
gaggtcaggagttaaagaccagcctggccaacatggtgaaaccgcatctctactgaaaatacaaaatttagccgggtgtggtggtgtgcacctgtaatcccagctacttgggaggctgaggcaggagaattacttgaacccgggaggcagaggttacagtgaaccaagatcacgccattgcactccagcctgggcaacagaatgagactctgtctcaaataaataaataaataaataaataaataaataaataaataaataagaaaaaatgtaaggaggcagctttagattaaacttgatttaacatttcctagatactaaaactgttgaatggatgaggcttaaagaggctagattagtttcctaaggccacataattt

SEQ ID NO: 3062 - DNA, 322 bp, Homo sapiens
  AC012454.4_25228
  Located on chromosome 2
  Distance between a terminus base of telomere on chromosomal short arm and 5'-terminus of this base sequence : 86846496
  Distance between 3'-terminus of neighbour sequence of sequence listing upward to telomere on chrosomal short arm and 5'-terminus of this base sequence : 160722
gaatgcctttattctccagatattgggatattaggacactcccaagtctggatctgtttagtaaacattatctctctgttcccttaactgtagacatctctaggctaggaatacctaacttcctgggaatgcagcctgtcaaggcccagcctcattttcctaaccctcactcaagatggagttggtctggttgaaacgcctctgacatataccgcaagtcagaattcagtaaattgcacacagtgtggtgtggtgtggtgtggtgtggtgtggtgtggtgtggtgtggtgtggtgtgggtatgacagagtttcactctggtt

SEQ ID NO: 3063 - DNA, 445 bp, Homo sapiens
  AC012454.4_160758
  Located on chromosome 2
  Distance between a terminus base of telomere on chromosomal short arm and 5'-terminus of this base sequence : 86917800
  Distance between 3'-terminus of neighbour sequence of sequence listing upward to telomere on chrosomal short arm and 5'-terminus of this base sequence : 70982
ttaaaccaataaactagcgatgagaaaactattgacaaagtacaaccagagaactcatctcagtgctggaatctgtaccttaagaaaaaggatgattacgggccgggcgcggtggctcacgcctgtaatcccagcactttgggaggccaaggcgggaggatcacgaggtcaggagatcaagaccttcctggctaacacggtgaaaccctgtctccactaaaaatacaaaaaattaggtgggcgtggtggcgggcgcctgtagtcccagctactcgggaggctgaggcaggagaatggcgtgaacccgggaggcggagattgcaccactgcactccagcctgggcgacagagcgagactccgtctcaaataaaaaacaaaacaaaacaaaacaaaacaaagaaaaaggatgattacttgaagtggtacaaatgacaaccaggtacc

SEQ ID NO: 3064 - DNA, 376 bp, Homo sapiens
  AC012454.4_17867
  Located on chromosome 2
  Distance between a terminus base of telomere on chromosomal short arm and 5'-terminus of this base sequence : 86995476
  Distance between 3'-terminus of neighbour sequence of sequence listing upward to telomere on chrosomal short arm and 5'-terminus of this base sequence : 77231
cactgaacttagattcagactgactggatggtgggcataagccaaacctgtttcttcccctgcaaaatgggaatgtgggtatatctcagagcagatgagctgacgtgtgtgtgtgtgtgtgtgtgtgtgtgtgtgtgtgtaaacagcaggtgcgtagagcagatcataagattagggtggagggctcagatataccatagacaggccgtctcccatgcctgccaggctgggcactgcgcccctgcagcccctcctgacgccttctcccctcaggtgccgtgctactcatatgggcagaagctgtccaaactggccatcctgaggatcgcctgtaactacatcctgtccctggcgcggctggctgaccttgactaca

SEQ ID NO: 3065 - DNA, 205 bp, Homo sapiens
  D2S2232
  Located on chromosome 2
  Distance between a terminus base of telomere on chromosomal short arm and 5'-terminus of this base sequence : 86995481
  Distance between 3'-terminus of neighbour sequence of sequence listing upward to telomere on chrosomal short arm and 5'-terminus of this base sequence : -371
aacttagattcagactgactggatggtgggcataagccaaacctgtttcttcccctgcaaaatgggaatgtgggtatatctcagagcagatgagctgacgtgtgtgtgtgtgtgtgtgtgtgtgtgtgtgtgtgtaaacagcaggtgcgtagagcagatcataagattagggtggagggctcagatataccatagacaggccgtc

SEQ ID NO: 3066 - DNA, 452 bp, Homo sapiens
  AC012511.5_156576
  Located on chromosome 2
  Distance between a terminus base of telomere on chromosomal short arm and 5'-terminus of this base sequence : 87110925
  Distance between 3'-terminus of neighbour sequence of sequence listing upward to telomere on chrosomal short arm and 5'-terminus of this base sequence : 115239
gttgctcaaattgttccagctttggcctttaggagctctttcaattggctcctgtgctcctttgacctcttcccatcaatgtgagttggtgtgtgtgtgtgtgtgtgtgtgtgtgtgtgtataaaacacttccttactttctggcactacatgatgctccaggctcatctcatcttgtacatttcctgcctgtcctaaaatcaatctttcctttatgagaaaaaatagcgaacatctgcctctgactagtcacatagttggcccttgctgtaaagagggaggatcacttgagtccaggagttccaaaccagcctgggttacatggtgaaaccactgctctgcacaaaaacttatatataaaaaacaaaattagccaggcttggtggcatgcgcctgtagtcccagctacccaggaggctgaggtgaaaggatcacttgatctcagagttcaa

SEQ ID NO: 3067 - DNA, 462 bp, Homo sapiens
  AC012511.5_111451
  Located on chromosome 2
  Distance between a terminus base of telomere on chromosomal short arm and 5'-terminus of this base sequence : 87178788
  Distance between 3'-terminus of neighbour sequence of sequence listing upward to telomere on chrosomal short arm and 5'-terminus of this base sequence : 67411
accttaagcaagtatcaggaagaacttcacccaggaggtgccttcacagcacaatctgcctatcttcagatggggagtcctgacctggccttgtgaatgctgtgggaccccaggcctccttttgcccatatagaaagtccaagtctttgctgcttttgaggttaagcatcagttggtttcaactatctttggctacacacacacacacacacacacacatacacacacagagctttgaggattcataatacttttgctcattcaatcttgagttgcaattgctttgaccatagcaacagagtcctccataacaaaggcctttacaacattttaacagtgaatataatgcaattaattttttgcagcaattaattacacatgcgttaagaaaccataaacttgtagatttctgtctctccctgggaaaattctagaatggttcattaaacattaggttgtgac

SEQ ID NO: 3068 - DNA, 236 bp, Homo sapiens
  chr2.fa.O7frz.90167048
  Located on chromosome 2
  Distance between a terminus base of telomere on chromosomal short arm and 5'-terminus of this base sequence : 87471794
  Distance between 3'-terminus of neighbour sequence of sequence listing upward to telomere on chrosomal short arm and 5'-terminus of this base sequence : 292544
atttattcaatccattgtaatgacatttaagatgagtgaaaattaacaagtaatgcaagtaaatatattttttactggttctggttgtagaggaaaaaacattgctgtatattatgttctattaagaagttacactattaaaatgtttctgagatttatattttagatagatagatagatagatagatagatagatagatagatagataggtttctaacttgttccagaaaggatc

SEQ ID NO: 3069 - DNA, 378 bp, Homo sapiens
  AC068288.3_86066
  Located on chromosome 2
  Distance between a terminus base of telomere on chromosomal short arm and 5'-terminus of this base sequence : 87563657
  Distance between 3'-terminus of neighbour sequence of sequence listing upward to telomere on chrosomal short arm and 5'-terminus of this base sequence : 91627
gtgtccaacatggattatgtaggaaggacaaggtcctggggtcagatttaagttggtttaaggaaaacaaatgtagcaagagtgagattcataccaattatatttatttgattgtacagctccctctttcctacctcaccccccttaaagtagattatgtataagctatgttaaaagtagatatgtataagctattttacacacacacacacacacacacacacacacacacacacacttatttttagaacagttttgggatcacatcaaaattgagcagaaagtagagagatttcttatatgtcccctgcgccacatgtgcacagcctccccagctattgacatcctgccccagagtggtacatttgttacaatcca

SEQ ID NO: 3070 - DNA, 450 bp, Homo sapiens
  AC068288.3_48784
  Located on chromosome 2
  Distance between a terminus base of telomere on chromosomal short arm and 5'-terminus of this base sequence : 87578404
  Distance between 3'-terminus of neighbour sequence of sequence listing upward to telomere on chrosomal short arm and 5'-terminus of this base sequence : 14369
atagcttagcctagtctacctcacacgcgctcagaacacttactctagcctacagttgggcaaaatgatctaacacaagcttattttatactaaagtgttgactatctcatgtaatttattgaatactatactgaatgtgaaaaacagaaaatggttgtatgagtactcaaagtataatttctactgaatgcctattgcctttgcaccactgtaaagtaaagaaattgtaaagtcgagccattataagtcaggcacagtctctctctctctctctctctctctctctctccctctgtctgtctctgtctctctctctctctgtatacatatatgtggaaatttattataataattggctcacatgattatggaggccaagaagtcccacaatttgttgtttgcatcgtggagaaccaggaaaaccagtgttgtaattcagtctgagtcca

SEQ ID NO: 3071 - DNA, 461 bp, Homo sapiens
  chr2.fa.O7frz.90650245
  Located on chromosome 2
  Distance between a terminus base of telomere on chromosomal short arm and 5'-terminus of this base sequence : 87703758
  Distance between 3'-terminus of neighbour sequence of sequence listing upward to telomere on chrosomal short arm and 5'-terminus of this base sequence : 124904
tacaactgtcctaaacctttacacacagcaaaaactgaaaataaccttaatatccatcaaaaggggaacagaaaaataaaatgtgatacatcaatgtaatttcatctagtagttcaaatcaatggactagagcatgctctctctctctctctctctctatatatatatacacatacacatagataattttattgtggttgctgttgttttgttttgtcttgttttatagagacagggtttcattatgtttcccaggctggttttgaactcctggctcaagtgatcctcctgccacagcctcccaaagggctggcattacaggtatgagccactgcaccctgcctacatttatccacatgaacatatttcaaaaacgatgataaatggagcaaaaagacgcagaatggtatctatagtatgataccattcataaaaattttaagattcatgatagtggcttt

SEQ ID NO: 3072 - DNA, 268 bp, Homo sapiens
  G08187
  Located on chromosome 2
  Distance between a terminus base of telomere on chromosomal short arm and 5'-terminus of this base sequence : 87878554
  Distance between 3'-terminus of neighbour sequence of sequence listing upward to telomere on chrosomal short arm and 5'-terminus of this base sequence : 174335
ggtggtgtacacccataatcccaactactcaggaggatgacgcaggagaatcacttgagaggtggaggttacagtgagctgagatggtgccattgcactccagcctgggcaataagagtgagactctgtctcaaaaatatatagatagatagatagatagatagatatagatatagatagatagatagatagatagatagatagatagatataggctttaggtgactttaattgcaaattgttttagctgatttctgtgctgtgtttt

SEQ ID NO: 3073 - DNA, 347 bp, Homo sapiens
  AC064848.2_75950
  Located on chromosome 2
  Distance between a terminus base of telomere on chromosomal short arm and 5'-terminus of this base sequence : 87938038
  Distance between 3'-terminus of neighbour sequence of sequence listing upward to telomere on chrosomal short arm and 5'-terminus of this base sequence : 59216
tacaggaagctaatggtacaaagcatattggaaaagtcctgtcactataaagacgagggtaaagtcacttcaccatcttttcacttatattgcactagaatagaaagatgcttgtggtttagatggaacatttacttctactttggattgagagagagaagtgtgtgtgtgtgtgtgtgtgtgtgtgtgtgtgtgtgtgaatcagtttggctactattcgggccaaattgataatagttgccttattgaaagaagatggtaattacaaggatattgaagaacttcacagccagtaaaagatgcttttatcatgttcagaagttgtgaattgactaaagctatctgag

SEQ ID NO: 3074 - DNA, 177 bp, Homo sapiens
  DISO7_00004355
  Located on chromosome 2
  Distance between a terminus base of telomere on chromosomal short arm and 5'-terminus of this base sequence : 87965044
  Distance between 3'-terminus of neighbour sequence of sequence listing upward to telomere on chrosomal short arm and 5'-terminus of this base sequence : 26659
gagcaggcacttgttagatgctaccacagggatgcctcagccaacgggtggagagaggtttttaacagagagggagagagagagagagtgtgtgtgtgtgtgtgtgtgtgtgtgtgatcatgggctgaaactggatgaggcagtcacttgagctgccagatagccaattgtccctgc

SEQ ID NO: 3075 - DNA, 133 bp, Homo sapiens
  D2S2216
  Located on chromosome 2
  Distance between a terminus base of telomere on chromosomal short arm and 5'-terminus of this base sequence : 88183713
  Distance between 3'-terminus of neighbour sequence of sequence listing upward to telomere on chrosomal short arm and 5'-terminus of this base sequence : 218492
tccctgacaaagtgggcccactgccaggacattaggcccttgatgaatgagtgtgtgtgtgtgtgtgtgtgtgtgtgtgtgtgtattctgagggggtagagttgaatctccgtggctggaaataatttacccc

SEQ ID NO: 3076 - DNA, 181 bp, Homo sapiens
  D2S2181
  Located on chromosome 2
  Distance between a terminus base of telomere on chromosomal short arm and 5'-terminus of this base sequence : 88450990
  Distance between 3'-terminus of neighbour sequence of sequence listing upward to telomere on chrosomal short arm and 5'-terminus of this base sequence : 267144
ccccattaacaaattagtcgtaccacaaactgagagagactggatgggaccaaataccttttgaccactggataatttgataatttggagaagaaacagtacagaacactgctgtgtgtgtgtgtgtgtgtgtgtgtgtgtgtgtgtgttggaggtatgagatagcaggtggtttgggagg

SEQ ID NO: 3077 - DNA, 237 bp, Homo sapiens
  AC012671.4_110855
  Located on chromosome 2
  Distance between a terminus base of telomere on chromosomal short arm and 5'-terminus of this base sequence : 88450999
  Distance between 3'-terminus of neighbour sequence of sequence listing upward to telomere on chrosomal short arm and 5'-terminus of this base sequence : -172
caaattagtcgtaccacaaactgagagagactggatgggaccaaataccttttgaccactggataatttgataatttggagaagaaacagtacagaacactgctgtgtgtgtgtgtgtgtgtgtgtgtgtgtgtgtgtgttggaggtatgagatagcaggtggtttgggaggaggatttgaccccatatgcctgtgccacccaggaatgaaatctttctaatactaagctatgcctg

SEQ ID NO: 3078 - DNA, 416 bp, Homo sapiens
  chr2.fa.O7frz.92413146
  Located on chromosome 2
  Distance between a terminus base of telomere on chromosomal short arm and 5'-terminus of this base sequence : 88501948
  Distance between 3'-terminus of neighbour sequence of sequence listing upward to telomere on chrosomal short arm and 5'-terminus of this base sequence : 50712
aaaggatgccaaatctgtcaagatcaagaaaaagaaggacaggccgggcgtggtggctcatgcctgtaatctgagcactttgggaggctgaggagggtggatcacgaagtcaggagttcaagaccagactggccaatatggtgaaacctcatctctgctaaatatacaaaaattagccgggcatggtggcacatgcctgtagtcccagctactcgggaggctgagtcaggagaattgcttgaactcgggaggcagaggttgcagcgagccgagatcgtaccactgcacttcagcccaggggcagtgttagactccgtctcaataaataaataaataaataaataaataaataaataaataaataaaagaaggacaatgcgaaatttgaagttcaatttagcagatacctgtccacc

SEQ ID NO: 3079 - DNA, 290 bp, Homo sapiens
  AL137070.9_164532
  Located on chromosome 2
  Distance between a terminus base of telomere on chromosomal short arm and 5'-terminus of this base sequence : 91580434
  Distance between 3'-terminus of neighbour sequence of sequence listing upward to telomere on chrosomal short arm and 5'-terminus of this base sequence : 3078070
taagagtctgtgctggagctagagggaactgggctagataatcaggaggacagacagggtgaggggacttcgggctaccttcatgctgtcagagataaagataggagtacaaaggggaatttttgggtgaggtacacgggtgaaatgagttttcagggcctcatcctgtgtgttcaccttctgtgtgtgtgtgtgtgtgtgtgcatgtgtgcatgtatgtgtgtgtgcaggtcctggacagtcgcagcttaagttagcagcaagagggattgaggttaaaggtgtagcac

SEQ ID NO: 3080 - DNA, 247 bp, Homo sapiens
  AL137070.9_118779
  Located on chromosome 2
  Distance between a terminus base of telomere on chromosomal short arm and 5'-terminus of this base sequence : 91626272
  Distance between 3'-terminus of neighbour sequence of sequence listing upward to telomere on chrosomal short arm and 5'-terminus of this base sequence : 45548
aatacaagtagcaaccattaccacaaatgaattctcataagaaacagttattcaagtctttttctctctgtctttgtcaaacgcatgtgcgcgcgcacacacacacacacacacacactttgtttgtatgcctgtggattgtgagagagtgagaatgagcctgtaaatacagaattatatcagaattcttgtagcaaataagctatcaggaaaattgagccaacttagtattggtcttgtgaaggac

SEQ ID NO: 3081 - DNA, 300 bp, Homo sapiens
  AL137070.9_113046
  Located on chromosome 2
  Distance between a terminus base of telomere on chromosomal short arm and 5'-terminus of this base sequence : 91631970
  Distance between 3'-terminus of neighbour sequence of sequence listing upward to telomere on chrosomal short arm and 5'-terminus of this base sequence : 5451
tggagctttaaacaagttacttagtttatatctgtagtttataaatcatgatgtgttaaactttattatgatcttacaatttgaatttaattcttttataatgtctctaggctctctctcctgatgatcgatagatagatagatagatagatacatagatacatagatacatagatacatagatagataggtattttccttttagaaaacctctcgcttttctcatatcccacactcttgacagcattatattcaagagcaagggtgggaaatgtgttgactgccaaggtattagatagc

SEQ ID NO: 3082 - DNA, 234 bp, Homo sapiens
  AL137070.9_96082
  Located on chromosome 2
  Distance between a terminus base of telomere on chromosomal short arm and 5'-terminus of this base sequence : 91649022
  Distance between 3'-terminus of neighbour sequence of sequence listing upward to telomere on chrosomal short arm and 5'-terminus of this base sequence : 16752
actcactttgcctggttgtacattgacgtgtgtgtgtgtgtgtgtgtgtgtgtgtgtgtgtgtgtaactcttatttttatatactatgtttttttgagatggagttttgctcttgttgcccaagctggagtgcaatggctcaatctcggctcactgcaacctccgccacctgggttcaagcgattctcctgcctcagcttcccgagtagctggaattacaggtgctcacctgta

SEQ ID NO: 3083 - DNA, 354 bp, Homo sapiens
  AL137070.9_29552
  Located on chromosome 2
  Distance between a terminus base of telomere on chromosomal short arm and 5'-terminus of this base sequence : 91715436
  Distance between 3'-terminus of neighbour sequence of sequence listing upward to telomere on chrosomal short arm and 5'-terminus of this base sequence : 66180
tagcttagcactcaaatagcttttgaaatctctgtagactcacctcaattgaagagtcctgataatttacagaagtgtgtagtgcactaagagatccctgatgtacgatgtctgcctgtggagtgttttatgtgttgatccactggagtgtgtgtgtgtgtgtgtgtgtgtgtgtgtgtgtctgtgtgtaggtgggtgagtatgggtgggcatggattgtgtgtgtgtgtgtgtgtgtatgtgtttacactgttgtatgtgtctgttggggtgccgccatttgggatttggaagagtgaggaccataaacttgtcaacattcctacatgcctgcttcataacaagtgtactgaa

SEQ ID NO: 3084 - DNA, 242 bp, Homo sapiens
  AC068165.3_41138
  Located on chromosome 2
  Distance between a terminus base of telomere on chromosomal short arm and 5'-terminus of this base sequence : 91853050
  Distance between 3'-terminus of neighbour sequence of sequence listing upward to telomere on chrosomal short arm and 5'-terminus of this base sequence : 137260
aaatacgtaccattgaatactgaggaaaaggtatagccatcatcaccagcagctgagatgccagttgagataccagaaatgccccagcacgtaactcctcttttaattcacacacacacacacacacacacacacacacacacacacactcatggtaaccacttcaggatggacacagaaacagccatattcttttttgggagcacattcccctatgacacttagatcctaatgctgactcc

SEQ ID NO: 3085 - DNA, 110 bp, Homo sapiens
  DISD22_0001717
  Located on chromosome 2
  Distance between a terminus base of telomere on chromosomal short arm and 5'-terminus of this base sequence : 92036607
  Distance between 3'-terminus of neighbour sequence of sequence listing upward to telomere on chrosomal short arm and 5'-terminus of this base sequence : 183315
gttaacacaggatacagagaaagagaagtgtgtgtttgtgtgtgtgtgtgtgtgtgcatttacctatgtgtagccacatcaatttttgtatttgtaagaatgccttgtga

SEQ ID NO: 3086 - DNA, 388 bp, Homo sapiens
  AC009237.2_136136
  Located on chromosome 2
  Distance between a terminus base of telomere on chromosomal short arm and 5'-terminus of this base sequence : 92151735
  Distance between 3'-terminus of neighbour sequence of sequence listing upward to telomere on chrosomal short arm and 5'-terminus of this base sequence : 115018
tttcctctgactcattgctagtaaccaaaaattcaagattatgtaaaataaagttactgttattagacaataaaaattctactgccttcaaatcagaaaatgttatttctgttctcagttcaactcctggtgtgtgtgtgtgtgtgtgtgtgtgtgtgtgtgtgtgtgtgtgtgtgtaattttggccagattttctcatatctcttcaggttttctcattgtatatttgaagatatgaaaagacaaaatttttgcaaatttagctaaatgatcaaattggcttctatctgtgattcaaaaataagaaaatatctcatccaaaaatagagagtttctgtgctgggtatgggacaagagccagtttctgtaaggtttcttgaacaggaac

SEQ ID NO: 3087 - DNA, 174 bp, Homo sapiens
  AC008268.3_71025
  Located on chromosome 2
  Distance between a terminus base of telomere on chromosomal short arm and 5'-terminus of this base sequence : 92253882
  Distance between 3'-terminus of neighbour sequence of sequence listing upward to telomere on chrosomal short arm and 5'-terminus of this base sequence : 101759
agagtctttaccagaaggtgagagtgtgtgtgtgtgtgtgtgtgtgtgtgtgtgtgtgtgtttgtgtatgtgtgtgtgtgtgtgcagctggtgtggagagggagggagaggagcagcagctgacagctcaggaatgcatcagtactcagaagtttctaagaatgattacgtcga

SEQ ID NO: 3088 - DNA, 221 bp, Homo sapiens
  DISD22_0001729
  Located on chromosome 2
  Distance between a terminus base of telomere on chromosomal short arm and 5'-terminus of this base sequence : 92638644
  Distance between 3'-terminus of neighbour sequence of sequence listing upward to telomere on chrosomal short arm and 5'-terminus of this base sequence : 384588
ataacaccctggacctggaaaggcaggccaggggtgaggggcgacccagctgggagagaagagagcccagaggctgggggcttccaggggctccaagctgactgcgcctgaggagtggggctgttgagcaggaagggatgtgtgtgtgtgtgtgtgtgtgtgtgtgtgtgtgtgagagagagagagagagagagattactaatgtgatggaactgtagtcg

SEQ ID NO: 3089 - DNA, 300 bp, Homo sapiens
  AC021188.4_91297
  Located on chromosome 2
  Distance between a terminus base of telomere on chromosomal short arm and 5'-terminus of this base sequence : 92898229
  Distance between 3'-terminus of neighbour sequence of sequence listing upward to telomere on chrosomal short arm and 5'-terminus of this base sequence : 259364
ttgcattactggttctcctactctcatggagtgtattaagactttatactttcctctttattttgcctgtttttccacaagattttaatgatatatatatatatatatacatatatatatatacacatatatatgtatatatatgtgtatatatatatatatatatatatttttttttttttttccctgaattgactgatattacacattctatttgtttttttgtatttttttttagagacagggtcttgctctgttgcccaggccatagtccagtggtgtaattggagctcattgtaa

SEQ ID NO: 3090 - DNA, 208 bp, Homo sapiens
  D2S113
  Located on chromosome 2
  Distance between a terminus base of telomere on chromosomal short arm and 5'-terminus of this base sequence : 93198582
  Distance between 3'-terminus of neighbour sequence of sequence listing upward to telomere on chrosomal short arm and 5'-terminus of this base sequence : 300053
ctgttgttttttaggtgggagaacagtatggtacttatgtttagagaaaaaaagggatcttttttttttttccacagatatatacccatatgtgtgtgtgtgtgtgtgtgtgtgtgtgtgtgtgtatgtgaaaatgctattatatttgggattttcttcaaaacaatctaggggagaaagaaaatgagcagggtgagatgaaacaagc

SEQ ID NO: 3091 - DNA, 110 bp, Homo sapiens
  DISO7_10008979
  Located on chromosome 2
  Distance between a terminus base of telomere on chromosomal short arm and 5'-terminus of this base sequence : 93397545
  Distance between 3'-terminus of neighbour sequence of sequence listing upward to telomere on chrosomal short arm and 5'-terminus of this base sequence : 198755
ttcttccttccctagctatccaacacacacacacacacacacacacacacacgcgcgcgcgcgcgcgcgcccttagttaaaaattgtattggtcattgagtcactagatt

SEQ ID NO: 3092 - DNA, 247 bp, Homo sapiens
  Z67658
  Located on chromosome 2
  Distance between a terminus base of telomere on chromosomal short arm and 5'-terminus of this base sequence : 93479794
  Distance between 3'-terminus of neighbour sequence of sequence listing upward to telomere on chrosomal short arm and 5'-terminus of this base sequence : 82139
tggtgatagcaggcttggtttagaataagacaaaataatttgtataagcagcctaactcaatgccaggtgcagggccggggctcaaccagtatttgttgagtgtgaatctgagggctgaaatctcctaatgggaatatgcatgtgcacacacatacacacaaacacacacacacacacacagagagaaagagacagagagagagagagagagagagagagagagagagaaacatgcccaggacagat

SEQ ID NO: 3093 - DNA, 402 bp, Homo sapiens
  AC018892.3_159523
  Located on chromosome 2
  Distance between a terminus base of telomere on chromosomal short arm and 5'-terminus of this base sequence : 93570258
  Distance between 3'-terminus of neighbour sequence of sequence listing upward to telomere on chrosomal short arm and 5'-terminus of this base sequence : 90217
agtatgccatcacttgcagatgcccacaagagaacttggacatacagaagagggataactgagttgagactggagttgtgcagaatatatatatgtgtgtgtgtgtgtgtgtgtgtgtgtgtgtgtgtatgtgtgtaactacataatatattaatatacgtacagacataattttaaaagagcacaaatggaaacacatacataacacaaatgcagttacattaagagtgggggccagagggtccttttatcacctactgtcagtgaagggatccaaaatggtcacaagagtcttctcctgccagtttccaggccctatcctgacggcaaacaccaggacagtgtctttaatcagagctggcccaaggcccatcaccctctaatgtgaaagctgtctacttt

SEQ ID NO: 3094 - DNA, 125 bp, Homo sapiens
  D2S2175
  Located on chromosome 2
  Distance between a terminus base of telomere on chromosomal short arm and 5'-terminus of this base sequence : 93859405
  Distance between 3'-terminus of neighbour sequence of sequence listing upward to telomere on chrosomal short arm and 5'-terminus of this base sequence : 288745
ctgcttagagttattttgggttttagtttgtgtgtgtgtgtgtgtgtgtgtgtgtgtgtgtatgtgtgtgtattagattgaaacaaagggaactgatacataattgtccaatatctgaggctcat

SEQ ID NO: 3095 - DNA, 416 bp, Homo sapiens
  chr2.fa.O7frz.101909848
  Located on chromosome 2
  Distance between a terminus base of telomere on chromosomal short arm and 5'-terminus of this base sequence : 93988985
  Distance between 3'-terminus of neighbour sequence of sequence listing upward to telomere on chrosomal short arm and 5'-terminus of this base sequence : 129455
gaggacaaggaaagttatgtagaaaagaaagaaggaggccgggcgcggtggctcacgcctggaatcccagcactttgggaggccgaggctggtggatcacctgaggtcaggagtttgagagcagcttggccaacatggtgaaaccccgtctctactaaaaatacaaaaattagctgggtgtggtggtgcacgcctgtagtcccagctattcaggaggctgagacaggagaatcacttgaacccaggaggtggaggttgcagtgagccaagatcgtgccactgcactcaagcctgggcgacagaacaagactctgtctcaaaaataaataaataaataaataaataaataaataaataaatgaaaaggaagaaggagacctggcagagaaacgctatatctaaatagtgctgaggca

SEQ ID NO: 3096 - DNA, 219 bp, Homo sapiens
  D2S2222
  Located on chromosome 2
  Distance between a terminus base of telomere on chromosomal short arm and 5'-terminus of this base sequence : 94344671
  Distance between 3'-terminus of neighbour sequence of sequence listing upward to telomere on chrosomal short arm and 5'-terminus of this base sequence : 355270
tgtgttcaatttgtaccccacaactttgctaaatgcatttactggttttaatatgtttgtgtgtgtgtgtgtgtgtgtgtgtgtgtgtgtgtgtggagtctatatggttttcaacatataagatcaagtcatctgcaaccagagataattttatttcttcctttctgatttggatgcctcatttcttttttttgcctaatgactctggctatgacttcc

SEQ ID NO: 3097 - DNA, 378 bp, Homo sapiens
  AC017099.9_66660
  Located on chromosome 2
  Distance between a terminus base of telomere on chromosomal short arm and 5'-terminus of this base sequence : 94361990
  Distance between 3'-terminus of neighbour sequence of sequence listing upward to telomere on chrosomal short arm and 5'-terminus of this base sequence : 17100
tgagctgatatcaggcaactgcactccagcttgggcaacaaggtgagaccctgtctcaaaaaaacaaaacaaaacaaaatatatatatatatatatatatatatatatatatatagagagagagagagagagagagagagagagagagagagagagagagtcatgctttgatgtatttatgcattaaaatgccaaggataactttctttaaatcaaaaagcactaaattttgttatgctgtcagcccaccctcatgtagacatagcttagtttttacatagataagacccctctataagaagagtttaatataaagagggtgtgttccccctcttgctttctgaggatggcctactctgtaactgagtagctttcaat

SEQ ID NO: 3098 - DNA, 156 bp, Homo sapiens
  DISD22_0001740
  Located on chromosome 2
  Distance between a terminus base of telomere on chromosomal short arm and 5'-terminus of this base sequence : 94464353
  Distance between 3'-terminus of neighbour sequence of sequence listing upward to telomere on chrosomal short arm and 5'-terminus of this base sequence : 101985
cgtaaagccatattgctctggtttttgtgtgtgaatgtgtgtgtgtgtgtgtgtgtgtatttttttctcttctgaaaactgtaaatagaggaattttcattacaagtgaaaatatttgtgttccatatttatttcctgtctaacgtactttgctct

SEQ ID NO: 3099 - DNA, 476 bp, Homo sapiens
  AC027241.3_45441
  Located on chromosome 2
  Distance between a terminus base of telomere on chromosomal short arm and 5'-terminus of this base sequence : 94662687
  Distance between 3'-terminus of neighbour sequence of sequence listing upward to telomere on chrosomal short arm and 5'-terminus of this base sequence : 198178
accttgaacttacctacaggacatggggccctggaggctagagtggcatggccgggggcggggggtggaggtgggtgtggcagggtggagggggaaggatactggagacagttctgatagggacttggggagacccaaagagggtgaaggtggggcagtcagcaaaagtggtggccaaaggctgaaataaagatagaaaggaaggtggttatgtgaaggtgtgtgtgtgtgtgtgtgtgtgtgtgtgtgtgtgtcttacgtgggtacatttggcaattgatccagaatatggagaaatgacagagaggactcaatgatgacttttattcagcaaataattgtcaagtgagggtctgaatttgaactactcttttaagtgtcaccctgaataggataatgactagaagctattataatgggttgagctagaataaaattgtatctgaattgtggacatttctgatttaagttgagtg

SEQ ID NO: 3100 - DNA, 477 bp, Homo sapiens
  AC027241.3_137337
  Located on chromosome 2
  Distance between a terminus base of telomere on chromosomal short arm and 5'-terminus of this base sequence : 94759561
  Distance between 3'-terminus of neighbour sequence of sequence listing upward to telomere on chrosomal short arm and 5'-terminus of this base sequence : 96398
agatcttggtttccaaatatctttctccaataaaaggaaccagggctgattctagggctgagacggggaaaatataccatgagcatggagtgtcttgtagtgccggaaagtactcaaaaagcacaatgttggggggcaagtggcgatagggctttctacatacacacacacacacacacacacacacacacacacacacacacaatgatggaagtaaattagagggacatagcaaccaacctgaaagagctcccaatggccaaaactgaagccatttgaaaaacaaaatttttaaatttagtattagactatatcccaaagtataaaagtccatgagtctatgccataaatgaatgattgaataaataaattaatgagggagaaaggacacatattttttacagaaggattccagatcatatatgtagattatttgatactttccaccccaggatgtaaagccttattgatggatct

SEQ ID NO: 3101 - DNA, 253 bp, Homo sapiens
  DISO7_00004034
  Located on chromosome 2
  Distance between a terminus base of telomere on chromosomal short arm and 5'-terminus of this base sequence : 94848280
  Distance between 3'-terminus of neighbour sequence of sequence listing upward to telomere on chrosomal short arm and 5'-terminus of this base sequence : 88242
agactgggttggtactggttcctgcgggctggagggggtggagtagggagtgttgtgaaagtttcaagcacagaggactgaatggaagcctcacaatgcaacctaaggactttggattcttgcttttgagtacatgcactgtgtgtgtgtgtgtgtgtgtgtgtgtgtgtgtgtgtgtgtgtgtgtgtaaatggtgtagtttgttggctgtcagccttactaggaggctggtttggagcctgttgccttagct

SEQ ID NO: 3102 - DNA, 333 bp, Homo sapiens
  AC064860.3_49181
  Located on chromosome 2
  Distance between a terminus base of telomere on chromosomal short arm and 5'-terminus of this base sequence : 95019781
  Distance between 3'-terminus of neighbour sequence of sequence listing upward to telomere on chrosomal short arm and 5'-terminus of this base sequence : 171248
ccaaagtgatctacagattcaatgtaatccctatcaaaaaatttaatgacatttttctcagaaatgggaaaaaaatcctaaaattcatatataaccacacacacacacacacacgcacgcgcacacacacacacacacacacacacacacacacacacacaacaaatagccaaggtaatcatgaggaaaaacaataaagctggaggcaacacactttattatttcaaactatactatgaagctataataatgtaaacagtatggtattgatttttaaaaaacagacacactggccaatggaacagaatatagagcctagaaatgaactcatgt

SEQ ID NO: 3103 - DNA, 333 bp, Homo sapiens; identical to SEQ ID NO: 3102
  AC061962.3_36836
  Located on chromosome 2
  Distance between a terminus base of telomere on chromosomal short arm and 5'-terminus of this base sequence : 95019781
  Distance between 3'-terminus of neighbour sequence of sequence listing upward to telomere on chrosomal short arm and 5'-terminus of this base sequence : -333

SEQ ID NO: 3104 - DNA, 471 bp, Homo sapiens
  chr2.fa.O7frz.102635972
  Located on chromosome 2
  Distance between a terminus base of telomere on chromosomal short arm and 5'-terminus of this base sequence : 95095336
  Distance between 3'-terminus of neighbour sequence of sequence listing upward to telomere on chrosomal short arm and 5'-terminus of this base sequence : 75222
agcctgctagaggaatcacatcaggaggttctccctggctttttattttatttttattttattttattttattttattttattttattttattttatcttattttattttattttgagatggagttttgctcctgttgcccaggctggagtgcaatggcgcagtcttggctcaccgcaacctctgcctcccgggttcaagtgattctcctgcctcagcctcccaaatagttgggattgcaggcatgtgccaccatgtccagctaattttgtatttttagtagagatggggtttctccatgttggtcaggctggtttcaaactcccgacctcaggtgatctgcccacctcggcctcccaaagtgctgggattatgggtgtgagccaccgcgctcggacctccctggcttttttaaatgtatatgcacaaacggtaggagacctctccattgtaattgatcaacagtgcactc

SEQ ID NO: 3105 - DNA, 454 bp, Homo sapiens
  AC068040.6_176064
  Located on chromosome 2
  Distance between a terminus base of telomere on chromosomal short arm and 5'-terminus of this base sequence : 95201775
  Distance between 3'-terminus of neighbour sequence of sequence listing upward to telomere on chrosomal short arm and 5'-terminus of this base sequence : 105968
atcaagatacaggactgtcctcatgctgcccttttgtagtccaacattccccgctacctttaacccctggcaaccacttataacttctctgttcctataattttgccttttctagaatgtcatgtagattaagtcacacagtatgtccccttttcattccagcttctttcactcagcacaatgcattagaggctcactcatgttataccagatcaatagcctattcctttttattgctgagtagaactccattgtgtggatataccagtttgttgaaccatttcaacctgctgaaagacatctgggttcttttcagtttttagcaattataaataagttgctatagtttgtgtgtgtgtgtgtgtgtgtgtgtgtgtgtgtgtgtaaacataagttttcactgcccagtaaatacctaggagttggattgctgagtcataggctaagtgtatgt

SEQ ID NO: 3106 - DNA, 160 bp, Homo sapiens
  DISO7_10000933
  Located on chromosome 2
  Distance between a terminus base of telomere on chromosomal short arm and 5'-terminus of this base sequence : 95318145
  Distance between 3'-terminus of neighbour sequence of sequence listing upward to telomere on chrosomal short arm and 5'-terminus of this base sequence : 115916
caccagtctatgtaattaagggtgtatatatacatgtatatttatatatacatattacatattataatacatattacatgtatatataaatatatgtgtgtgtgtgtgtgtgtgtgtgtgtgtgtgtgtgtatatacccagacctttcaattacctactg

SEQ ID NO: 3107 - DNA, 256 bp, Homo sapiens
  AC019097.4_88655
  Located on chromosome 2
  Distance between a terminus base of telomere on chromosomal short arm and 5'-terminus of this base sequence : 95433488
  Distance between 3'-terminus of neighbour sequence of sequence listing upward to telomere on chrosomal short arm and 5'-terminus of this base sequence : 115183
aaactcctgacttcaagtgatccacccacctcggcctcccaaagtgctgggattacaggcgtaagccactgcgcccggccgttcctatttctttagcgttagttttacacatatttgcgtgtgtgtgtgtgtgtgtgtgtgtgctatcttcctttattcatgtgctcttctccagggtatttttagctacagtttcccattctgctttctcatggaatggtacagattccacatctggcagtaatagatactggtg

SEQ ID NO: 3108 - DNA, 251 bp, Homo sapiens
  DISO7_10000935
  Located on chromosome 2
  Distance between a terminus base of telomere on chromosomal short arm and 5'-terminus of this base sequence : 95591714
  Distance between 3'-terminus of neighbour sequence of sequence listing upward to telomere on chrosomal short arm and 5'-terminus of this base sequence : 157970
tgttctggctaatgtgctgtttaaataaatggatgaatggatggatgaacagatagatggatgggtggatgcagagatggatgggtggatggatagatggatggatggatagatgagtgggtgggtaggtagataaatgggtgggtggatgggtggatggatggatggatggatggatggatggatggatggatggatggtgtgatatactttttaagtgctgtccggagccagctttgaggccaggacta

SEQ ID NO: 3109 - DNA, 351 bp, Homo sapiens
  chr2.fa.O7frz.103428348
  Located on chromosome 2
  Distance between a terminus base of telomere on chromosomal short arm and 5'-terminus of this base sequence : 95641519
  Distance between 3'-terminus of neighbour sequence of sequence listing upward to telomere on chrosomal short arm and 5'-terminus of this base sequence : 49554
tattgtatgattcttaaggcgttgcatcctcatagcttaactcccgcttgtaagtgagaacctacaaggtttggttttccactcctgagttacttcacttagaataatggtctccgatgccatccaggttgctgcaaatgccattattttgttcccttttatggctgagtagtattccatggtgtgcatgtgtgtatgtatatatatatataaatctatctatatatatatatgtatatatatacatcacatttgctttatccactcattggttgatgagcatttaggctggttccatatttttgcaattgcagattgtgctgctataaacatggatgtacaagtgtcttt

SEQ ID NO: 3110 - DNA, 451 bp, Homo sapiens
  AC023965.3_82165
  Located on chromosome 2
  Distance between a terminus base of telomere on chromosomal short arm and 5'-terminus of this base sequence : 95646591
  Distance between 3'-terminus of neighbour sequence of sequence listing upward to telomere on chrosomal short arm and 5'-terminus of this base sequence : 4721
ttgatttaatttgactgcttctagatagttttatttttactttatagaaaaggaaactgcgattcgtattagcccattggtgcgtttaagcgctctctctctttctctctctctctctctctctctctctctttctcttcctttgtctctcactatttttccctcttaggttagttagagagtgggcatgtgacacagagaagacagcagcaggaaaggtacattttgatgggacaaggaaggtgttgtgtgagaaatcactgggtgctcacgggttctgccgagacctgcttggtcgtggagaccctaacccagtggcgctagacaaactaaagacacacacacagaaatatagtgtgtggagtgggaaaccagggggctgacagccttcagagctgagagccacgaacagagttttacccatatgcttattgagaacaagccagtaata

SEQ ID NO: 3111 - DNA, 411 bp, Homo sapiens
  AC018690.3_7860
  Located on chromosome 2
  Distance between a terminus base of telomere on chromosomal short arm and 5'-terminus of this base sequence : 95757450
  Distance between 3'-terminus of neighbour sequence of sequence listing upward to telomere on chrosomal short arm and 5'-terminus of this base sequence : 110408
ttagaacgtaaggaacaagattattattaggcctgtattaaagttcttgggataacctttatatgacaattgtaattacttactgttagtatataagacactaaagtggaaataattatggtgctcagtgaaccagaatgcggatctgaaatgttttacgttgcattattttgatgtagatcaggataccaaattttggaagatcatttgaagattagcaaaaagaaaatgtagataagcataatacaaaaagggggtgtgtgtgtgtgtgtgtgtgtgtgtgtgtgtgtgaaattagttggtcagtgttactttttagactaaaagggaatgtccagattagatctgttgtaatgttacttccattcatttatgtccttttgtccagaaagtcaagcatttatgacgtta

SEQ ID NO: 3112 - DNA, 203 bp, Homo sapiens
  AC018690.3_214879
  Located on chromosome 2
  Distance between a terminus base of telomere on chromosomal short arm and 5'-terminus of this base sequence : 95908906
  Distance between 3'-terminus of neighbour sequence of sequence listing upward to telomere on chrosomal short arm and 5'-terminus of this base sequence : 151045
aggatcaagacagccatagagaaataataataataataataataataataataataataataataatgataaaatccatgatttcattaaaaatcaagaaagggtgccttaaaaggtccaggagctttgaggcacctctgagagatggaagaagtgtgggatcattgtgaagaaggaaatcacagtccagaggctatgcagaa

SEQ ID NO: 3113 - DNA, 437 bp, Homo sapiens
  AC073118.1_8441
  Located on chromosome 2
  Distance between a terminus base of telomere on chromosomal short arm and 5'-terminus of this base sequence : 96015441
  Distance between 3'-terminus of neighbour sequence of sequence listing upward to telomere on chrosomal short arm and 5'-terminus of this base sequence : 106332
atacataagacaagatggccttgggctgagaactgctgacgttaggcgatgagcacagggcaggttcttatattattctggccatttccctacatgaaatgaacaaaactttcattttgtattgaaaatgtattgatttgttttttgtttttttcttctactaaaattaatgtgtgtgtgtgtgtgtgtgtgtgtgtgtgtgtatgctgaaatttcccataataaaaaaactaaaagaaaaaaatcataaaaaaggctctattttggccgggcatggtggctcacgcctgtaatcccagcactttgggaggcccaggcaggtggatcacctgaggtcaggagttcgagaccagcctgaccaacagggagaaaccccgtctctactaaaaatacaaaattagatgggcatggtggcacatgtctgtaattccagctac

SEQ ID NO: 3114 - DNA, 322 bp, Homo sapiens
  chr2.fa.O7frz.103910571
  Located on chromosome 2
  Distance between a terminus base of telomere on chromosomal short arm and 5'-terminus of this base sequence : 96019900
  Distance between 3'-terminus of neighbour sequence of sequence listing upward to telomere on chrosomal short arm and 5'-terminus of this base sequence : 4022
ggtttgtaattcagtctgaagtacctactatgtgcaagcactggacttggcttaggtggcagtcacaacaagcaaagcccttgcaatattgtgcttagtgtctagaggtggggcagacatgaaaagctacacacacacacacacacacacacacacacacacacacacacacacacacacagcagtctacattccaaggggcatggctgaagaggacagggtgctctgaaaccaactaatgaaggaaaccttgtttggaatgagtgtcaaggaaggcttactaagtaagaaataacaaagctgaggcttaaaggataaagaa

SEQ ID NO: 3115 - DNA, 415 bp, Homo sapiens
  AC010736.10_94590
  Located on chromosome 2
  Distance between a terminus base of telomere on chromosomal short arm and 5'-terminus of this base sequence : 96231527
  Distance between 3'-terminus of neighbour sequence of sequence listing upward to telomere on chrosomal short arm and 5'-terminus of this base sequence : 211305
acgcttgtaattccagcactttgggaggccgaggcaggcggatcacctgaggtcaggagttcgagaccagcctggccaacatggtgaaaccctatatctactaaaaatacaaaattagctgggtgtggtggcacgcacctctaatcccagctacttgggaggctgaggcaggagaatcacttgaactggggaggtggaggttgcagtgagctgagatcacaccactgcactccagcctgggtaacacagcataataataataataataataataataataataataataaaaaataaataaaataaaaataaaaaataaaaaaaacaagcactggcattttcagtttctataggtgggccctgcctcacaagaaaggggattctatgagtacactagatgctgagtttcaacacc

SEQ ID NO: 3116 - DNA, 462 bp, Homo sapiens
  AC010736.10_22981
  Located on chromosome 2
  Distance between a terminus base of telomere on chromosomal short arm and 5'-terminus of this base sequence : 96271346
  Distance between 3'-terminus of neighbour sequence of sequence listing upward to telomere on chrosomal short arm and 5'-terminus of this base sequence : 39404
tgtagataagatgaaagtcgataacaataataaaaaaaagtctatcatcagttgactttaaggaagagcatcccagacaacctgggtgggcctgattcaatcagttaaaaggttctaagggcagaaatgaggattccctgaagaagaagaaattctactggtggacttcagcttcagctccggaccacatgtttctttctacactgctcttcctgatggcctgtccacggcttttggacttgcctgctagccccatattcgtataagccaacaccttgcaatcaatcaatcaatcaacctacctatccatattacacacacacacacacacacacacacacaatctatgtacacatccatatatcgcctactgtttctgtttctctgttggagcccatactggtacaccactgaagggcttttactgacgactgaagagctctcaggtgctaatactatgcc

SEQ ID NO: 3117 - DNA, 460 bp, Homo sapiens
  chr2.fa.O7frz.105690191
  Located on chromosome 2
  Distance between a terminus base of telomere on chromosomal short arm and 5'-terminus of this base sequence : 96457613
  Distance between 3'-terminus of neighbour sequence of sequence listing upward to telomere on chrosomal short arm and 5'-terminus of this base sequence : 185805
tgcagtgagctatgattgtactgctgcactccagcctgggccacagagcgaggccctgtccggaaaaaaaaaaaaaaagaaggaaaaaagaagaagaaagagagaggagagagaaagaaagagagaaagaaggaaagaaagaaaaagaaagaaagaaaagaaaaagaaagagaaagaaagaaagaaagaaagaaagaaagaaagaaagaaagaaagaaagaaagaaagaaagaaagaaagaaaaccaacaagctctggtgtgagaacagagctgcacctgcctcataggcaagtctttgtttttaactcccaatccccttccttgatgagctgagacacgaggcccagcaaggagaaaaatgaaaaagaatacaaacacatctgccttgcccacctcagccctcaaatcctaaagcagctagcaggagagaggagaagatgtcaaccttcataaagtttg

SEQ ID NO: 3118 - DNA, 394 bp, Homo sapiens
  AC013722.5_22087
  Located on chromosome 2
  Distance between a terminus base of telomere on chromosomal short arm and 5'-terminus of this base sequence : 96711655
  Distance between 3'-terminus of neighbour sequence of sequence listing upward to telomere on chrosomal short arm and 5'-terminus of this base sequence : 253582
actccaaatgaatttacatgctattagcatccaaaaatttaaagagttccatttatttatttatttatttatttatttatttatttatttattgagatggagtctcactgtagcccaggctggagtgcagtggtttgttctcagctcactgcaacctccacctcccgggttcaagctattctcctgtctcagcctcctgagtagctgggattacaggcgtgctgcaccaccatgtctggctaattttttgtatatttagtagagacagggtttcaccatgctggccaggctagtctcaaactcctgacctcaaatgatctgcccacctcagcctcccaaagtgctgggattacaggtgtgagccaccgtgcccagccaagacttccatttaaga

SEQ ID NO: 3119 - DNA, 343 bp, Homo sapiens
  AC013722.5_65346
  Located on chromosome 2
  Distance between a terminus base of telomere on chromosomal short arm and 5'-terminus of this base sequence : 96838999
  Distance between 3'-terminus of neighbour sequence of sequence listing upward to telomere on chrosomal short arm and 5'-terminus of this base sequence : 126950
gatgacttaagccaaggagttcaagaccagcctggacaacatagcaagacctcatctttctaaaaataaataaataaataaataaaataaagaggtgaggtttcccaggggtcctgggtgccacacccagcagggcaggttgtgtattatttgatgtgtatgagggtatcttatctaatcccttcctaaaattaaatgacttcaacacaggagtttttgatataatgtatatgcattattgcagtgttaggttggggcttgattgtggtcaataacagttagatattaagagaatgaagaccttggaaaagaaggccattcaacaggtatttactgtatgctg

SEQ ID NO: 3120 - DNA, 353 bp, Homo sapiens
  chr2.fa.O7frz.104919928
  Located on chromosome 2
  Distance between a terminus base of telomere on chromosomal short arm and 5'-terminus of this base sequence : 96910035
  Distance between 3'-terminus of neighbour sequence of sequence listing upward to telomere on chrosomal short arm and 5'-terminus of this base sequence : 70693
gtcactagttctgcattataggatgggacaggaactgaaaagggtgcagcactaggcttctcaaatctgagttttataaactgagcaaaataataattaataaataaataaataaataaataaataaataaatggagcaaactgaacctttctagaaggcatatcaggactaggccttattcttcctttgtagtctccacagtgcctacgactgaggttgtagaaggaacacacatttctggtagaactgaaatataccaaataggtgctcacagttttaagaggcaactgcagcacacgatgctcagtgaagacagtgctgtccataaaaggtgaactttcctaaagaatac

SEQ ID NO: 3121 - DNA, 236 bp, Homo sapiens
  AC012493.6_8900
  Located on chromosome 2
  Distance between a terminus base of telomere on chromosomal short arm and 5'-terminus of this base sequence : 96995733
  Distance between 3'-terminus of neighbour sequence of sequence listing upward to telomere on chrosomal short arm and 5'-terminus of this base sequence : 85345
ccaagtatttcataaccatcagttcctttaaaaatctctaaattaaatgacagagtgccaggaattctcatttgcttattttattggtatccttaaagatatttattgctagatgaatagtagatacttaatgctttgtttgaaataccagaccactctcagaccagtcttgaaatgcattattattattattattattttttagttttagagaactaggatgacattggtaccac

SEQ ID NO: 3122 - DNA, 423 bp, Homo sapiens
  chr2.fa.O7frz.104707477
  Located on chromosome 2
  Distance between a terminus base of telomere on chromosomal short arm and 5'-terminus of this base sequence : 97204678
  Distance between 3'-terminus of neighbour sequence of sequence listing upward to telomere on chrosomal short arm and 5'-terminus of this base sequence : 208709
ataaatagctgctccaagtgacgtaacagacccagttggcactaccctgagtggaaaatgtagctcaagacttcccttgtttgtgtgtttcttggaggcaggttgactgctctcttgtctttaaaaagactctttagagagcttattgtctaagagaggggcgtgtaggcaaccacccaggaagttctgtgggggcattccagggatatttgtgtgtgtgtgtgtgtgtgagagagagagagagagagagacagagagagagacagagaaagagagagagagaaaccaatgtaacatccctacatccttgcccccggcccccatcatgcctggtcacagggatgacctactttaattattggagggtatggaaccaaaagggatcccagaggcaaatagctctttaatggtagttgcagctaa

SEQ ID NO: 3123 - DNA, 201 bp, Homo sapiens
  chr2.fa.O7frz.104490743
  Located on chromosome 2
  Distance between a terminus base of telomere on chromosomal short arm and 5'-terminus of this base sequence : 97267985
  Distance between 3'-terminus of neighbour sequence of sequence listing upward to telomere on chrosomal short arm and 5'-terminus of this base sequence : 62884
atgcatgttcatgaggtatacttctccttatcctattttcatatttaaatgaaaacaaattggctcatttaccgggagactctcagcttggtagagattgaaaaagtgtgtgtttgtgcacgtgtgtgtgtgtgtgtgtgtgtgtgtagtgttgcatttgttttccctcagagggttaggaaagtatggattgaatggatt

SEQ ID NO: 3124 - DNA, 186 bp, Homo sapiens
  D2S2209
  Located on chromosome 2
  Distance between a terminus base of telomere on chromosomal short arm and 5'-terminus of this base sequence : 97269860
  Distance between 3'-terminus of neighbour sequence of sequence listing upward to telomere on chrosomal short arm and 5'-terminus of this base sequence : 1674
tcaccaatcccatccttggccctgtttcctggcatggctccagcagcactgactcccagggaagagattctgttttattcgttgctgtgtccccagtgggtagcagactcatattgtctctctctaatgctgtctttacacacacacacacacacacacacacacacacgcaaacgcatacgcatg

SEQ ID NO: 3125 - DNA, 294 bp, Homo sapiens
  AC012493.6_148530
  Located on chromosome 2
  Distance between a terminus base of telomere on chromosomal short arm and 5'-terminus of this base sequence : 97390840
  Distance between 3'-terminus of neighbour sequence of sequence listing upward to telomere on chrosomal short arm and 5'-terminus of this base sequence : 120794
agtccatagtttgcattacagttcactcttggtgttgtacattctatgggttttgataaatgtataatgacatgtattcacaattgtaatatcatccagaatagtttcactgacctaaaaatcctctgtgctctgcctattttatatctatctttgaaaaatagtttttctagacataggattccttgctgatatcatcatcatcatcatcatcatcatcatcatcatcattcttactttagttacatggataagttctttagtgctgatttctaagatattggtgcacctgtc

SEQ ID NO: 3126 - DNA, 454 bp, Homo sapiens
  AC012493.4_130379
  Located on chromosome 2
  Distance between a terminus base of telomere on chromosomal short arm and 5'-terminus of this base sequence : 97456546
  Distance between 3'-terminus of neighbour sequence of sequence listing upward to telomere on chrosomal short arm and 5'-terminus of this base sequence : 65412
actttatggtttgtaagatgtgactcctcagaccccttaggtaggaatttgggcatgttaaaaaaaattaaagcttagttctctgtctcctccctttctcttacacacacacacacacacacacacacacacagagacacacagacacacacacacaaatttgagacagagtctcacaccgttgcccaggctagagtgcagtggcacagtcatggttcactgcactcttgacctccctgggctcaggtgatcctcccacttcagattctcaagtagcggggactacagcacatgccaccacacccagctaatttttgtattttagtagagacggagttttgccatattgctcaggctggtctcgaactcctgacctcaagtgatccacccccccttggcctcccaaagtactggaatcacaggcgtgagacactgcactcagcctaatagttta

SEQ ID NO: 3127 - DNA, 290 bp, Homo sapiens
  AC012493.6_110572
  Located on chromosome 2
  Distance between a terminus base of telomere on chromosomal short arm and 5'-terminus of this base sequence : 97462258
  Distance between 3'-terminus of neighbour sequence of sequence listing upward to telomere on chrosomal short arm and 5'-terminus of this base sequence : 5258
tcagatgttctttcctcagtctactgatgctaatgctaatctatttcagaaatgtcctcacaggtacacccagaaataatttcatcactatgtgggcatctcttagcccagtcaacttgacatatacaatgaaccatcacagtcagggtattttttaaatcaccacacacccacattttatctatctatctatctatctatctatctatctatctatctatctatctatctatctgagaaggattctcaccctgtcacccaggctagagtacagtggcattatctcagct

SEQ ID NO: 3128 - DNA, 452 bp, Homo sapiens
  chr2.fa.O7frz.103983525
  Located on chromosome 2
  Distance between a terminus base of telomere on chromosomal short arm and 5'-terminus of this base sequence : 97612489
  Distance between 3'-terminus of neighbour sequence of sequence listing upward to telomere on chrosomal short arm and 5'-terminus of this base sequence : 149941
gtaagcgacatcacttagatgtgaagccaggcagtctggcaccagagaccaaattcttagactctgctccactgcctccctggggaactgctcactgacaagctttgacaaatggtaccttcatcctttgttagtaaatgctaggcaaaagggtattaatttacagatcatgcctgtttcagttcattcttccaagatctgctatgcctccttggttgatatgtgtgtgtgtgtgtgtgtgtatatatatatataggctaattttaagaattcttctaaaacctataaaatataactggaatatgcaattcaaatgacacagcactagcagtgaactaatactctagtccctacattttttcaaacagaagatttcagaagctgtaaggtaaacagactcgcccattttaccgattttttagtgtgaattctgcatactgaattccttaaga

SEQ ID NO: 3129 - DNA, 424 bp, Homo sapiens
  AC012357.5_184293
  Located on chromosome 2
  Distance between a terminus base of telomere on chromosomal short arm and 5'-terminus of this base sequence : 97650534
  Distance between 3'-terminus of neighbour sequence of sequence listing upward to telomere on chrosomal short arm and 5'-terminus of this base sequence : 37593
gctatttcattagttgatcaatctgttcatcacccagttttaaaatagttgtgggcccagcacagtggctcacacctgtaatcccagagctttcagagtcggagaaggaaggactgcttgaggccaggagatcaaggttacaatgagctatgatcatgcactccagcctgggcaacagagtaagaccctgtcacttagaacaaaaaaaaaaatcgctgtctctctctcacacacacacacacacacacacacacacacacacacacacactggttatggcagcaaatataaactcatcaaactgtattatcacgctagtcacatctctccatcttgtctgtgacaccagagactctcaaagtggctggctgaaatcaatattcactctctatccggcattcccttcatgtatcagacgaatgat

SEQ ID NO: 3130 - DNA, 426 bp, Homo sapiens
  chr2.fa.O7frz.104062070
  Located on chromosome 2
  Distance between a terminus base of telomere on chromosomal short arm and 5'-terminus of this base sequence : 97658427
  Distance between 3'-terminus of neighbour sequence of sequence listing upward to telomere on chrosomal short arm and 5'-terminus of this base sequence : 7469
ataactgagatgtttccaggagtgttaaaagacataaatccacagatatactaatcagggtaaatgaaaagaaattcaggctgggcgcggtggctcacaccttaaaccccagaactttgggaggctgaggcgggtggatcacctgaggtcaggagttcaagaccatcctgaccaacatggagaaaccccatatctactaaaaatacaaacttagccgggcatggtggcatgcacctgtaatcccagctactcgggaggctgaggcagaagaatcacttgaacccgggaggcggaggttgcagtgagccgagatcgtgccactgcactccagcctgggcaacaagaacaaaactccgtctcaaaaaaaaaagaaaagaaaagaaaagaaaagaaaagaaaagaaattcaatctaggtgattgtcata

SEQ ID NO: 3131 - DNA, 459 bp, Homo sapiens
  chr2.fa.O7frz.104152958
  Located on chromosome 2
  Distance between a terminus base of telomere on chromosomal short arm and 5'-terminus of this base sequence : 97763421
  Distance between 3'-terminus of neighbour sequence of sequence listing upward to telomere on chrosomal short arm and 5'-terminus of this base sequence : 104568
aatttccattgatagaatccactgaccttattcaaatttcataggttttacaagccctcgtgtgtgtgttgtgtgtgtgtgtgtgtttagttctttatatgtgtgtgaatttctgtgaccactaccataagccaaatacagaacagttcagttgcaaatagcccttatactaccttcacatatcgagagccacctcctttttactatctcctgcttcatctccaatccttggcatcaactactttcttttactccataactttatcattttaataaaattggataaatggaattaaacagagattggattttctcactcagcataattttctggagacccatccaagttgttgcacagaataataatgaaccattattaatgcttcattcctatgtattgttccatagaatcctatggaatagatgaaccacagtttgtttaaaccttacctgttggag

SEQ ID NO: 3132 - DNA, 174 bp, Homo sapiens
  chr2.fa.O7frz.92597190
  Located on chromosome 2
  Distance between a terminus base of telomere on chromosomal short arm and 5'-terminus of this base sequence : 97957813
  Distance between 3'-terminus of neighbour sequence of sequence listing upward to telomere on chrosomal short arm and 5'-terminus of this base sequence : 193933
aataccttggatgacattatgtaggaggatttgttagaagaataccttgcaagacacacacacacacacacaccctaaaggcaaaagtgacgcacatactgaacatttaatatggttttgactccaaatcctttgtacagcacctgttgtctgagcttgataaagatttgataa

SEQ ID NO: 3133 - DNA, 435 bp, Homo sapiens
  AC062029.1_5845
  Located on chromosome 2
  Distance between a terminus base of telomere on chromosomal short arm and 5'-terminus of this base sequence : 98062424
  Distance between 3'-terminus of neighbour sequence of sequence listing upward to telomere on chrosomal short arm and 5'-terminus of this base sequence : 104437
cagtctaacagtacggatgaaacgagaagacctataacaacattacagactagaaacagtgccagtgtcagggatgtcccaaggtttttgtggtgttctactaggtgaggtatgggagtgagggtaggtaagaagataagagaaggttgtggcagaatgagttggttcctgaaaaatgggtaaaattgtaatggaaagtcactggacttgaggaaacagcaagaggcacagaggccggagattatgtttggaaaacattttgtctctgtgtatgtctgtgtgtgtgtgtgtgtgtgtgtgtgtgtgtgtgtgtgtgtgtacgtaagcgatatagacatgcacatatgtatgctaggcagggagaagtagatgaggatagaaaaaataggttagagccgactgtatatgcatatagtctgatgctaatagcatcat

SEQ ID NO: 3134 - DNA, 449 bp, Homo sapiens
  AC023416.3_100842
  Located on chromosome 2
  Distance between a terminus base of telomere on chromosomal short arm and 5'-terminus of this base sequence : 98224700
  Distance between 3'-terminus of neighbour sequence of sequence listing upward to telomere on chrosomal short arm and 5'-terminus of this base sequence : 161841
tgaatgctggtacaactttctaatatcttctcttagagttctgcattgaagtttttaaataagtttagtctatacctttcttttccattttcagtcttcaattttgacttcaagataattctagtcctatgatgtgatttatgtttctaaataatggcatttaccctctttcactattccctggaattggaaaaaataggttatttatttatttatttatttatttatttatttatttatttgggtttgggtaaaacttaaccatatgtttaacaggacctggactttgatttaagcaaacttagggtaaagacagtttaaagacaatcaaggaaattggaatagaaaatgggtattggatattagggaattactctcaattatgctgggaatcataatggaatggtggttgttttttaaaagtccttatcagttggcaacgtattaat

SEQ ID NO: 3135 - DNA, 414 bp, Homo sapiens
  AF017732.1_43308
  Located on chromosome 2
  Distance between a terminus base of telomere on chromosomal short arm and 5'-terminus of this base sequence : 98227723
  Distance between 3'-terminus of neighbour sequence of sequence listing upward to telomere on chrosomal short arm and 5'-terminus of this base sequence : 2574
atctccagtgtttatcataccacactctatgtccatgtgtacacatcatttagctcccacttataagtgagaacatgtgacatttgaccttctgtttttgaattatccacttaagataatggcctccagttccaaccacattgctgcaaaagacatgatttcattcttttctttatagctgaatagtatttcattgtggtatgtgtatacacacacacacacacacacacaccacgttttctttatccaatcatctgttgatggacacttgggttgattccatatctttgctattgtgaatagtgctgcaataaacaagtgagtgcagatatcttttttatataataatttatttccctttgggtagatacccagttgtggtattgctgaaccacatggtagttctatttctag

SEQ ID NO: 3136 - DNA, 392 bp, Homo sapiens
  AC023416.2_77565
  Located on chromosome 2
  Distance between a terminus base of telomere on chromosomal short arm and 5'-terminus of this base sequence : 98250962
  Distance between 3'-terminus of neighbour sequence of sequence listing upward to telomere on chrosomal short arm and 5'-terminus of this base sequence : 22825
agtggtttacgataggatgaacctattgaagcagctagcagagaaaaggttatttatgtgggtaactgtgtatgcttgttggacattccctgggtctctcacactgttaccacagcagcattataaaaacatcatctatctatctctctatctatcaattgatctatctgtcaatctatctattgtctatctccataaacacacaaacatactcacatttgtgtgtgtgtgtgtgtgtgtgtgtgtgtgtatgtatacagaagaaatgataaaagttatatatgtcttatgtcccaaactttagaaaggatatgtaacatgttagcaatctttgaacacacttgctggaatatagagtaaaatactttgttgctggtatatcaaactgtagt

SEQ ID NO: 3137 - DNA, 105 bp, Homo sapiens
  DISO7_10000926
  Located on chromosome 2
  Distance between a terminus base of telomere on chromosomal short arm and 5'-terminus of this base sequence : 98363127
  Distance between 3'-terminus of neighbour sequence of sequence listing upward to telomere on chrosomal short arm and 5'-terminus of this base sequence : 111773
tggtaagtattgcctcatggatatatatgtgtgtgtgtgtgtgtgtgtgtgtgtgcatatatatatatatatttatgatacatgctgtgtttatgtgtataatga

SEQ ID NO: 3138 - DNA, 183 bp, Homo sapiens
  chr2.fa.O7frz.115230551
  Located on chromosome 2
  Distance between a terminus base of telomere on chromosomal short arm and 5'-terminus of this base sequence : 98457556
  Distance between 3'-terminus of neighbour sequence of sequence listing upward to telomere on chrosomal short arm and 5'-terminus of this base sequence : 94324
gctctcctttattcaaatgaacagcgttcagggtgagaccatcctcccgcatgtgagcatgcaagtatgcatacacgcacacacacacacacacacacacacacacacacagtgtaacacatgcccaccccaaccacttccactgctgaccccagacacctctaactcttgctagaccagtta

SEQ ID NO: 3139 - DNA, 338 bp, Homo sapiens
  chr2.fa.O7frz.115330992
  Located on chromosome 2
  Distance between a terminus base of telomere on chromosomal short arm and 5'-terminus of this base sequence : 98561665
  Distance between 3'-terminus of neighbour sequence of sequence listing upward to telomere on chrosomal short arm and 5'-terminus of this base sequence : 103926
tttacaagttgacttctgaatttgtgatcatcttacatcttagttaagattattttggatgcaaataaaagagatcaattataaactttctccagcaagaatgaagaatcaatcttaaggaggaagggtggggggtggagagagagagagagagagagagagggaagttctggaatttagctctcatgagaaccagggactgggaaggggtctggagtccccgaatctgtgctagagggtctctctctctctcatagtctgagcctttgcacctcttggtgtctgcccattcttgctcttctctgcatttgtgactgtccatttggaatttatagcat

SEQ ID NO: 3140 - DNA, 257 bp, Homo sapiens
  AC013332.4_49454
  Located on chromosome 2
  Distance between a terminus base of telomere on chromosomal short arm and 5'-terminus of this base sequence : 98699377
  Distance between 3'-terminus of neighbour sequence of sequence listing upward to telomere on chrosomal short arm and 5'-terminus of this base sequence : 137374
gaggttgtagtgagccaagattgccactgcactccagcctggcgatagaccgagactccgtctcaaaaacaaacaaacaaacaaacaaacaaacaaatttggaaaaattgatgatgtgtcttgattttggccaacattttgccaagctagagaaacaagagtcaggtaatattccattaaataagtttccagagagcttgaatcaagtctcagctaacttgaattcagctgatgtagacctatcagctgacaagact

SEQ ID NO: 3141 - DNA, 229 bp, Homo sapiens
  D2S1892
  Located on chromosome 2
  Distance between a terminus base of telomere on chromosomal short arm and 5'-terminus of this base sequence : 98757331
  Distance between 3'-terminus of neighbour sequence of sequence listing upward to telomere on chrosomal short arm and 5'-terminus of this base sequence : 57697
tcctaactctgaaatgctaaagacacatctcagggctccagagcattgccatggtttcttgccttttgcccaccagggtctggttgggaaaccgtctgcaccagagttgcttagggacttgaaagagtacagcctcctgtatctctctctctctctctctcacacacacacacacacacacacacacacacacacacacacacacccgccatttctccctgccagagct

SEQ ID NO: 3142 - DNA, 124 bp, Homo sapiens
  Z66945
  Located on chromosome 2
  Distance between a terminus base of telomere on chromosomal short arm and 5'-terminus of this base sequence : 98903929
  Distance between 3'-terminus of neighbour sequence of sequence listing upward to telomere on chrosomal short arm and 5'-terminus of this base sequence : 146369
tccactgcaaatctgaggctacacaaagaaacagtgaatacatgtacgtgtgtgtgtgtgtgtgtgtgtgtgtgcgtgtgtgtgtgatttattctgaggtattggctcacacattatggaacct

SEQ ID NO: 3143 - DNA, 376 bp, Homo sapiens
  AC069171.2_144252
  Located on chromosome 2
  Distance between a terminus base of telomere on chromosomal short arm and 5'-terminus of this base sequence : 98926431
  Distance between 3'-terminus of neighbour sequence of sequence listing upward to telomere on chrosomal short arm and 5'-terminus of this base sequence : 22378
tgtcctcaaatcttcgtttataacattctcccaccatgacactgagctctgcaagagaaggggctaagtctcgttaccttctgtcttcccagagccatctacacagtaggtgtttaacaagtgttggttggatgaatggatggttgaatggacagacagatgaagggatggataaatggtagatggatggacaaacagtgaatagttagatggatggacggatggatggatggatcgatggacagatggatggatggatggatggatggatggatggatggatggatggacagatggacagatgaatggatggatggatggttggtcgctagctgcaaatacagcccaggtgggaagctacatgcaggtgagcatg

SEQ ID NO: 3144 - DNA, 475 bp, Homo sapiens
  AC069171.2_111069
  Located on chromosome 2
  Distance between a terminus base of telomere on chromosomal short arm and 5'-terminus of this base sequence : 99091052
  Distance between 3'-terminus of neighbour sequence of sequence listing upward to telomere on chrosomal short arm and 5'-terminus of this base sequence : 164245
ttgtatctttgaatctaggttcctgcactccagcctgggcaatgtagtgagagaaagaaaaaagaagagaagagaagaggggaggggaagtgaggagagaggggaggggaggggagggaggaggggaagggagggaaggggagggaagaaaggaaaggaaggaaggaaggagagagagatggaaagaaagaaaagaagacagacaaagaaagaaagagacagaaagaaagaaagaaagaaagaaagaaagaaagaaagaaagaaagaaagaaagaatgaagaagaaagaaagaaaaggaaaggaaggaaggagaaagaaggaaagaaagagaaagaaagagaaaggaagaaaggaaggaaggaaggaaggaaggaaggaaggaaggaagagacagggctaggcgtggtggctcacgcctgtaataccagcactctgggagaccaaggcaggcagatcacttgagatcaggaactt

SEQ ID NO: 3145 - DNA, 232 bp, Homo sapiens
  AC067761.2_48663
  Located on chromosome 2
  Distance between a terminus base of telomere on chromosomal short arm and 5'-terminus of this base sequence : 99246467
  Distance between 3'-terminus of neighbour sequence of sequence listing upward to telomere on chrosomal short arm and 5'-terminus of this base sequence : 154940
cagcctgttgagtagctaggactacaggtgcatgccaacacagccagctgtttcttaacttttttgtagagatgaggttttgccacattgtcgaggctggtctctaactcctggggtcaagtgatcctcctgcctcggcctgccaaagtgtggggattacagacatgagccactgtgcctggcttccaatcgctttatttatttatttatttatttatgacggagtctcacg

SEQ ID NO: 3146 - DNA, 293 bp, Homo sapiens
  AC064810.2_26283
  Located on chromosome 2
  Distance between a terminus base of telomere on chromosomal short arm and 5'-terminus of this base sequence : 99411435
  Distance between 3'-terminus of neighbour sequence of sequence listing upward to telomere on chrosomal short arm and 5'-terminus of this base sequence : 164736
gagcctgagagacagacattatcttgtgaaaaggtccatccaggtacgagatttcagggaacagatggaaagcaattgctgtccttggtgggtccaatctttatacagataaccaaaagccttttccagcatctgcttgtctccaagggcctttaattcaaaatattcatcatgccagggtgccatatcttggggtaaaattattattattattattattatcttaatgtacaaaagtggagagttcagattccctttctttgagcaaaatttgcagaagtaatgacctaagg

SEQ ID NO: 3147 - DNA, 246 bp, Homo sapiens
  chr2.fa.O7frz.114721811
  Located on chromosome 2
  Distance between a terminus base of telomere on chromosomal short arm and 5'-terminus of this base sequence : 99461010
  Distance between 3'-terminus of neighbour sequence of sequence listing upward to telomere on chrosomal short arm and 5'-terminus of this base sequence : 49282
agtctcacatcctcagtgattattacaataattcgagtgaacacggaagactagatttttatttgtgggagtgtgtgtgtgtatgtgtgtgtgtgtgtgtgtgtttctaacaccagccacttgcttccagagacacatttccatctgtgtggtcactagcctgcaaagttgtggcacttcttggtgcctccttcagggcaagtctgaaatattttaatagacgacttaaacgtcctttaggtagag

SEQ ID NO: 3148 - DNA, 144 bp, Homo sapiens
  chr2.fa.O7frz.114805605
  Located on chromosome 2
  Distance between a terminus base of telomere on chromosomal short arm and 5'-terminus of this base sequence : 99567845
  Distance between 3'-terminus of neighbour sequence of sequence listing upward to telomere on chrosomal short arm and 5'-terminus of this base sequence : 106589
ccagactacagctcaagtgtagacaagggtgtgtgtgtgtgtgtgtgtgtgtgtgtgtgtgtgtgttcatggagagactgggaataggaacaggatggggaggaaagagaaatgctttatggcttaggaatattgaattcggag

SEQ ID NO: 3149 - DNA, 294 bp, Homo sapiens
  AC067761.2_100941
  Located on chromosome 2
  Distance between a terminus base of telomere on chromosomal short arm and 5'-terminus of this base sequence : 99766218
  Distance between 3'-terminus of neighbour sequence of sequence listing upward to telomere on chrosomal short arm and 5'-terminus of this base sequence : 198229
agattgcacatgtaagtgagaccatgcagtagtttttcttttctttgtctggtttattcacttagcataatgtcttccagtttcatccatgttgtcataaatgccaggattttcttttttgtacacgctgaataatattcccatatatatatatatatatatatatataccataattttttaatccatttatctgtttatggacacttacattgtttccgtgtctaagctattatgaataatgctgcaatgaatatgggaccacagatacctctttgagatcctcataccattt

SEQ ID NO: 3150 - DNA, 453 bp, Homo sapiens
  AC067761.2_149902
  Located on chromosome 2
  Distance between a terminus base of telomere on chromosomal short arm and 5'-terminus of this base sequence : 99791052
  Distance between 3'-terminus of neighbour sequence of sequence listing upward to telomere on chrosomal short arm and 5'-terminus of this base sequence : 24540
acatgttcagctatctggaagctctctgaaccctgttctcttgtttttttgtggaagcttcatgatgtcagcattccttcctccaggttatgggtcaggaccccctttgtaataagggtcttatgacccacagtcagaaagatggggaagattagagtcctgcattgaggcaggtgaaaggagggcgggaagaggtcagagagattgttttctgaggcctgcccctgaggcgtaaagcacccaacatcatagcaaaagattgtaaccagggctatgggagttgtaagccagaaatcatgacaaaaacctgtgtgtgtgtgtgtgtgtgtgtgtgtgtgtgtgtgtgtgtgtgtgtgtaggttattatatatatgtacatatacacacatatatacacataaaataacccacaagtccattaaaatgtaatcgaatcattcaaatggataggtt

SEQ ID NO: 3151 - DNA, 407 bp, Homo sapiens
  chr2.fa.O7frz.94637274
  Located on chromosome 2
  Distance between a terminus base of telomere on chromosomal short arm and 5'-terminus of this base sequence : 99830332
  Distance between 3'-terminus of neighbour sequence of sequence listing upward to telomere on chrosomal short arm and 5'-terminus of this base sequence : 38827
cagtgatttccactcataaagttgggttgactcctagccttgttctcctatgtgtctgtgtgactttatgctgaggggatgtgacatcacagagggagaagtgcacttgtgtacagaaacatggcttaggagattggctttggatgtggctgcaatgaaatatatattttgaagaagtcccctatgaaatgtcttatacattgtttcttatggcagggtgctcgggctcacacctgtaatctcagcactttgagagaccaaggaggaaggatcacgtaaggccaagaatttgataccagcctgggcaacatagggaaaccacatgtgtacacacacacacacacacacacacaatttgtgaacagtggcatcacgaagtgattatttatgaacaattggctaagaaa

SEQ ID NO: 3152 - DNA, 134 bp, Homo sapiens
  DISO7_10000252
  Located on chromosome 2
  Distance between a terminus base of telomere on chromosomal short arm and 5'-terminus of this base sequence : 99910785
  Distance between 3'-terminus of neighbour sequence of sequence listing upward to telomere on chrosomal short arm and 5'-terminus of this base sequence : 80046
ataattgtattgcggcgcgtgtgtgtgtgtgtgtgagtgtgtgtgtaattttgattcatgcaccaaaaaaatttaattaaaaaaaaaacagacattttgaaggcccaagttgccctttggaagtcacttatgct

SEQ ID NO: 3153 - DNA, 214 bp, Homo sapiens
  HUMUT657
  Located on chromosome 2
  Distance between a terminus base of telomere on chromosomal short arm and 5'-terminus of this base sequence : 99998908
  Distance between 3'-terminus of neighbour sequence of sequence listing upward to telomere on chrosomal short arm and 5'-terminus of this base sequence : 87989
gctgaggcaggagaatcacttgaatccgggaggcggaggttttggtgagccgagatcgcaccattgcgctccatcctgggcaacaagagcgaaactgggcaacaaaataaataaataaataaataaataaataaataaataaataagcttagtatttactaggtacaagcgaccctttattaaaagatattattcaaggcactggtcattgttc

SEQ ID NO: 3154 - DNA, 138 bp, Homo sapiens
  DISO7_10000928
  Located on chromosome 2
  Distance between a terminus base of telomere on chromosomal short arm and 5'-terminus of this base sequence : 100102012
  Distance between 3'-terminus of neighbour sequence of sequence listing upward to telomere on chrosomal short arm and 5'-terminus of this base sequence : 102890
ggtaagtattgcctcgtggatatatgtgtgtgtgtgtgtgtgtgtgtgtgtgtgtgtgcgcatatatatatatatatatatatatatatatatatatatatatatttatgatacatgctgtgtttatgtgtataatga

SEQ ID NO: 3155 - DNA, 259 bp, Homo sapiens
  DISO7_10000930
  Located on chromosome 2
  Distance between a terminus base of telomere on chromosomal short arm and 5'-terminus of this base sequence : 100182358
  Distance between 3'-terminus of neighbour sequence of sequence listing upward to telomere on chrosomal short arm and 5'-terminus of this base sequence : 80208
gagattggctttggatgtggctgcaatgaaatatatattttgaagaagtcccctatgaaatgtcttatacattttttcttatggcagggtgctcgggctcacacctgtaatctcagcactttgagagaccaaggaggaaggatcacgtaaggccaagaacttgataccagcctgggcaacatagggagaccacatgtgtacacacacacacacacacacacacacacacacacacaatttgtgaacagtggcatcaaga

SEQ ID NO: 3156 - DNA, 211 bp, Homo sapiens
  G10069
  Located on chromosome 2
  Distance between a terminus base of telomere on chromosomal short arm and 5'-terminus of this base sequence : 100322274
  Distance between 3'-terminus of neighbour sequence of sequence listing upward to telomere on chrosomal short arm and 5'-terminus of this base sequence : 139657
tcagtgctaccaacaatggatgcattaaggtataatcatgaatgatagatagatagatagatagatagatagatagatagatagatagatttgctcattaaaaaagaaataaaaaacttaaaaaaaccctaatacttgaaaataatgccacagcaaggaagggtcctgccactggctatctggcatagctaatctcccatctccagacaca

SEQ ID NO: 3157 - DNA, 199 bp, Homo sapiens
  G09118
  Located on chromosome 2
  Distance between a terminus base of telomere on chromosomal short arm and 5'-terminus of this base sequence : 100322274
  Distance between 3'-terminus of neighbour sequence of sequence listing upward to telomere on chrosomal short arm and 5'-terminus of this base sequence : -211
tcagtgctaccaacaatggatgcattaaggtataatcatgaatgatagatagatagatagatagatagatagatagatagatagatagatttgctcattaaaaaagaaataaaaaacttaaaaaaaccctaatacttgaaaataatgccacagcaaggaagggtcctgccactggctatctggcatagctaatctccca

SEQ ID NO: 3158 - DNA, 138 bp, Homo sapiens
  DISO7_10000939
  Located on chromosome 2
  Distance between a terminus base of telomere on chromosomal short arm and 5'-terminus of this base sequence : 100458163
  Distance between 3'-terminus of neighbour sequence of sequence listing upward to telomere on chrosomal short arm and 5'-terminus of this base sequence : 135690
ttgatcattccatactttgctcaaaaactctaagcagcacacacacacatgtgcacagacacacagacacacacacacacacacacacacacacacacacgcccctgcaggtggaagacccaacccaacactgtgatc

SEQ ID NO: 3159 - DNA, 366 bp, Homo sapiens
  AC062027.3_15749
  Located on chromosome 2
  Distance between a terminus base of telomere on chromosomal short arm and 5'-terminus of this base sequence : 100634457
  Distance between 3'-terminus of neighbour sequence of sequence listing upward to telomere on chrosomal short arm and 5'-terminus of this base sequence : 176156
tacatttgcaccaacctaatacatggaaggatgaactatgttcatggatcagaagattttgtgattctgtattgtaaaagtattgattctcccctaatcatctataactgcaatgccattctaatcaaaatctcagcatggtggtggtgtgtgtgtgtgtgtgtgtgtgtgtgtgtgtgtgtaatgtgacaagctgattctaaaatatttagaaacacacagctccaagaatagccaagataatcttgcaggggaacaaggttggaggatttataccgcagataaactacagtagttaagacagtgtggtttctcataaaagagtcaacaaatagatatattgtacagaacaaggagtacagaaac

SEQ ID NO: 3160 - DNA, 464 bp, Homo sapiens
  AC069062.2_2023
  Located on chromosome 2
  Distance between a terminus base of telomere on chromosomal short arm and 5'-terminus of this base sequence : 100850981
  Distance between 3'-terminus of neighbour sequence of sequence listing upward to telomere on chrosomal short arm and 5'-terminus of this base sequence : 216158
aatggtaggcctaaattcagacatatcaataattacattaaatttaaataaaccactcagcttaaaaggcaaagatttttcacattggataaaaaggtgagactcaattatatgctatctaaaaaaggcacactcagtgacagagtgagactctgtctcaaaaagaaagaaaaagaaaaggaaggaaggaaggaaggactgaaaacatatagtggagagagagagagagagagagagagagagagagaaagagaaggaaagaaagaaagaaaaagaaagaaagagaaagaaagaaaaagaaaacatacaatgtcttctctgaccacagtggaattaaattataaataaataataagatatctgaaagaaaccaaatatgtggaaattaaaccacacagttctaagtaacccatggatcaaagaaaaaattatgagaaaaattagaaagcattctgaactacatg

SEQ ID NO: 3161 - DNA, 360 bp, Homo sapiens
  AC069062.2_122366
  Located on chromosome 2
  Distance between a terminus base of telomere on chromosomal short arm and 5'-terminus of this base sequence : 100886763
  Distance between 3'-terminus of neighbour sequence of sequence listing upward to telomere on chrosomal short arm and 5'-terminus of this base sequence : 35318
caggaagctcatgaaagatagattctgaggtctcaaaagaccgatccagtcggaacttttatagatgagacccaaaacatctgcatttttaatatgttccctaagtaatactgctgttaactaaattttgagaagcaccacttggttcgttcttgctattgccagaagcagaaaatatattgaaaattttgaagtgctaatgcattttgggcccaaaccagtcagaatgactgccagccacaggcaaaacagtagacagatgtatgtgtgtcatctctgtccaggaaagacacgttatgttatgttatgttatgttatgttatgttatgttatgttatgttatgttcactgctacttgcc

SEQ ID NO: 3162 - DNA, 264 bp, Homo sapiens
  D2S2269
  Located on chromosome 2
  Distance between a terminus base of telomere on chromosomal short arm and 5'-terminus of this base sequence : 100916294
  Distance between 3'-terminus of neighbour sequence of sequence listing upward to telomere on chrosomal short arm and 5'-terminus of this base sequence : 29171
agccaaaccaagtcaatgtcctaacacctggtacctatgaatgtgatgttatttagtaataatgtctttgcagatgtaattagttaagatggaatcatcatacaatgactggcatccgtaagagaaaacacacacacacacacacacacacacacacacacacacacagagagagagagagagagagagagagagagagacagagagagaaacatgcagagagagagagaaaagacagaagcagagattggtgtcatgctttca

SEQ ID NO: 3163 - DNA, 377 bp, Homo sapiens
  AC069062.2_50034
  Located on chromosome 2
  Distance between a terminus base of telomere on chromosomal short arm and 5'-terminus of this base sequence : 100916307
  Distance between 3'-terminus of neighbour sequence of sequence listing upward to telomere on chrosomal short arm and 5'-terminus of this base sequence : -251
caatgtcctaacacctggtacctatgaatgtgatgttatttagtaataatgtctttgcagatgtaattagttaagatggaatcatcatacaatgactggcatccgtaagagaaaacacacacacacacacacacacacacacacacacacacacagagagagagagagagagagagagagagagagacagagagagaaacatgcagagagagagagaaaagacagaagcagagattggtgtcatgctttcacagcaaagggatgctgagattgctggcaatcaccaaaagctaggaaaagataaggaaggatcattccctgcagcctttggaggaagtgtggccctgtatatacctttatttcagacttgtagcctc

SEQ ID NO: 3164 - DNA, 451 bp, Homo sapiens
  AC069062.2_51439
  Located on chromosome 2
  Distance between a terminus base of telomere on chromosomal short arm and 5'-terminus of this base sequence : 100917675
  Distance between 3'-terminus of neighbour sequence of sequence listing upward to telomere on chrosomal short arm and 5'-terminus of this base sequence : 991
ttagccaggtgtattggtagacacctgtaatcccactacttgggaggctgagggaggagaatcgcttgaacctgggagacagaggttgcagtgagccgagattgcagcactaactccagcctgggtgacagagtgagattgtctcaaaaaaaaagaaagaaagaaagaaagaaagaaagaaacccagagtgtgtctgctacctttcatcatgtgaggacacagtaaaaaggcaccatttatgggtcatgaaacaggtcctcaccagacaccaaacctgctggaaccttgatcctggactttccaacctccagaactgtgagaaataaatttttgttgtttattagtcacccagcctaaggtagtttattatagcaacctgaatgcactaagatacaccctcagtaaagccagggaagcctccctccactatagtctaccagtgagtcaggc

SEQ ID NO: 3165 - DNA, 210 bp, Homo sapiens
  D2S160
  Located on chromosome 2
  Distance between a terminus base of telomere on chromosomal short arm and 5'-terminus of this base sequence : 100960100
  Distance between 3'-terminus of neighbour sequence of sequence listing upward to telomere on chrosomal short arm and 5'-terminus of this base sequence : 41974
tggcctccagaaacctccaaaattaaagtacaggtaacagtgtgtgtgtgtgtgtgtgtgtgtgtgtgtgtgcgcgtgtgtatgtgtgttgtgttttgtgtgtgtgtgtgtgtgtgtatgggaggcatgaagtgcattcatcaggaattaagagtcaaatttctgatagacaaaaaggaagttatgctctaaagggtgggcttaggtaca

SEQ ID NO: 3166 - DNA, 400 bp, Homo sapiens
  AC036182.2_139470
  Located on chromosome 2
  Distance between a terminus base of telomere on chromosomal short arm and 5'-terminus of this base sequence : 101048435
  Distance between 3'-terminus of neighbour sequence of sequence listing upward to telomere on chrosomal short arm and 5'-terminus of this base sequence : 88125
atagtgttattgcagatgcaatcagttaagatgagatcatacaggagtagtatggtccctggtcagtccctactccaatatgactgaagccctcataggaaggggaagtgtgtgtacacacacacacacacacacacacacacacacacacacacatgcaggacactgtgtaaagactggagttctgctgccaaagccaaggaaatactagaaatgagggaagactcctggaacacatccttccctaatgccttcagagggagcctggcttagccgacacctcagtcttgactttctggcctccggaaccatgagtctcattgttcattcccatggttctaagccacccagtttgtgatgctttgttacagcagccctggagaactaatacaaacttcaa

SEQ ID NO: 3167 - DNA, 240 bp, Homo sapiens
  D2S2264
  Located on chromosome 2
  Distance between a terminus base of telomere on chromosomal short arm and 5'-terminus of this base sequence : 101290979
  Distance between 3'-terminus of neighbour sequence of sequence listing upward to telomere on chrosomal short arm and 5'-terminus of this base sequence : 242144
tcgaatgaacagtgcctccccttctttttatgtaaaaaacccaaaactcaagttaagttacatatgcttggttgatgatgatgatgatgtgtgtgtgtgtgtgtgtatgtatgtgtgtgtgtgtttgtgtgtgtgtctgtctgtgtctgtgtctgtctgtgtgcacaggccatgaaactatttgatgattaaacagtttggattgtcttttaattgtatagtgacatgccctttgagatg

SEQ ID NO: 3168 - DNA, 293 bp, Homo sapiens
  HUMUT1265
  Located on chromosome 2
  Distance between a terminus base of telomere on chromosomal short arm and 5'-terminus of this base sequence : 101443296
  Distance between 3'-terminus of neighbour sequence of sequence listing upward to telomere on chrosomal short arm and 5'-terminus of this base sequence : 152077
gagcccagggtgaaagaagaaggggatgggggtactagtcagggttcttcagagaaacagaaccaatactacatctgtctccatctctatctctagctctagctctatctctatctctatctctatctctatctctatctctatctctatctctgtctctgcctctatgtctgtctctgtctctgtctctatatctatctatctatctatctatctatctatctatctatctatctatcatctatctttctatgtataaagagattgattataaggagttgacgcatgtgatt

SEQ ID NO: 3169 - DNA, 421 bp, Homo sapiens
  chr2.fa.O7frz.106333813
  Located on chromosome 2
  Distance between a terminus base of telomere on chromosomal short arm and 5'-terminus of this base sequence : 101611300
  Distance between 3'-terminus of neighbour sequence of sequence listing upward to telomere on chrosomal short arm and 5'-terminus of this base sequence : 167711
tgtttatacataggacagccacagtggctcacacttgtaatcccagcactttgggaggccaaggcagacagatcacctgaggtcaggagttccagaccagcctggccaacatggcgaaaccccacctctactaaaaatacaaaaatgttagctggtcatggtggcgtgcacctataatcccagctacttgggaggctgaggcaggagaatctcttgagccctagaggtggagtttgcagttagccgagatcacgccattgcactccagcctgggtgacagagtgagactgtgtcttaataaaataaaataaaataaaataaaataaaataaaataatgtaacatgaattcaatgtaaaaaaatttagaaatatgcctacagtgcctcatatgggtctttcttggttgataggaatgagact

SEQ ID NO: 3170 - DNA, 466 bp, Homo sapiens
  chr2.fa.O7frz.106488512
  Located on chromosome 2
  Distance between a terminus base of telomere on chromosomal short arm and 5'-terminus of this base sequence : 101766076
  Distance between 3'-terminus of neighbour sequence of sequence listing upward to telomere on chrosomal short arm and 5'-terminus of this base sequence : 154355
ttagtggctaatctaacagcattcttagaaacagtgcgtttctattccctgggaaaggtgacgcatgcctgtagtcccagctactcacgaggctgaggctggagaatcacttgaacccgggaagtggaggttgcagtgagcttagatcgtgtcactgcactccagcctgggtgaaagagtgagactccatctcaaaaaacaaacaaacaaacaaacaaataaataaataaataaataaataagaaaaaaaccccagtaaaacagtgcatatcttttgaaatttcctttaggtttcttttgaggttttttttttttttttgtctctacccaaaaaaattgctgacttactatgtgataaggtcattcattctctctatctgttctgttctgtgataaaaatcaaccacccctagtgtttgaacccacaggttaagtacttgagatccacaatcttaatcagaagtta

SEQ ID NO: 3171 - DNA, 347 bp, Homo sapiens
  AC069485.2_89611
  Located on chromosome 2
  Distance between a terminus base of telomere on chromosomal short arm and 5'-terminus of this base sequence : 101959954
  Distance between 3'-terminus of neighbour sequence of sequence listing upward to telomere on chrosomal short arm and 5'-terminus of this base sequence : 193412
cactatgaatttgcatctaggtgttagcccttctcaaccattcctttctcaatttcccagtgatgttagctgagtgtgtgtgtgtgtgtgtgtgtgtgtgtgtgtgtgtgtgtgtgtgtgttggctggggggaaatcccctgcactcactaatatgaactaagaaaaaacaaaacacaaagcatcttgcagtttgatgtaaaagagatgttggggtagtatatggatgatgtattattctcattttttactgagtatcagtaatcattgcaaaagtgttgtatcttatcctaaaagtataagaaatgtaatttaaaataaaaactaacatttaagtgccaactacat

SEQ ID NO: 3172 - DNA, 261 bp, Homo sapiens
  AC069485.2_134817
  Located on chromosome 2
  Distance between a terminus base of telomere on chromosomal short arm and 5'-terminus of this base sequence : 101987074
  Distance between 3'-terminus of neighbour sequence of sequence listing upward to telomere on chrosomal short arm and 5'-terminus of this base sequence : 26773
atgatagacagcagatggatagatgatatatagatggatagatagatagatagatagatagaattagaaaatacatatctgtagtagttttctctaggagggattgtgggacttttgtgggggtttccctttgctcttttgtttctggacaatttctacactttttcatgtatattcttaaccaaattcagtttaagatctctgcaagtctttctctttttaagtaattcttttcctaatacgagaaattcacaatgttca

SEQ ID NO: 3173 - DNA, 222 bp, Homo sapiens
  D2S373
  Located on chromosome 2
  Distance between a terminus base of telomere on chromosomal short arm and 5'-terminus of this base sequence : 102012351
  Distance between 3'-terminus of neighbour sequence of sequence listing upward to telomere on chrosomal short arm and 5'-terminus of this base sequence : 25016
ttgatgataatggtgataggaattgtgtgtgtgtgtgtgtgtgtgtgtgtgtttgtgtgcttgcgtgtgtaggtatccttaattggcaaaattaaaaaccaagagccttatggaaattcccaaagtagtttagatattttcctttcttattaaattcactggcctggcatcaaaaacatgacctggaaaggaaagtgtatgtaaggggcaggccaagtctgt

SEQ ID NO: 3174 - DNA, 326 bp, Homo sapiens
  AC069485.2_99565
  Located on chromosome 2
  Distance between a terminus base of telomere on chromosomal short arm and 5'-terminus of this base sequence : 102034236
  Distance between 3'-terminus of neighbour sequence of sequence listing upward to telomere on chrosomal short arm and 5'-terminus of this base sequence : 21663
acaaggtcatgagatcgagaccgtcctggctagcacagtgaaactccgtctctactaaaaatataaaaaattagccgggcgtggtggcgggcacctgtagtcccagctactcgggaggctgaggcaggagaatggcgtgaacctgggaggcggagcttgcagtgagccgagatggcgccaccgcactccagcctgggcgacagagcgagactccatctcaaaaaacaacaacaacaacaacaacaaaaagtgtacatccagagatgtaagaagagcaatgaaagcagctgtcatctggaagatatttgacaaatcaggtgaatcta

SEQ ID NO: 3175 - DNA, 212 bp, Homo sapiens
  AC007239.2_65799
  Located on chromosome 2
  Distance between a terminus base of telomere on chromosomal short arm and 5'-terminus of this base sequence : 102152156
  Distance between 3'-terminus of neighbour sequence of sequence listing upward to telomere on chrosomal short arm and 5'-terminus of this base sequence : 117594
ccatttctttgtaacaaaatgtaagataaatctatttttaattgttcttgaagaataagaaaacctagtgtttcatttacaaaatatgtatgaagtttcagcagatgcacacacacacacacacacacacacacacacatacatatgagtttgctgcctctttgcttgaagaaaattcctttgggtgtgtctcagttacaccagacatgtat

SEQ ID NO: 3176 - DNA, 476 bp, Homo sapiens
  chr2.fa.O7frz.106945882
  Located on chromosome 2
  Distance between a terminus base of telomere on chromosomal short arm and 5'-terminus of this base sequence : 102223524
  Distance between 3'-terminus of neighbour sequence of sequence listing upward to telomere on chrosomal short arm and 5'-terminus of this base sequence : 71156
gaactgtggattacaatagtgaagctccgcagcacctgccacatggcaggtgttcagaaatgccatgaatcagcttactaaactttccattctacgtgggaaattagcactcagggagcaaaccaggacacgcgcgcgcgcacacacacacacacacacacacgatgaaaccaaaccgccattgtgcaatgcacaccctttgtccaaaggtagatgggtacaattcactctgatctgcatttttaaacattcaagtcaaccgagagctctagtgaaaatgcacccaattctgtacaagtggggtcatcaacagcggcttctccagcctggtctggtaaaaaagcaaaccacaggcacacacatcatgatgaaaccaaacctacgctgtgcaatgcgcagtttgtcgaaaggcagatgggtaaaattcactctgatctgcattttttaatatttaagtcaaccaagaatcctagtga

SEQ ID NO: 3177 - DNA, 413 bp, Homo sapiens
  chr2.fa.O7frz.107022419
  Located on chromosome 2
  Distance between a terminus base of telomere on chromosomal short arm and 5'-terminus of this base sequence : 102300042
  Distance between 3'-terminus of neighbour sequence of sequence listing upward to telomere on chrosomal short arm and 5'-terminus of this base sequence : 76042
tctacctgaatacagtgtccttctgtttcctctcttgaccacatgtctcatgcaggctgccatgattaattcttgcttccatatccactaaaccattggcctttggtgtaaattccttctcattgtctgtctctctctctctctctttgtctacacatgtacacacacacacacacacacacacacacacacacacacacacacactggtttaccccatgggtgagatataaactgatctgatacaaattaaatggacagtatcttcaattagtgaacaagttaaagactatagtgatagaaatgactacttttccttcttttaaatggaatttcccttcaaataatgacaatatttaaatataagttaattctttcctattaaaaatcatctacctgattacctgcaataca

SEQ ID NO: 3178 - DNA, 130 bp, Homo sapiens
  D2S2356
  Located on chromosome 2
  Distance between a terminus base of telomere on chromosomal short arm and 5'-terminus of this base sequence : 102377795
  Distance between 3'-terminus of neighbour sequence of sequence listing upward to telomere on chrosomal short arm and 5'-terminus of this base sequence : 77340
agctgcttattcaaataccctgttcattatttcttcctctaagaatgagactgttgtgtgtatatgtgtgtgtgtgtgtgtgtgtgtgtgtgtgtatgtgtgtatgtagggcaaaagtaggaatgtaatg

SEQ ID NO: 3179 - DNA, 365 bp, Homo sapiens
  chr2.fa.O7frz.107331667
  Located on chromosome 2
  Distance between a terminus base of telomere on chromosomal short arm and 5'-terminus of this base sequence : 102610257
  Distance between 3'-terminus of neighbour sequence of sequence listing upward to telomere on chrosomal short arm and 5'-terminus of this base sequence : 232332
ctggtttagcagtacaatgaatactcagggctgtaaattggcataacaaatcttcgtgcccaaaaaaatcacatatgtttgaatacaaacacacacacacacacacacacacacacacacacacagacgtaagtcaaatatacatcacagtcaatatgggcataatggtactcatccccaaacctcaaggaatatcaacatttatttcatgctgacattcaaattctgatgcgtttaggcatgttgaactcatggcaatctgaaaaatgcctactaggtatttcttagagtctatttaaaatttgagatttaaaaaaatcaaattatttatctatttatttgatatggcttagacctcagatact

SEQ ID NO: 3180 - DNA, 204 bp, Homo sapiens
  D2S299
  Located on chromosome 2
  Distance between a terminus base of telomere on chromosomal short arm and 5'-terminus of this base sequence : 102833306
  Distance between 3'-terminus of neighbour sequence of sequence listing upward to telomere on chrosomal short arm and 5'-terminus of this base sequence : 222684
tttcaaatggcagcaactgagtgtttgggagagtggatatttgggtgggcatgggagaccagcactggtacattgaatctaggaatgcatatttcacgcacacacacacacacacacacacacacacactaaatggttaaggataagtgcaagagaatgaagaggaagatatttgaaagtgatacattctgggtattacacaat

SEQ ID NO: 3181 - DNA, 381 bp, Homo sapiens
  AC011593.4_14532
  Located on chromosome 2
  Distance between a terminus base of telomere on chromosomal short arm and 5'-terminus of this base sequence : 102906417
  Distance between 3'-terminus of neighbour sequence of sequence listing upward to telomere on chrosomal short arm and 5'-terminus of this base sequence : 72907
tactcattatggcagacctagttgacaaatacggctcacctatgaaatgtaaagctccatcatgcagtctttgaatctcccagggttctgagatatgatttaataaatatttgtagaatgacaaaattttatctgtgatgactatgtcacacacacacacacacacacacacacacacacacacacacccctttaggccacccactgtgtcacattcctctcccttctttccttgaaagcactgcttccaaggaaagaataatcactttacttggaaataaattatcctctaaattagaaatatgtgcctttcaaaatttgaatatcaatctctgtaggtgaattttatctccctttatgctttacaagtaggtttacttg

SEQ ID NO: 3182 - DNA, 472 bp, Homo sapiens
  chr2.fa.O7frz.108151043
  Located on chromosome 2
  Distance between a terminus base of telomere on chromosomal short arm and 5'-terminus of this base sequence : 103224257
  Distance between 3'-terminus of neighbour sequence of sequence listing upward to telomere on chrosomal short arm and 5'-terminus of this base sequence : 317459
tcctaactcattctatgaagtcagcatcatcctgaaaccaaaagctggtagagatacaacaacaaaaaaaaagaaaacaaaagaaagaaggaaagaaagaaagaaagacagagagagaaagaaagaaagaaaggaaagaaagaaagaaagaaagaaagaaagaaagaaagaaagaaagaaagaaagaaaaagaaaacttcgggccaatattcctgatgaacattgatgcaaaaagtctcaataaaattctgacaaactgaatatagtagcacaccaaaaagtttatccaccaccatcaagttggcttcatccaagggtggttcaacatacacaaatcaataaatgtaattcatcacataaacagatctaaagacaaaaacttcatgattatttcaatagacacagaaaaggtcttcaacaaaattcaacatcccttcatgttaaaaactctccataacctaggtattgaaga

SEQ ID NO: 3183 - DNA, 435 bp, Homo sapiens
  chr2.fa.O7frz.108258129
  Located on chromosome 2
  Distance between a terminus base of telomere on chromosomal short arm and 5'-terminus of this base sequence : 103328848
  Distance between 3'-terminus of neighbour sequence of sequence listing upward to telomere on chrosomal short arm and 5'-terminus of this base sequence : 104119
gagtaggcttcgatctatgaactttggagatacacaaaccttcagaccagagcatcagcattaaccacatctgcctaattttcaagaggctccatttattgttaacattatattatcccctttctcctctcttagcagtcctcgaggatccaagtggcattgtttgtttgtttgtttgtttgtttaattttactttgagttctgggatacatgtgcagaatgtgcaggtttgtcacataggtgtacaagtgccatggtggtttgctgcatgcacccatcaacccaaagcttccataaactacatgtggctgcttttgaaatgtgttgcgtttttctacctttgattttgatgaaaacgccagccattgctctaatgtgctccataattataatttgtttaattatgataagcttacaaagtaggacttacggtta

SEQ ID NO: 3184 - DNA, 241 bp, Homo sapiens
  G10097
  Located on chromosome 2
  Distance between a terminus base of telomere on chromosomal short arm and 5'-terminus of this base sequence : 103361664
  Distance between 3'-terminus of neighbour sequence of sequence listing upward to telomere on chrosomal short arm and 5'-terminus of this base sequence : 32381
gtgaaatgtccttctgcagtgcccaaatttgaattacaagtatttccagagtaattcatcaataatgattttctttagttatatacctctgatctcatgacattggtatgctaacacaaggtagacagacagatagatagatagatagatagatagatagatagatagatagacagattcatctgctataaatacactacttgggtgacaactattttcctgaagcttagcttaaatgact

SEQ ID NO: 3185 - DNA, 159 bp, Homo sapiens
  chr2.fa.O7frz.108355415
  Located on chromosome 2
  Distance between a terminus base of telomere on chromosomal short arm and 5'-terminus of this base sequence : 103421520
  Distance between 3'-terminus of neighbour sequence of sequence listing upward to telomere on chrosomal short arm and 5'-terminus of this base sequence : 59615
aataagcaggtacaagtttctagtcagcaacttgaattttccataagacaacattgttttcaggtgataaattttttttttaaattagctttcttaaaaaaaattgtgtgtgtgtgtgtgtgtgcgcatgtttgtgtatcaggtatgaatcttggatta

SEQ ID NO: 3186 - DNA, 402 bp, Homo sapiens
  HUMUT5000
  Located on chromosome 2
  Distance between a terminus base of telomere on chromosomal short arm and 5'-terminus of this base sequence : 103497282
  Distance between 3'-terminus of neighbour sequence of sequence listing upward to telomere on chrosomal short arm and 5'-terminus of this base sequence : 75603
gtttgcagtgagccctggccatgccactgcgctccaaactgggcaacagagtgagaccctgtctcaaccaaaaaaagaaaagaaagaaagaagaaggaaggaaggaaggacggaaagaaggagagagagaaagaaagaaagaaagaaagaaagaaagaaagaaagaaagaaagaaagaaagaaagaaagaaggaaggaaagaaggaaagaaggaaagaaagaaagaaagaaagagagagagagagaaagaaaggaaggaaggaaggaaggaaggaaagaaggaaggaaggaaggaaggaaggaaggaaggaaggaaggaaggaaggaaggaaattcttataaacatgcaaaacaagattaatagttattaaattttttgaaaggcagactctcgctctgtca

SEQ ID NO: 3187 - DNA, 115 bp, Homo sapiens
  DISD22_0001745
  Located on chromosome 2
  Distance between a terminus base of telomere on chromosomal short arm and 5'-terminus of this base sequence : 103594567
  Distance between 3'-terminus of neighbour sequence of sequence listing upward to telomere on chrosomal short arm and 5'-terminus of this base sequence : 96883
ttaccaggagatgggtatgacaaaataaaaggatatttgggtttttatagtgctcgtgtgtgtgtgtgtgtgtgtgtgtgtgtgtgtgaatgttacatgtgcatgtatattggaa

SEQ ID NO: 3188 - DNA, 108 bp, Homo sapiens
  DISD22_0001749
  Located on chromosome 2
  Distance between a terminus base of telomere on chromosomal short arm and 5'-terminus of this base sequence : 103700486
  Distance between 3'-terminus of neighbour sequence of sequence listing upward to telomere on chrosomal short arm and 5'-terminus of this base sequence : 105804
ggttctgcagagaaacagcatgtgtgtgtgtgtgtgtgtgtgtctgtgtgtgtataaaaatggtagaagcaaaaattataaaaccacatgaaatggtactatagaaga

SEQ ID NO: 3189 - DNA, 185 bp, Homo sapiens
  Z67545
  Located on chromosome 2
  Distance between a terminus base of telomere on chromosomal short arm and 5'-terminus of this base sequence : 103768966
  Distance between 3'-terminus of neighbour sequence of sequence listing upward to telomere on chrosomal short arm and 5'-terminus of this base sequence : 68372
gaaactgtgaaaaataccatagaatgtgccgaataatgtattacaagaaaaatgtttttcatcaacacacacacacacacacacacacacacacatacacacagaaaaaaaaaactggctcagatttaaaacatgcatttgatcatatatctataatattttccttatgtttatagcatgtaggt

SEQ ID NO: 3190 - DNA, 108 bp, Homo sapiens
  G12437
  Located on chromosome 2
  Distance between a terminus base of telomere on chromosomal short arm and 5'-terminus of this base sequence : 103940893
  Distance between 3'-terminus of neighbour sequence of sequence listing upward to telomere on chrosomal short arm and 5'-terminus of this base sequence : 171742
tgtatgggtacatagaaatagatgatagatgatagatagatagatagatagatagatagatagatagatagatgatacaaagataggagtaatctgaatgaaatcctc

SEQ ID NO: 3191 - DNA, 470 bp, Homo sapiens
  AC013402.5_112980
  Located on chromosome 2
  Distance between a terminus base of telomere on chromosomal short arm and 5'-terminus of this base sequence : 104097181
  Distance between 3'-terminus of neighbour sequence of sequence listing upward to telomere on chrosomal short arm and 5'-terminus of this base sequence : 156180
gtacaagcaatacaaaggatttacattttgtaacattattatcaaaatcattaagacatacttaaaaacacagctctctacgatatttttatgatgaaactctgggaaaaattcatctctattgttatatttacctaagataatgtgttcaaataatatagctcaggtaagaggatttttatgagcacgttataaatactgtgtcttaagagcatacattgaaatgatgtctctactatccgtgtgtgtgtgtgtgtgtgtgtgtgtgtgtgtgtgtatctagcatagcctcacttgcatttgggcattactttattgcactgtaggcttgtgaaggtaaagggttatatatgatctttatcgtgtttcctaggaagccaattcaccctttgtgcccaatagatgattaaaagtattcattgttagaaaacgttaccctgactcaaacatcagacatgactagtgatgct

SEQ ID NO: 3192 - DNA, 346 bp, Homo sapiens
  AC068057.1_53462
  Located on chromosome 2
  Distance between a terminus base of telomere on chromosomal short arm and 5'-terminus of this base sequence : 104199455
  Distance between 3'-terminus of neighbour sequence of sequence listing upward to telomere on chrosomal short arm and 5'-terminus of this base sequence : 101804
ttaagagtctataggccaggacttctaaaactcggcaatttaactatttctgctataaaatatacatacagaaattgtatcagctagaaaaatattaattttgagaaatcaaaagctaagttagatttgatttggggaatattttccaaacaaaagaaaataatcctaaagtcaaaactctgagctttttattatattgcaaggaaagcatatagaggaattgggttgtttagtgtgtgtgtgtgtgtgtgtgtgtgtgtgtgtgtgtcttctcaaagaactgtagatttacacacagagcattgtaaccaacttcatccccatctagtatgcagtgagaagcttg

SEQ ID NO: 3193 - DNA, 97 bp, Homo sapiens
  D2S2364
  Located on chromosome 2
  Distance between a terminus base of telomere on chromosomal short arm and 5'-terminus of this base sequence : 104207941
  Distance between 3'-terminus of neighbour sequence of sequence listing upward to telomere on chrosomal short arm and 5'-terminus of this base sequence : 8140
ctccatgtaccaattcaggctgtggctagatacacacacacacacacacacacacacacacacacaaactcatcacttactcacacatcctgcctgg

SEQ ID NO: 3194 - DNA, 229 bp, Homo sapiens
  D2S1321
  Located on chromosome 2
  Distance between a terminus base of telomere on chromosomal short arm and 5'-terminus of this base sequence : 104218827
  Distance between 3'-terminus of neighbour sequence of sequence listing upward to telomere on chrosomal short arm and 5'-terminus of this base sequence : 10789
tctcaagaaacctcaaatagccaaaacaatttttaaaatgaagaacaaagttgttgtgttcacatttcctgatttcaaaacatattacaaagctacagtaatcaaaacagtgtagtaatggcataatgacagacatataaaccaaaataataataataataataataataataataataataatagaataaagatcccagaaataagcacttgcctatatggttaaatg

SEQ ID NO: 3195 - DNA, 392 bp, Homo sapiens
  AC018730.4_47655
  Located on chromosome 2
  Distance between a terminus base of telomere on chromosomal short arm and 5'-terminus of this base sequence : 104235015
  Distance between 3'-terminus of neighbour sequence of sequence listing upward to telomere on chrosomal short arm and 5'-terminus of this base sequence : 15959
ttctcagttgtattaaacgtatgagagaacacctgtttcatgttacccacccacaactcggctgtgtgattagatggagcacacactatcaagaacaaaaaatatttgtgggaaagaatggcttgacaagttaacaaaattttttatgttctttccaattcagagagagagagagagagagagagagagagagagaaaggagccaaattgccagaggatagaaacactttgtttctacttgaactctcataaaaggcttctgaatgaggtttttgacattggaacggagggtatttttatgatggatattttaaccttttcctcaaaagctgagattttgcaatcacaacccactgtttcccaatgatgatgacttaaggagaagtagcatt

SEQ ID NO: 3196 - DNA, 381 bp, Homo sapiens
  AC018730.4_59429
  Located on chromosome 2
  Distance between a terminus base of telomere on chromosomal short arm and 5'-terminus of this base sequence : 104295242
  Distance between 3'-terminus of neighbour sequence of sequence listing upward to telomere on chrosomal short arm and 5'-terminus of this base sequence : 59835
tgttcagttctgttaggaccaccacaacctcaaagaatcaaaccatttttctgataaagctgaattaatatttctgggcgttgtttttacacacatacaaatacacacaaaacccaccaagctgaccttggaatatttttctagctaagaaatgaccaaattttgtcaatgaatcatcatcatcatcatcatcatcatcatcatctctggtcaatcagcctggctctatgttacctagccctgtgaatttaaatttgaaaaagagcattgcactcagtggggaggcagggagtgtggtgagggggcaggcaggaacagtccatcacactgtgacagctccagcttccctggcaattggtagctttcattaccagacttgtc

SEQ ID NO: 3197 - DNA, 270 bp, Homo sapiens
  D2S1343
  Located on chromosome 2
  Distance between a terminus base of telomere on chromosomal short arm and 5'-terminus of this base sequence : 104311391
  Distance between 3'-terminus of neighbour sequence of sequence listing upward to telomere on chrosomal short arm and 5'-terminus of this base sequence : 15768
tactgataattgtcaactgaacccttttgaaacacaggtttaaataaaccttttcataaacatgtccactctctccctcagtccctcctaccctctgatcctgttcttccccagcctcataataacaattattattattattattattattattattattattattattattattctggaaacgctcaggcctgtggagccctagagactaaagggcagtcagcagagtaatgagcaaacctgggggctggagaaagtccaaggaattga

SEQ ID NO: 3198 - DNA, 137 bp, Homo sapiens
  D2S135
  Located on chromosome 2
  Distance between a terminus base of telomere on chromosomal short arm and 5'-terminus of this base sequence : 104343363
  Distance between 3'-terminus of neighbour sequence of sequence listing upward to telomere on chrosomal short arm and 5'-terminus of this base sequence : 31702
aaaaatcaaacctccgagcccagactggggcatcttcaccatgtgtgtgcacaggtgagtgtgtgtgtgtgtgtgtgtgtgtgtgtgtgtgtattttctcactggccctatccctcaagcgtcatccacacttcaca

SEQ ID NO: 3199 - DNA, 467 bp, Homo sapiens
  AC012360.4_103399
  Located on chromosome 2
  Distance between a terminus base of telomere on chromosomal short arm and 5'-terminus of this base sequence : 104625642
  Distance between 3'-terminus of neighbour sequence of sequence listing upward to telomere on chrosomal short arm and 5'-terminus of this base sequence : 282142
ttacagaccgtagacctgaaagatgatataaaaggataactgaaattacaggctacaaagtctaataaaatagcactcgggtttccccagattcttgacatcagtgtttattttctgcataacactggaaaggaattcttttctagactctctttctctctttcttttcttttctttctttctttctttctttctctttatttctttatttctttcctttctttccttccttccctctctccctccctcccttccttctttccttcgctactctctctccctccttccttcctccttctctccttccttccctctttcctcccttccctgcttcctttcttttgcctccaaactgtatgcagaacttttatattactttaatttgaaattaatgtaaggaagtaaagagagttcctaaatagtattttataaattgtacgtgggtgtatatcattacggaagcattt

SEQ ID NO: 3200 - DNA, 443 bp, Homo sapiens
  AC068362.3_11876
  Located on chromosome 2
  Distance between a terminus base of telomere on chromosomal short arm and 5'-terminus of this base sequence : 104707244
  Distance between 3'-terminus of neighbour sequence of sequence listing upward to telomere on chrosomal short arm and 5'-terminus of this base sequence : 81135
cttggactgaattatgtcacaggtcttcctgggtctccagaagctgatggcagaacatagaaacttctcagcctccagaatggcctgaaccaattcctcacaataaatcagtctctcaatcacacgccctttctctccccacccctacacacacacacacacacacacacacacacacacacacacacactgtctctctctctctcctattggttctctttctctggagaaccctgcctgttgcaatgtgcatcctggcacggccatggcagtgggaaaagctgaccttccctgtcggttgctgcttaagaagcagcttgttttccagcatttgtgtaaacacaagatacctgaaaattacaccagtaggcgcaaatcgagcacagatgggaaactggcactgccactgcatgtttccaatgttgagttgcatgaaattacag

SEQ ID NO: 3201 - DNA, 181 bp, Homo sapiens
  HUMUT7103
  Located on chromosome 2
  Distance between a terminus base of telomere on chromosomal short arm and 5'-terminus of this base sequence : 104769763
  Distance between 3'-terminus of neighbour sequence of sequence listing upward to telomere on chrosomal short arm and 5'-terminus of this base sequence : 62076
ctttctttgcatcttcctacaatttacagtttttgtataaatacaatgacttatttatttatttattttttttttttttgagatggagtctcttgctttgttgcccaggctgcagtgcagtggcacggtctcggctcactgcaacctctgcctcccaggttcaagtgcttctcctgtctca

SEQ ID NO: 3202 - DNA, 479 bp, Homo sapiens
  AC068362.3_182644
  Located on chromosome 2
  Distance between a terminus base of telomere on chromosomal short arm and 5'-terminus of this base sequence : 104820033
  Distance between 3'-terminus of neighbour sequence of sequence listing upward to telomere on chrosomal short arm and 5'-terminus of this base sequence : 50089
ttctcaagactgcaatagacacaccctgcctgagtttccagcctgccgccctacggaattcaaatgctcccatttggaactgcagtatcatctcttccctgagcctccagcctgctgccctgttctatagattccagacttaccgcctccacaatctcatgagccaatcccttgaaatctctctctctctctctctctctctctctctctctctctccttatgtatgtatctatgtgtatacatttccttgattgattctgtttctctggagaacgtgactaacacagaaagtcaagacaggtgaaaaattcaaaatccgggaaatatgcatactttttatgtcatggttggtgctaacagttaaagtctttaaacagcccctagagtccccagtggaagcttccttgggcccttgttcaggaaactagtaagggtttaatttgtttttcaattaatgtcgtggttcttattgttactg

SEQ ID NO: 3203 - DNA, 395 bp, Homo sapiens
  chr2.fa.O7frz.109728085
  Located on chromosome 2
  Distance between a terminus base of telomere on chromosomal short arm and 5'-terminus of this base sequence : 104929824
  Distance between 3'-terminus of neighbour sequence of sequence listing upward to telomere on chrosomal short arm and 5'-terminus of this base sequence : 109312
atgcagattgaatgaccactcacacacctttgcatcagaacttgaatggaagcattaagttggtgatatagagatatataatgcaattatagaatatatttatcatttaatatatgtacatatatatatatatatatatatctagtggttataaacttgtttgggagtttcacatgcacacacttttgaaccaaagggaacagaacacattttgtcaaattcagcaggctctttaatcatgttgggtgcctggtgtggaggctacacttgaattttggaaatgataaaattttatttacccttagtaaaatatagtttcctggtttggggcctgggcagaagaaagccttttaaaagaggcttattgaaatctcttaaagtgttcttggacatta

SEQ ID NO: 3204 - DNA, 359 bp, Homo sapiens
  chr2.fa.O7frz.109611707
  Located on chromosome 2
  Distance between a terminus base of telomere on chromosomal short arm and 5'-terminus of this base sequence : 105003035
  Distance between 3'-terminus of neighbour sequence of sequence listing upward to telomere on chrosomal short arm and 5'-terminus of this base sequence : 72816
tataggaaatctcaatttgtcaaggcatcaaatgtcaattctccccaaatttatagatttaatgcaatacaatctctcagcaggtgtgtgtgtgtgtgtgtgtaaattgaaaagctgaacctaaaatttatggaaatacctgggaaataaatgtttagaaaaatacaaaaaacaaaggtgaaagatatacattatcagatatcaagacctataattaagctagagtaattaagacaatataataccaatgcaaagattaacaaatagtctgtgaaaaagaatagagaatctagacatagattcaaacataaatgaatgctttattactgtcatatgtgtttatgactaaggagtactgg

SEQ ID NO: 3205 - DNA, 314 bp, Homo sapiens
  AC026642.3_136319
  Located on chromosome 2
  Distance between a terminus base of telomere on chromosomal short arm and 5'-terminus of this base sequence : 105165571
  Distance between 3'-terminus of neighbour sequence of sequence listing upward to telomere on chrosomal short arm and 5'-terminus of this base sequence : 162177
tcaaatgtcttgatttggtctctattttaggttctgatattccaatatcaagagttttgtgcccatttttcatgttaagttgtccctctcgtcttttggcatttgctcctggagaacagaaaatttaagtttacgagtcatcatatcagctccgagattgacatttggtcacactaaccttgggaagattcctgtgataacagaagtgaaatggcctttatctttttgacaatcccacttgattttattttattttattttatttttttggccttcaaagtggatgtccagacttgagaatgctgagtgaattt

SEQ ID NO: 3206 - DNA, 333 bp, Homo sapiens
  AC018802.5_62929
  Located on chromosome 2
  Distance between a terminus base of telomere on chromosomal short arm and 5'-terminus of this base sequence : 105184345
  Distance between 3'-terminus of neighbour sequence of sequence listing upward to telomere on chrosomal short arm and 5'-terminus of this base sequence : 18460
ttaatcaagtgctactggatttacaaaaggtaaaagaaattcacagtctatgcttacatggaccagtggttctcaaagtgtggcctgtgggccagcagcatcagcatctccaaggaattaccaaaaaagcaaattctcaggcttcgccccagcattttgatttagacatgcaggggcttggcccagcatctgtctttggctttttggggtgtgtgtgtgtgtgtgtgtgtgtgtgtgtgtgtgtgtctgagacagagttttgctggagtgtggtggctggagtgtcgtggagtgtggctggagtatggtggctcaatcacagtttactgaagc

SEQ ID NO: 3207 - DNA, 393 bp, Homo sapiens
  AC026642.3_117539
  Located on chromosome 2
  Distance between a terminus base of telomere on chromosomal short arm and 5'-terminus of this base sequence : 105184345
  Distance between 3'-terminus of neighbour sequence of sequence listing upward to telomere on chrosomal short arm and 5'-terminus of this base sequence : -333
ttaatcaagtgctactggatttacaaaaggtaaaagaaattcacagtctatgcttacatggaccagtggttctcaaagtgtggcctgtgggccagcagcatcagcatctccaaggaattaccaaaaaagcaaattctcaggcttcgccccagcattttgatttagacatgcaggggcttggcccagcatctgtctttggctttttggggtgtgtgtgtgtgtgtgtgtgtgtgtgtgtgtgtgtgtctgagacagagttttgctggagtgtggtggctggagtgtcgtggagtgtggctggagtatggtggctcaatcacagtttactgaagccttgacctcccaggcttaattgatcctcccacctcagccttccaagtagctaggacttca

SEQ ID NO: 3208 - DNA, 178 bp, Homo sapiens
  D2S2229
  Located on chromosome 2
  Distance between a terminus base of telomere on chromosomal short arm and 5'-terminus of this base sequence : 105184491
  Distance between 3'-terminus of neighbour sequence of sequence listing upward to telomere on chrosomal short arm and 5'-terminus of this base sequence : -247
ccccagcattttgatttagacatgcaggggcttggcccagcatctgtctttggctttttggggtgtgtgtgtgtgtgtgtgtgtgtgtgtgtgtgtgtgtctgagacagagttttgctggagtgtggtggctggagtgtcgtggagtgtggctggagtatggtggctcaatcacagtt

SEQ ID NO: 3209 - DNA, 151 bp, Homo sapiens
  HUMUT5125
  Located on chromosome 2
  Distance between a terminus base of telomere on chromosomal short arm and 5'-terminus of this base sequence : 105194136
  Distance between 3'-terminus of neighbour sequence of sequence listing upward to telomere on chrosomal short arm and 5'-terminus of this base sequence : 9467
agtgagccaagagtgtgtcattgcactccagctgaggcgacaagagcaaaactctgtcaaaaaaaagaaagaaagaaagaaagaaagaaagaaagaaagaaagaaagaaagacagacatatgccaaaaagatagtagtggctggattgtgg

SEQ ID NO: 3210 - DNA, 465 bp, Homo sapiens
  AC010978.5_32632
  Located on chromosome 2
  Distance between a terminus base of telomere on chromosomal short arm and 5'-terminus of this base sequence : 105222485
  Distance between 3'-terminus of neighbour sequence of sequence listing upward to telomere on chrosomal short arm and 5'-terminus of this base sequence : 28198
tcctgtttagtgcgtgtattagtcagctccagctgccttaagagaataacacacagaggccgggcgcagtggctcacggctgtaatcccagctactcgggaggctgagtcacgcgaattgcttgaacccaggaggcggaggttgcagtgagccaagatcacaccactgcactcctgggtgacagcgtgagaccctgtctcaaaagcaaacaaacacacacacacacacacacacacacacacaaaacaacaacaacagaatgggtggctaaagctgcagacatttattttctcacagttctggaggctggaagtccatgaccccggggccggcagggctggtttctggtgagtgtctcttcctggctcgtcttcttgtgtcctcactcacgtagccttccttctgtgagtgcactgagagagaggtctggtgtttcttcctcttataagaacatctgtcctgttg

SEQ ID NO: 3211 - DNA, 358 bp, Homo sapiens
  chr2.fa.O7frz.110019948
  Located on chromosome 2
  Distance between a terminus base of telomere on chromosomal short arm and 5'-terminus of this base sequence : 105295524
  Distance between 3'-terminus of neighbour sequence of sequence listing upward to telomere on chrosomal short arm and 5'-terminus of this base sequence : 72574
ggttactttccttgcctagtacggcccagcgttggatggtgacctgtgtctcacacctgaatgttggattccagatactctgtccttgtccttaagaggccctgggccggccgtgtggcggatgtgtatgtaagagaacagcattaaataaacaggccacacagagcttgaaatgagcgcattgctgcagttgaggttctcaaactaggaaaagcagagagaaatttttcttgacttcctccagaaaaacaaaaagtcctctcatgctgtgtgtgtgtgtgtgtgtgtgtgtgtgtgtgtgtgtgtgtcacaatggagggggtgttgtagggcttttagtaaactggaccttgaacag

SEQ ID NO: 3212 - DNA, 414 bp, Homo sapiens
  AC010978.5_129971
  Located on chromosome 2
  Distance between a terminus base of telomere on chromosomal short arm and 5'-terminus of this base sequence : 105337229
  Distance between 3'-terminus of neighbour sequence of sequence listing upward to telomere on chrosomal short arm and 5'-terminus of this base sequence : 41347
ggtacacagttatccttatgacatacttctttatgtcagtgaattttcattttcagatgtgtaaagataatgtaatccagggcctacctcggagagctggcacttctgaggcagctgattaggtacctcagccaggcattcaatttctctcatgttaaagactggacctggccttctcttctttgtccctttcacacatgagtttggccctccgaacccacgggaaagatctgtaacctctagctcacatgtgcatgtacacacacacacacacacacacacacacacacacacacacacacacggttccctgcaaatggatgactttagatgcagttaacaccatccaaataatactagaaagaataacactggaataacaccatccaaataacacgagtaccttcaactaaa

SEQ ID NO: 3213 - DNA, 244 bp, Homo sapiens
  D2S176
  Located on chromosome 2
  Distance between a terminus base of telomere on chromosomal short arm and 5'-terminus of this base sequence : 105375534
  Distance between 3'-terminus of neighbour sequence of sequence listing upward to telomere on chrosomal short arm and 5'-terminus of this base sequence : 37891
ttgtgcactcgttatgagaatgtaactaatgcctgatgatctgagatggaacagtttcatcccaaaaccgtcacacacacacacacacacacacacacacacacaggtttgtggaaaagttgtcttccacaaagccaatccaggttggggactactgatatagaaagaaatgtctgatctttaaggcccagagtgattatttttctcttttgttaactgtcttacttgccttaacctccatcag

SEQ ID NO: 3214 - DNA, 236 bp, Homo sapiens
  D2S1897
  Located on chromosome 2
  Distance between a terminus base of telomere on chromosomal short arm and 5'-terminus of this base sequence : 105402624
  Distance between 3'-terminus of neighbour sequence of sequence listing upward to telomere on chrosomal short arm and 5'-terminus of this base sequence : 26846
aggcattgatataaggctctctctcttactctcagtacatacattatatatatatatatatatgtgtgtgtgtgtgtgtgtgtgtgtgtgtgtgtgtgtgtgtgtgtgtgtattttgagatcttctatgatcatataaatcagagggcaattaagttcttctgcagtctggagggcagaatatcaaaactaggcagagaaaaatagtctcacctggttgagtatcagcaaattcct

SEQ ID NO: 3215 - DNA, 456 bp, Homo sapiens
  chr2.fa.O7frz.110247683
  Located on chromosome 2
  Distance between a terminus base of telomere on chromosomal short arm and 5'-terminus of this base sequence : 105523179
  Distance between 3'-terminus of neighbour sequence of sequence listing upward to telomere on chrosomal short arm and 5'-terminus of this base sequence : 120319
gtaccagtgcagtacattttctacacaaaatctgcacaataatgggttgggtgcggtggctcacgcctgtaataccagcactttgggaggcagaggcaggcagatcatttgaggtcaagagtttgagaccagcctggccaacatggctcaaccctgtctctactaaaaatacaataattagccaggcatggtggcacacgcctgtagtctcagctacttgggaggctgaggcaggaaaattgcttgaacccaggaagtggaggttgcagcacaccattgcactccagcctgggtgacagagcaagactctgtcaaaaaaagaaagaaagggaagggaagggagggaaggaaggaaggaaggaaggaaggaaggaaggaaggaaggaaggaaggaaggaaggaaggaaggaaggaaagaaagaaaagaaatccgcacaataacaagattctggctaa

SEQ ID NO: 3216 - DNA, 448 bp, Homo sapiens
  chr2.fa.O7frz.110338758
  Located on chromosome 2
  Distance between a terminus base of telomere on chromosomal short arm and 5'-terminus of this base sequence : 105615219
  Distance between 3'-terminus of neighbour sequence of sequence listing upward to telomere on chrosomal short arm and 5'-terminus of this base sequence : 91584
ttatggctgagaatatgatcagtcttggagaatgttccatgtgggcttcaaaggaaggtgcattctggcattgttggatgaagtgggcattgtgagggcagaaagagtgaagagatggagggcagcaagggggaaattatcaagggcacagaagacctgatgccaaggttgaggacccgctgaaggagaaagtgaaaaacaggcttcaaaccacagaggcagagaagcatcttatgctctcccaacataaatgccaactgagggaacgcaatactctgagcaaaggacaaagcaccagtcatttattgtatgacttcattcaatgtgtgggtgtgtgggtgtgtgtgtttgcatgtatgtgtgtgtgtgtgtgtgtgtgtcctacacacagtcacagaattggcagaaatggcctagagcagctttggtatcaaagctcgcagttaaa

SEQ ID NO: 3217 - DNA, 122 bp, Homo sapiens
  DISD22_0001754
  Located on chromosome 2
  Distance between a terminus base of telomere on chromosomal short arm and 5'-terminus of this base sequence : 105739020
  Distance between 3'-terminus of neighbour sequence of sequence listing upward to telomere on chrosomal short arm and 5'-terminus of this base sequence : 123353
aaggctttctggaaggtagactgtgtgtgtgtgtgtgtgtgtgtgtacacacatatataattatatagagttatataattacatctgttaatatttaatgtatgtattcatttgagccaaca

SEQ ID NO: 3218 - DNA, 177 bp, Homo sapiens
  D2S293
  Located on chromosome 2
  Distance between a terminus base of telomere on chromosomal short arm and 5'-terminus of this base sequence : 105901472
  Distance between 3'-terminus of neighbour sequence of sequence listing upward to telomere on chrosomal short arm and 5'-terminus of this base sequence : 162330
ccagagtatcgtgagtgtgtgggcatgtgagagagagagagagagagagagagagagagagagagagtgtgtgtgtgtgtgtgtgtgtgtgtgtgtgtgaataaaaggtcttcttttgatcatgttaggtttgagatatcaacaaaacatccaagggatgtcaaataggcacttgct

SEQ ID NO: 3219 - DNA, 160 bp, Homo sapiens
  D2S1393
  Located on chromosome 2
  Distance between a terminus base of telomere on chromosomal short arm and 5'-terminus of this base sequence : 105931965
  Distance between 3'-terminus of neighbour sequence of sequence listing upward to telomere on chrosomal short arm and 5'-terminus of this base sequence : 30316
gagaaagctaaatggagcccttggtgttggaccggaatcaactttcagtataaacccatggttttcacatacacagagacagatacatagatagatagatagatagatagatagatagatagatagatagatgattgatagatgattgatagatgattga

SEQ ID NO: 3220 - DNA, 195 bp, Homo sapiens
  G08161
  Located on chromosome 2
  Distance between a terminus base of telomere on chromosomal short arm and 5'-terminus of this base sequence : 105931998
  Distance between 3'-terminus of neighbour sequence of sequence listing upward to telomere on chrosomal short arm and 5'-terminus of this base sequence : -127
ggaatcaactttcagtataaacccatggttttcacatacacagagacagatacatagatagatagatagatagatagatagatagatagatagatagatgattgatagatgattgatagatgattgatagatagagatacagaaatacagatatgtgcataggcatgtgtttgcatgctcatgttgctcccattc

SEQ ID NO: 3221 - DNA, 412 bp, Homo sapiens
  AC016994.5_131591
  Located on chromosome 2
  Distance between a terminus base of telomere on chromosomal short arm and 5'-terminus of this base sequence : 106119922
  Distance between 3'-terminus of neighbour sequence of sequence listing upward to telomere on chrosomal short arm and 5'-terminus of this base sequence : 187729
gcagctctataaggacatagtgagaaaggtcagctccctgggacgagcatcggtattccatgagaacaccaggtctgttaaaggttacccgtctgcctggtgtgactggctggagaaataaggtagggagaatctagatatggttgaattgtcattgctgctcaaaatttgtttctttgtaacaacaacaacaacaacaacaacaacaacaacaacaacaacaggtgaaattatcttgaaatacaaaagaatgtctgttggtcctgagagtgaaaaaaggaatccttaacagcttcagcttgcaccaagaggatttttttttatcagcttcccttcataagagaggatggaggattttggaagagacagaacctgggagaaattcagtgagctgccacttactgttaactac

SEQ ID NO: 3222 - DNA, 240 bp, Homo sapiens
  AC016994.5_151420
  Located on chromosome 2
  Distance between a terminus base of telomere on chromosomal short arm and 5'-terminus of this base sequence : 106139794
  Distance between 3'-terminus of neighbour sequence of sequence listing upward to telomere on chrosomal short arm and 5'-terminus of this base sequence : 19460
agatcaatgacaattctgatgtcacaatatctccaggcctactaaccaagaaacattcagactggtgcactgaacagaagttgtttctatactccttttccctttaacatttattgctttccttttcccagcagaaaacacacacacacacacacacacacacacacacacacacacacacagagagagagagagagagatcgagagagagagagagagaaagatttcctaatccaataa

SEQ ID NO: 3223 - DNA, 236 bp, Homo sapiens
  AC073105.1_143035
  Located on chromosome 2
  Distance between a terminus base of telomere on chromosomal short arm and 5'-terminus of this base sequence : 106214123
  Distance between 3'-terminus of neighbour sequence of sequence listing upward to telomere on chrosomal short arm and 5'-terminus of this base sequence : 74089
gtaagtttcttattcaacttgcactaaaattattatatgggccagtctccctaactataatttctcctcaattcaatccacccctcatggccaccatattatgctcctaaaacataaaaataatacacacacacacacacacacacacacacacacacacacacacgagtttatctatctctatgcatagaaatatctatgtataagcttatctatgtacagatttaccaatccac

SEQ ID NO: 3224 - DNA, 173 bp, Homo sapiens
  AC005040.2_150462
  Located on chromosome 2
  Distance between a terminus base of telomere on chromosomal short arm and 5'-terminus of this base sequence : 106331273
  Distance between 3'-terminus of neighbour sequence of sequence listing upward to telomere on chrosomal short arm and 5'-terminus of this base sequence : 116914
gcctacagatggcctagtttgggaccttgtgattgcgtgagttaatactttatatatatatatacacacacacacacacacacacacacacacacacatacacattatatatgtatatatatatattctgtccctccggagatccctgactaatacaagaccataactttcca

SEQ ID NO: 3225 - DNA, 227 bp, Homo sapiens
  chr2.fa.O7frz.111226117
  Located on chromosome 2
  Distance between a terminus base of telomere on chromosomal short arm and 5'-terminus of this base sequence : 106485956
  Distance between 3'-terminus of neighbour sequence of sequence listing upward to telomere on chrosomal short arm and 5'-terminus of this base sequence : 154510
cagctgagtcttaaggtagtgtaggtggtcatatacctgttctgatttcgaaggagccaggaccttttctgcttctctacttctggtcctcttcctcttcttttatccccagtctctcccaaaaacataaaaatacacaagcacacacacacacacacacacacacacacttgcactactctaggatttaagcctaaatttgcatccttacatcactaattctatgg

SEQ ID NO: 3226 - DNA, 332 bp, Homo sapiens
  chr2.fa.O7frz.111434739
  Located on chromosome 2
  Distance between a terminus base of telomere on chromosomal short arm and 5'-terminus of this base sequence : 106753626
  Distance between 3'-terminus of neighbour sequence of sequence listing upward to telomere on chrosomal short arm and 5'-terminus of this base sequence : 267443
gtgttgacagcgatgaatataccccactcatttgctgagccctgaggttacttgaggtcatgaaaaatccactgacacaggttgaatcaattctgctaaaggccttttagattcaggctgatggttccagtaaaagttacacacacacacacacacacacacacacacaacagagggtgagagagtactatagaggcattggacatgctaatccattgagtcctttaatgcaaagggacactctgtcttcccattattgtcagccatgggctgaaaaatattgcatttgacacatcttttatacaaccctacttagctatgcatttctatgg

SEQ ID NO: 3227 - DNA, 107 bp, Homo sapiens
  DISD22_0001761
  Located on chromosome 2
  Distance between a terminus base of telomere on chromosomal short arm and 5'-terminus of this base sequence : 106899741
  Distance between 3'-terminus of neighbour sequence of sequence listing upward to telomere on chrosomal short arm and 5'-terminus of this base sequence : 145783
cagatgtatagctctagcaagacacacacacacacacacaaacagagagagagagagagagagagagagagagagagagagtgtagagatgtactggaagtcatcag

SEQ ID NO: 3228 - DNA, 367 bp, Homo sapiens
  chr2.fa.O7frz.111719375
  Located on chromosome 2
  Distance between a terminus base of telomere on chromosomal short arm and 5'-terminus of this base sequence : 107031689
  Distance between 3'-terminus of neighbour sequence of sequence listing upward to telomere on chrosomal short arm and 5'-terminus of this base sequence : 131841
ggtttatctcattaggcaagacaccttgattaagtagccaatggaggaggagtgtgtagcatgggaaggcagaaaggtctaattaaaaaaaaaaatctctctctctctctctctctctctgtctgtctgtctgtctctctctctctctctctctctctctgtgtgtgtgtgtgtgtgtgtgtgtgtgtgtatatatatatataactactactgcagttatttcaaatatatttgatggcctctgaaataactgcagtagtagtacttgtagtttctcacaataacacacttcctgtaagttttccaataaatgatgccagccagaatctggaagaggcagagtctggatgaaataagctcaatataa

SEQ ID NO: 3229 - DNA, 201 bp, Homo sapiens
  G08188
  Located on chromosome 2
  Distance between a terminus base of telomere on chromosomal short arm and 5'-terminus of this base sequence : 107147697
  Distance between 3'-terminus of neighbour sequence of sequence listing upward to telomere on chrosomal short arm and 5'-terminus of this base sequence : 115641
aggaatgaggtggtagtgacatctctccatagatagatgatagatagatagatagatagatagatagatagatagatagatatagagattatatatacataatatacatttacagaacagaaatggagatatgtgatatatatttgctagaaaatatacttatatttcctagttctgtctgttggcaagatctacaagcaa

SEQ ID NO: 3230 - DNA, 216 bp, Homo sapiens
  D2S1890
  Located on chromosome 2
  Distance between a terminus base of telomere on chromosomal short arm and 5'-terminus of this base sequence : 107218863
  Distance between 3'-terminus of neighbour sequence of sequence listing upward to telomere on chrosomal short arm and 5'-terminus of this base sequence : 70965
tttcagatcacctaatgggccaacttgctgtatacagtagccctaccatctctgacctcactaccctcacccaccccatcaacacacacacacacacacacacacacacacacacacacacacactacccctactgcctcatttttactcagtgatttctgatggtaaagtatcccagacataattctcatttattcaatgaccgaccagacagtt

SEQ ID NO: 3231 - DNA, 290 bp, Homo sapiens
  AC013464.2_43773
  Located on chromosome 2
  Distance between a terminus base of telomere on chromosomal short arm and 5'-terminus of this base sequence : 107218881
  Distance between 3'-terminus of neighbour sequence of sequence listing upward to telomere on chrosomal short arm and 5'-terminus of this base sequence : -198
gccaacttgctgtatacagtagccctaccatctctgacctcactaccctcacccaccccatcaacacacacacacacacacacacacacacacacacacacacacactacccctactgcctcatttttactcagtgatttctgatggtaaagtatcccagacataattctcatttattcaatgaccgaccagacagttcctttttctgtatccactcccattttatagctcatttgtacctcccctggtgaagagcaggggagagaattagataagcattgacaagttcc

SEQ ID NO: 3232 - DNA, 198 bp, Homo sapiens
  chr2.fa.O7frz.112021722
  Located on chromosome 2
  Distance between a terminus base of telomere on chromosomal short arm and 5'-terminus of this base sequence : 107340860
  Distance between 3'-terminus of neighbour sequence of sequence listing upward to telomere on chrosomal short arm and 5'-terminus of this base sequence : 121689
aattagtcacggttgaattctccagagatacagaaccaataagatgtatagataagggagatagatacatagataggtggatagatgatagatagatagatagatagatgatagatagatagatagatagatagatagatagatagatagaggagagacaatttattagagaaatggtttacctgattgtcagactga

SEQ ID NO: 3233 - DNA, 201 bp, Homo sapiens
  chr2.fa.O7frz.112224094
  Located on chromosome 2
  Distance between a terminus base of telomere on chromosomal short arm and 5'-terminus of this base sequence : 107535146
  Distance between 3'-terminus of neighbour sequence of sequence listing upward to telomere on chrosomal short arm and 5'-terminus of this base sequence : 194088
tagctgtgtcataggctacaacatctaggtttgtgtaagttcactctaatgtttgcgcaatgaagaaatcagctacagctaatgatgcgtttttcagaacatattcctatccttaagtgacacatgactctgtgtgtgtgggtgtgtgtgtgtgactgtgtgtgggcatgtgtaaaactatacttctgaattggctgtaag

SEQ ID NO: 3234 - DNA, 407 bp, Homo sapiens
  chr2.fa.O7frz.112365963
  Located on chromosome 2
  Distance between a terminus base of telomere on chromosomal short arm and 5'-terminus of this base sequence : 107634916
  Distance between 3'-terminus of neighbour sequence of sequence listing upward to telomere on chrosomal short arm and 5'-terminus of this base sequence : 99569
gagttacaaatacacgtccttaaaggaaataaattcactactttcttgtccaagattatggctaaaattacagctcattggcacagattttatatctatctatctatctatctatctatctatctatctatctatctatctatgtaaaacactgatgaaactgaaaaacttggaacagtatctggtccaaggtagctgcttaataaacgtctgatgaattgaatggaaactggaagactatcatttattatatgagtctttaaagtaacaatgaagtttctatttaaatgtaatttttaaagttttgtaaattgtgttgtcagtactgacaacaataaaataaccaagaaataatatatgagtgcttattgatgaagaaataaattaaatgcagtccaattaggtac

SEQ ID NO: 3235 - DNA, 457 bp, Homo sapiens
  AC019100.3_10875
  Located on chromosome 2
  Distance between a terminus base of telomere on chromosomal short arm and 5'-terminus of this base sequence : 107655202
  Distance between 3'-terminus of neighbour sequence of sequence listing upward to telomere on chrosomal short arm and 5'-terminus of this base sequence : 19879
aattgaagattaggaatggtctctgggagtcttgcaaaacagaggacagacaatgtaaatatatggaattttaacaatgaactctgtacaatatttacttaactccagtatactgagtgttactatgtataataaaaagagtaaaatcaataattagatcatctcaacagatggaaattttactaagcaccaggtgaggagtgcaagatcagaagctctggagactgttctcccctgcccacacccactgacaaccacagtgtgtcccactgcatccactaaccccgacattcttgccctgaaatacacacacacacacacacacacacacacacacacacacacacagagggggacatggaggtttcatggttttattacaggccttgtggtttcctaaaatgaactttcttctacaccaattttaactacggattcagtaaagaggcaatagaat

SEQ ID NO: 3236 - DNA, 169 bp, Homo sapiens
  D2S340
  Located on chromosome 2
  Distance between a terminus base of telomere on chromosomal short arm and 5'-terminus of this base sequence : 107708369
  Distance between 3'-terminus of neighbour sequence of sequence listing upward to telomere on chrosomal short arm and 5'-terminus of this base sequence : 52710
ctggaaccccagtagccagttatccttgagtaacagtgatttacatcttctgctttctccttttggtgcatttaaaagtcttccctcaatacaacaatgacaacacacacacacacacacacacacacacacacacacacacacacacacaatgcaaaactgggcaaag

SEQ ID NO: 3237 - DNA, 207 bp, Homo sapiens
  D2S1889
  Located on chromosome 2
  Distance between a terminus base of telomere on chromosomal short arm and 5'-terminus of this base sequence : 107749309
  Distance between 3'-terminus of neighbour sequence of sequence listing upward to telomere on chrosomal short arm and 5'-terminus of this base sequence : 40771
gttccaaatccttgccctgcatcaggcaagttgagcaccagagaagagaagcactgaagtcaaacaaagccttagggctgctcctctacacacacacacacacacacacacacacacacacacacacacagaggaactcctgaagaatattttcataataaaaagatttctcaaaagttttttaaaaaatggtaatttaagcaagct

SEQ ID NO: 3238 - DNA, 274 bp, Homo sapiens
  AC019100.3_188924
  Located on chromosome 2
  Distance between a terminus base of telomere on chromosomal short arm and 5'-terminus of this base sequence : 107750070
  Distance between 3'-terminus of neighbour sequence of sequence listing upward to telomere on chrosomal short arm and 5'-terminus of this base sequence : 554
gatgtagatggctgttcctaaatcagagagctgagaggatagttccaactccttgccctgcatcaggcaagttgtgcaccagagaagagaagcactgaagtcaaacaaagccttagggctactcctctacacacacacacacacacacacacacactcctgaagatgcaccttcagggccaatggcatggaacatgggtagaaggaatcaagaataagaagtagaacaatagcagctccccctatttatgagggtcttagtaccagtgccatgc

SEQ ID NO: 3239 - DNA, 410 bp, Homo sapiens
  AC068941.4_2585
  Located on chromosome 2
  Distance between a terminus base of telomere on chromosomal short arm and 5'-terminus of this base sequence : 107814186
  Distance between 3'-terminus of neighbour sequence of sequence listing upward to telomere on chrosomal short arm and 5'-terminus of this base sequence : 63842
aacttgtacgattactgagcactctagtggtaaggagaaattaagaccagctggttattaatcttaactttgaccaagacaaaccctaattcagttacttatgaagggatgggtctcaggctgaagactactctctaccatcctagaaactggaaaaatctcgaattcatcttccctactggaagtgagctcaaactccataaatgagttacctgccttccatcaccatgaaagcaataaaaacttgccttccttgtgtaaaactccaaaaacaaaacaaaacaaaacaaaacaaaaaacagaagttgtacagcaaaataaactttagatcttgaccaaatttggggagatcagggattctccggagggggtacttctaggcctcagtaaattgtcttattggtttgagc

SEQ ID NO: 3240 - DNA, 366 bp, Homo sapiens
  AC012487.10_29173
  Located on chromosome 2
  Distance between a terminus base of telomere on chromosomal short arm and 5'-terminus of this base sequence : 108003272
  Distance between 3'-terminus of neighbour sequence of sequence listing upward to telomere on chrosomal short arm and 5'-terminus of this base sequence : 188676
cctcaggttatagcttgtcaccagctctaagagtggctagtacccagtctcagtgttggataacaagcaaaagtgatgagttgttttcttggggtttgtgtgtgtgtgtgtgtgtgtgtgtgtgtgtgtgtgtgtgtgtgtgtgtgtttggtttgttgtggtggtatgtttttgtttttgttttttcagagacatggtctccctatgttgcctagtctgggcctgaactcctgggctcaagtgatctcctatgtcggcctcccagagcactgagattacaggcaagtgtaagccactgcacctggccgttttcttgtttttaaagattaacctcaggccctagttatgttaccatcctagaaatgc

SEQ ID NO: 3241 - DNA, 225 bp, Homo sapiens
  AC010095.3_35198
  Located on chromosome 2
  Distance between a terminus base of telomere on chromosomal short arm and 5'-terminus of this base sequence : 108125256
  Distance between 3'-terminus of neighbour sequence of sequence listing upward to telomere on chrosomal short arm and 5'-terminus of this base sequence : 121618
taatggagcactaggcataagtaggttaagagaaaaccacattactacaaagatacttgcatatatacttggcatataatgaaaattatgtatagcatcttaaaatctacagctaaagtcataaaataaataccttcttcattcctaatttatcaaatgatgttaatgatgatgatgatgatgatgatgatgatgatgatgatggtaacatttattgagcattta

SEQ ID NO: 3242 - DNA, 463 bp, Homo sapiens
  chr2.fa.O7frz.112958005
  Located on chromosome 2
  Distance between a terminus base of telomere on chromosomal short arm and 5'-terminus of this base sequence : 108399009
  Distance between 3'-terminus of neighbour sequence of sequence listing upward to telomere on chrosomal short arm and 5'-terminus of this base sequence : 273528
cacggaacactacgtattgtacgaatctgtttatatgaaaagtccagataggaaaatctataaagacagaaagcagattagtggttgcctaggactggaagtgctgaataaaggtttgggcaactgctaatgggttgggtttttttttggagagaggagataaaatgttctaaaactgattaaggcgatggttgcacaactctgtgaataaagaaaaaaaaacactgaattgcacagttaaaatgctacttgtatatgtgaattatatctcaataaagctgttaccaaacaaacaaacaaacaaaaaacccaccaccagaacaaaaacaagatataatcaggcctgcttggtgctcttggtttttgtgtctcctaagtctctctaagttttggacactttacatcctcccacctccctattatttacgctattaacttgttgaagagtctaggtcagttaact

SEQ ID NO: 3243 - DNA, 384 bp, Homo sapiens
  AC026895.2_53905
  Located on chromosome 2
  Distance between a terminus base of telomere on chromosomal short arm and 5'-terminus of this base sequence : 108421850
  Distance between 3'-terminus of neighbour sequence of sequence listing upward to telomere on chrosomal short arm and 5'-terminus of this base sequence : 22378
gtgcctgttagatcctgtaaggaaaaaaacagtgattttgctccagaagctggagagtctcctagggtctcgatgctcgtcatgaggaggtggatgccagcctgattctcattcccttgtaaaggacttatttttgttgtttcaactttatttaatttctgacttttgctttttatcttgctagggacttttcataggctctttgcacttaatattctgaaaattccatagacgtggtgtgtgtgtgtgtgtgtgtgtgtgtgtgtgtgtgtgtgtgtgtgtggcgaggtgtcctacaaccccacaattctgattttaggaaccaaccctggaacactccctgcccccacatgcaccaagatgagcataaggacagagtaccat

SEQ ID NO: 3244 - DNA, 264 bp, Homo sapiens
  D2S1893
  Located on chromosome 2
  Distance between a terminus base of telomere on chromosomal short arm and 5'-terminus of this base sequence : 108659517
  Distance between 3'-terminus of neighbour sequence of sequence listing upward to telomere on chrosomal short arm and 5'-terminus of this base sequence : 237283
aacaaggtgaggctctgtctcactctcacacacacacacacacacacacacacacacacacacacacacacacacaaatatacataacaaacaagaaatgtataaattaaagaaaaagagaaaattttttaaagcacccacaatctagctgtcatgctctggtagttgtcttccagccttgtctctgtgcatagatttataagatttttaaaaatacagtgatattagtgtacttgccatctggtatcctgcttcatttttaga

SEQ ID NO: 3245 - DNA, 101 bp, Homo sapiens
  DISD22_0001766
  Located on chromosome 2
  Distance between a terminus base of telomere on chromosomal short arm and 5'-terminus of this base sequence : 108955056
  Distance between 3'-terminus of neighbour sequence of sequence listing upward to telomere on chrosomal short arm and 5'-terminus of this base sequence : 295275
agtcatagaagcagaggctatgacttttattcattcattcattcattcattcattcagcagattgtagtatcttctactgatggtgggctggatacttctt

SEQ ID NO: 3246 - DNA, 365 bp, Homo sapiens
  AC013268.2_36553
  Located on chromosome 2
  Distance between a terminus base of telomere on chromosomal short arm and 5'-terminus of this base sequence : 109052590
  Distance between 3'-terminus of neighbour sequence of sequence listing upward to telomere on chrosomal short arm and 5'-terminus of this base sequence : 97433
gagtgagcaggtctgacataataaatccagtctccctgagtttttgcataccttcctatacacataaaccaaggaagttgtgacatctcaactttatgtactttaggtaaactctgattctgtttcagccaaccagccaagtaacaaaacaaataagcaaacagccaaccaatcaaccaacaagcaagcaagcaacaaaccaaccaaacaagcaagcaagcaagcaagcaagcaaccaaccaaccaagtaaccgatcaaaccaacccttggagccctttctaaaactttgacctacaaccctgaatccagaatctctgtttagtgggccaacattaataaatttagcctactccaactttgtgtt

SEQ ID NO: 3247 - DNA, 472 bp, Homo sapiens
  AC013268.2_36781
  Located on chromosome 2
  Distance between a terminus base of telomere on chromosomal short arm and 5'-terminus of this base sequence : 109052666
  Distance between 3'-terminus of neighbour sequence of sequence listing upward to telomere on chrosomal short arm and 5'-terminus of this base sequence : -289
gttgtgacatctcaactttatgtactttaggtaaactctgattctgtttcagccaaccagccaagtaacaaaacaaataagcaaacagccaaccaatcaaccaacaagcaagcaagcaacaaaccaaccaaacaagcaagcaagcaagcaagcaagcaaccaaccaaccaagtaaccgatcaaaccaacccttggagccctttctaaaactttgacctacaaccctgaatccagaatctctgtttagtgggccaacattaataaatttagcctactccaactttgtgttacttccaccatggtgccacacacttaatatccattcccacatatattctccagatttctttctgtataaattgtgtgtgtgtgtgtgtgtgtgtgtgtgtgtgtagaaagagagcatcaactgaaaaatcacacaattttataaatttagaaaagagagctttatttcttataaaggtttgca

SEQ ID NO: 3248 - DNA, 427 bp, Homo sapiens
  AC013268.2_168246
  Located on chromosome 2
  Distance between a terminus base of telomere on chromosomal short arm and 5'-terminus of this base sequence : 109153085
  Distance between 3'-terminus of neighbour sequence of sequence listing upward to telomere on chrosomal short arm and 5'-terminus of this base sequence : 99947
tctggtttcctttgattaactaagcccgcaattttaatgcagttgaatatgtcaatcttttcctctattgactatgttttttatcaagtttaagaaattcttctcacgcacaccaacatggcacatgtatacatatgtaacaaacatgcacattgtgcacatgtaccctaaaacttaaagtataataataataataataataataataataataataaagaaatgcttctctattttgagtcatgaagatattcttgcattccagattttcctcctgagataattttccttcttcctggagtgcaacctttagtagtctctttagtgaaggtcagagggtagtagtctgtttgatttattagaaaacgtctttaaatttcccctgacaattattttctctccgcacttccaagatatgtttccactg

SEQ ID NO: 3249 - DNA, 421 bp, Homo sapiens
  AC013268.2_193115
  Located on chromosome 2
  Distance between a terminus base of telomere on chromosomal short arm and 5'-terminus of this base sequence : 109177854
  Distance between 3'-terminus of neighbour sequence of sequence listing upward to telomere on chrosomal short arm and 5'-terminus of this base sequence : 24342
cttacaggctgtaggatacctttgacttgcccatggacaacatggcatagtaggaaaagtttaagtaagaagaaaaacaaccttcttaggctcatatctatgaaatggagaaaataatacaacccataaccccttagtctcttaagctgagaggccctgagccatttccaccttctgaagcaattagtatattaagaaatgaagatatgccttggtcttctggctaaagaccagggttttcattttccttctctgctgtgcatctcttctgactgggtctatcttcaggaccaaagcaatgtgtgtgtgtgtgtgtgtgtgtgtgtgtgtgtgtgtgagagagagagagagagagagagagagagagaaacacaaatgtgaaaattattccccccatgcttttaggatcatggttcctctg

SEQ ID NO: 3250 - DNA, 463 bp, Homo sapiens
  chr2.fa.O7frz.113743779
  Located on chromosome 2
  Distance between a terminus base of telomere on chromosomal short arm and 5'-terminus of this base sequence : 109281062
  Distance between 3'-terminus of neighbour sequence of sequence listing upward to telomere on chrosomal short arm and 5'-terminus of this base sequence : 102787
aattgcataatcctgtctacatagtaaaaacattaatttgatttcagctggagaatggattggaagtcaccaaggatggaagcagggaggccagttgggacaccattccagtagttcacataagagacaatagtagtatagcctgtggtaggtgatgttgggtagatttggtgttgttctgtgtgggaaacacgtgaggggagaagaaaagacacatgcacaatacctttaatggtaaataacctttatcccatataaatggcaatgcagatataataagcaaatgatataataagcaaattgatataataagcaaattgcaatgggaaggggagaagggaaatgatatatatatatatatatatatgtatatatacactcaccagactatggaggattcattgccagactgagaagcaacagcctgggccccagagttggacactgcactcaccagactatg

SEQ ID NO: 3251 - DNA, 290 bp, Homo sapiens
  chr2.fa.O7frz.114427069
  Located on chromosome 2
  Distance between a terminus base of telomere on chromosomal short arm and 5'-terminus of this base sequence : 109334939
  Distance between 3'-terminus of neighbour sequence of sequence listing upward to telomere on chrosomal short arm and 5'-terminus of this base sequence : 53414
ttctaagatgtagccagaattaagaaccactgataggttgcaagtgctgctatagtggctgtcacggtgatgctgtgtcactgaagggactgtatatatatatatgtgtgtgtgtgtgtgagtgtatgtgtgtgtgtataaagattgatatatatgtgtgtgtatatatatataatgatcagaaggttacacaagggcgtggaggcgtgcaggaggaggttcagtatttcatactggtctccccatcacatgttctattggcaaaagtttctgaagtcagtagaaatgtc

SEQ ID NO: 3252 - DNA, 470 bp, Homo sapiens
  chr2.fa.O7frz.114352430
  Located on chromosome 2
  Distance between a terminus base of telomere on chromosomal short arm and 5'-terminus of this base sequence : 109413924
  Distance between 3'-terminus of neighbour sequence of sequence listing upward to telomere on chrosomal short arm and 5'-terminus of this base sequence : 78695
ttaggctgaataacattccattgtgtgtatggaccacattttgcttatccgttcatccatccatttgggttgtttccatcttttagttactgcgaataataatgctgctatgaatgggcatgctggtgtattcctgtaatcccagctacttgggaggctgagacaggagaatcgtttgaacctgggagacagaggttgcagtgagccaagatcgctccactgcactccagcctgggcaacagagcaatactccatctcaaacaaacaaacaaacaaacaaataaataaaaccattccttttgttttcaaaacccaagtctctgctttcaattattttggtatatactcagcccagtctatatttggaggccattatttgtagttatgtactttttagacatcccaaatatctatcttgtccccactttaattctcgaagatctaccctccatttctatcctttagtaagc

SEQ ID NO: 3253 - DNA, 360 bp, Homo sapiens
  chr2.fa.O7frz.114266585
  Located on chromosome 2
  Distance between a terminus base of telomere on chromosomal short arm and 5'-terminus of this base sequence : 109473022
  Distance between 3'-terminus of neighbour sequence of sequence listing upward to telomere on chrosomal short arm and 5'-terminus of this base sequence : 58628
caatagcgttgagtctgtagattgctttgggtagtatggccgttttaactatattgattcttccaactatattgattccatgagcattttttcagtttgtcggtgtcatctgtgatttctttcagcagtgttttgtagttctctttgcagatacctttcacctccttggttagatatattcctaggtttttgcgtgagagtgagtgtgtgtgtgtgtgtgtgtgtgtgtgtgtgtgtgtgtctgttgtacatggcattgtgttcttgatacggctctcagcttgaccattattgatatacagaaatgctgctgatttttgtacattggttttgcatcttgaaacttcactgaagttgtat

SEQ ID NO: 3254 - DNA, 457 bp, Homo sapiens
  AC023877.3_40772
  Located on chromosome 2
  Distance between a terminus base of telomere on chromosomal short arm and 5'-terminus of this base sequence : 109767627
  Distance between 3'-terminus of neighbour sequence of sequence listing upward to telomere on chrosomal short arm and 5'-terminus of this base sequence : 294245
tgtagctcttagttcaaagcagaaggcctgaggaactgggttggggggcactgatgaaagtcacagagcctgaaggccagcgagcctggagtttttatatccaagggcaggagaagatgggtgtcccagctctagaagagacagagagagagagagagagagagagagagagagtgagcaaattctttcctttgcctttttgttctattagggccctcagctgattggatggtgcctgctcacatgtgggtgagggcagatcttccttattgagtccactagttcaaataccaacctattctggaaacaacctcacagagagactcgaaataatgctttgtcagccatctagatatcccttaacccagtcaaattaacacctaacattaaccattacaagttcactctttgtcaacttggcatccacatgcatctccttaagccatacttaatcttc

SEQ ID NO: 3255 - DNA, 353 bp, Homo sapiens
  chr2.fa.O7frz.118325551
  Located on chromosome 2
  Distance between a terminus base of telomere on chromosomal short arm and 5'-terminus of this base sequence : 109944469
  Distance between 3'-terminus of neighbour sequence of sequence listing upward to telomere on chrosomal short arm and 5'-terminus of this base sequence : 176385
ccagttaagtgtcatgtttcagctttttttgtaaagccctagaccaggcatttatgtgtatgcgtgtgtgtgtgtgtgtgtgtgtgtgtgtgtgtgttaatggggaccagaagacaaactgaaaacatggtcactattcttgaagagcactcagtctatctggggacacaggatattcccttttgcaagtgtcgttaggattggtagttactaccgatgatggttaattttaagtgtcagcttggctggtcgtgagatgccagactaaatgttgttgctgagtctgtctgggagggtgtttcaggatgagattagcatttgaattggtggactcagtaaagtagatggtcctt

SEQ ID NO: 3256 - DNA, 392 bp, Homo sapiens
  chr2.fa.O7frz.118430391
  Located on chromosome 2
  Distance between a terminus base of telomere on chromosomal short arm and 5'-terminus of this base sequence : 109977161
  Distance between 3'-terminus of neighbour sequence of sequence listing upward to telomere on chrosomal short arm and 5'-terminus of this base sequence : 32339
tgacttctccagaatgttacattaatggaatcattcactatatagcttttgtgtgtgtgcctgtcttttttacatagcataatgctttttgagattcattcatgttcatatatatatatatatatatatctttaacacattttttattgctgaatggtattccattgtatgcatttgctgcaatatgtttattcatttaccaattaacaaccatttgggttgtttctagtttttacttattgtgaataaaacttcttaatcttgtacagatcttagtgtgaatcacagagtaaatttttctcacttatgcaaatgttcaatatgggttttctcaatggacaaaaacagctttttgtttttttcccacacagtaacttggaaatctaggcttc

SEQ ID NO: 3257 - DNA, 215 bp, Homo sapiens
  HUMUT1209
  Located on chromosome 2
  Distance between a terminus base of telomere on chromosomal short arm and 5'-terminus of this base sequence : 110238316
  Distance between 3'-terminus of neighbour sequence of sequence listing upward to telomere on chrosomal short arm and 5'-terminus of this base sequence : 260763
caggtttctccagagacagaaacaataggatggatggaaggatagatgatagatagatagatggattatttatagatagatagatagatagatagatagatagatagatagatagataatgtgtgaaaagagatttataagggaaatttgctcacacgattatggagagtgggaaggccatgacaagctgtctgtgagctggagaccctgggata

SEQ ID NO: 3258 - DNA, 371 bp, Homo sapiens
  AC010885.7_41878
  Located on chromosome 2
  Distance between a terminus base of telomere on chromosomal short arm and 5'-terminus of this base sequence : 110281662
  Distance between 3'-terminus of neighbour sequence of sequence listing upward to telomere on chrosomal short arm and 5'-terminus of this base sequence : 43131
tcaacagttaaactacggctaaaaagaatgcaatgggaatgaacaaaagtgaaatgcattgctaaaatagctgtaaaggccaaaagtgtgcaggaggaggaaaaacagctctgtgtgtgtgtgtgtgtgtgtgtgtgtgtgtgtgtgtgtgtgtgtgttctcctccacttgaagttcaagaagtgatgaagtctatagtgggtaaaattcagcaattgttgccagtgaaggctgtttgtggccatgatgtgtcagagttggaaaagaggaaattgggagaagttataatggaacaagatgatcaagagtattcaggttgcttgacacttgctttggtcgttctggccattctttagctcagacagttactg

SEQ ID NO: 3259 - DNA, 228 bp, Homo sapiens
  D2S308
  Located on chromosome 2
  Distance between a terminus base of telomere on chromosomal short arm and 5'-terminus of this base sequence : 110291367
  Distance between 3'-terminus of neighbour sequence of sequence listing upward to telomere on chrosomal short arm and 5'-terminus of this base sequence : 9334
tggttttttcaagggattttctttctattgtgtgtgtgtgtgtgtgtgtgtgtgtgtgtttgggggtggtggcatatgtatttaagacaataagttagaagagataagaggtgggttttaaaaacgtaaatacaggccaggtccaatggctcacgcctgtaatcccagcacttagggaggccaaggtggacgggttacctgatgtcaggagttccagacccacctggc

SEQ ID NO: 3260 - DNA, 150 bp, Homo sapiens
  chr2.fa.O7frz.118841258
  Located on chromosome 2
  Distance between a terminus base of telomere on chromosomal short arm and 5'-terminus of this base sequence : 110349779
  Distance between 3'-terminus of neighbour sequence of sequence listing upward to telomere on chrosomal short arm and 5'-terminus of this base sequence : 58184
aaagaaactagagctttacgagaccaaatatatctgaatatctgaggctttagaaaaacagaagaaaggaaggaagggaggaaaaagaaagaaagaaagaaagaaagaagaaacagacaaaataaaagctttggaattgctatagaaagg

SEQ ID NO: 3261 - DNA, 445 bp, Homo sapiens
  chr2.fa.O7frz.119079176
  Located on chromosome 2
  Distance between a terminus base of telomere on chromosomal short arm and 5'-terminus of this base sequence : 110629063
  Distance between 3'-terminus of neighbour sequence of sequence listing upward to telomere on chrosomal short arm and 5'-terminus of this base sequence : 279134
gagaggattcttagaagcttgtacctattttctttggacttcattccatgtgacttctccccttgctgattttgcttttcatcctttcactgtaataactcatagccatgaacaggactatcaaacttgggcttggtcttgtggaccaccaaggcaactgtattattgtgtgtgtgtgtgtgtgtgtgtgtgtgtgtgtgtgtgtgtttctattaatatcgttgtttatttgatgctcatattttcccagttttatcagtagaagcccctccaaggcagttcccatatccttttgacagattcccttaatttttttatgttatttgattttttaaaattatactttaagttctgggatacatgtgcagaacgtgaagccttgtcacataggtacacacgtgccatggtggttcactgcacccatcaacctgtcatctacattagg

SEQ ID NO: 3262 - DNA, 107 bp, Homo sapiens
  DISD22_0001783
  Located on chromosome 2
  Distance between a terminus base of telomere on chromosomal short arm and 5'-terminus of this base sequence : 110877627
  Distance between 3'-terminus of neighbour sequence of sequence listing upward to telomere on chrosomal short arm and 5'-terminus of this base sequence : 248119
tcaatgtagataatggatggattcttattatgtgtgtgtgtgtgtgtatatatatatatatatatatatatatgaatttattttttaacagaagcatccaatgcttt

SEQ ID NO: 3263 - DNA, 389 bp, Homo sapiens
  chr2.fa.O7frz.119423536
  Located on chromosome 2
  Distance between a terminus base of telomere on chromosomal short arm and 5'-terminus of this base sequence : 111168851
  Distance between 3'-terminus of neighbour sequence of sequence listing upward to telomere on chrosomal short arm and 5'-terminus of this base sequence : 291117
gtctatcgtcatcttaatcttgactgtagattgactgtttttgaatggacttaaagtgacagcaaattagtgaccaccatgtcatattttaaaggcttacaatgaagtaatttattctgttatataaaatagaatgatctttcatctaaattagagaagttttgcaattgtgtaggtatattgagtgtgtgtgtgtgtgtgtgtgtgtgtgtttattacatgcagttcaagggaggctaggtatatgataatatcttatccaagaactgttcccactgtgcttcccgaaagaaaaccgtctgatttcatgtcatttcaggcactttgggttattttaaaagtcttatctagttttttaagacatggttctagaatgcagtctaagaatg

SEQ ID NO: 3264 - DNA, 281 bp, Homo sapiens
  DISD22_0001786
  Located on chromosome 2
  Distance between a terminus base of telomere on chromosomal short arm and 5'-terminus of this base sequence : 111274495
  Distance between 3'-terminus of neighbour sequence of sequence listing upward to telomere on chrosomal short arm and 5'-terminus of this base sequence : 105255
caggtctctaaatacttgtgaattgttaaaccatatatttatttggatttttgtgtccctattcataattatagtatctgatagggttaacaaatatttacacttttaatagcaactattaaaatatagtaggttttcagactttcatacatgtgtactctctctctctctctctctctctgtctctctctctctctctatatatatatatataattgtgccttatattttgttacagaatcactagagatatattctcaagtaacttgctagtaaggaga

SEQ ID NO: 3265 - DNA, 157 bp, Homo sapiens
  G08157
  Located on chromosome 2
  Distance between a terminus base of telomere on chromosomal short arm and 5'-terminus of this base sequence : 111421446
  Distance between 3'-terminus of neighbour sequence of sequence listing upward to telomere on chrosomal short arm and 5'-terminus of this base sequence : 146670
atgtagaagagtcagaatttcaacccaaatctctgaaacatactccttcttcgttctttcactgcctgatatgtctatctgtctgtctatctatctatctatctatctatctatctatctatctatctgtatgtgtatgtgtgtgcatttgtgtctg

SEQ ID NO: 3266 - DNA, 469 bp, Homo sapiens
  AC017040.6_170360
  Located on chromosome 2
  Distance between a terminus base of telomere on chromosomal short arm and 5'-terminus of this base sequence : 111540912
  Distance between 3'-terminus of neighbour sequence of sequence listing upward to telomere on chrosomal short arm and 5'-terminus of this base sequence : 119309
agccagataattactggttatttaaaaaattactttgaaagaaatacacataaagcatatccctctcttaattctttgaaataatttccaaaaattataattatttttaaataagttaaaagtaaatttaagggaactgaaaattattaaggttcttgattcttgatgcttattggcatgttaccttcggaaagttggtgcatttgccattctacctgacgttctacctgacatgtttaagggtcatagttctctttatccttgtcaacatgctgaatgttatcatttaaaaaataaataaaactgtgtgtgtgtgtgtgtgtgtgtgtgtgtgtgtgtgtgtgtgtgtgtatagtcatctgcaagttgaatgtgttctttggagaaaaaaaggtctatgtttgagtcaaaaattccatcatcaagacacagcctgtggtctcatattttcttcagttggtgacaagga

SEQ ID NO: 3267 - DNA, 293 bp, Homo sapiens
  chr2.fa.O7frz.119994816
  Located on chromosome 2
  Distance between a terminus base of telomere on chromosomal short arm and 5'-terminus of this base sequence : 111752972
  Distance between 3'-terminus of neighbour sequence of sequence listing upward to telomere on chrosomal short arm and 5'-terminus of this base sequence : 211591
ttagcttccacttatgagtgagaatatattatgtttggttttccattcctgagttactccacttagaataatggtctccaattccatccaggttgatgtgaatgccattgtttcattcctttttatggctgagtagtattccatggtgtatgtgtgtgtgtgtgtgtgtgtgtgtgtgtgtgtgtgtatctcacaatttctttatccacttgttgattgatgggcatgtgggctgcttccatattttttgcaattatgaattttactgctataaacatgcatatgcaagtatc

SEQ ID NO: 3268 - DNA, 465 bp, Homo sapiens
  chr2.fa.O7frz.120116902
  Located on chromosome 2
  Distance between a terminus base of telomere on chromosomal short arm and 5'-terminus of this base sequence : 111782265
  Distance between 3'-terminus of neighbour sequence of sequence listing upward to telomere on chrosomal short arm and 5'-terminus of this base sequence : 29000
tcaatttcaaggacatttgtagtaaagccctgccattttttgacaattatttcttagtccaaattgcctctggcataagggcattgacaacaaaagtttagttttgttttgttttgttttgttttgttttgttattctgtggtgtgtgggcattattttaagtcaatttgtcaagggtagaagaaacaaatttacatctcatagaaaaataaatatttccagagagtgaaaaattttcaaaaagtcaaatggctacttgccccttgcccacccactgcctttggatctcagttgtgtctctacccagcttggacccagaaccagccttttcctttgtgctttattgacctttcagtgcttttctcattctccaaaaccaggaaattgtataatttgcaagcttttcttttgttcttaggttgacagataatagtaaaaggagtaaagagtttcgatatttggaat

SEQ ID NO: 3269 - DNA, 438 bp, Homo sapiens
  chr2.fa.O7frz.120239354
  Located on chromosome 2
  Distance between a terminus base of telomere on chromosomal short arm and 5'-terminus of this base sequence : 111906550
  Distance between 3'-terminus of neighbour sequence of sequence listing upward to telomere on chrosomal short arm and 5'-terminus of this base sequence : 123820
atttatcctctgtcatcctcagtctattattgagtccacccaataagttttatttctattttgtatttttcagttctaaaatttccatttgtttcttcattttaaaatcatttctatttatttgttgagttttatactttttcatttgtttaaagataatttgttattaatgaaatatttttattatggattctttaaaatcttttttcagtaatttcagtatctgaattttcttggtattcatatcagttgattttctcatttaagttataattttctcagttcttggtataataggtgattttttaatttttcttggacattttgtgtattatgttagattctggatctgatgtgtgtgtgtgtgtgtgtgtgtgtgtgtgtgtgtgtgtgtgtgtgtatacccccacaaaggcatttgcctgtttatgagtattg

SEQ ID NO: 3270 - DNA, 381 bp, Homo sapiens
  chr2.fa.O7frz.120316906
  Located on chromosome 2
  Distance between a terminus base of telomere on chromosomal short arm and 5'-terminus of this base sequence : 112096106
  Distance between 3'-terminus of neighbour sequence of sequence listing upward to telomere on chrosomal short arm and 5'-terminus of this base sequence : 189118
ggtctggatccacagtctaaatcttgcaatggacctgctggaaaatactgagaaccaaaagatgattcagacacacctacacatatgcaaattacagtactaataatttttctgatttcattaagtccttttgtatttatactgaaagagaatctgttcccacaaatttatataaatggagagagagagaatgtgtatgtgagagagagagagagatagtgcaggagaaagtgtgtgtgtgtgtgagagagagagagagagagagagaaggtcttcaatgtctcactatgttgactaggctggtcataaactcctggcctcgagtgatcccccacctgcctcggcctaccaaagccctgggagtacaggcataaaccatgg

SEQ ID NO: 3271 - DNA, 367 bp, Homo sapiens
  chr2.fa.O7frz.121336485
  Located on chromosome 2
  Distance between a terminus base of telomere on chromosomal short arm and 5'-terminus of this base sequence : 112275652
  Distance between 3'-terminus of neighbour sequence of sequence listing upward to telomere on chrosomal short arm and 5'-terminus of this base sequence : 179165
tataccaaatctaccaagactgacccataacaaaatagaaaactggagcaatcaacaatgagtaataggatccaagcagtaacccaatgtcctccatcaaagaaaagcccaggacatgatgatttcactgcctaattttcccaaagattaaaaaccaatgccaattctactcaaactattccaaaaaagtgaagaagaagaagaagaagaagaagaagaagaagaagaagaagaagaagaagaagaagaaggaagaagaagaagaagaaggaagaagaagaagaagaagaagaagaagaagaagaagaagaagaagaagaagaagaggaagaagaagaagaaggaatactttcaaacttattctgca

SEQ ID NO: 3272 - DNA, 217 bp, Homo sapiens
  G08172
  Located on chromosome 2
  Distance between a terminus base of telomere on chromosomal short arm and 5'-terminus of this base sequence : 112343507
  Distance between 3'-terminus of neighbour sequence of sequence listing upward to telomere on chrosomal short arm and 5'-terminus of this base sequence : 67488
aaacggatgcagaggatgtacattacttatcatgatttttatgctctctctctttctctcttctatctatctatctatctatctatctatctatctatctatctatctatctatcattgacagcatggatttgaactgcatgaatccacttatatgtggatttttccacacccttttacccagacggaaaagtgtggcagaatgggctcacatgata

SEQ ID NO: 3273 - DNA, 336 bp, Homo sapiens
  chr2.fa.O7frz.121007826
  Located on chromosome 2
  Distance between a terminus base of telomere on chromosomal short arm and 5'-terminus of this base sequence : 112435257
  Distance between 3'-terminus of neighbour sequence of sequence listing upward to telomere on chrosomal short arm and 5'-terminus of this base sequence : 91533
atcctagctaaagtgcctagagtgccaaggctgaataaacatggtccatatatatatatatatgtgtatatatatatatatatatatatatatagagagagagagagagagagagagagacagagaaaatatgcaccttatatatttaaacgaaaataaaaaacaaaccaatacatttaaaagatttttattagaaattatataaccactgaaaacctataatttttgtaatgatacatcaagacattctagacactatgctattttacatgaatgattctattagaccttcataacaaccctatgaaataggtttagcaattaactttgcataag

SEQ ID NO: 3274 - DNA, 260 bp, Homo sapiens
  D2S363
  Located on chromosome 2
  Distance between a terminus base of telomere on chromosomal short arm and 5'-terminus of this base sequence : 112539378
  Distance between 3'-terminus of neighbour sequence of sequence listing upward to telomere on chrosomal short arm and 5'-terminus of this base sequence : 103785
ttggctattcaggatctctcctggttccatacaaattttaggattgctttttctagttctgtagagaatataattggtattttgttaagaattgtattaaacttttagattgcttttggtagtaggctcattttcaaaatattcttcctatttatgaacatgggattttgtgtgtgtgtgtgtgtgtgtgtgtgtgtgtgtgtattctctttaaggtctttaattagggttttgtagttgttcttgcagagagcatttgc

SEQ ID NO: 3275 - DNA, 259 bp, Homo sapiens
  chr2.fa.O7frz.120746803
  Located on chromosome 2
  Distance between a terminus base of telomere on chromosomal short arm and 5'-terminus of this base sequence : 112693639
  Distance between 3'-terminus of neighbour sequence of sequence listing upward to telomere on chrosomal short arm and 5'-terminus of this base sequence : 154001
gaattcaagtgttctgtcttagatgatctattcaaagtatgaatatctactcactacattgtgtgtgtgtgtgtgtgtgtgtgtgtgtgtgtgtgtgtgtgtgtggaggtgactgccagataccttagccagccatcttgaagctaaaaaatgtataatcgtcttaacaaaaacagaaaatgtaattgaaaaaaatataacatcaatttctgataaaaactcagtaatctgagaatagtagaacatttcctaagccatc

SEQ ID NO: 3276 - DNA, 288 bp, Homo sapiens
  chr2.fa.O7frz.120657858
  Located on chromosome 2
  Distance between a terminus base of telomere on chromosomal short arm and 5'-terminus of this base sequence : 112782024
  Distance between 3'-terminus of neighbour sequence of sequence listing upward to telomere on chrosomal short arm and 5'-terminus of this base sequence : 88126
tgatcagagcctacagatatttactaaaataatccaataattgcctaatgaacaaattggttcaggtcagtttacacacacacacacacacacacacacacacacacacgtaaatatatatataatcatgcatatataaaaggtagggtattaatactgtgatctcatgtttttacatatggaaaagcactgggattgccacagagaagaattggtagcaaatagtcattttccaaataaaaagtaatgaaatgccaatgaatatgtcctgttactctgcattagaaa

SEQ ID NO: 3277 - DNA, 268 bp, Homo sapiens
  D2S2379
  Located on chromosome 2
  Distance between a terminus base of telomere on chromosomal short arm and 5'-terminus of this base sequence : 112965626
  Distance between 3'-terminus of neighbour sequence of sequence listing upward to telomere on chrosomal short arm and 5'-terminus of this base sequence : 183314
gccagaatttgattaaagggttatgttgattcagtgtaatgaccacccttgtatatgtgtgtgtgtgtgtgtgtgtgtgtgtttactgagtcggtgggtataatgactgacccactgactcagtgaacgcacacacaagcacacacatatacagaggtgctcaatacagggctattagtgaagacaaaaatctagaaataaatatctttcaagactagattggttaaataatgacacatccatataatggaatgtagcagaaaaatcg

SEQ ID NO: 3278 - DNA, 203 bp, Homo sapiens
  chr2.fa.O7frz.121438915
  Located on chromosome 2
  Distance between a terminus base of telomere on chromosomal short arm and 5'-terminus of this base sequence : 113086683
  Distance between 3'-terminus of neighbour sequence of sequence listing upward to telomere on chrosomal short arm and 5'-terminus of this base sequence : 120789
ctggcttatttaacttagcataatgtcctccaggtccatccatgttgttgcaaatgatagcattttctgcctttttagggcttcattgtgtggtacacactttttctttatatatccatttctttctttgtgtgtgtgtgtgtgtgtgtgtgtgtgtgtgtgtgtgtgtgcgtgtgtgtgtgtgagatgaagtttcacttgtg

SEQ ID NO: 3279 - DNA, 445 bp, Homo sapiens
  chr2.fa.O7frz.121542435
  Located on chromosome 2
  Distance between a terminus base of telomere on chromosomal short arm and 5'-terminus of this base sequence : 113190365
  Distance between 3'-terminus of neighbour sequence of sequence listing upward to telomere on chrosomal short arm and 5'-terminus of this base sequence : 103479
ttcaagtaaactgatcctttagacatccattatgagttttgagtcactggcctgctctgtgccagaaaaaaaaaaaaaaaaaaatagcaaaccctaaatgggataacagtttctgcagtttttgtcctaaaaacactgttccttgtaatgatatcacagaaatccagtaatgagtttcacacacacacacacacacacacacacacacatcctcataaatgccttgaaaactagcaagtaaaacggacattaaataaatgtttgaaagaaggaaaaaaagaaagaaaataggaaaaagggtaaagaaaaaggaaataaggaaagagaaagtggagaaagtaatgtctttcatttaaatagctgatgcctgtctcattctatgtcatatttccaatatagcatagtggaaaactagagctttcttctgctagtatccttttctagg

SEQ ID NO: 3280 - DNA, 410 bp, Homo sapiens
  chr2.fa.O7frz.121657958
  Located on chromosome 2
  Distance between a terminus base of telomere on chromosomal short arm and 5'-terminus of this base sequence : 113302225
  Distance between 3'-terminus of neighbour sequence of sequence listing upward to telomere on chrosomal short arm and 5'-terminus of this base sequence : 111415
atttaacttaatgacctccagttccatccatgttacagcaaatgacatactttctttcttttttatatccaaatagtcttccattatgtgcatatatatatatgtatgtgtatatatatatatgtatgtgtgtgtgtatatatatgtatgtgtatatatatatgtatgtgtgtgtgtatatatatgtatgtgagtgtgtgtgtgtatgtgtgtgtatatatatatatatatatatatatatatatatgtatatcccattttgtttacgtgtttacccacagatagacacttaggttgattttatatctttactttttgaatagccctgcaagaaacatgggagtgcaggtgtccctttgatatactgatttatttacctttggataaactagttaaattgctggatcatg

SEQ ID NO: 3281 - DNA, 183 bp, Homo sapiens
  DISO7_10000949
  Located on chromosome 2
  Distance between a terminus base of telomere on chromosomal short arm and 5'-terminus of this base sequence : 113330868
  Distance between 3'-terminus of neighbour sequence of sequence listing upward to telomere on chrosomal short arm and 5'-terminus of this base sequence : 28233
agatacgtatgtgctgtctgcatatatatgtaaatatatacacatatatacacacacatatatacacatgtttatatatatatatatatatatatctgcatcttaatatctatctcattgaagaggttatttttgtatctttctctctctctgtttttcaaaactccatctccaaatgctcta

SEQ ID NO: 3282 - DNA, 471 bp, Homo sapiens
  chr2.fa.O7frz.122069332
  Located on chromosome 2
  Distance between a terminus base of telomere on chromosomal short arm and 5'-terminus of this base sequence : 113692623
  Distance between 3'-terminus of neighbour sequence of sequence listing upward to telomere on chrosomal short arm and 5'-terminus of this base sequence : 361572
aaatgatctatagattcaatgcacttctaatcaaaatcccaacagggtgtatgtctgtgcatgtgtttatgggtgcacactgtgtgtgtgtgtgtgtgtgtgtgagagagagagagacagacagaattgataagctggcagtaaatgtgtattgaagaaaaaggaaaggtaaaaggtgctcgaccatatatcaaggcctatgataacattacagtaattaagacagcgtggtactggttcaacaataggcaaagagactgatggtataaactagagaacccagaaacagattcatggacatttgaacggtggttcacagaacagtggagaaaggactgtctgtcaacgaatgcttcttagatttccatatgaaaaaaattaaagccaacccttaattcataatttctgatggactctagacataaatatgaaaggcaaatcagcaacgtttctacatcagtggttcttaaa

SEQ ID NO: 3283 - DNA, 145 bp, Homo sapiens
  DISO7_10000953
  Located on chromosome 2
  Distance between a terminus base of telomere on chromosomal short arm and 5'-terminus of this base sequence : 113902969
  Distance between 3'-terminus of neighbour sequence of sequence listing upward to telomere on chrosomal short arm and 5'-terminus of this base sequence : 209875
agccaatggttaacatttactgttttctacattgaacaaactgctcaaaattatatatatatatatatatatatatatatatatatatatatatatatagtcatataatcctcatttaatgggaaagatctccatgcagtggaga

SEQ ID NO: 3284 - DNA, 430 bp, Homo sapiens
  chr2.fa.O7frz.122356295
  Located on chromosome 2
  Distance between a terminus base of telomere on chromosomal short arm and 5'-terminus of this base sequence : 113979542
  Distance between 3'-terminus of neighbour sequence of sequence listing upward to telomere on chrosomal short arm and 5'-terminus of this base sequence : 76428
attcacaagtcatgcagactagaatcgaaatgcttgtggttgctaacagggcattcagaactcaatcctttaatacacacatttcccacaggagaacttgtggtttagaagcattctcttgttccgtgtgtgtgtgtgtgtgtgtgtgtgtgtgtgtgcgtttgtgtatgtgtgtatgtgtgtgtgtgtatgtgtgtggttaaaggtttgtaggtcgaatagtcagaacaggaggttggaagccacaaaaagaacaaaaggaatggacttgtgcttgtgaaggagcaggtgagaggagaaggcctcattagtccctacagtggggagagatgaagttagtgcaaacttttgtgaagtcagactcattttacacagaatgtgacgatttgccgtccattgagagaaaaactcatggtttaaatgaaagcta

SEQ ID NO: 3285 - DNA, 393 bp, Homo sapiens
  chr2.fa.O7frz.122716230
  Located on chromosome 2
  Distance between a terminus base of telomere on chromosomal short arm and 5'-terminus of this base sequence : 114179571
  Distance between 3'-terminus of neighbour sequence of sequence listing upward to telomere on chrosomal short arm and 5'-terminus of this base sequence : 199599
ttctgaagttgccattaagtaggaaaaatactgcctcttttaggacctactgtgatattcctgaattaaggatttaacaggatctctaagcaaaacagaatcttggggtgggcaaatcacagaactcaccagggggaacaaacaggaataggaggggtgtgtgtgtgtgtgtgtgtgtgtgtgtgtgtgtgcacatgcatgatccaaggggatttgaatccaaataatctgaatatagacagagtacttagtcattacactaatggctatatgaagaatgacagaaggaaaaacaaaggatttataagttacatacacacacacctctgtgtgtgtgagagagagagagagagagagagaaagaattaagtgtggaaggtacatgatacctct

SEQ ID NO: 3286 - DNA, 446 bp, Homo sapiens
  chr2.fa.O7frz.116619142
  Located on chromosome 2
  Distance between a terminus base of telomere on chromosomal short arm and 5'-terminus of this base sequence : 114536451
  Distance between 3'-terminus of neighbour sequence of sequence listing upward to telomere on chrosomal short arm and 5'-terminus of this base sequence : 356487
acatggagaattcctatcagaccactgcttcacggcatcctaagttttaatcaggacgaatgttcagataaacccaaaaaatccttgaaacgaggacaaatgcaacatttggccctcaagtcgctgcctcccattgtcatccccttttgaaacaacaaaaaatatcacacatgtctgacctgcctggccaacatggtgaaaccctgcctctactaaaagtacaaaaattagccgggtatagtggcaggtgcctgtaatcccagctactcgggagaggctgaggcagcagaattgcttgaatctggaaggcggaggttgcagtgagctgagattgtgccactgtgtgtgtgtgtgtgtgtgtgtgtgtgtgtgtgtgtgtggtgtatacacacacacacacatatatatctcccacatctcccacaagataaagtcaatatctggtc

SEQ ID NO: 3287 - DNA, 434 bp, Homo sapiens
  chr2.fa.O7frz.116967319
  Located on chromosome 2
  Distance between a terminus base of telomere on chromosomal short arm and 5'-terminus of this base sequence : 114682394
  Distance between 3'-terminus of neighbour sequence of sequence listing upward to telomere on chrosomal short arm and 5'-terminus of this base sequence : 145497
agattcttagaatcacggtaattttagcatcatcctttgatgacttataagcacccatgtcaaatttcactggtgaagagaagaaccaaaaagaaagtaaattcattgtatttgtataaaatcaagtgttgatgtagattgtgtgtgcatggtgtgtgtgtgtgtgtgtgtgtgtgtgtgtgtgtgtgtgtagttaggtccccacctatggtgtaaatacctggaagtcaggaatggaattctatacatctttgtgtccttcacaatgtcttccacactcactaggcaggtaaatacttggttaatgttcttagaattttctacgttgaatgaatccttcggggctgaataagtgttgaatctcttataatttcattagtgggataagaccctgtaatttgttagatcataagttcataatgacctaacatgga

SEQ ID NO: 3288 - DNA, 187 bp, Homo sapiens
  G10162
  Located on chromosome 2
  Distance between a terminus base of telomere on chromosomal short arm and 5'-terminus of this base sequence : 114917695
  Distance between 3'-terminus of neighbour sequence of sequence listing upward to telomere on chrosomal short arm and 5'-terminus of this base sequence : 234867
gaggcgtgagaatctcaagagcatactctgttgtctgcttagctctctgtgtttgctcatttactagggcagtgattggcacatggtatgaatgaatgaatgaatgaatgaatatgggggttggccatttggtgggtctagttgggattacactcttcagctctcttccagatccacttgaggatac

SEQ ID NO: 3289 - DNA, 254 bp, Homo sapiens
  chr2.fa.O7frz.117180447
  Located on chromosome 2
  Distance between a terminus base of telomere on chromosomal short arm and 5'-terminus of this base sequence : 114969952
  Distance between 3'-terminus of neighbour sequence of sequence listing upward to telomere on chrosomal short arm and 5'-terminus of this base sequence : 52070
ggtatgctttccattaatcacatctgggattgttaggaggttccaacacatcaccacgggcaccttctagtactctgagtctctgggttgagaggaaggagggagagacagagtgcgtgtgtgtgtctgtgtgtgtgtgtgtgtgtgtgtgtgtgtgtgtgtgtatctccattttagccctccacacagcaggttaatcaccacttttcctgacttgaagctgaacactcctaagtaatttgtagctaacctgc

SEQ ID NO: 3290 - DNA, 238 bp, Homo sapiens
  AC016683.6_146986
  Located on chromosome 2
  Distance between a terminus base of telomere on chromosomal short arm and 5'-terminus of this base sequence : 115133201
  Distance between 3'-terminus of neighbour sequence of sequence listing upward to telomere on chrosomal short arm and 5'-terminus of this base sequence : 162995
ctccagaaatactttgttgcacggatggatggatggatggatggatggatggatggatggatggatgcttgcttactcaaggaggaagggcacctatgttgtgggtggaggaggcaggctgtacacatgcccctatcctacctctgccagacaaagagactttaggctccacagccctgaggctcccctgcccacctgtgtgcttctgttccaggccctctactggtctatccgcagc

SEQ ID NO: 3291 - DNA, 398 bp, Homo sapiens
  AC016683.6_115878
  Located on chromosome 2
  Distance between a terminus base of telomere on chromosomal short arm and 5'-terminus of this base sequence : 115164137
  Distance between 3'-terminus of neighbour sequence of sequence listing upward to telomere on chrosomal short arm and 5'-terminus of this base sequence : 30698
agaccttgtcatcttgaatcatcattggatgatgactggcagacaaagaaacccaaatgactggcaggcaggttccagaacagtccaaatgaggatggagagctactccaggctcatttcatcctctatagtactcttagagtacctagaacccgggtcctatccatgcaggcttgagagagagatgtgaagcatatatttcatcatcatcatcgtcatcgtcatcatcatcatcatcatcatcaatacccttcagattcagattttacagaacgggtaaactgggattcatcagagttaaatcactgggagaccagcactgcttgagggtagggttcatcttccactcacagtgttttggggcccttagagtgctctccatttatgctcactgattc

SEQ ID NO: 3292 - DNA, 359 bp, Homo sapiens
  AC016683.6_69908
  Located on chromosome 2
  Distance between a terminus base of telomere on chromosomal short arm and 5'-terminus of this base sequence : 115234542
  Distance between 3'-terminus of neighbour sequence of sequence listing upward to telomere on chrosomal short arm and 5'-terminus of this base sequence : 70007
catctgctctgataaattccactcttggtcatatacgtgttcagacaggagactcctcagagaatattttcacagctagagaagaaagtggaatttcttcttcttcttcttcttcttcttcttcttcttcttcttcttcttcttcttcttcttcttcttcttcttcttcttcttctttttaatggacttcatttgagctgtaaatatgcctctagcactgacactgaaatttggtgacacatcgattcattcttggcattttaaatgtgtctatgataaaatcccctcagaggatcctttcagaacccagttgggagatatcaggggcactcctttaggtccagtagatgctttattct

SEQ ID NO: 3293 - DNA, 115 bp, Homo sapiens
  D2S1895
  Located on chromosome 2
  Distance between a terminus base of telomere on chromosomal short arm and 5'-terminus of this base sequence : 115235465
  Distance between 3'-terminus of neighbour sequence of sequence listing upward to telomere on chrosomal short arm and 5'-terminus of this base sequence : 564
aatgtgtagatgacatcctggggacacacacacacacacacacacacacacagacacacacacacacacacacagacacacacacacacaggttcattcatagcaaacattgtac

SEQ ID NO: 3294 - DNA, 220 bp, Homo sapiens
  AC016745.3_130608
  Located on chromosome 2
  Distance between a terminus base of telomere on chromosomal short arm and 5'-terminus of this base sequence : 115303930
  Distance between 3'-terminus of neighbour sequence of sequence listing upward to telomere on chrosomal short arm and 5'-terminus of this base sequence : 68350
cagaaacagagtggaacttgagttggacctgccatgtactgtgtgaccttgagcaagaccgttgactgcttgaacctgagtttattgaacctgtgaaatgggaataaaattattcacccagtttagatcaggatcaaactaccatcaccaccaccaccaccaccaccatcaccaccatcaccaccaccactactaaccctcttaaccgagtgagcattta

SEQ ID NO: 3295 - DNA, 395 bp, Homo sapiens
  chr2.fa.O7frz.117882245
  Located on chromosome 2
  Distance between a terminus base of telomere on chromosomal short arm and 5'-terminus of this base sequence : 115656461
  Distance between 3'-terminus of neighbour sequence of sequence listing upward to telomere on chrosomal short arm and 5'-terminus of this base sequence : 352311
tacagagcaagactctgtcaagaaagagaaaaaaagaagaaagagaagaaagaaagagggaaagaaaaggaaagaaaaagagagagaaagaaaaagaaagaaagaaagaaagaaagaaagaaagaaagaaagaaagaaagaaagaaagaaagaaaaagaaaggaagaaaggaaggaaggaagaaagaaagaaagaaaggagaaagaatcttattacccaaaagatctaaaccaattattttattttcatctgccgtaacatataagttatcatctttcaataattcctcacaaaatctctaaaagctaggccagcatgatgcaattctcagttatctagcaaacactatttttaaaaatgtgtattgggactaaacttacctctgaattcgatgt

SEQ ID NO: 3296 - DNA, 131 bp, Homo sapiens
  DID22N_0016950
  Located on chromosome 2
  Distance between a terminus base of telomere on chromosomal short arm and 5'-terminus of this base sequence : 116021142
  Distance between 3'-terminus of neighbour sequence of sequence listing upward to telomere on chrosomal short arm and 5'-terminus of this base sequence : 364286
tgcatgatatgttaatgggtctttgagaacaggatttaaaaattcacacacacacacacacacacacacacacacacacacacacacacagtcaactagctttaaataagacatttgctgagtagatgagc

SEQ ID NO: 3297 - DNA, 432 bp, Homo sapiens
  chr2.fa.O7frz.122921930
  Located on chromosome 2
  Distance between a terminus base of telomere on chromosomal short arm and 5'-terminus of this base sequence : 116089589
  Distance between 3'-terminus of neighbour sequence of sequence listing upward to telomere on chrosomal short arm and 5'-terminus of this base sequence : 68316
aacaagagtgaaactccatctcaaaaaataaaaagaaagaaagaaagaaggaaggaaagaaagaaggaaggaaaggaaaggaaaggaagaaaaacaaagaaagaaggaaggaaagaaagaaggaaggaaaggaaaggaaaggaaaggaaaggaaaggaaaggaagaaaaacaaagaaagaaggaaggaaagaaagaaggaaggaaaggaaaggaagaaagaaagaaagagagagaaaggaagaaagaaagagagagagaaagaaaaagaaagaaagaaaacaaaagaaaggaatgaagaaatttaaaaagaggaacctccatatttagccactattgatttatttaggttctggttggcagacttttatataaaaacaaagaacaaagtgacactccagggctggcctgagttgattccattagaacctgtt

SEQ ID NO: 3298 - DNA, 255 bp, Homo sapiens
  AC018686.5_221024
  Located on chromosome 2
  Distance between a terminus base of telomere on chromosomal short arm and 5'-terminus of this base sequence : 116279718
  Distance between 3'-terminus of neighbour sequence of sequence listing upward to telomere on chrosomal short arm and 5'-terminus of this base sequence : 189697
cagcattgtagctccaaatttcccctgggagttgagtttggctggagcttaaattagtataagggagttgtagaagctaatattcccacaacaaacatttaagacaatttcaaatatatatatctacacacacagacacacacacacacacacacacacacacctccatccccagagactttcattaccatctatatatggatcacacatatacagaattcttggatgtttgagtgcaagtgatagagtatctgc

SEQ ID NO: 3299 - DNA, 126 bp, Homo sapiens
  D2S1310
  Located on chromosome 2
  Distance between a terminus base of telomere on chromosomal short arm and 5'-terminus of this base sequence : 116292805
  Distance between 3'-terminus of neighbour sequence of sequence listing upward to telomere on chrosomal short arm and 5'-terminus of this base sequence : 12832
tatccacacactaatgtttaagttctatctatctatgtctctctgtgtatctctctccttcttatagacacacacacacagacacacacacacacacacacacacattacatcacaaggctcctgc

SEQ ID NO: 3300 - DNA, 276 bp, Homo sapiens
  AC073837.2_77607
  Located on chromosome 2
  Distance between a terminus base of telomere on chromosomal short arm and 5'-terminus of this base sequence : 116357983
  Distance between 3'-terminus of neighbour sequence of sequence listing upward to telomere on chrosomal short arm and 5'-terminus of this base sequence : 65052
aaggtatggaggttgaatgatccctaataaccattccaaagctcatcttctgttgcctccaaactgtaataataataataaaaaacattattaactgagcatttagtctgtacaaggtcctatggtgtttctctatattatctcagtagagaaacaaggcttgatgtgccctgtttggtggaaggtatatttctctatattatctcagttgattctcaactgggttgattctcaactgagataatatagatactatcaataaatgtaattggaggc

SEQ ID NO: 3301 - DNA, 349 bp, Homo sapiens
  AC012665.4_109354
  Located on chromosome 2
  Distance between a terminus base of telomere on chromosomal short arm and 5'-terminus of this base sequence : 116413824
  Distance between 3'-terminus of neighbour sequence of sequence listing upward to telomere on chrosomal short arm and 5'-terminus of this base sequence : 55565
ctggttaagtgccatagaaataaaaaggcttttgcaaaacattccacaacctgatttttaatttactgcatcatcagctacttttataataatatttaatctactgaaacaaaaccagccttagagggaaaaaaaaaaccaacaacaacaaagagaaagagagtttatttttagcagctccattcttgtgtaaggtagctagtgaaaccgaaactttacctaaggacactagtcctagtttcttctctctctctctctctctctctctctctcttccttctttccatttatttttttatttctccttttttctcagtggctgagagaatcaagttaaaggttagatctc

SEQ ID NO: 3302 - DNA, 416 bp, Homo sapiens
  AC012665.4_59830
  Located on chromosome 2
  Distance between a terminus base of telomere on chromosomal short arm and 5'-terminus of this base sequence : 116438943
  Distance between 3'-terminus of neighbour sequence of sequence listing upward to telomere on chrosomal short arm and 5'-terminus of this base sequence : 24770
gaatgatgcatacttgtttgaggagctgctagctaggggagtttggggatcatatagtcggaagactggcatgtgtttatcagagtgaaggctgagaaattttacctttctttctctccttttctaattttgggaaaaacgctcagcggtcttgaagagtggcccgtggctgtggggaacagagtgtatatttgtgtttatttgcttggtatgtgagagccacccagagagaaaattagtctataaaagtattgtgtgtgtgtgtgtgtgtgtgtgtgtgtgtgtgtgtagttgtgtgtggcaggaggcccctgtatgtatgtgaatgttaatgtgtacacccaagtcagccccactagtcaggcatgaagaaatgtatttgctgagggttttggtgtatgctgttcagaaaagaa

SEQ ID NO: 3303 - DNA, 354 bp, Homo sapiens
  AC012665.5_104293
  Located on chromosome 2
  Distance between a terminus base of telomere on chromosomal short arm and 5'-terminus of this base sequence : 116500344
  Distance between 3'-terminus of neighbour sequence of sequence listing upward to telomere on chrosomal short arm and 5'-terminus of this base sequence : 60985
aacagctaacacttaagacctgagcttctcgatggcttacaaaaaagggctttcaagggcagggatacatttcagaaagcagaagttacaggcaaaatcataaatcaatacatgtaagttattggtttggcccaaaaaggtgagctatctttctttctttttctttctttcttcctttctttctttctttctttctttctttctttctttctttctttctttcttttctgagatggagtctctctctgtcacccaggcttgagtgcagtggcacaatcttggctcactgcaacctctgcctcccaggttcaagtgattctcccacctcagcctcctgagtagctggaactacag

SEQ ID NO: 3304 - DNA, 299 bp, Homo sapiens
  AC013457.5_19294
  Located on chromosome 2
  Distance between a terminus base of telomere on chromosomal short arm and 5'-terminus of this base sequence : 116602458
  Distance between 3'-terminus of neighbour sequence of sequence listing upward to telomere on chrosomal short arm and 5'-terminus of this base sequence : 101760
ttagttgaagtccttcatttagagacaatggaggcctatggtggcaataagattggccccaggacatagctggttgactgctgatctggattagaactcaggtctcctggctcccaattcagggcttcattcactcaagaagctgtgccactcttggaacacacacacacacacacacacacacacacacacacagagttgctcaaatcagtgaatgattctgtctttgggcagcacaaatctttaatgttttgagatcacaatgaaatggaaattactcagaacaaacttctgctatg

SEQ ID NO: 3305 - DNA, 411 bp, Homo sapiens
  AC013457.5_87007
  Located on chromosome 2
  Distance between a terminus base of telomere on chromosomal short arm and 5'-terminus of this base sequence : 116639891
  Distance between 3'-terminus of neighbour sequence of sequence listing upward to telomere on chrosomal short arm and 5'-terminus of this base sequence : 37134
gcacaggttacagtgagctgagatcgcatcattgcactcaggcctgggcaacaagagagaagctgcatctcaaaaaaaaaaaaaaaaaaagaatatatatatatatatatatatatacacacacacacacacacacacacacgtatatatatagtgatatgcatgtaaaattgtgagtgtatatacaaataaatttgtaataaaaatttctaaaatagaaaagtgtaggagtatgcacaagtgggagagataacatttgaactggctgaatcactgcagtgttgtgatgaacatattggtttgaacgtattgaaaccagtctggtggcaagacctggaactctcctcttggccccgttctcattatcttggtcataataggggaaagatgtggaaatcatgttgattacac

SEQ ID NO: 3306 - DNA, 430 bp, Homo sapiens
  AC016673.3_64436
  Located on chromosome 2
  Distance between a terminus base of telomere on chromosomal short arm and 5'-terminus of this base sequence : 116726341
  Distance between 3'-terminus of neighbour sequence of sequence listing upward to telomere on chrosomal short arm and 5'-terminus of this base sequence : 86039
ataacacagctagttctgcactacccagaggccatgggctgctgtcctgagccgttttcttagccacagtgtcaggaactgccaggacctactggatgattgagatgaggtgtgtgtgtgtgtgtgtgtgtgtgtgtgtgtgtgtgtgtgtgtgtgtgtgcttattttctattgctgtgctcactaacttggtggcttaaaagaatagacatttattcttatagttctggaggccagaagtctgaactgagttttatggagctaaaatccaggtgtgggcagtgctgctttcttcacaggagcatctgctctgaatgtcccagctcgtagctgcctcactctcatctctgcttccatggtcacatggctttctcttctgtgccaaatctcccgctgcctccttcttataaggattctagtgatggtattg

SEQ ID NO: 3307 - DNA, 406 bp, Homo sapiens
  HUMUT7080B
  Located on chromosome 2
  Distance between a terminus base of telomere on chromosomal short arm and 5'-terminus of this base sequence : 116733357
  Distance between 3'-terminus of neighbour sequence of sequence listing upward to telomere on chrosomal short arm and 5'-terminus of this base sequence : 6586
gaaagcgaagaagggatgggcagtggcttctagaagctctgccgccggactgggagattttttggatagagagcatctcattcccagcacctacatagggttagcatacagctgtgcactgactacatggatgatggatgagtaggtgtatgtatgtatgtatgtatgtatgtatggatggatggatggatggatggatagatagatggatggatagatagatgaatagatggatagatggatggatgagtagatgctctagctaatgtatccaggatgctatgggagatagcatttccagggctgggatacagccctggaaagtgatctgctctaactgcctgacagagaggtgggaatctatatgcttgctctgtctcccatcatgtttaccatgttcagaccc

SEQ ID NO: 3308 - DNA, 435 bp, Homo sapiens
  AC016673.3_177170
  Located on chromosome 2
  Distance between a terminus base of telomere on chromosomal short arm and 5'-terminus of this base sequence : 116755040
  Distance between 3'-terminus of neighbour sequence of sequence listing upward to telomere on chrosomal short arm and 5'-terminus of this base sequence : 21277
gtttcagaaatccaggaattagcttatgttccaggctttgatgtgcggccatagctctgtgtggagatctcagacactccatatatgccctcccctccctgctcatgcctacacaagagacttcctccctgcctgggccggaggctgggtggctgagaggaacagttcttgcctttcggactccctatttcctgcctctcagctacttgctctatatacccactctgacacacacacacacacacacacacacacacacacacacacacacacttcccatgaaacacagctgtaatgaggcaaccaccagccctctccaacaggcagaagagagagaattcaagcacgaggctaaaaatgcagctttgacaacatcaaaagggcttcctcccaactgattgtatcctgcatgttcatgttttgtaaagtatttgg

SEQ ID NO: 3309 - DNA, 336 bp, Homo sapiens
  AC016736.4_63438
  Located on chromosome 2
  Distance between a terminus base of telomere on chromosomal short arm and 5'-terminus of this base sequence : 116815371
  Distance between 3'-terminus of neighbour sequence of sequence listing upward to telomere on chrosomal short arm and 5'-terminus of this base sequence : 59896
attataaagccgacttcggtacatataaagagatttggggtcggtgaatgggcccactaagctttattttgtggtgtcagctgtcttggttcatgtgtagacagcagggctcccaaagccagcatgctggggtctgtgagggaacaagcttcccatttcttgtatttatttatttatttatttatttatttattttttggagacagaatctcgctctgtcacctaggttggagtgcagtggtgccatcttggctcactgcaacctctgcctcccgatttcaagcaattctcctgcttcagcctcctgagcagctgggattacaggtgtgctccacc

SEQ ID NO: 3310 - DNA, 208 bp, Homo sapiens
  D2S2254
  Located on chromosome 2
  Distance between a terminus base of telomere on chromosomal short arm and 5'-terminus of this base sequence : 116819000
  Distance between 3'-terminus of neighbour sequence of sequence listing upward to telomere on chrosomal short arm and 5'-terminus of this base sequence : 3293
tccaggttattaagtcaggaggcttttaaatttcaggggttcaaggatttatcacacacagttgcgtgtgtgtgtgtgtgtgtgtgtgtgtgtgtgtgtgtgtgtgtttaaggatgttaatgtttatgatgcatttctgtggaatgcaggcccattgggaattgtaaatttttcttattggtaaccatttctgcattggtttagcacg

SEQ ID NO: 3311 - DNA, 476 bp, Homo sapiens
  AC013275.5_55668
  Located on chromosome 2
  Distance between a terminus base of telomere on chromosomal short arm and 5'-terminus of this base sequence : 117004510
  Distance between 3'-terminus of neighbour sequence of sequence listing upward to telomere on chrosomal short arm and 5'-terminus of this base sequence : 185302
actattaaatctgatcctctggagcagggcccaagggtccaagcatcaccctccctctcctccccacctttttttaaaaaagagacagagttttgctctttcgcccaggctgaagtgcaatgacatgatcatagctcactgcaaccttgaattcctgagcttaagtaatcctcccaactcagccttccaagtaactggaactacaggcatgtgccaccatgtctgaaatacacacacacacacacacacacacacacacacacacatatacacatatagcttgaaagagagtctggctatgtgtcaaagctagtcttgcactcccgtcctcaagtgatcctcccacctcagactctcaaagcaagcactgggcagcatccatatttttaaaagctccccatgggagtccactgagcagccaaggatgggaaccaccagtccagtgggtgaaagtatcaggaagcagaacattagta

SEQ ID NO: 3312 - DNA, 229 bp, Homo sapiens
  AC013275.6_79557
  Located on chromosome 2
  Distance between a terminus base of telomere on chromosomal short arm and 5'-terminus of this base sequence : 117048067
  Distance between 3'-terminus of neighbour sequence of sequence listing upward to telomere on chrosomal short arm and 5'-terminus of this base sequence : 43081
taacgttcatgtttatcaaatgagcaactaatggatgaatggatagaggaatggatggatgagtgggtggatgtgtgcatgggtgggtgggtggatggatggatggatggatggatggatggatggatgggtgttaatggcagggtaaaagttaaagggctttggaaacagacaagtcttggcttgaatcctgaggtctgtccttgtttaccatgtgagttggtatgtt

SEQ ID NO: 3313 - DNA, 427 bp, Homo sapiens
  chr2.fa.O7frz.124155683
  Located on chromosome 2
  Distance between a terminus base of telomere on chromosomal short arm and 5'-terminus of this base sequence : 117296062
  Distance between 3'-terminus of neighbour sequence of sequence listing upward to telomere on chrosomal short arm and 5'-terminus of this base sequence : 247766
ttacagttgctttgttcaaatcaagatttaaacaaggttcacacattgcatttggtagatatgtctcctgagcgtcttttaatcttaagcagtcctccccactagacaatcacacgcagacacacacacacacacacacacacacacacatacacacacacacagtcgcactggcacaccctgctcatgcccacttctcacatcactctttgtaaaaactatcctgtcagttttggtccacagcccttctctcacagggcacacaccctctcctcccttctctggacccctagagactccaagtcactgagccacagcttggtattgactcttattgttttctacatttctttgttttgttttcctcatactaggtaatgccccacagaggcaagaactaagtctcataatgaccttaacatcaaag

SEQ ID NO: 3314 - DNA, 103 bp, Homo sapiens
  DISO7_10000956
  Located on chromosome 2
  Distance between a terminus base of telomere on chromosomal short arm and 5'-terminus of this base sequence : 117496490
  Distance between 3'-terminus of neighbour sequence of sequence listing upward to telomere on chrosomal short arm and 5'-terminus of this base sequence : 200001
agacactgttggagtctaggcattggctggccatacctgcagctgctgacacacacacacacacacacacacacacctttcaggggctcaataatggacctac

SEQ ID NO: 3315 - DNA, 329 bp, Homo sapiens
  chr2.fa.O7frz.124556889
  Located on chromosome 2
  Distance between a terminus base of telomere on chromosomal short arm and 5'-terminus of this base sequence : 117708061
  Distance between 3'-terminus of neighbour sequence of sequence listing upward to telomere on chrosomal short arm and 5'-terminus of this base sequence : 211468
aatattaaggcctggacagtaggaggcagaggaagagaccacagatgataaggatatcatggcattaagcctttttttctggaaatgtgtgtgtgtgtgtgtgtgtgtgtgtgtgtgtgtgtgtgtgtgtgtgtgtgtttagaggggaactcccagctgactttataaagcatctgggctaagtttacagctgtgaataattttagctgtcattttttcatgacaacccttcccatcatgcctccaaattaagtaaccatgagcatatggcagcagggtattggttaggcaaattttggcgcatccttgaaattaatactatgcagctc

SEQ ID NO: 3316 - DNA, 178 bp, Homo sapiens
  DISO7_10000957
  Located on chromosome 2
  Distance between a terminus base of telomere on chromosomal short arm and 5'-terminus of this base sequence : 117793379
  Distance between 3'-terminus of neighbour sequence of sequence listing upward to telomere on chrosomal short arm and 5'-terminus of this base sequence : 84989
aataacacagaaagaatggtgctttaaaacacacacacacacacacacacacacacacacacatttttgaaggttaaaaggagacagtaaatctctcattgaaaatgtctatgtatttgtgagtttagttttatatgaaagcataacttgtttataaacagcagtttcctgttgaatc

SEQ ID NO: 3317 - DNA, 282 bp, Homo sapiens
  chr2.fa.O7frz.124653314
  Located on chromosome 2
  Distance between a terminus base of telomere on chromosomal short arm and 5'-terminus of this base sequence : 117857222
  Distance between 3'-terminus of neighbour sequence of sequence listing upward to telomere on chrosomal short arm and 5'-terminus of this base sequence : 63665
caatgcaatcctactcaaataccaacagcgtttttgcagaaatagaaaaactgatcctcaaattcattaaaaaaaaaaaatccccgcaaggcattaaaacacacacacacacacacacacacacacacacaaacttgaagttgccaaaacaatctgtaaaggcagcacaaagtcggactcacacttcccaatgtcagaacttactacaaagctacaataatcaaaacaggtttggcataaggatatatggtccaatggaactgagagtccagaaataagctc

SEQ ID NO: 3318 - DNA, 241 bp, Homo sapiens
  D2S2341
  Located on chromosome 2
  Distance between a terminus base of telomere on chromosomal short arm and 5'-terminus of this base sequence : 118015338
  Distance between 3'-terminus of neighbour sequence of sequence listing upward to telomere on chrosomal short arm and 5'-terminus of this base sequence : 157834
tgcctggaatgatgggggcttggtttgcctgctcagccccctccccacctcttcctgtggggtctgtgtgtggagcacaagtcaggccccagggtccccaggggccagggtcaggcagggagggagactcttcctggccaccctgggcacctgtgtgtgtgtgtgtgtgtgtgtgtgtgtgtgtgtgtgtgtcagtgggtgtgtgtgtgtgtgtggatctggaggattctcctaggcagct

SEQ ID NO: 3319 - DNA, 314 bp, Homo sapiens
  AC018737.6_106785
  Located on chromosome 2
  Distance between a terminus base of telomere on chromosomal short arm and 5'-terminus of this base sequence : 118095590
  Distance between 3'-terminus of neighbour sequence of sequence listing upward to telomere on chrosomal short arm and 5'-terminus of this base sequence : 80011
ctggccttaagatgagcatttttatttatttatttatttatttatttatttattattttgagaaggagtcttgctctgtcgccctggctggaatgcagtggctcgatctcagctcactgcaacttccgcctcccaagtgattctcctgcctcagcctcctaaatagctgggattaaaggcacgcgccaccacagtcagctaatttttgcatttttagtagggacagggtttcatcatgttggccaagccggtctcgaactcctgaccttgtgatctgcctgcctcggcctcccaaagtgctaagattacaggcg

SEQ ID NO: 3320 - DNA, 435 bp, Homo sapiens
  AC018737.3_196348
  Located on chromosome 2
  Distance between a terminus base of telomere on chromosomal short arm and 5'-terminus of this base sequence : 118143060
  Distance between 3'-terminus of neighbour sequence of sequence listing upward to telomere on chrosomal short arm and 5'-terminus of this base sequence : 47156
tattgacctgttagcacttaagtctgccattttggttttttgctttctgtttgttctctgttttttatttctgttttctttttctgccttcctgtgaacatttttaagaattccactttgcactgtttttgaaaagatctctttgcatagctttgtggttactctaaatgttgcgtgtgtgtgtttgtgtgtgtgtgtgtgtgtgtgtgtgtgtgtgtagacatttatcactgtctactggtattatcattttattagctcaagtgaaatatagaaacttcatttccctatatccctttactctcccccattaataatagttgaatgtttcctctacatacagttataaccacatcagacaatattataattttcgcttcaacaatcaaacatcgtttagaaaactcaagagaaggaaagtctattgaatttacc

SEQ ID NO: 3321 - DNA, 449 bp, Homo sapiens
  AC018737.3_31333
  Located on chromosome 2
  Distance between a terminus base of telomere on chromosomal short arm and 5'-terminus of this base sequence : 118153310
  Distance between 3'-terminus of neighbour sequence of sequence listing upward to telomere on chrosomal short arm and 5'-terminus of this base sequence : 9815
tctatggagtatcggcctcttctggaagcttgttaggaacacagaacctgggccacctcagacctactgaatcagcacctgcctggtgcaggcaatccacatgctcattcaagtttgagaagccttggatcactacccccctggggggatgtaaggcaagaccaggaactcatagaggtggaggtgactgggaatacctgaaaaaggatttccatagagaagtgcttgccgtcattccttcctgtatcctcatctcccctaagtagctatgagacatgtcaagattccaccttcaggaaggaggggagtgttcacacacacacacacacacacacacgcacacacacacgaggacacggatggtaccttcagggaaccagtgaacttatctacatcctctggaatttgggggatacagggattgtacctggtttatacaccaacatctg

SEQ ID NO: 3322 - DNA, 149 bp, Homo sapiens
  Z66623
  Located on chromosome 2
  Distance between a terminus base of telomere on chromosomal short arm and 5'-terminus of this base sequence : 118153588
  Distance between 3'-terminus of neighbour sequence of sequence listing upward to telomere on chrosomal short arm and 5'-terminus of this base sequence : -171
tcaagattccaccttcaggaaggaggggagtgttcacacacacacacacacacacacacgcacacacacacgaggacacggatggtaccttcagggaaccagtgaacttatctacatcctctggaatttgggggatacagggattgtac

SEQ ID NO: 3323 - DNA, 410 bp, Homo sapiens
  AC018737.6_59429
  Located on chromosome 2
  Distance between a terminus base of telomere on chromosomal short arm and 5'-terminus of this base sequence : 118176285
  Distance between 3'-terminus of neighbour sequence of sequence listing upward to telomere on chrosomal short arm and 5'-terminus of this base sequence : 22548
tcacttgaggtcaggagtttaagaccatcctggccaacatggtgaaaccccgtctctactaaaaatacaaaattagctgggtgtcctgtcaggtgcctgtaatcccagctgggaggctgaggcaagagaatcacttgaacctgggagctggagattgcagtgagctgagattgcaccattgcactccaacctgtcaacagagtgagactccgtctcaaaaataaataaataaatacataaatacataaataaataaataaataaataaataattttacacaagagaactttgctttagtaccacaatcactgtaaacacaatctgtagcccttggtgttcggagtatatttcctgttttccagtcactgggctattttggttttatttcttattcatgaggcctgaacta

SEQ ID NO: 3324 - DNA, 193 bp, Homo sapiens
  D2S343
  Located on chromosome 2
  Distance between a terminus base of telomere on chromosomal short arm and 5'-terminus of this base sequence : 118237536
  Distance between 3'-terminus of neighbour sequence of sequence listing upward to telomere on chrosomal short arm and 5'-terminus of this base sequence : 60841
taattgtgctactgcatgctagcctgggtgacagagtgagaccctgtctctctctctctcacacacacacacacacacacacacacacacacacacagcaaatcaaaatcagtcaccccattatcaacatccctcaccggagtggttacaattgatgaacctacactgacacatcattatcaccctaagtgca

SEQ ID NO: 3325 - DNA, 254 bp, Homo sapiens
  AC018737.3_67168
  Located on chromosome 2
  Distance between a terminus base of telomere on chromosomal short arm and 5'-terminus of this base sequence : 118262789
  Distance between 3'-terminus of neighbour sequence of sequence listing upward to telomere on chrosomal short arm and 5'-terminus of this base sequence : 25060
tttccttgtagatgttaccaatactgccttctagagatgggtactagatacagaagatttactgaataattgcttctgcgtgtgtgtgtgtgtgtgtgtgtgtgtgtgtgtgtgtgtgtgtgtttctttccaatatggtgatctaccaaactttctgtagttttcaatacttgtagtaatggatgatgattgtgatatcaggattacaatttgatttaactttaaaaacaactttctggaatttattggataga

SEQ ID NO: 3326 - DNA, 169 bp, Homo sapiens
  Z67525
  Located on chromosome 2
  Distance between a terminus base of telomere on chromosomal short arm and 5'-terminus of this base sequence : 118529814
  Distance between 3'-terminus of neighbour sequence of sequence listing upward to telomere on chrosomal short arm and 5'-terminus of this base sequence : 266771
ggtggtgagataaacaccttcaccccaaatttggcttaaatgtgaagactgatggcatcacacacacacaaacatacacacacacacacacacacacacaccccaagaggatatgaaaatgttattcatatttgagaatttctgtgaagagcctggaaacttctcaaga

SEQ ID NO: 3327 - DNA, 178 bp, Homo sapiens
  D2S2212
  Located on chromosome 2
  Distance between a terminus base of telomere on chromosomal short arm and 5'-terminus of this base sequence : 118647681
  Distance between 3'-terminus of neighbour sequence of sequence listing upward to telomere on chrosomal short arm and 5'-terminus of this base sequence : 117698
gctaagacttgtggtcctgctcccaggatgtcagggactgggtcagcctcctcctgcctgaaagaggccccgcccctgtgtgtgtgtgtgtgtgtgtgtgtgtgtgcgtgtgtgtgcaccctgccccactccgccccaccagaagtaggcaagttctggggatgggctctctggaagg

SEQ ID NO: 3328 - DNA, 189 bp, Homo sapiens
  Z67547
  Located on chromosome 2
  Distance between a terminus base of telomere on chromosomal short arm and 5'-terminus of this base sequence : 118720728
  Distance between 3'-terminus of neighbour sequence of sequence listing upward to telomere on chrosomal short arm and 5'-terminus of this base sequence : 72869
cagagcagaatgcgtgggccagttggggtctctggttccccagttgggaggaggaccattgcaagccagtctggagggtgtgtgtgtgtgtgtgtgtgtgtgtgtgtgtgtgtgtgtgatgctgggctctgggaaagataaatgaaggcccttctccttcactccagttcacttttggatgaactgttg

SEQ ID NO: 3329 - DNA, 298 bp, Homo sapiens
  D2S283
  Located on chromosome 2
  Distance between a terminus base of telomere on chromosomal short arm and 5'-terminus of this base sequence : 118764963
  Distance between 3'-terminus of neighbour sequence of sequence listing upward to telomere on chrosomal short arm and 5'-terminus of this base sequence : 44046
ttagcgtgccatcctcatgctggcctcaggaggtgagaacccctattctcatttttccaaagtaaatttgtgtgtgtgtgtgtgtctgtgtgttttggttttggggtttttttttgagacagggtcttggaacccctattctaatttttccaaagtgtgtgtgtgtgtgtgtgtgtgtgtgtgtgtgtgtgtgtgtgtgtgtgtgcgtgtatattttggttttgggtttttgttttgttttgttttgttttgttttgttttgttttgttttgttttttgagtcagggtcttgctgttt

SEQ ID NO: 3330 - DNA, 163 bp, Homo sapiens
  D2S2265
  Located on chromosome 2
  Distance between a terminus base of telomere on chromosomal short arm and 5'-terminus of this base sequence : 118824825
  Distance between 3'-terminus of neighbour sequence of sequence listing upward to telomere on chrosomal short arm and 5'-terminus of this base sequence : 59564
ggttcaatatagacccagcccaaagcactctgtgggctgtgccctgcccctcaggcataaccttctcacacacacacacacacacacacacacacacacagctttgtgctccagcctttctttgcacacactgcttcctttgttggtaatgcactacctcgtg

SEQ ID NO: 3331 - DNA, 315 bp, Homo sapiens
  U96763.1_587
  Located on chromosome 2
  Distance between a terminus base of telomere on chromosomal short arm and 5'-terminus of this base sequence : 118878929
  Distance between 3'-terminus of neighbour sequence of sequence listing upward to telomere on chrosomal short arm and 5'-terminus of this base sequence : 53941
ttcagaaagacattcataccaccaaggccagaagcaacaagcactgacagctctcagtctgtcctcgtgggctccagcttgtccttgctcccccagtctataggtatcttctcttcctgaccacctgcctgtgggctttgagttccagcatcagacacagcaaaaaggccttacagagactgcttgaccagccctcatgactgtgaaaggccaggtccttgcagcagatccatttctctatctatctatctatctatctatctatctatctatctatctatctatctatccatccatctgtctacctatctacct

SEQ ID NO: 3332 - DNA, 293 bp, Homo sapiens
  U96763.1_709
  Located on chromosome 2
  Distance between a terminus base of telomere on chromosomal short arm and 5'-terminus of this base sequence : 118879065
  Distance between 3'-terminus of neighbour sequence of sequence listing upward to telomere on chrosomal short arm and 5'-terminus of this base sequence : -179
tttgagttccagcatcagacacagcaaaaaggccttacagagactgcttgaccagccctcatgactgtgaaaggccaggtccttgcagcagatccatttctctatctatctatctatctatctatctatctatctatctatctatctatctatccatccatctgtctacctatctacctgcccacctatctatctacctattatctagctagctagtatgatctctgtatcatctatctatctatctatctatctatctatcatctatcatgatttctttgtctgacatctat

SEQ ID NO: 3333 - DNA, 138 bp, Homo sapiens
  D2S2258
  Located on chromosome 2
  Distance between a terminus base of telomere on chromosomal short arm and 5'-terminus of this base sequence : 118914699
  Distance between 3'-terminus of neighbour sequence of sequence listing upward to telomere on chrosomal short arm and 5'-terminus of this base sequence : 35341
gcatatcacagccttcttgcacttaggaacaccaaacagcacttcagcactaggtttggggcaattttaaatggcaaagccaccgacaacacacacacacacacacacacacacacaatgtagaaaatgtggcactaa

SEQ ID NO: 3334 - DNA, 407 bp, Homo sapiens
  chr2.fa.O7frz.125685146
  Located on chromosome 2
  Distance between a terminus base of telomere on chromosomal short arm and 5'-terminus of this base sequence : 119017406
  Distance between 3'-terminus of neighbour sequence of sequence listing upward to telomere on chrosomal short arm and 5'-terminus of this base sequence : 102569
ctagttcgtagaacattgcctggcccatagcagaccctcaaaaaatatttgttaaatgaccaaagtggaattttgccaacccatggaaaatcctgtgccttcactggaataattgatgaccaccacgatgatgtctgcagatcaccgaatttccccctactggtctttggttgtaaaactaggcacagaatatccccaaacttccaagttatacttagctgtatatatatatatgtgtgtgtgtgtatatatatatatatacacacacacacacatatatatacacatatgtgtatctacatatatacacatatatacacacatatgtgtatatacagagagagagacagagagagacagagagagagagagacagagagagagagttaagctgtttcgatacaatg

SEQ ID NO: 3335 - DNA, 410 bp, Homo sapiens
  chr2.fa.O7frz.126040049
  Located on chromosome 2
  Distance between a terminus base of telomere on chromosomal short arm and 5'-terminus of this base sequence : 119138711
  Distance between 3'-terminus of neighbour sequence of sequence listing upward to telomere on chrosomal short arm and 5'-terminus of this base sequence : 120898
tgaacatttagatggcatagagaaactgcagtagtgatggaataaaacctgtctccctctttatctaattttctctttcttttcttttctttctttcaccttttctcctcctcctctttttctcttttcttcttccttccttccctccttccctccttccttccctcttttcttttctcttttcttttttttctttctttctttcttttctttctttctttctttctttctttctttctttctttctttctttctttctttttctttctttccttctttctcttcctctctctctttctgtctctccctctttctctctctcccccacctcctcctccttcgtgtttttttaaaacacaactcccagtgtaattctttgatctcttttgaacttcaaacctttgactgtt

SEQ ID NO: 3336 - DNA, 377 bp, Homo sapiens
  chr2.fa.O7frz.125811119
  Located on chromosome 2
  Distance between a terminus base of telomere on chromosomal short arm and 5'-terminus of this base sequence : 119300109
  Distance between 3'-terminus of neighbour sequence of sequence listing upward to telomere on chrosomal short arm and 5'-terminus of this base sequence : 160988
ccatagtgcataggaacagtaaagccagggtgctgacgtgtgtgtgtgtgtgtgtgtgtgtgtgtgtgtgtgtgtggtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagac

SEQ ID NO: 3337 - DNA, 101 bp, Homo sapiens
  DISD22_0001805
  Located on chromosome 2
  Distance between a terminus base of telomere on chromosomal short arm and 5'-terminus of this base sequence : 119454957
  Distance between 3'-terminus of neighbour sequence of sequence listing upward to telomere on chrosomal short arm and 5'-terminus of this base sequence : 154471
ttgcaggacttcctactggagataatagcaatctccacacacacacacacacacacacacacacacacacacacacacacgtttatgtggaagttgttgcc

SEQ ID NO: 3338 - DNA, 261 bp, Homo sapiens
  chr2.fa.O7frz.126519393
  Located on chromosome 2
  Distance between a terminus base of telomere on chromosomal short arm and 5'-terminus of this base sequence : 119669747
  Distance between 3'-terminus of neighbour sequence of sequence listing upward to telomere on chrosomal short arm and 5'-terminus of this base sequence : 214689
gagtgctttagatatgaaagatttctatctcaacatactgttaggatatgatatatatgatctatcatatcctaacatatatatgtatatatggagatatatatggatatatatatatatggagatatatatggagatatatatggatatatatatatgggtgtgtgtgtgtgtgtgtgtgtgtgtgtgtatatatatatatatatatatatatatatatatatatgagtttattaagtattaacttacacgatcacaagg

SEQ ID NO: 3339 - DNA, 242 bp, Homo sapiens
  D2S2224
  Located on chromosome 2
  Distance between a terminus base of telomere on chromosomal short arm and 5'-terminus of this base sequence : 119748658
  Distance between 3'-terminus of neighbour sequence of sequence listing upward to telomere on chrosomal short arm and 5'-terminus of this base sequence : 78650
atgtgtgcctgtgggtttaggtgtgtgtgtgtgtgtgtgtgtgtgtgtgtgtgtatatatatatatgtatgtatgtatgtgtatatatatatacatatatatatataatttttgatgttgtattcttgtgctcaaaccactggactaatgtgtctagttaaaccattgaaatagaagtttcactgggaagaatggaaatggaccccaggcccaccacggtggaggggcaccgggatggagtt

SEQ ID NO: 3340 - DNA, 458 bp, Homo sapiens
  AC011246.3_184869
  Located on chromosome 2
  Distance between a terminus base of telomere on chromosomal short arm and 5'-terminus of this base sequence : 119808184
  Distance between 3'-terminus of neighbour sequence of sequence listing upward to telomere on chrosomal short arm and 5'-terminus of this base sequence : 59284
ctttagatacctttcactgtggagtccatgtttctccatctggtctgagagcttacattaatagtgatcaccatcctctctagcaaatttgaatttttcctctctgaggatctctcttttatctttaaatgttcttttaacattcagtgctctctcatttatccttaaaacaaaactcaaaaccgtcacttgatctttctatgcttattggatatcaaattccaggaatatagaatgtatattttttgcctcaacttccatccagccattgatccatccatccatccatccatccacccatccacccaaccatccatccatccatccatccatccatccatccatccatccatccttttatatatccaaatagctaaaaaagaatatataagtgatattttatatagtcatctgtctacacagaaaaacattttctaagttttcactaaatgccagaa

SEQ ID NO: 3341 - DNA, 476 bp, Homo sapiens
  AC011246.3_91906
  Located on chromosome 2
  Distance between a terminus base of telomere on chromosomal short arm and 5'-terminus of this base sequence : 119920199
  Distance between 3'-terminus of neighbour sequence of sequence listing upward to telomere on chrosomal short arm and 5'-terminus of this base sequence : 111557
ttcctcataattcagacgtcaggtggttgaggtctttcctgaggaccctgtgtgatgaaggccatcctgtcctctgctcctctctcccatcacgatgtcagttggatggtttctgcgggggtccaggagggtctgtatgcccctctccatctcagtttcctctattgttaacatcttgcagtagtgtaatacttttattaaaattgatgagctaatattgatagatgatgatgatgatgacgatgatgattactcttagagagagggtcttattctctcacccaggctggagtgccgtggtgtgatctagttcattgtaaccttgaattcctggactcaaacagtcccccaccccagtctcaagtggctaagaccacaggcatacaccaccatgcctgactaggaccacaggtgcacagcaccacacctagtttttaaaattattttttgtagagatgaggtttcattacgttatg

SEQ ID NO: 3342 - DNA, 378 bp, Homo sapiens
  AC019110.4_25141
  Located on chromosome 2
  Distance between a terminus base of telomere on chromosomal short arm and 5'-terminus of this base sequence : 119982149
  Distance between 3'-terminus of neighbour sequence of sequence listing upward to telomere on chrosomal short arm and 5'-terminus of this base sequence : 61474
gaaacttaaaatcatggtagcaggagaaaaggaagcaaggtacgtcttacatggtggctggagagagagagacagagagagagagagagagagaaagaggtagagacagagagagagagagagagagaggaagtgccacacttctaaaaccatcaaatctcatgagaactcacttactgtcatgagaacagcatgggggaaactgcccccatgattcagtcgcctcccaccagttccttcccttgacacatgaggattacaattctagatgaggtttgggtggcggacacagagctaaaccgtatcaagaactaaggggagatttcagctgatttttaccacaggggaactggagtctggactttgagtatagtcaaa

SEQ ID NO: 3343 - DNA, 261 bp, Homo sapiens
  chr2.fa.O7frz.126948041
  Located on chromosome 2
  Distance between a terminus base of telomere on chromosomal short arm and 5'-terminus of this base sequence : 120098416
  Distance between 3'-terminus of neighbour sequence of sequence listing upward to telomere on chrosomal short arm and 5'-terminus of this base sequence : 115889
cacctactttgttctaggcactttacttggggtaaagcagtgacaatggacagaccaggactctcctggctgaccatacattctagtgtgtgtgtgtgtgtgtgtgtgtgtgttgaggggaggagcatgggagtaataaataaacaagagaaaaaagccaggtgacataaaagaaatgatgagcctgtggtagggccactgatgtgagaatggttgaggatgattctttaggaaatactatttaagcttagtgttgaagga

SEQ ID NO: 3344 - DNA, 154 bp, Homo sapiens
  Z67222
  Located on chromosome 2
  Distance between a terminus base of telomere on chromosomal short arm and 5'-terminus of this base sequence : 120210640
  Distance between 3'-terminus of neighbour sequence of sequence listing upward to telomere on chrosomal short arm and 5'-terminus of this base sequence : 111963
cccacaatatgaaaaccagtttctctgattacaagaaaacagaggagtatgtgtgtggcctggtgtgtgtgagtgtgtgtgtgtgtgtgcgtgtgtgtaacacctactgcagataagcaaggcctcgttggcattttcattgtgtttgctctgg

SEQ ID NO: 3345 - DNA, 134 bp, Homo sapiens
  DISO7_00000952
  Located on chromosome 2
  Distance between a terminus base of telomere on chromosomal short arm and 5'-terminus of this base sequence : 120273283
  Distance between 3'-terminus of neighbour sequence of sequence listing upward to telomere on chrosomal short arm and 5'-terminus of this base sequence : 62489
ctgtaggattcactgtcaccacatcaaaaaagctttgctgctgctgctgctgctgctgctgctgctgctgttgctgctgctgctgctgttgctgctgctgctgctgctgctgctgagcccaacttatccttggt

SEQ ID NO: 3346 - DNA, 375 bp, Homo sapiens
  chr2.fa.O7frz.127892815
  Located on chromosome 2
  Distance between a terminus base of telomere on chromosomal short arm and 5'-terminus of this base sequence : 120487701
  Distance between 3'-terminus of neighbour sequence of sequence listing upward to telomere on chrosomal short arm and 5'-terminus of this base sequence : 214284
tgcacttacatgttctaggaactgtgctaagtgctttacttatattatttctttcataaaacaaggcactgaattaatgcatgccatgaattcaataaaaattatatatagaagtaaacctattaggatatggaccaatgaattatatttgggattgttgttagtagttgtgtgtgtgtgtgtgtctgtgtgtgtgtgtgtatatatatatgtttactttcttaactttgctactatattttgtgagaaaggtattttataatctgaaaagactccatatttttgtttattcttggttttcatacgatagtcaagtcttcgtccctgattttgtgtcattttctatacccatctaccttgccactcaagtttctg

SEQ ID NO: 3347 - DNA, 446 bp, Homo sapiens
  chr2.fa.O7frz.127694819
  Located on chromosome 2
  Distance between a terminus base of telomere on chromosomal short arm and 5'-terminus of this base sequence : 120681012
  Distance between 3'-terminus of neighbour sequence of sequence listing upward to telomere on chrosomal short arm and 5'-terminus of this base sequence : 192936
gtcaaactattcttgtttgcagatgatatgatcttatatttggaaaaaactacagactcctccaaaaagctattagaactgataagcacattcagtaaagttgtaagatgcaaaatcagcatacaaaatcagtagcatttctatatgccaacagcaatctgaaaaagaaatcaagaatgtaatcccacttacaatagctgcaaataaaatgaaatatctgggaattaaggtaaccaaagaagtgaacgatttctaaaagattataaaacattcgtgaaataaattgaaaaagacacacagacacacacacacacagacacacacacacacacacacacatacgatagccatgtttatgctatgaaaaaatactgttaaactgtccatactacacaaagcaatctgtagattcaatgcaatccctaagaacataccaatgacatgtt

SEQ ID NO: 3348 - DNA, 412 bp, Homo sapiens
  chr2.fa.O7frz.127598839
  Located on chromosome 2
  Distance between a terminus base of telomere on chromosomal short arm and 5'-terminus of this base sequence : 120776987
  Distance between 3'-terminus of neighbour sequence of sequence listing upward to telomere on chrosomal short arm and 5'-terminus of this base sequence : 95529
acagtacaatagaacaccaggtagacttctaagattttaaatccagtccctgacacctggatggcacctccagaaccacctgggccctgggggtacttgccaccctgaagagaagacaggcctggatggctttgccacctgctgattgtagagccataaggccttgagcaaacataggtagtggccagggaatggttacagcaggccttggccgagacccagtgttatgctagatttaggtttgacccaccacagtcatagtggtggttaccacaagggtgcttctgtcagtccacctcaagctttaggtggctcagaagagagagggagagagagagagagagtgagagagtccatttgtttgtgagaaagtaggggaatggaacaagagtctttacctggtaatccagag

SEQ ID NO: 3349 - DNA, 336 bp, Homo sapiens
  chr2.fa.O7frz.127370685
  Located on chromosome 2
  Distance between a terminus base of telomere on chromosomal short arm and 5'-terminus of this base sequence : 121005847
  Distance between 3'-terminus of neighbour sequence of sequence listing upward to telomere on chrosomal short arm and 5'-terminus of this base sequence : 228448
tagtgctaacgaattctgaaagcaacactagtgagaacagcctcccactgccatcactacctccacaagacacacacacacacacacacacacacacacacacacaggaatcacaattcaacaaacaattattaaaaataacaatcaaacacatataacatgtatatggcaattattacatgccactcactattctaagcaataacttattgaattatcactacatctctgtgaggtaagtattgtctgttacatatatgaggaagctgaggcacttcaagtttgagcaacttgtcccaacttccataggaagtaaatatcggattcacatctaaa

SEQ ID NO: 3350 - DNA, 316 bp, Homo sapiens
  chr2.fa.O7frz.127285491
  Located on chromosome 2
  Distance between a terminus base of telomere on chromosomal short arm and 5'-terminus of this base sequence : 121090597
  Distance between 3'-terminus of neighbour sequence of sequence listing upward to telomere on chrosomal short arm and 5'-terminus of this base sequence : 84414
gtttggcctataaatttcagacttgtcagcctctgtaatcttttcaacctattccttaaaatctctcctgctcatctatctatctatctatcaatctatctatctatctatctatctatctatctttctatctatctatctatctgctgtttatctggagaaccataacaaatacagtatccttaatttcatttcagagataaagtttagaaaaataagttgctttcccaaagtcaaatagctgataaatgatgggtccagtagttgaagctggactttttaaaaaatatttcttctgtaggatgtcaactaatgc

SEQ ID NO: 3351 - DNA, 355 bp, Homo sapiens
  chr2.fa.O7frz.128081195
  Located on chromosome 2
  Distance between a terminus base of telomere on chromosomal short arm and 5'-terminus of this base sequence : 121184984
  Distance between 3'-terminus of neighbour sequence of sequence listing upward to telomere on chrosomal short arm and 5'-terminus of this base sequence : 94071
ggtaagaaaccaagtagtcgaggctggaacattccatactaccctgagcctgggaagagctgagtgatgtgtggcacttaaaaacactaagaaaagtagttacattatacattatattgcacaaaactgcttctgtgcgcatacacacacacacacacacacacacacacacacaaacacaggaacaaacatagatacattgtgtaactgatcggagatagaaataattgaggtagtgatacagaaaaggtaaatgttacccattccaagacacatttgatataataacaacaagtcttttagttaaatatatttatgattgttgaaggaagtctaaaaccttggtttaactgct

SEQ ID NO: 3352 - DNA, 200 bp, Homo sapiens
  Z66747
  Located on chromosome 2
  Distance between a terminus base of telomere on chromosomal short arm and 5'-terminus of this base sequence : 121192801
  Distance between 3'-terminus of neighbour sequence of sequence listing upward to telomere on chrosomal short arm and 5'-terminus of this base sequence : 7462
agctagatttttacaagatcctttcatacacacacacacacacacacacacacacatcagtttcctcgtagtattatgaaatactcatacgtaagggttgtttttttctgtccttttctatattctctgttgattatgtttttttccttgcacttttttctttacttctagttttatcaatcatgtcttaccctcacctc

SEQ ID NO: 3353 - DNA, 391 bp, Homo sapiens
  chr2.fa.O7frz.128192375
  Located on chromosome 2
  Distance between a terminus base of telomere on chromosomal short arm and 5'-terminus of this base sequence : 121328257
  Distance between 3'-terminus of neighbour sequence of sequence listing upward to telomere on chrosomal short arm and 5'-terminus of this base sequence : 135256
atcctcatagaactcgtaggtattataccagtgtcacagaatataagatcaatatataaaaattaattgctttcctatatactgggaataaatttttggaattggaatttttagaaatactatttactatagtaccaagaatgaaagtacttggagataaatctatctgtctatctatctatctatctatctatctatctatctatctatcaatcaatcatctatctatatctatctatctaatatctaatatactaaaaacaacagaatgttgatggaagatcaaagatgatttaaagaaatgaagaaatactttgttctcatagatgggaagacacaatattgttaaaatattaattcttcttaacttgatctatagattcaatgcaat

SEQ ID NO: 3354 - DNA, 260 bp, Homo sapiens
  chr2.fa.O7frz.128595237
  Located on chromosome 2
  Distance between a terminus base of telomere on chromosomal short arm and 5'-terminus of this base sequence : 121429435
  Distance between 3'-terminus of neighbour sequence of sequence listing upward to telomere on chrosomal short arm and 5'-terminus of this base sequence : 100787
cataaagtcagactgaagctctacgccatttctcaagctgacatcttatcagttgtttgtttgtttgtttgttttttctcaacgccagacacagagagtacggctcaggctctggtgggcttgcctgaagatataacccaaatctaacactagttgtgcccctggaattttttttacctgtgcctcagtttcctcatctgtaaaatgggggaaataatgggacactacttcttagggttgtcttcaggattatgatttac

SEQ ID NO: 3355 - DNA, 125 bp, Homo sapiens
  D2S1340
  Located on chromosome 2
  Distance between a terminus base of telomere on chromosomal short arm and 5'-terminus of this base sequence : 121558908
  Distance between 3'-terminus of neighbour sequence of sequence listing upward to telomere on chrosomal short arm and 5'-terminus of this base sequence : 129213
tagcacccaagatctcttgcaataataataataataataataataataataataataataataaattaacaaggagagcaatagaatatgtatatttttaaaaaatcaacagaattcttctaaac

SEQ ID NO: 3356 - DNA, 447 bp, Homo sapiens
  chr2.fa.O7frz.128707743
  Located on chromosome 2
  Distance between a terminus base of telomere on chromosomal short arm and 5'-terminus of this base sequence : 121849076
  Distance between 3'-terminus of neighbour sequence of sequence listing upward to telomere on chrosomal short arm and 5'-terminus of this base sequence : 290043
tcttggtacagaattatcctacatattctgaacagatgataaagaaagtgctaaaaaccgtgtggatggaaatatgtagtagatagtcctgggaatatcatttttcaaggacagtagttggaactggagatgatccacttagaaagcagtagcagatgaaggtaacttaaattcatctatttatctgcctatcatcgatttagatattttacatgaattgtcactttttgttctcacaacaagcctgtgtatagttatcatccccattacatgtagagaaaactgagattaattaacttcccaaaggacacataattagtaagttgcagagtcaggatctgaattcagactggtctggtctctttgcaaatatactacagtctccaacacacacacaaacacacacacacacacacacataagcaaccacattatgatcttgtagga

SEQ ID NO: 3357 - DNA, 310 bp, Homo sapiens
  AC010901.5_97979
  Located on chromosome 2
  Distance between a terminus base of telomere on chromosomal short arm and 5'-terminus of this base sequence : 121916967
  Distance between 3'-terminus of neighbour sequence of sequence listing upward to telomere on chrosomal short arm and 5'-terminus of this base sequence : 67444
aacaagacaggttctagaggaccatgggctgccacatatcctagacagagctaacactagggtgacctaatagccaagtatttcctgggacagctctgattgacgccgctgtctgagcatgactatactgactttttcatcttcaagtgttctagtttggaggacaaagtctgtgatttatctatattcttagttaaaactgtaggaagtgtgtgtgtgtgtgtgtgtgtgtctgtgtgtgtgtgtgttttaaattggtgagcttggcagcctgtcttcctatgtgtagtttccactaggttaagaaacc

SEQ ID NO: 3358 - DNA, 384 bp, Homo sapiens
  AC010901.5_109630
  Located on chromosome 2
  Distance between a terminus base of telomere on chromosomal short arm and 5'-terminus of this base sequence : 121928521
  Distance between 3'-terminus of neighbour sequence of sequence listing upward to telomere on chrosomal short arm and 5'-terminus of this base sequence : 11244
tgtttaggcaagtcctagactaatgctctcaccgaacagaatagttctgctgtcatccacaggttacttgacctctctctactatagtttgttttcgtgtaaattgggaactgttccatctgcaattcactcagtaggcattttgtgatgctgtttgtcatggtggtcctatgaggaacccatgagtgtttcatggtcctgaactttattgaagttacagaatgggccctccttctgatttcaactcttactcaccacaggcattgcagaggccctgagccatgccaagtctcatcttccttcctttatttatttatttatttatttatttatttatttatttattttaagcagggataattgtagatgttcctcatagagttg

SEQ ID NO: 3359 - DNA, 405 bp, Homo sapiens
  chr2.fa.O7frz.128893257
  Located on chromosome 2
  Distance between a terminus base of telomere on chromosomal short arm and 5'-terminus of this base sequence : 122015656
  Distance between 3'-terminus of neighbour sequence of sequence listing upward to telomere on chrosomal short arm and 5'-terminus of this base sequence : 86751
attagctggatgtggttgtacctgcctcttgtcccagctacttgggaggctgaagctggaggttctcttgagcctgagaggtcaaggctgcagcgagccacgattgtacctctgcaatccagcctgggcaacaggagaccacatctccaaaataataatagtaataatagtaataacaataataataataatttaaacagcaacaacaacagaaacttgggatgtttgtcagctcagagtctctttcagctaaaaaatctgaagtatgagtgtccccaaagcacgatcaatgataacaaaagggagatgagcatgaatcaatctttccattgatgatcaaagggctagaccctctccctggctctagataatccaacagctgacagtcaactcctagatctttct

SEQ ID NO: 3360 - DNA, 440 bp, Homo sapiens
  chr2.fa.O7frz.129140316
  Located on chromosome 2
  Distance between a terminus base of telomere on chromosomal short arm and 5'-terminus of this base sequence : 122263820
  Distance between 3'-terminus of neighbour sequence of sequence listing upward to telomere on chrosomal short arm and 5'-terminus of this base sequence : 247759
gtatttggaaaccaagacctagatgtttgtttgctcattgtttctgggccctttcagtgggcagaactaaaattgtgtgtgtgcatgtgtgtgtgtgcgtgtatgtgtgtgtgtgtgtttatgagttcataaggttatttacaaaacaaacctagttccattagattcttttctcatcattctgtcttctatatatatatgatatatatgagatatatataatacatatatatgatacatatatatgatacatatatatgtaacttctctcacagtgagaccttgtttcagcaatgtcagtatatttacccatttgctccattctgcagtatgcacacaatcatttcagaattacttcagcaatatcacatcaataacaatgtaaagttaaagatttccttgaattttaatttttatccttagaatttattctgccaagg

SEQ ID NO: 3361 - DNA, 345 bp, Homo sapiens
  chr2.fa.O7frz.129212001
  Located on chromosome 2
  Distance between a terminus base of telomere on chromosomal short arm and 5'-terminus of this base sequence : 122334897
  Distance between 3'-terminus of neighbour sequence of sequence listing upward to telomere on chrosomal short arm and 5'-terminus of this base sequence : 70637
cagtatctagcaccatttgtattccatattttttcctgcctcgggcccataaaagtagcaagtttctttggacaatctctgctgcaatcagaactctcattcaaactgaaatgtgagataacagttgaagaggaactgcaagcttcctgggggagggagggtgtgtgtgtgtgtgcgtgtgtgtgtgtgtgtgtgtgtgtgtgctctttttaatagacttataaataaaaatgtctatgagggccaagcagtcacataaatgaagacattatttctacaaagacccatcttgtctaagcaataaatattaaggaaaactgccttcctgaaagatgttaaattaca

SEQ ID NO: 3362 - DNA, 427 bp, Homo sapiens
  chr2.fa.O7frz.129373714
  Located on chromosome 2
  Distance between a terminus base of telomere on chromosomal short arm and 5'-terminus of this base sequence : 122511135
  Distance between 3'-terminus of neighbour sequence of sequence listing upward to telomere on chrosomal short arm and 5'-terminus of this base sequence : 175893
actgattgtggatgtcattcacgtttacaacatacctttacagcagtacttggatgagggcttgattgaataagtagggactatagcctgctcaatttgacacatcctcagaccattataataccctctctttattttttattgaagtgaaacgcacataaaattaaccattttaaagaatacaattcagaggcatttagtatatccacaatattttgcaacaattgtttctatctagctccaaaacattttcatcacacacacacacacacacacacacacacacacacacacaactcagtacccattaaacagtcacatctcatcttcacccctcctcttagctcctggaaaccactaagctgctttctgtctgtattgatttacctatttgagatatttcctataaatggaaccatacaatttg

SEQ ID NO: 3363 - DNA, 391 bp, Homo sapiens
  chr2.fa.O7frz.129485059
  Located on chromosome 2
  Distance between a terminus base of telomere on chromosomal short arm and 5'-terminus of this base sequence : 122511171
  Distance between 3'-terminus of neighbour sequence of sequence listing upward to telomere on chrosomal short arm and 5'-terminus of this base sequence : -391
tttacagcagtacttggatgagggcttgattgaataagtagggactatagcctgctcaatttgacacatcctcagaccattataataccctctctttattttttattgaagtgaaacgcacataaaattaaccattttaaagaatacaattcagaggcatttagtatatccacaatattttgcaacaattgtttctatctagctccaaaacattttcatcacacacacacacacacacacacacacacacacacacacaactcagtacccattaaacagtcacatctcatcttcacccctcctcttagctcctggaaaccactaagctgctttctgtctgtattgatttacctatttgagatatttcctataaatggaaccatacaatttg

SEQ ID NO: 3364 - DNA, 217 bp, Homo sapiens
  DISD22_0001816
  Located on chromosome 2
  Distance between a terminus base of telomere on chromosomal short arm and 5'-terminus of this base sequence : 122626103
  Distance between 3'-terminus of neighbour sequence of sequence listing upward to telomere on chrosomal short arm and 5'-terminus of this base sequence : 114541
ttcaactcctaagttcaatgtttcaaatctatgtatatttgtctaatgcaatatatatatatatatatatatatatatatatacacacacacacatatatatatacacacacatatatatatacacacacatatatatacacacacatatatgtatatatggtggtaatagatatagaaactaataagaaatatcaattatatggatgttgaggtca

SEQ ID NO: 3365 - DNA, 365 bp, Homo sapiens
  AC023347.6_38616
  Located on chromosome 2
  Distance between a terminus base of telomere on chromosomal short arm and 5'-terminus of this base sequence : 122985498
  Distance between 3'-terminus of neighbour sequence of sequence listing upward to telomere on chrosomal short arm and 5'-terminus of this base sequence : 359178
attcttaaattaagtgcatttgagaattaatatctttaactttttggaaatctccttatatttgattttgtctttgtttctctctcttcttctttattttcttcttttgtagatatgtgctgtgtgtgtgtgtgtgtgtgtgtgtgtgtgtgtgtgtgtgtgtcccagcaaacattaaattgctattaacattcttgtacccatattgttctgagaaactatgaacatgtttttctgagaatccttactttcctctgaccactatgctgaagtccctgggtcacaggcatagctactacaatgtcctttgcatgattttgtttgtttgtttggatgaccctcagttcctattgaccaagatttct

SEQ ID NO: 3366 - DNA, 245 bp, Homo sapiens
  chr2.fa.O7frz.131477932
  Located on chromosome 2
  Distance between a terminus base of telomere on chromosomal short arm and 5'-terminus of this base sequence : 123003480
  Distance between 3'-terminus of neighbour sequence of sequence listing upward to telomere on chrosomal short arm and 5'-terminus of this base sequence : 17617
gattgtcagataactccgagtgtcccaccccacccgaatccctgtccctcccaatcatgcctacaaaattttttatttctaaatcttcacaagactctgaattgcctaagcttcacagcaaacctcagcaatctgtgtgtgtgtgtgtgtgtgtgcgcgcgcgcgcgcgcgcgcgcgcgcacgcaaaacttatcttctctgacctcttagcttattccaagcttcaatctaagcatctaatcaaa

SEQ ID NO: 3367 - DNA, 362 bp, Homo sapiens
  AC023153.4_169106
  Located on chromosome 2
  Distance between a terminus base of telomere on chromosomal short arm and 5'-terminus of this base sequence : 123118918
  Distance between 3'-terminus of neighbour sequence of sequence listing upward to telomere on chrosomal short arm and 5'-terminus of this base sequence : 115193
agtagaataaatttgagttggcactgggtcttatgatgaccttcagatcatattatataagtagtcatctccttttattatcattactcttattactactattattattactctttttcctcattgttttcctctgtttcctcattggcatgctggaaagaaagggaattttgctatcatgtgaatatggaaagatgtaacgcactgcacaaagttgtggatcaaatggtcaatttaacaggggttttggtgtttaaacagcaaataaataaaataaacatattattattattatggctcttaggactgcatggatggaactgcccagctgaggctccctgaattaagacttgttcctgaac

SEQ ID NO: 3368 - DNA, 367 bp, Homo sapiens
  AC013474.9_120461
  Located on chromosome 2
  Distance between a terminus base of telomere on chromosomal short arm and 5'-terminus of this base sequence : 123414347
  Distance between 3'-terminus of neighbour sequence of sequence listing upward to telomere on chrosomal short arm and 5'-terminus of this base sequence : 295067
actgtacatctttagagcctagaacagcatctggcatacaacagatgctcaataaacattagttaaactagtgaattaactgcaatgcaatgtggaaagtgcagtgtagtagagctgcatatactctgtgtgtgtgtgtgtgtgtgtgtgtgtgtgtgtgtgtgtatttttgtccttaaagaagtaaggcttaacttaattggggatggggaaggtgctgctgtgaatctttctcagtatttgtttttcttagtgcatctttccctttctctttgcatttcacatggcagcctgttcagtgcctcccttctctgagccagaggattagggatgagagaggatatgggatgaggtcaagactatgcag

SEQ ID NO: 3369 - DNA, 318 bp, Homo sapiens
  AC067962.2_57214
  Located on chromosome 2
  Distance between a terminus base of telomere on chromosomal short arm and 5'-terminus of this base sequence : 123505535
  Distance between 3'-terminus of neighbour sequence of sequence listing upward to telomere on chrosomal short arm and 5'-terminus of this base sequence : 90821
ctgaagagtcattgcaagtaagaaactgtgatgctggccttccattctcctgcccccctcccctccctccctacacacacacacacacacacacacacacacacacacacacacacacacatatgcacgcacacacacaagcacacacacatttcttcctacacaccatctccttgcgtttcttagcagcagacaggtatcagccccagacctgaggcagacacttggggatctggttcgggacagggcagacaggcatttggtgcatggatcctactgacctcccagagataactagaaacaaatgtaagaactgct

SEQ ID NO: 3370 - DNA, 371 bp, Homo sapiens
  chr2.fa.O7frz.132137451
  Located on chromosome 2
  Distance between a terminus base of telomere on chromosomal short arm and 5'-terminus of this base sequence : 123621908
  Distance between 3'-terminus of neighbour sequence of sequence listing upward to telomere on chrosomal short arm and 5'-terminus of this base sequence : 116055
tttgaactattaagacctgcaggagtcacacagctggtccatatggctggaccccatagctggcccttagtccaaagaccacactgctggccagagaagaagtcctcgaaactggaacaggttatgagtgtgagattatatatatatatatatatataatgtttagggatcctgaagctgcaggagtcccgagaccctgaaggagcaaggcttgaatatctcaggagatgaaacagaaggtgatggttatgactacaaggctggagaaaggctgcagggaggcctttatgagcagcaacccaaggcacaggcagagaggagaaattctgtaaaataaagaagcccagtggtggtgccattagtcttactaa

SEQ ID NO: 3371 - DNA, 286 bp, Homo sapiens
  AC012508.8_163130
  Located on chromosome 2
  Distance between a terminus base of telomere on chromosomal short arm and 5'-terminus of this base sequence : 123798723
  Distance between 3'-terminus of neighbour sequence of sequence listing upward to telomere on chrosomal short arm and 5'-terminus of this base sequence : 176444
actggatgtttgacaatattagacatttgttcattttcttaggtgtgacaatggtattgttatcactcatattgttatcactcatatgaaatgattaagagcaacatgtcatgatagctgcaactacttttaaactcttgtaagtgtgtgtgtgtgtgtgtgtgtgtgtgtgtacttttctgttttggaaaaaaatgagaatgaactacattctcataaagtgcaaggtaaacactttattttcaaacatatttatgcacttctcataaagtgcaaggtaaatact

SEQ ID NO: 3372 - DNA, 418 bp, Homo sapiens
  chr2.fa.O7frz.132512605
  Located on chromosome 2
  Distance between a terminus base of telomere on chromosomal short arm and 5'-terminus of this base sequence : 123808521
  Distance between 3'-terminus of neighbour sequence of sequence listing upward to telomere on chrosomal short arm and 5'-terminus of this base sequence : 9512
tacaattgctggatcatatagtaactctactgtagtttttagttttttgaggaactgccatcctgttttccatgacaactgccccattttacattcccaccagcaatgcacaagggttccaatttttccacgtcttctctaatacttgttattgtctcgtgagatgatagatgagatagatagatagatagatagatagatagatagatagatagatgatagatagacagatagatagatagacagacagaaagaaagatagatagggagtagccatcctactgggtgtgagttggtatctttttgtggttttagcttgcatttccctaacattcagtgatgtttagcatcttttcatgtgtttattgaccatctgtatgtcttccttggagaaatgtctattcaagtcggtcttagc

SEQ ID NO: 3373 - DNA, 282 bp, Homo sapiens
  AC012508.8_10268
  Located on chromosome 2
  Distance between a terminus base of telomere on chromosomal short arm and 5'-terminus of this base sequence : 123899464
  Distance between 3'-terminus of neighbour sequence of sequence listing upward to telomere on chrosomal short arm and 5'-terminus of this base sequence : 90525
acaagtatgcacctactgtgagccaagctgaggggatgagatgccttggtgaccacagggaccagagacacatgggcctgcctgggtcaggaagcaaagcaaagtgcccagagtatgggattccccccaggaagtcttcccagggtgcatgtgtgtgtgtgtgtgtgtgtggtagcgggggcagtgtcggcagcatggttctttcccccccaggaacattaaaaaacaactagtatgaccatcatctcattaaagaaatactgtagcagtaacagaaacaaa

SEQ ID NO: 3374 - DNA, 117 bp, Homo sapiens
  DISD22_0001831
  Located on chromosome 2
  Distance between a terminus base of telomere on chromosomal short arm and 5'-terminus of this base sequence : 123975916
  Distance between 3'-terminus of neighbour sequence of sequence listing upward to telomere on chrosomal short arm and 5'-terminus of this base sequence : 76170
cctagaggagatctaccaccccctctgtaactttcagttttgtgaatcagcacattcattctctctctctctcgatctctctctctctctccaaagtggcatttgtctagatggctc

SEQ ID NO: 3375 - DNA, 150 bp, Homo sapiens
  D2S2271
  Located on chromosome 2
  Distance between a terminus base of telomere on chromosomal short arm and 5'-terminus of this base sequence : 124194149
  Distance between 3'-terminus of neighbour sequence of sequence listing upward to telomere on chrosomal short arm and 5'-terminus of this base sequence : 218116
gccagagtttgcctttatcacacattttctacttcttgcttaacaaaacaaatacacacacacacacacacacacacacacacacaccctcatgaagaacttatatttgcccatgtgatgaaagtgggggctaggacactttcactgtgt

SEQ ID NO: 3376 - DNA, 418 bp, Homo sapiens
  AC010976.4_97777
  Located on chromosome 2
  Distance between a terminus base of telomere on chromosomal short arm and 5'-terminus of this base sequence : 124499416
  Distance between 3'-terminus of neighbour sequence of sequence listing upward to telomere on chrosomal short arm and 5'-terminus of this base sequence : 305117
ggctttgagaactagcagtttacccttctcttctcaggtgaaggtaaccctcattctggtccctgagattaggtaggacactgatccccgtaagctcagccacactgacctgcctcagggcttaacaaaaggaactggactaagaagtcatcccattcccaaggggcagaaaattttaagcacaccagtgcttcctgtaaggggcaatgcctcacctgctttcctgggtaggtccatccatccatccatccatccatccatccatccatccatcaatccattcatctgtttgttcattcacctattcacccaccaatctatccacccattcacttacccaatccaaccattaatccatccaccatccatctatccacccacccacccattcacccactcattcaaccactaatcgact

SEQ ID NO: 3377 - DNA, 468 bp, Homo sapiens
  chr2.fa.O7frz.133297858
  Located on chromosome 2
  Distance between a terminus base of telomere on chromosomal short arm and 5'-terminus of this base sequence : 124678213
  Distance between 3'-terminus of neighbour sequence of sequence listing upward to telomere on chrosomal short arm and 5'-terminus of this base sequence : 178379
aaagcctgtaacattaaaggatcacagttataaacacacttgaaagaaacaagtcaacgacagaaataatatgcactgcccagacaaagacagctctcatcaaccagttaaaaaagcagcagaggctgggcgtgatggctcacgcctgtaatcccagcactttgggaagcctaggcgagtggatcacctgaggtcagttcaagaccagcctggccaacatggtgaaacccagactctactaaaaatacaaaaattagccaggcgtgatggcgcatgcctgtagtcccagctactcaggaggctgaggcaggagaatcacttgaacccaggaggcagaggttgcagtgagccgagattgcaccaatgcactctagtctgggtgacagagcgagactctgtctcaaaataataataataataataataataataataataataataataatacagtagcagagcttccac

SEQ ID NO: 3378 - DNA, 150 bp, Homo sapiens
  Z67394
  Located on chromosome 2
  Distance between a terminus base of telomere on chromosomal short arm and 5'-terminus of this base sequence : 124833599
  Distance between 3'-terminus of neighbour sequence of sequence listing upward to telomere on chrosomal short arm and 5'-terminus of this base sequence : 154918
gcagggcatctgtttcatctttcactgcacctaacatggtgccctacatacagtatacacacacacacacacacacacacactcctgattgtcaccaacaatcttatctacacatctaataatttaagtttgcctgctgacagtggagta

SEQ ID NO: 3379 - DNA, 395 bp, Homo sapiens
  chr2.fa.O7frz.133860578
  Located on chromosome 2
  Distance between a terminus base of telomere on chromosomal short arm and 5'-terminus of this base sequence : 125073506
  Distance between 3'-terminus of neighbour sequence of sequence listing upward to telomere on chrosomal short arm and 5'-terminus of this base sequence : 239757
cctttcaaatcttgatcaagtaagtgtccattttttatggttaactgtgagtgacgggtatacagtgttgcatcagaaaatgaagtattacttgtgtcttcagtcctctcctcacaggatggcgtcttgttttttcatggtgtgtgtgtgtgtgtgtgtgtgtgtgtgagagagagagagagagagagagatttttatctgccctcaagacatatcagcgtgaaaaatgtcatagatttgatgctggctggggagagagatggaaggagaatgctgcctctctgaaccattagcatatctttgtattttgtactcaaactaatctcataggtttgtttctctacctactagggtcagtttgtttttctgctgtaggaactaaatagctcaggatt

SEQ ID NO: 3380 - DNA, 448 bp, Homo sapiens
  AC017079.3_62553
  Located on chromosome 2
  Distance between a terminus base of telomere on chromosomal short arm and 5'-terminus of this base sequence : 125102833
  Distance between 3'-terminus of neighbour sequence of sequence listing upward to telomere on chrosomal short arm and 5'-terminus of this base sequence : 28932
aagcctggaagtttgagaccaacctgggcaacatagcgagaccctgtctctattttttaaaagtcacacacacacacacacactcactcacacacacacacacacacacacacgcaccagcaagttgctgacccactctgtttcatttagaggcaaatatttttcaattctttatgctatttttcccaggattcccctccaagtttctcaagcatatccttctatcttcctgcattaccattgcttgatacctagtgtggagactgaggactccctctgctcccctacagctgcatctcccgcctccccacttcccctcctacggcatcaagcttaggagctattatgactggaattgtgttcccctatatatgttgaagccccaagcccccatgtgactgtattccggggtagggcttttaaagaggtaattacgcttaaataaggt

SEQ ID NO: 3381 - DNA, 146 bp, Homo sapiens
  DISD22_0001843
  Located on chromosome 2
  Distance between a terminus base of telomere on chromosomal short arm and 5'-terminus of this base sequence : 125184375
  Distance between 3'-terminus of neighbour sequence of sequence listing upward to telomere on chrosomal short arm and 5'-terminus of this base sequence : 81094
agtaaagaggctccaccgcaaagaagggaggcgtgtgtgtgtgtgtgtgtgtgtgtgtgtgtgtgtgtgtgtgtgtggagggggagacaaaagaggtcttcggaccaccctcccacacccaggctctgggatttcctgactgtggc

SEQ ID NO: 3382 - DNA, 101 bp, Homo sapiens
  DISD22_0001848
  Located on chromosome 2
  Distance between a terminus base of telomere on chromosomal short arm and 5'-terminus of this base sequence : 125517358
  Distance between 3'-terminus of neighbour sequence of sequence listing upward to telomere on chrosomal short arm and 5'-terminus of this base sequence : 332837
ctgaggatgtgcaagtgcgcgtgtgtgcgcgcgcacacacacacacacacacacaaggataaggggtggtgctgtagatgcagctaaggagggccagagta

SEQ ID NO: 3383 - DNA, 420 bp, Homo sapiens
  AC037478.2_162037
  Located on chromosome 2
  Distance between a terminus base of telomere on chromosomal short arm and 5'-terminus of this base sequence : 125629971
  Distance between 3'-terminus of neighbour sequence of sequence listing upward to telomere on chrosomal short arm and 5'-terminus of this base sequence : 112512
tttaggacggtatgtggtactctcttcaccggccctgtcatagccacaggtttgcgttcccagctccagctcttacctggaggaatctctctctcccagtctgtctctgtcttgctcttatactctcctctcttcctggtatacacacatacacacacacacacacacacacacacacacacacacacacacacacagagtcactggagatatctgtggcagtgctggcagtgggggatgctggacatcctgtgcagggtgttaggagtcccaggatacttgtgcaccagccacatcccagcttaggacgtgggggtgaagttaccacctctggcccctggtgtcctccattcccagactctctagccaaagatcatttgcagaccattcacattcattctttgattcacttgtccagat

SEQ ID NO: 3384 - DNA, 378 bp, Homo sapiens
  AC037478.2_48262
  Located on chromosome 2
  Distance between a terminus base of telomere on chromosomal short arm and 5'-terminus of this base sequence : 125664408
  Distance between 3'-terminus of neighbour sequence of sequence listing upward to telomere on chrosomal short arm and 5'-terminus of this base sequence : 34017
caacgtacatctactctggagtgcggtgcagccattacgcagaatgaggtagaccatgcggctgacaagaaaagagtatttccaaaatggtggtgcgtaaagcaaagaaaagtatatgtagtatggttctgatgtttaacttgtaaagatgacatttacaatgatgcatgtttatacaagtaggggtgtgtgtgtgtgtgtgtgtgtgtgtgtatgcacagaaaagtgcctgggagtggcatcctcccggctgacagtggtgagtccagatgcgggcagggggagccgctgctgatgcgcgagttgtctgaagcccttcggggagaatgcatctgctcaggctgctgcgagcttgcctaagtgaactttccagagctt

SEQ ID NO: 3385 - DNA, 382 bp, Homo sapiens
  chr2.fa.O7frz.134355217
  Located on chromosome 2
  Distance between a terminus base of telomere on chromosomal short arm and 5'-terminus of this base sequence : 125717290
  Distance between 3'-terminus of neighbour sequence of sequence listing upward to telomere on chrosomal short arm and 5'-terminus of this base sequence : 52504
gatccaatcacctgttatcaggccccatctccaactttgggaagcacatttcaacatgagatttggaggggacaaacacccaaaccatattacacacacccacacacacacacacacacacaaacacatcacaaaacaatctttatcctcactactttggaatatactgtgatactttctattctttaaagaaaaaataaatcctggttgttacccattgaactactatgccacctcttttaacaaaatctagaggcttccctagctcatgttagcagcagggaaatttgccagaaacaaagagactgggagtccaccatgcttattttgttttgtttttaaattgaaattcttgagataaatgtagattgatgtgaagttg

SEQ ID NO: 3386 - DNA, 410 bp, Homo sapiens
  chr2.fa.O7frz.134457894
  Located on chromosome 2
  Distance between a terminus base of telomere on chromosomal short arm and 5'-terminus of this base sequence : 125753441
  Distance between 3'-terminus of neighbour sequence of sequence listing upward to telomere on chrosomal short arm and 5'-terminus of this base sequence : 35769
ggaatgtactgaaacttcactaacatttctagaagagaacactcatactaaatcctaaccctgtgcagttttctttgtaaacatttatacaaatgtgtctcctaacgaagtggcataatttgctaacacgtttgtccttcctaattaaaagccagcagatgctttatggtaataagtaaaatatgagacttcattagggatattcttgcttttgtgtgtgtgtgtgtgtgtgtgtgtgtgtttcattaaagtctacagtgtacctgttgaaatgttagaaggattattttgtcttcattatctagtttcataggatttttttttcaatctttcaacacacactaactttatccttaatatttactactagtagtattatcacttattggtcacctaccatagtgaaatca

SEQ ID NO: 3387 - DNA, 201 bp, Homo sapiens
  HUMUT5035
  Located on chromosome 2
  Distance between a terminus base of telomere on chromosomal short arm and 5'-terminus of this base sequence : 125800246
  Distance between 3'-terminus of neighbour sequence of sequence listing upward to telomere on chrosomal short arm and 5'-terminus of this base sequence : 46395
ggaggggtggtggtagtgatgcattgttttgttatctctctcatctatcatttatctatctatctatctatctatcatctatcatccatctatcatctatcttaagtatatagattgtgcaagtttctaaattgctggaattttttgtagatttaaagatgaataggtattgaattttatcaagcattttcctgaatgtga

SEQ ID NO: 3388 - DNA, 414 bp, Homo sapiens
  AC068483.1_27382
  Located on chromosome 2
  Distance between a terminus base of telomere on chromosomal short arm and 5'-terminus of this base sequence : 125993755
  Distance between 3'-terminus of neighbour sequence of sequence listing upward to telomere on chrosomal short arm and 5'-terminus of this base sequence : 193308
atctgaatccttacttctgaacttctacccatatgatcttcaacaacttaattcatctttctgagcaggaatagtaatatccacctcctgggttaatacttgtaaagattagaagagaaaaaaagtatatatatatatatatatatatatgtatatataaataggtacatgtacctaatagaaaacccaatgtagtctggaatttctgatgagttaaaatgcaagagaaagcagtaaaattgttgctggtgcctttccccaagccctgaggaatccattgtcctcagctttcctggagggtgctaaattctgtgtatgctgtctctttaaccctgtcactgtggttccttattgttgttcctcctaggctcccagagaatggcattcaactgctaagatcgatgaggctaattt

SEQ ID NO: 3389 - DNA, 147 bp, Homo sapiens
  D2S2215
  Located on chromosome 2
  Distance between a terminus base of telomere on chromosomal short arm and 5'-terminus of this base sequence : 126149729
  Distance between 3'-terminus of neighbour sequence of sequence listing upward to telomere on chrosomal short arm and 5'-terminus of this base sequence : 155560
acctgggactcagaaaagttacgttgcttgcccagtgcaataggtgcattctttttgccattgaattttctatccatagtcacacacacacacacacacacacacacacacacacacacacacatatgcatacttttaggcacagca

SEQ ID NO: 3390 - DNA, 296 bp, Homo sapiens
  chr2.fa.O7frz.134993674
  Located on chromosome 2
  Distance between a terminus base of telomere on chromosomal short arm and 5'-terminus of this base sequence : 126259008
  Distance between 3'-terminus of neighbour sequence of sequence listing upward to telomere on chrosomal short arm and 5'-terminus of this base sequence : 109132
atcatatggaaatgcaatgtattggaaaataatagctcaggaggaaagggatggggccaaagctgcaccgcagtaagggagacagcagatgatgatgcagacccaagctaggaaatagactactacaaattctccctcattatctatctatctgtgtgtgtgtgtgtgtgtgtgtgtgtgtgtgctttcttttctcagcttccttcaaaagacataaaatattgctgaaattaaattaatgtaaattgaaggtgggttctgataagatgtatcttgtaagcattagttcagtgaat

SEQ ID NO: 3391 - DNA, 372 bp, Homo sapiens
  chr2.fa.O7frz.135108856
  Located on chromosome 2
  Distance between a terminus base of telomere on chromosomal short arm and 5'-terminus of this base sequence : 126366412
  Distance between 3'-terminus of neighbour sequence of sequence listing upward to telomere on chrosomal short arm and 5'-terminus of this base sequence : 107108
gactggaatgtaccttaggaagacaagattggtttaacatataaaaatcaatgttatacaccacattagtagaataagaggaggaaaaacacataatcatctcaacagacacagaaaaatcatttgacaaaatccagcatcctttcattaaaacacacacacacacacacacacacacacacacacacacacacacctcaaatactaagaatagaaggggaagggaacttacttgatctgaaaaggggcatctagaatgaaaacacagctgatatagaacttaatggtgatagactgaaaaatttcccctaaattcaagaagaagtaaatgatgtccacgctggccacttctattcaacattgtactggagg

SEQ ID NO: 3392 - DNA, 156 bp, Homo sapiens
  AC003676.1_15261
  Located on chromosome 2
  Distance between a terminus base of telomere on chromosomal short arm and 5'-terminus of this base sequence : 126549012
  Distance between 3'-terminus of neighbour sequence of sequence listing upward to telomere on chrosomal short arm and 5'-terminus of this base sequence : 182228
ctggagctctccagtatcttactaatggtgggtgtcactaacaggtgataaaattgtataaagttaatatgcacacacccactctcctccacataaacacacacacacacacacacacacagaagcgaagctgagtgaatctgaatatgattagcg

SEQ ID NO: 3393 - DNA, 419 bp, Homo sapiens
  chr2.fa.O7frz.135794145
  Located on chromosome 2
  Distance between a terminus base of telomere on chromosomal short arm and 5'-terminus of this base sequence : 126716083
  Distance between 3'-terminus of neighbour sequence of sequence listing upward to telomere on chrosomal short arm and 5'-terminus of this base sequence : 166915
gtcagattaatgttattggaaagatttaaagaaatcagcacatatccaaccccaactcttctagagataccttaagtttctgagacataagaatttacatattacatttatgtattgagtggttcttaagcaggagtgtatccagattttgagaaaattgttgttgttgtcgttgttgttgttgttgttgttagagacagggtctcattatgttgaccaggctagactcgaactcctgagctcaagcaatcctcccacctcagcctccctagcagctgggactacagccatgcaccaccatgcctggcttcaaggaaacattttcaaatatacatatccaggctttattagacttactgtatcaaaatattcagaaaaagcctagacttgttatttaaacattttcctcaggttactag

SEQ ID NO: 3394 - DNA, 101 bp, Homo sapiens
  DISO7_10000981
  Located on chromosome 2
  Distance between a terminus base of telomere on chromosomal short arm and 5'-terminus of this base sequence : 126794424
  Distance between 3'-terminus of neighbour sequence of sequence listing upward to telomere on chrosomal short arm and 5'-terminus of this base sequence : 77922
aaggaacaattctggaatatgactgtaggttttgtgtgtgtgtgtgtgtgtgtgtgtgtgtgtgtgcgcctgtgcgtgcatgtgcatgcagatatttggat

SEQ ID NO: 3395 - DNA, 101 bp, Homo sapiens
  DISO7_10000982
  Located on chromosome 2
  Distance between a terminus base of telomere on chromosomal short arm and 5'-terminus of this base sequence : 126838031
  Distance between 3'-terminus of neighbour sequence of sequence listing upward to telomere on chrosomal short arm and 5'-terminus of this base sequence : 43506
aaggcagcatctggctagtcactcagatcctctaatagacaaaccaccaaacacacacacacacacacacacacacacacaccctggctggacagacttcc

SEQ ID NO: 3396 - DNA, 109 bp, Homo sapiens
  DISO7_10000978
  Located on chromosome 2
  Distance between a terminus base of telomere on chromosomal short arm and 5'-terminus of this base sequence : 127219610
  Distance between 3'-terminus of neighbour sequence of sequence listing upward to telomere on chrosomal short arm and 5'-terminus of this base sequence : 381478
gctgatcagaaagctgtgtcgtgtgtgtgtgtgtgtgtgtgtgtgtgtgtgtgtgtgtatgtgtgtgttgggccatgccaagttttccaattctatcctgtgatccaga

SEQ ID NO: 3397 - DNA, 158 bp, Homo sapiens
  DISO7_10000980
  Located on chromosome 2
  Distance between a terminus base of telomere on chromosomal short arm and 5'-terminus of this base sequence : 127237539
  Distance between 3'-terminus of neighbour sequence of sequence listing upward to telomere on chrosomal short arm and 5'-terminus of this base sequence : 17820
accaggaaacttcacatgctcttactttttctaaaagccatccattccccctggtggaggtactacttgtgtgtgtgtgtgtgtgtgtgtgtgtgtgtgtattattattctataatatggtttacttataaccttagacacacactcttccggcatct

SEQ ID NO: 3398 - DNA, 418 bp, Homo sapiens
  AC023040.3_130742
  Located on chromosome 2
  Distance between a terminus base of telomere on chromosomal short arm and 5'-terminus of this base sequence : 127303550
  Distance between 3'-terminus of neighbour sequence of sequence listing upward to telomere on chrosomal short arm and 5'-terminus of this base sequence : 65853
gagaagcttcatcctgtgacctatgccagcctgtgggatggacactgggtccctgtgcttgggacccaggccaaggaagctctgaacaatgggatatgcagggagaaatcagttcgcagacccgcggtgcctggctcctggccactgcgattgtgtgcctgtgtgagacgcctttacagagggcacagtgcatgcatgcatgtgtgtgtgtgtgtgtgtgtgtgtgtgtgtgtgaatcactcctgcttacatacaaaacctcagagctcaagcaaaacaaaaagactgaatgagacccatcccacgaggggcacttgagagcctttgcctcttggtgactcatctcccacaggcagcaggaaacaaaagagattcaggggtttccccacagtgtgtgtttacgtcattgtgaatcaat

SEQ ID NO: 3399 - DNA, 392 bp, Homo sapiens
  AC010984.3_141742
  Located on chromosome 2
  Distance between a terminus base of telomere on chromosomal short arm and 5'-terminus of this base sequence : 127322814
  Distance between 3'-terminus of neighbour sequence of sequence listing upward to telomere on chrosomal short arm and 5'-terminus of this base sequence : 18846
acctagttcaggagttccagaccagcctggccaacatggtgaaactccatctctactaaaaatgcaaaaattagctgggcgtggtggcatgtgcctgtaatcccaactactcgggaggctgaggcaggagaattgcttgaacccgggaggcggaggttgcagtaagctgagatggcaccactgcactccaggcctgggcgacagagcgagactccatcttaaaaaaacaaaaaacaaaacaacaacaacaacaaaactgaataacacacacacacacacacacacactctctccatctgtctctctctctctgtctactttatccatttatctgttgaaaaacactgagttgcctccaccccctgggtattgtgaatagcattgcaatgaac

SEQ ID NO: 3400 - DNA, 467 bp, Homo sapiens
  AC010984.3_20098
  Located on chromosome 2
  Distance between a terminus base of telomere on chromosomal short arm and 5'-terminus of this base sequence : 127341395
  Distance between 3'-terminus of neighbour sequence of sequence listing upward to telomere on chrosomal short arm and 5'-terminus of this base sequence : 18189
ccttctgccatgattgaagctccctaaggcgtccccagaaacagaaggggtcatgcttcctgtacagcctgcacaaccctgagccaatagtctcttttcttttcttttcttttcttttctttctttccttctttccttccttccttctttctccttccttcccttccttccttccttccttccttccttccttccttccttccttccttacttccttccttcctttcttccttcctttctttctttctgggacagagtctccctccgtcacctaggctggagcgcagtggcgcgatctcggctcactgcaaccttcgcctcccgggttcaagtggttctcctgcctcagcctcccaagtagctgggactacaggtgcccaccactgcacctagctaatttttgtatttttgtagagacggggtttcaccatgttggccaggcgggtctcaaactcctgatctcagat

SEQ ID NO: 3401 - DNA, 206 bp, Homo sapiens
  AC010984.3_129520
  Located on chromosome 2
  Distance between a terminus base of telomere on chromosomal short arm and 5'-terminus of this base sequence : 127403654
  Distance between 3'-terminus of neighbour sequence of sequence listing upward to telomere on chrosomal short arm and 5'-terminus of this base sequence : 61792
ggattaagtttccaatacatgaactttaagaaacacgtccaaaccgtagcagccatatcatcaccaccacttttgttattaccaccatcattatcatcactatcttcatcagcaccatccatcactattatcatcatcactatcagcaccatcatcactgtcaacatcatcatcatcatcactatcattagcacttcattaccatc

SEQ ID NO: 3402 - DNA, 153 bp, Homo sapiens
  DISD22_0001860
  Located on chromosome 2
  Distance between a terminus base of telomere on chromosomal short arm and 5'-terminus of this base sequence : 127840423
  Distance between 3'-terminus of neighbour sequence of sequence listing upward to telomere on chrosomal short arm and 5'-terminus of this base sequence : 436563
ggtccatgatgctctatttgtttggttttctctctttctttctttctttctttctttctttctttctctttctttctttctttctttctttggtctgttttctctctgttgttcagattgtataattctgtctcttccatctacaagttcact

SEQ ID NO: 3403 - DNA, 428 bp, Homo sapiens
  M2_128032797
  Located on chromosome 2
  Distance between a terminus base of telomere on chromosomal short arm and 5'-terminus of this base sequence : 128032751
  Distance between 3'-terminus of neighbour sequence of sequence listing upward to telomere on chrosomal short arm and 5'-terminus of this base sequence : 192175
gtgtccaataacttctccagcatctttggatatatgacttttttgttttatttatttatttatttatttatttatttatttagagacggagtctcactctgttgcccatgctggagtgcagtggcgtcatctcggctcattgcaagctctgcctcctgggttcacgccattcttctgcctcagcctcccaagtagctgggattacaggtgcccgccaccacacctggctaattttttgtatttttagtagagatggggtttcaccatgttagccaggctggtctcaatctcccgacctcatgatccgcccgccttggcctcccaaagtattgggattacaggagtgagccaccacgctcgaccgaaaagctctatttcttgttcaagtcgcagtccattgtgggttcataagggatgagaggcttctg

SEQ ID NO: 3404 - DNA, 392 bp, Homo sapiens
  chr2.fa.O7frz.136879578
  Located on chromosome 2
  Distance between a terminus base of telomere on chromosomal short arm and 5'-terminus of this base sequence : 128076734
  Distance between 3'-terminus of neighbour sequence of sequence listing upward to telomere on chrosomal short arm and 5'-terminus of this base sequence : 43555
caaccagaacagcttcagtgtcagggttctgcagaaacatgtacagggccacttctagactggtctgcgcttgtcggcaagtcggggggctccgctgcatcctgctgcactatcctgagagtcaagggtggtagacgtatatttgcaacttgggtagtttcatgtaaaaaacccaatgacgcaataaactgtgtatgcgtgtgtgtgtgtgtgtgtgtccatatatatctcagcatacaataactcgcaagagctttctcctttaatcattataggaatttttcaaaccccaaaatatcttgtccaaatgagaaatgagattttctggaccaacataaagctactatctgtccaatttcaaatcaaataggtatgatcctattccagattcc

SEQ ID NO: 3405 - DNA, 321 bp, Homo sapiens
  AC073869.2_54970
  Located on chromosome 2
  Distance between a terminus base of telomere on chromosomal short arm and 5'-terminus of this base sequence : 128145405
  Distance between 3'-terminus of neighbour sequence of sequence listing upward to telomere on chrosomal short arm and 5'-terminus of this base sequence : 68279
taggcaatcaacattacctgtcctcaacgccccagtgagcggagagccctccttaatgagctccttgatgaacttgttggttcgctccagttcaatctcctgacactgcaagcgctccctgaaatccgggctgtccaagtaggaatcgctgaactccagagtaggcagccccatggcacaggcgctgtcagcggcgtccgcgggcacgtctgggccggcggtcagggcagcagctggcggcggcggcggcgggcgctggggacgcgcgatagcggggaaggcgctgctgggacgccaggggactgatcgctgaaaggaaac

SEQ ID NO: 3406 - DNA, 479 bp, Homo sapiens
  chr2.fa.O7frz.137294531
  Located on chromosome 2
  Distance between a terminus base of telomere on chromosomal short arm and 5'-terminus of this base sequence : 128271851
  Distance between 3'-terminus of neighbour sequence of sequence listing upward to telomere on chrosomal short arm and 5'-terminus of this base sequence : 126125
aattcacattgctttctgtaatagagctttcctttccttccttccttccttccttccttccttccttccttccttcctttctttcttcctttctttctttgttgacagagtctcactctgtcgactaggcttgagtacaatgatgctacctcggctcactgcaacctccgtctcccgggttcaagtgattctcctgcctcagcctccggagtaactgggattacaggtgcatgctaccatgcctggcttgattttggggtttttagtagagacggggtttcaccatgttggcaggctggtctcgaactcctgacctcagatgatccacctgcctcagccacccaaagttctgggattacaggcatgagccaggcataagccagtgcccagcctgtaatagagctttctggactactgagttctacagtattttcctgtatgattattttcaatttctgtctcaagacttgagttaggct

SEQ ID NO: 3407 - DNA, 420 bp, Homo sapiens
  chr2.fa.O7frz.137580486
  Located on chromosome 2
  Distance between a terminus base of telomere on chromosomal short arm and 5'-terminus of this base sequence : 128540116
  Distance between 3'-terminus of neighbour sequence of sequence listing upward to telomere on chrosomal short arm and 5'-terminus of this base sequence : 267786
aaactacttggagctgaaagagaattacacattatagtcaaagtgtttataattctgaaggagtacttgtcttgtatggaagtgtggtttatttattgaactcaatttaaataattaatgtgaagattgtgttatggaaaggaaaaatatttttaaaaattccctctttggcctttgtatttttgcattggtatttctctttttgtttttatgtcatacacacacacacacacacacacacacacacacacacatatatagagagagagtgagagagagagagagagagagagagagagaggaaagtttgaatttacccatattaaaagatctttttttctcagtgactttaataaccataataatattgaagaataataatgctattatttttatgtcaaggtaacaatacttgctatc

SEQ ID NO: 3408 - DNA, 172 bp, Homo sapiens
  DISD22_0001869
  Located on chromosome 2
  Distance between a terminus base of telomere on chromosomal short arm and 5'-terminus of this base sequence : 128674817
  Distance between 3'-terminus of neighbour sequence of sequence listing upward to telomere on chrosomal short arm and 5'-terminus of this base sequence : 134281
gaggtcctgaggtcctgagatatatatatatatatatatatatatatatatatatatatatataaaatataaaatatatatatataaaatataaaatatatatatataaaatataaaatatatatatatatatatacaatgttttattgaaacttcccaattattgcatgtc

SEQ ID NO: 3409 - DNA, 140 bp, Homo sapiens
  chr2.fa.O7frz.137868011
  Located on chromosome 2
  Distance between a terminus base of telomere on chromosomal short arm and 5'-terminus of this base sequence : 128838894
  Distance between 3'-terminus of neighbour sequence of sequence listing upward to telomere on chrosomal short arm and 5'-terminus of this base sequence : 163905
gctagacaaatgaagtcatagaacagaatgtgctttaaatattatgaatagtgcttgcgtgtgtgtgtgtgtgtgtgtgtgtgtgtgtgtttatagatgcatattaggctgctgaaaagtttgactattctttccaggag

SEQ ID NO: 3410 - DNA, 386 bp, Homo sapiens
  AC055847.2_122812
  Located on chromosome 2
  Distance between a terminus base of telomere on chromosomal short arm and 5'-terminus of this base sequence : 128883070
  Distance between 3'-terminus of neighbour sequence of sequence listing upward to telomere on chrosomal short arm and 5'-terminus of this base sequence : 44036
aatttaaagcatagtaacatggagaaatattgcaaaacatacattttactgaattaattgttaatatctaatcattacatgagaacaaaggtaaagagtagctacacacacacacacacacacacacaagtgcaatattttcagtaaacgtgatgttcagctacactacaaatcacacctatgttttctccacagaaaagtaaagattaaaaatcacaataatatttattgtacatatggaggtaaagatactcaaaatattaccctaaaatacttttttttttgagatggagtcttgcttttattgcccaggctggagtgcaatggcacaatcttggctcactgcaacctcagcctcccagggtcaagttattctcctagctcag

SEQ ID NO: 3411 - DNA, 225 bp, Homo sapiens
  AC012001.5_11063
  Located on chromosome 2
  Distance between a terminus base of telomere on chromosomal short arm and 5'-terminus of this base sequence : 129132753
  Distance between 3'-terminus of neighbour sequence of sequence listing upward to telomere on chrosomal short arm and 5'-terminus of this base sequence : 249297
aaggtacagctaaggatagagaaggtggtattttataaaagtgtgtgtgcatatataaatatatgaatatatattatacatgtgtgtcatatatagttgtgtgtgtgtgtgtatatatatatatatatatatatatatatatatatatatatatatatgtaaccttgtttagtgatgtctgtactcatttttagacttctcctaaattttatgccaagaactgta

SEQ ID NO: 3412 - DNA, 381 bp, Homo sapiens
  AC012001.5_86069
  Located on chromosome 2
  Distance between a terminus base of telomere on chromosomal short arm and 5'-terminus of this base sequence : 129207670
  Distance between 3'-terminus of neighbour sequence of sequence listing upward to telomere on chrosomal short arm and 5'-terminus of this base sequence : 74692
acgtatgcttcagctgaaccataataaaagtaagcctaatagttttatcacgtgaaagaggtcttgcattttttaataactggtttgaaaatatttatagtatcacataccttccagaaggttcttgttttatattgaagaatgagactctcaaccttgattttctattcttgggaaaatgttaaatcaatattcacaaattgtgtgtgtgtgtgtgtgtgtgtgtgtgtgtgtgcgttttagtggtgaagatgtacaaaacctatattttggtggcagcataaattttgatggcagcagttgggggaatatggtttaaagaatttgagtaatgttttaaaaatcaaacaccttgcttaggaaccacaaatgttaatattt

SEQ ID NO: 3413 - DNA, 473 bp, Homo sapiens
  chr2.fa.O7frz.129773897
  Located on chromosome 2
  Distance between a terminus base of telomere on chromosomal short arm and 5'-terminus of this base sequence : 129228685
  Distance between 3'-terminus of neighbour sequence of sequence listing upward to telomere on chrosomal short arm and 5'-terminus of this base sequence : 20634
ctgtcttacagtcttggacaagatctgaaagaactatttggattaccaatgactcttgttctattttcttactttctcccaaacaaacacagtctctctctctctctctctctctctctctctctctctctctctctgttctaagtcacctggacctgggggtgtagtgacacaaactccctgtggccaccatgactaggactgtgctgggcgagaacagaagtcagcaaagcactgagtctcacccagccccactgtaacccctccctatctactgtctatgttaactcaagagcttggggctctacagtcaaaaggtggtgaagccagccaagcccgtgtcttttccttcagtgtggtaagttctgccaggtcccaggccctgggtgtgtccagaggtgccatccaggagtcagggactagagtcaaaaacgttgtaagtctacgtggtgttctattgtactgcagctgag

SEQ ID NO: 3414 - DNA, 299 bp, Homo sapiens
  AC012001.5_127861
  Located on chromosome 2
  Distance between a terminus base of telomere on chromosomal short arm and 5'-terminus of this base sequence : 129253751
  Distance between 3'-terminus of neighbour sequence of sequence listing upward to telomere on chrosomal short arm and 5'-terminus of this base sequence : 24593
ggtaccatttgttgacagaactgttctttcctctttgaatggtcttcatactcttttcaaaaataatttgaccatatttgagaagaatatagaaatgatttttaaatccattataaagaaggagaaaatatgcattaatactgtatcttatacttacgtaattacttttactggtgctctttgtgtgtttgtgtgcgtgtgtgtgtgtgtgtgtgtgtgtgtgtgtgtgtttgcatttccatctgggcctatttgttttcagcctacagaatagcctttagtatttcctataaggcagg

SEQ ID NO: 3415 - DNA, 262 bp, Homo sapiens
  D2S2296
  Located on chromosome 2
  Distance between a terminus base of telomere on chromosomal short arm and 5'-terminus of this base sequence : 129390941
  Distance between 3'-terminus of neighbour sequence of sequence listing upward to telomere on chrosomal short arm and 5'-terminus of this base sequence : 136891
tgtatgacttccaagacaaaatctccttgaaaagataatgttctaattttaacccttgtattcttccttctggctactacatctttctctctctctcttgttctccctctctctctctcttttttcctctctcaccctcttaaacacacacatactgtgtgtgtgtgtgtgtgtgtgtgtgtgtgtgtgtatttatataaaacttttatttccaggtgcagtggttcacacctgtaatctctgcctgcacattgggaggtga

SEQ ID NO: 3416 - DNA, 244 bp, Homo sapiens
  HUMUT5135
  Located on chromosome 2
  Distance between a terminus base of telomere on chromosomal short arm and 5'-terminus of this base sequence : 129479167
  Distance between 3'-terminus of neighbour sequence of sequence listing upward to telomere on chrosomal short arm and 5'-terminus of this base sequence : 87964
gtggaccttcagcagaaagcttacaagtgagaagggattaagaagctattttcagtattgttttttttctttttctttctttcttttcctttctttctttctttctttctttctttctttctctttctttctttctctttctttctttctttctttctttctttctttctttctttctttctttctttctttctttctttctttccttctttctttctttgaaacagtgtctcagtttgttgcc

SEQ ID NO: 3417 - DNA, 176 bp, Homo sapiens
  D2S383
  Located on chromosome 2
  Distance between a terminus base of telomere on chromosomal short arm and 5'-terminus of this base sequence : 129576557
  Distance between 3'-terminus of neighbour sequence of sequence listing upward to telomere on chrosomal short arm and 5'-terminus of this base sequence : 97146
tacccatagtagcccccaacactctaaaacaagtaaacaaacaaaagcatggcgtgaaatggaatacatgctgtcttgtgtgcacatgtacacacacacacacacacacacacacacacaaagttgcatctgtccctggacaatgggaatgatctcttagaaatcttcattggaaa

SEQ ID NO: 3418 - DNA, 101 bp, Homo sapiens
  DISO7_10000962
  Located on chromosome 2
  Distance between a terminus base of telomere on chromosomal short arm and 5'-terminus of this base sequence : 129601007
  Distance between 3'-terminus of neighbour sequence of sequence listing upward to telomere on chrosomal short arm and 5'-terminus of this base sequence : 24274
agcgctactaacagattaatgggatgtgagctgtgtgtgtgtgtgtgtgtgtgcatgtgtgtgtttccttttagaatggtaggacttaccttccatctact

SEQ ID NO: 3419 - DNA, 193 bp, Homo sapiens
  DISO7_10000968
  Located on chromosome 2
  Distance between a terminus base of telomere on chromosomal short arm and 5'-terminus of this base sequence : 129752848
  Distance between 3'-terminus of neighbour sequence of sequence listing upward to telomere on chrosomal short arm and 5'-terminus of this base sequence : 151740
aagcctctcctaggtaactgcataaattaaacagtgatgccatttaacaaaggtgacacacaggtgaagaagtttaaaggtaagggaatcaatgacatttggtttttgtgtgtgatgtttgagggactttatgtggtatgtgtgtgtgtgtgtgtgtttgtgtgtgcgtgtgtctgagtattgtccaaatgga

SEQ ID NO: 3420 - DNA, 185 bp, Homo sapiens
  DISO7_10008988
  Located on chromosome 2
  Distance between a terminus base of telomere on chromosomal short arm and 5'-terminus of this base sequence : 129971780
  Distance between 3'-terminus of neighbour sequence of sequence listing upward to telomere on chrosomal short arm and 5'-terminus of this base sequence : 218739
tcacatgcagctctgaggggaaacgaggaggccatgaccacattttctcctaaaaataaataaataaataaataaataaataaataaataaataaacaaacaaaccacaacagataaagttaaattcctcttctcccatcactcccctgccagaacctccccagaggtggctgtggtcatctgtt

SEQ ID NO: 3421 - DNA, 176 bp, Homo sapiens
  D2S2159
  Located on chromosome 2
  Distance between a terminus base of telomere on chromosomal short arm and 5'-terminus of this base sequence : 130359167
  Distance between 3'-terminus of neighbour sequence of sequence listing upward to telomere on chrosomal short arm and 5'-terminus of this base sequence : 387202
acgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacagccattcatctgggctggcaga

SEQ ID NO: 3422 - DNA, 417 bp, Homo sapiens
  chr2.fa.O7frz.139793019
  Located on chromosome 2
  Distance between a terminus base of telomere on chromosomal short arm and 5'-terminus of this base sequence : 130630283
  Distance between 3'-terminus of neighbour sequence of sequence listing upward to telomere on chrosomal short arm and 5'-terminus of this base sequence : 270940
aggaatcctaccaataaatcacacctgaatctggtcccgcctctagaggtaggtaccaattcacaaggaaaacaaggacagaagatcatgtcaaatagtaacaccagggaaatccagactctggaaatctcttggaacagtcttgtttctcaaaaacaaaaccacctcccggcccacagccaaccaaccaaccaaccaaataaataaataaataaataaataaataaataaataaatgcaatggaaaagaagaggtgcctaaagattaaaagagattttaaaagttatcccctcaatgtgcataaaccacacatcgatcctaattcaagcaagcaaattattaaaagaaataatgaaatactggagaaattgcaatgcaaactaaatattgaacatatttaagaacgcttgttgatt

SEQ ID NO: 3423 - DNA, 256 bp, Homo sapiens
  AC016759.9_86893
  Located on chromosome 2
  Distance between a terminus base of telomere on chromosomal short arm and 5'-terminus of this base sequence : 130670135
  Distance between 3'-terminus of neighbour sequence of sequence listing upward to telomere on chrosomal short arm and 5'-terminus of this base sequence : 39435
gatagaggacttaactttccaaacaacaagactcgatgaagatagcatgaggccaaatcaatctgtctcttctctctcccctccattttgtgtgtgtgtgtgtgtgtgtgtgtgtgtgtgtgtgtgtgtgtgtgtgtgcatgtgttttactcaaaaggcaaacaaaaatctttcattgtctctcaatattacacaaaaatttttcagaagaggaaacaaaagttcatgcttgcactagtgcgtctttaatgctaaa

SEQ ID NO: 3424 - DNA, 291 bp, Homo sapiens
  D2S2282
  Located on chromosome 2
  Distance between a terminus base of telomere on chromosomal short arm and 5'-terminus of this base sequence : 130703838
  Distance between 3'-terminus of neighbour sequence of sequence listing upward to telomere on chrosomal short arm and 5'-terminus of this base sequence : 33447
ctatgccagtgaaatcttttccaaaaatgaaaccagccaaaataaacatattttcaggaaaacaaaagtgaaggaaattgcctcaagcagatctctactaccaggaaatactcaaataagttatttaggccaaaaggaaacaatattagacacccagttccttaggaaagaatgagaactctggaaagagaaagcatgttagcaaatataaaagacattaaaacacacacacacacacacacacacacacacaagcatacataaatattttaaagaccattggtttctaaa

SEQ ID NO: 3425 - DNA, 421 bp, Homo sapiens
  AC016759.9_35236
  Located on chromosome 2
  Distance between a terminus base of telomere on chromosomal short arm and 5'-terminus of this base sequence : 130721754
  Distance between 3'-terminus of neighbour sequence of sequence listing upward to telomere on chrosomal short arm and 5'-terminus of this base sequence : 17625
attatgttaaatgaagtaagccaggcacagaaagacacatatggcatgttctcattcatatatgagagctaaaaaagttgatctcatggaggtagagagtagaatgatagttaccagaggctgaaaaatgtgtgtgtgtgtgtgtgtgtgtgtgtgtgtgtgtgtgtgtgtgtgttggtggggtgttgctaggggatgaaaagaggtgggttggtgagaactaacatacagttaaagaaaaggaataagttctaatatttaatagcagagtaggtagattatagttaacaacaatgtattgtatatttcaaaatagccagaagagaggatttgaaatgtttccaacacacagaaatgataagtcctcgaggtgatgaataccctaaaccctgatttcatcattacacattctatgcatgta

SEQ ID NO: 3426 - DNA, 365 bp, Homo sapiens
  AC016759.9_19497
  Located on chromosome 2
  Distance between a terminus base of telomere on chromosomal short arm and 5'-terminus of this base sequence : 130737407
  Distance between 3'-terminus of neighbour sequence of sequence listing upward to telomere on chrosomal short arm and 5'-terminus of this base sequence : 15232
acgattctgagaaaggtcttaggaaagagatgcatggccttgaattcttggcatatcctgcaaaaatgtgcagggcccatggcagactgtgctccagcatatagtcaagattctttgagctgcaaattacaaaaacccagcttaaacttaattaaacaaaaggaagaatgacaaaaaatgtattgaccatgaaactcctgtctctctctctgactctctgtgtgtgtgtgtgtgtgtgtgtgtgtgtgtgtgtgtgtgtgtctctctcactgtctctctctctctctctctctctcctcctatcctctatgtggtctccattcatggacaggcactcccctgtgatcataagaaagctacctgta

SEQ ID NO: 3427 - DNA, 358 bp, Homo sapiens
  M2_130821714
  Located on chromosome 2
  Distance between a terminus base of telomere on chromosomal short arm and 5'-terminus of this base sequence : 130821675
  Distance between 3'-terminus of neighbour sequence of sequence listing upward to telomere on chrosomal short arm and 5'-terminus of this base sequence : 83903
taagagcaagtatttgtttcacgaaaattttcaagcagttgtgtgtgtgtgtgtgtgtgtgtgcgcacgcgtgcacgcacgtgtgtgtgcactgaggttgcaacataaaagatatttctaatggggatttatttttaatgggtacagagtttaatttttcacattgaaagagttatggagatctgttgtacatgaatatactcaacactactgaactgtacacttaaaatggttaagataataaattttatgttatatttcacacaaataaatataatttttaagaaaagaatttttactgtgaatcacggcctgaaaagttggagaaacactgttccactggattgaggttatttta

SEQ ID NO: 3428 - DNA, 280 bp, Homo sapiens
  AC016906.4_7532
  Located on chromosome 2
  Distance between a terminus base of telomere on chromosomal short arm and 5'-terminus of this base sequence : 131166251
  Distance between 3'-terminus of neighbour sequence of sequence listing upward to telomere on chrosomal short arm and 5'-terminus of this base sequence : 344218
gaagcctagtggtcattctatactcctcctcctcctcctcgtcttccctcattccttccagttagtcattgcccactgtcctgctgatttgacctcttaagtatttctagcatttggtttcttattatgactggactgccactaccctgttcaggcctttattggactcatttctcacccggattttcatgagccacccttcaaacccatcctctacacagcagccaatatcaaatatggtggcctcagcactgttaaatgtcttcagtgatttacctgc

SEQ ID NO: 3429 - DNA, 306 bp, Homo sapiens
  AC013276.3_162466
  Located on chromosome 2
  Distance between a terminus base of telomere on chromosomal short arm and 5'-terminus of this base sequence : 131236858
  Distance between 3'-terminus of neighbour sequence of sequence listing upward to telomere on chrosomal short arm and 5'-terminus of this base sequence : 70327
atagaattctgagctgacagtaagttttctctcagcatttaagaaatgctgtgtgtgtgtgtgtgtgtgtgtgtgtgtgtgtgtgtgtgtgtgtgtgtgtgtgttttccagcctccttcttctgacgagatgtcaggtgacattgccatctttgttcccttttatgtaatgtgtcttgtttttctctgtctgctttcaacattttctctttctcatttgcttttagcagtttgattataataaatgtgattgtctttatcttgtggttcactgaattgctggatctgaagttaatgttcctcaaca

SEQ ID NO: 3430 - DNA, 273 bp, Homo sapiens
  AC016906.4_33935
  Located on chromosome 2
  Distance between a terminus base of telomere on chromosomal short arm and 5'-terminus of this base sequence : 131236858
  Distance between 3'-terminus of neighbour sequence of sequence listing upward to telomere on chrosomal short arm and 5'-terminus of this base sequence : -306
atagaattctgagctgacagtaagttttctctcagcatttaagaaatgctgtgtgtgtgtgtgtgtgtgtgtgtgtgtgtgtgtgtgtgtgtgtgtgtgtgtgttttccagcctccttcttctgacgagatgtcaggtgacattgccatctttgttcccttttatgtaatgtgtcttgtttttctctgtctgctttcaacattttctctttctcatttgcttttagcagtttgattataataaatgtgattgtctttatcttgtggttcactg

SEQ ID NO: 3431 - DNA, 142 bp, Homo sapiens
  chr2.fa.O7frz.140293516
  Located on chromosome 2
  Distance between a terminus base of telomere on chromosomal short arm and 5'-terminus of this base sequence : 131264686
  Distance between 3'-terminus of neighbour sequence of sequence listing upward to telomere on chrosomal short arm and 5'-terminus of this base sequence : 27555
ccatgtaacatgttgctagtacccgtgttataaggccctatggggaattaaattgtgtagtgtgtgtgtgtgtgtgtgtgtgtgtgtgttacgaagcccaacatattctaagccttcatacatgatggtatgcttatgtaac

SEQ ID NO: 3432 - DNA, 473 bp, Homo sapiens
  AC013276.3_93452
  Located on chromosome 2
  Distance between a terminus base of telomere on chromosomal short arm and 5'-terminus of this base sequence : 131303667
  Distance between 3'-terminus of neighbour sequence of sequence listing upward to telomere on chrosomal short arm and 5'-terminus of this base sequence : 38839
tcacttgcataaatgaaggtattggtttaaaaaaagaatgaattattatacacaacaacatagatgacttcaaaataagaggagcatttattctgtttgattctgtatatattatacatataaaactctagaaaatgcaaaccaatccatagtgaccaaaaagaggtcattggttacttagggaggggagaggaggagagatggatatgtttgctgtcttgggtgtggtgatagctttatggtttttacattgtgtgtgtgtgtgtgtgtgtgtgtgtgtgaatgacagacttttatgtgttcccataaagtctagaaatttgctatcttatcctttacggaaaaaatttgatgacaactggataagatcaatcattattcacctgtgtgttttcagagccctagggtctgctattataggaggtcaaggagcagccacacaggatgggccctgtctcaacagagcagttcta

SEQ ID NO: 3433 - DNA, 382 bp, Homo sapiens
  HUMUT671
  Located on chromosome 2
  Distance between a terminus base of telomere on chromosomal short arm and 5'-terminus of this base sequence : 131353357
  Distance between 3'-terminus of neighbour sequence of sequence listing upward to telomere on chrosomal short arm and 5'-terminus of this base sequence : 49217
tacatgtctctttgccttcagttgaagagaagaaaaggtctggatatctaaatgtgggtttagctttgtttttatttttgtgctggaccatttttcaaaccatgatgtctactcagagggagaaaagttccgcaaggccttaagtaatgtggctggttcaggttatgttttaatataaactggatttttatctttatattgggaaacatatgagtaggttctcgatcatttttctgacattttttaagccattagaaatactctggcttcagggtttgtgtgtgtgtgtgtgtgtgtgtgtgtgtgtgtgtgtgtgtgtgtgtttccataaagagaactcatgttctccttggagatttaatagccactctgaagtaatgtc

SEQ ID NO: 3434 - DNA, 231 bp, Homo sapiens
  D2S368
  Located on chromosome 2
  Distance between a terminus base of telomere on chromosomal short arm and 5'-terminus of this base sequence : 131353612
  Distance between 3'-terminus of neighbour sequence of sequence listing upward to telomere on chrosomal short arm and 5'-terminus of this base sequence : -127
aaatactctggcttcagggtttgtgtgtgtgtgtgtgtgtgtgtgtgtgtgtgtgtgtgtgtgtgtgtttccataaagagaactcatgttctccttggagatttaatagccactctgaagtaatgtctcatatttaataagattttcattacttttacaaactatactccagtaaatttattgattgatatacaatgaagtatcttagatcagatggttctcaataaatag

SEQ ID NO: 3435 - DNA, 257 bp, Homo sapiens
  chr2.fa.O7frz.140683405
  Located on chromosome 2
  Distance between a terminus base of telomere on chromosomal short arm and 5'-terminus of this base sequence : 131475852
  Distance between 3'-terminus of neighbour sequence of sequence listing upward to telomere on chrosomal short arm and 5'-terminus of this base sequence : 122009
gatgttcaaactatggtgttaaatacagaaaaaacagttttcaaaaaaactatacgtagatcatctctgttttaaaaaagctaaatggatatacgtgtgtgtacacacgtgcacacacacacacacacacacacacacacatacacacacacggagcatacatcaaaatgttagttccggttatccctggaagtccccataacaagtgagtttcactgtattctctgcacctttatgaattacctcaactgtttaca

SEQ ID NO: 3436 - DNA, 430 bp, Homo sapiens
  chr2.fa.O7frz.140446377
  Located on chromosome 2
  Distance between a terminus base of telomere on chromosomal short arm and 5'-terminus of this base sequence : 131545711
  Distance between 3'-terminus of neighbour sequence of sequence listing upward to telomere on chrosomal short arm and 5'-terminus of this base sequence : 69602
gtgtctttgtacatcgtctgagctccagatctgtgcttccaactgctggttagaccatgtggaccgtctctatgccccatgcatctgcattcatctagttttctggaggggtctcttccatttttttttaaactaatgggtttgtctttttattttttactttatttatttatttatttatttatttatttatttatttatgtattttcgagacagagtttggttcttgtcacccaggctggagtgcagtgtcacggtctctcagctcactgcaacctctgcctcctgggtacaaacaattctcctgcctcagcctcccaagtagctgagattacagtcacctgaacaccacgcccagctgataaggtattttgagtagagatggggtttcaccatattggccaggctagtctcgaactcatgacctcag

SEQ ID NO: 3437 - DNA, 424 bp, Homo sapiens
  chr2.fa.O7frz.141071558
  Located on chromosome 2
  Distance between a terminus base of telomere on chromosomal short arm and 5'-terminus of this base sequence : 131833482
  Distance between 3'-terminus of neighbour sequence of sequence listing upward to telomere on chrosomal short arm and 5'-terminus of this base sequence : 287341
aaggccaacattactctgataccaaaaccaaagcaggagaaaagaaaattacagaccaacatcccacatgaacatagacactgaagtcctcaacaaactattagcatatcaaatacagcaatacacatacatacacacacacacacacacacacacacacacacacagaaatacaaattgcaccacaaagaagtggagtttatcttgagaatgcaaagctggttatatatccaaaaatcagtcaatgcaatcaacatattaaaaatctaaagaaaataaatcatatcaatttaagcagaaaacaacaatcatatcaatttaaacagaaaaaggatttgacaaaattcaacatccattcataataaaaactctcagcaaagcaggaacaaaagggaattttctcaatctgataaagagcatctac

SEQ ID NO: 3438 - DNA, 226 bp, Homo sapiens
  AC016725.2_198910
  Located on chromosome 2
  Distance between a terminus base of telomere on chromosomal short arm and 5'-terminus of this base sequence : 131921249
  Distance between 3'-terminus of neighbour sequence of sequence listing upward to telomere on chrosomal short arm and 5'-terminus of this base sequence : 87343
atgcacctgtagaaccaactacttgggaggctgaggcaacaggatcattcaagcccaggagttcaaagttacagtgagctatgatcacaccactgcactccagccaggatgacagagggagagtctgtttctaaaaaacaaacaaacaaacaaacaaacaaacaacatcaaactcttagtctcaagagattctcccacttctgtctcctaaagtgcaggaattaca

SEQ ID NO: 3439 - DNA, 239 bp, Homo sapiens
  AC016725.2_129683
  Located on chromosome 2
  Distance between a terminus base of telomere on chromosomal short arm and 5'-terminus of this base sequence : 132085498
  Distance between 3'-terminus of neighbour sequence of sequence listing upward to telomere on chrosomal short arm and 5'-terminus of this base sequence : 164023
acctaatgtagatgacgagttgatgggtgcagtgaaccaccatggcacttgtatacctatgtaacaaatctgcacattctgcacatggatcccagaacttaaagtatatatatctatctctatctctatctatatctatctatctatctatctatctatctatctatctatctatctatctatctgtatccccaaaaaactctttagtggttccccactgtcttcaggatcaagttcaa

SEQ ID NO: 3440 - DNA, 319 bp, Homo sapiens
  chr2.fa.O7frz.141278796
  Located on chromosome 2
  Distance between a terminus base of telomere on chromosomal short arm and 5'-terminus of this base sequence : 132237292
  Distance between 3'-terminus of neighbour sequence of sequence listing upward to telomere on chrosomal short arm and 5'-terminus of this base sequence : 151555
ccacctgtaaacctttagtctctttaaatttgctgaatttgaagaatttgcccaacatctcatggatggtaatagtggtgctgagatttgaacttgggcagtctgactccaaagtcttgctttactaaaagccaacttttacctaataatataaaaattatattaaatatatttcttgggattattttcctatgctatttacacactattttgtgtgtgtgtgtgtgtgtgtgtgtgtgtgtgtgtgtgtgtgtgtgtattgggggcagctacacaaaagcaggagattctgagactaggaaacattcctaactttagg

SEQ ID NO: 3441 - DNA, 461 bp, Homo sapiens
  chr2.fa.O7frz.141595671
  Located on chromosome 2
  Distance between a terminus base of telomere on chromosomal short arm and 5'-terminus of this base sequence : 132484421
  Distance between 3'-terminus of neighbour sequence of sequence listing upward to telomere on chrosomal short arm and 5'-terminus of this base sequence : 246810
aggataaactttctgtaagtggtcttcctggtcttcctggatcaaagatatattcagtataaggctttcatactggtaaactgacctccaaagagtttggaccatttttcacaacagtttatgagagtgtacatttgctgagccctccttgcacttggcaaaattctcttctgtccttgccaatgaaaaaaaattattattattattattattattattattattattattatttttaaatttaagagacaagatctcattatgttgcctggactggacttaaacttctgggctcaaggaatccttctgccttagcctcctaagtaactgggatgataggcacgtgccattgcatctagttcaaaaatgctgttttaaaaattgcttttctttaatcaaaaatcgcttttctttaatcaaaaatctttcgtttctttgcgttggactacctcttcatttct

SEQ ID NO: 3442 - DNA, 214 bp, Homo sapiens
  G08150
  Located on chromosome 2
  Distance between a terminus base of telomere on chromosomal short arm and 5'-terminus of this base sequence : 132618460
  Distance between 3'-terminus of neighbour sequence of sequence listing upward to telomere on chrosomal short arm and 5'-terminus of this base sequence : 133578
gagatttaggtggagacacacatccaaacaatattacactcagatagatagatagatagatagatagatagatagatagatagatagatagatagatagatagataagatagataagatagattgattagatagattagatagatagatagatagatagatagattagatattccaaaccccaaaaaatagcaaaatcattcgaagagaggcct

SEQ ID NO: 3443 - DNA, 344 bp, Homo sapiens
  HUMUT1307
  Located on chromosome 2
  Distance between a terminus base of telomere on chromosomal short arm and 5'-terminus of this base sequence : 132618467
  Distance between 3'-terminus of neighbour sequence of sequence listing upward to telomere on chrosomal short arm and 5'-terminus of this base sequence : -207
aggtggagacacacatccaaacaatattacactcagatagatagatagatagatagatagatagatagatagatagatagatagatagatagatagataagatagataagatagattgattagatagattagatagatagatagatagatagatagattagatattccaaaccccaaaaaatagcaaaatcattcgaagagaggcctaaatatatagaagactttaggagaaaaaaagctaacagaatgggaggagaggaattgaagacaataaatagagacagcctttgaagagaattgctttcataaggataagcgttgaattggattcgtatatggagagg

SEQ ID NO: 3444 - DNA, 147 bp, Homo sapiens
  Z67485
  Located on chromosome 2
  Distance between a terminus base of telomere on chromosomal short arm and 5'-terminus of this base sequence : 132714519
  Distance between 3'-terminus of neighbour sequence of sequence listing upward to telomere on chrosomal short arm and 5'-terminus of this base sequence : 95708
tctgaaacctgaaggaccacacacacacgcacccacgcgcgcgcgcgcacacacacacacacacacacacatgcataaacagtttttaatttccttcaaacaacatatgcaaattctgatatttagcatctatgacagatttcaaaa

SEQ ID NO: 3445 - DNA, 270 bp, Homo sapiens
  AC012551.5_13687
  Located on chromosome 2
  Distance between a terminus base of telomere on chromosomal short arm and 5'-terminus of this base sequence : 132749223
  Distance between 3'-terminus of neighbour sequence of sequence listing upward to telomere on chrosomal short arm and 5'-terminus of this base sequence : 34557
ttagaacctaagcactgtcaagactaacagcctctcagaagtacgcttttttgtttctccccttatcactaaaccaaatattccaaagcaggattttccaaaggaaaagatggagatggaatgagaaagtgtgtgtgtgtgtgtgtgtgtgtgtagggggcggggggtgcctgtgcctgtatgttgttgggaatgcatcacctatgtgctcatccatgcgcctctgtgctcagcacacagaaagcacgcagtgttgatggctaaatgaat

SEQ ID NO: 3446 - DNA, 457 bp, Homo sapiens
  AC011999.5_137395
  Located on chromosome 2
  Distance between a terminus base of telomere on chromosomal short arm and 5'-terminus of this base sequence : 132948024
  Distance between 3'-terminus of neighbour sequence of sequence listing upward to telomere on chrosomal short arm and 5'-terminus of this base sequence : 198531
caccactgtattggtaatcaagccattaacatcaaacagcctgaaaacaaaatagcattccaattacacagaactctttgaccctgagggttaggcgaacagtttcagctcacaatgaaccaggatgggaacactggaacaaagaattaaactttttgctccaataggaaactagaaaattgtcggccagcttatttttaactgcacgtgcgcgcgcgcacacacacacacacacagacacacacaaacacacacaaacacacacacacacacacacacacttccggctaacatctatgccaaacagcatacacaagactttgatttacaaaccaggatctatattcttttccagattttactagttgtgtgaatacaaactttcctttatgtttgtccaaaaatagtatgatatgagacctactccttgctttccttcaaattgagctcttaaaca

SEQ ID NO: 3447 - DNA, 360 bp, Homo sapiens
  chr2.fa.O7frz.142243512
  Located on chromosome 2
  Distance between a terminus base of telomere on chromosomal short arm and 5'-terminus of this base sequence : 132984298
  Distance between 3'-terminus of neighbour sequence of sequence listing upward to telomere on chrosomal short arm and 5'-terminus of this base sequence : 35817
cttacttgttctggccttctaccacccctctgatctcatttcctagccatgccctgttctcactccactccaggcaccctagacttcttgtagccctttaaatgctccaagaaaattctcattgcaagacctttaaatgtgctgttccctctgccaggcatgctcttccctgatatttgcaggacttactcccaatttcctttgtgtttttttctgatgtcttccctgactatcatccacatgatactaattagcccttctcccctcattacctcttactcctatcccttctcctgctctgtgtgtgtgtgtgtgtgtgtgtgtgtgtgtgtgtgtgtgtattccttatcatttgacatt

SEQ ID NO: 3448 - DNA, 266 bp, Homo sapiens
  D2S2196
  Located on chromosome 2
  Distance between a terminus base of telomere on chromosomal short arm and 5'-terminus of this base sequence : 133051855
  Distance between 3'-terminus of neighbour sequence of sequence listing upward to telomere on chrosomal short arm and 5'-terminus of this base sequence : 67197
ggtctaaatacccccaagtgccaaatcttcctgtagattgaatatataatgtgctacaatttttgaaatgcatgtggatgctattgtgattcataaaatatggaattggtttggaagtgtcttgaattcataggagttttgtgtgtgtgtgtgtgtgtgtgtgtgtgtgtgtgtgtgtgtgtgtgtttaagaatgttgtttgggccgggcacggtggctcatgcttgtaatcccagcactctggggggctgaggtgggtggatcac

SEQ ID NO: 3449 - DNA, 427 bp, Homo sapiens
  AC068492.1_16770
  Located on chromosome 2
  Distance between a terminus base of telomere on chromosomal short arm and 5'-terminus of this base sequence : 133051876
  Distance between 3'-terminus of neighbour sequence of sequence listing upward to telomere on chrosomal short arm and 5'-terminus of this base sequence : -245
caaatcttcctgtagattgaatatataatgtgctacaatttttgaaatgcatgtggatgctattgtgattcataaaatatggaattggtttggaagtgtcttgaattcataggagttttgtgtgtgtgtgtgtgtgtgtgtgtgtgtgtgtgtgtgtgtgtgtgtttaagaatgttgtttgggccgggcacggtggctcatgcttgtaatcccagcactctggggggctgaggtgggtggatcacctgaggtcaggagtttgagaccagcctggccaacatggtgaaacgccatctctactaaaaatacaaaaaatagctgggtgtggtggcaggcgcctgtaatcccagttacccagtaggccgaggcacgagattcgcttgaacctgggacacggaggttgcagtgaatcaagattgcactactg

SEQ ID NO: 3450 - DNA, 370 bp, Homo sapiens
  AC062002.2_28115
  Located on chromosome 2
  Distance between a terminus base of telomere on chromosomal short arm and 5'-terminus of this base sequence : 133342357
  Distance between 3'-terminus of neighbour sequence of sequence listing upward to telomere on chrosomal short arm and 5'-terminus of this base sequence : 290054
gcttatttgattaattctgtcaacttatgctttaaatgtacagtaaagtatctgttatctaagcttacatttaccaagtatgcatgtgcgcacatgcacacgcacacacacacacacacacacacacacaaatttttctgctttgatgattcaaaggctcatataaaatcattttttaataatttgatgaggcataaactactgtggtctttttgggtatgaatttataaggagcagggaatttaataatgattataattcttatgctccatcaagaccctttccttgggttggatgtcctttcacaagtttctgtattatcctgtgtatatatctattatttcacctccaagttgtatttaagtcctta

SEQ ID NO: 3451 - DNA, 441 bp, Homo sapiens
  AC010146.12_123855
  Located on chromosome 2
  Distance between a terminus base of telomere on chromosomal short arm and 5'-terminus of this base sequence : 133352502
  Distance between 3'-terminus of neighbour sequence of sequence listing upward to telomere on chrosomal short arm and 5'-terminus of this base sequence : 9775
cctcaggataattctacctgattatggtgtattatctttttgatgtgctgttggattcaatttgctagtatttttttgagtattttatgtgtatgttcatcagagatattagtctgttgtgtgtgtgtgtgtgtgtgtgtgtgtgtgtgtccttgtctggttttggcatcagggtgatattggtctcatagaataagttagggggaattccctccttcttgattttttttgaaatagtttcaggaggattggtattagttctttgtatatttggtagaatttggctgtgaatctgtctggtccagagccttttttttttctttaaattggaagattttttattgctgatacaatcactactcatgtgttccatgtgtggatgaaaagaatgtataccctgcagttattgtgtagaatgttctgtaaatgtctgttaagtcc

SEQ ID NO: 3452 - DNA, 202 bp, Homo sapiens
  D2S442
  Located on chromosome 2
  Distance between a terminus base of telomere on chromosomal short arm and 5'-terminus of this base sequence : 133377218
  Distance between 3'-terminus of neighbour sequence of sequence listing upward to telomere on chrosomal short arm and 5'-terminus of this base sequence : 24275
aagggaaggagcatagcaacggtgattagatgagacaaaatttatttgaatgaaattcaaaaggtggtttctcccaaagtagcagaacagaacttacattagtcagggttctcaagagaaacagaatctatctatctatctatctatctatctatctatctatctatctatctatctatcacatctgtctatctaccaaatc

SEQ ID NO: 3453 - DNA, 287 bp, Homo sapiens
  AC010146.12_197323
  Located on chromosome 2
  Distance between a terminus base of telomere on chromosomal short arm and 5'-terminus of this base sequence : 133425919
  Distance between 3'-terminus of neighbour sequence of sequence listing upward to telomere on chrosomal short arm and 5'-terminus of this base sequence : 48499
tttagattcacatgcagttgtaaggaataatatagagaaatattgtatacattttacatagttcctcacaacagtaatattttacaagatagtcatatggtattacaactgagatgctgacattgatacaattcacttatcctattcagaattccttggttttacttgtacgcgtgtgtgtgtgtgtgtgtgtgtgtgtgtgtgtatttagttatatacaatttattcacatttttactgtgatataattcacaaaatataaaattcactaattcagagttcaatgg

SEQ ID NO: 3454 - DNA, 168 bp, Homo sapiens
  chr2.fa.O7frz.142870682
  Located on chromosome 2
  Distance between a terminus base of telomere on chromosomal short arm and 5'-terminus of this base sequence : 133468255
  Distance between 3'-terminus of neighbour sequence of sequence listing upward to telomere on chrosomal short arm and 5'-terminus of this base sequence : 42049
attcagtccataacacttgtttacaaaggttctagcagagttgtgacacagatgggcagatttccttgtcatctctctttcaaggcgggctctctctctctctctctctctctctctctctgtattgtgaaaggaggacatctcaggtccttagattccacttcaaat

SEQ ID NO: 3455 - DNA, 417 bp, Homo sapiens
  chr2.fa.O7frz.143015062
  Located on chromosome 2
  Distance between a terminus base of telomere on chromosomal short arm and 5'-terminus of this base sequence : 133608138
  Distance between 3'-terminus of neighbour sequence of sequence listing upward to telomere on chrosomal short arm and 5'-terminus of this base sequence : 139715
ctagcggatagtatggaaactttattctggatcatccatttttcctgctgtactggatcattccaatcagaacattaaagtgataatacttcccatatttaaaaaaatcctccttgactgcatattacacaacacacacacacacgcacgcacgcacacacacacacacacacacagagacagagagagagagaattctatttttctgttattcgcaaaaaagtttattaaaacataccaatttcccaacattttcttctgcttatcttcaatcctactcttccctttatctcttgaatcctgctcctccctttatctcttgaatccattttaaccaggcttctttcctcaccactccaggaaatttacctttgtcaaggtcaccaatgacctccatgttgctagatccaatcttaa

SEQ ID NO: 3456 - DNA, 266 bp, Homo sapiens
  D2S314
  Located on chromosome 2
  Distance between a terminus base of telomere on chromosomal short arm and 5'-terminus of this base sequence : 133654516
  Distance between 3'-terminus of neighbour sequence of sequence listing upward to telomere on chrosomal short arm and 5'-terminus of this base sequence : 45961
tttttatgaagtgtgtaaacttgagtacattggatcttcttgtatcatttctccataattattatccctttttggggacacgtgttaaaaggctatatatatatatgtgtgtgtgtgtgtgtgtgtgtgtgtgtgtgtgtgtgtgtgtattcttttttaatgtcaagtccttgatcaggaaaacaacttataatatttataaagtttttcctttgggaaatatgtccaatttatgacccaatttctcagggcacattagagtagaa

SEQ ID NO: 3457 - DNA, 419 bp, Homo sapiens
  AC010100.10_114696
  Located on chromosome 2
  Distance between a terminus base of telomere on chromosomal short arm and 5'-terminus of this base sequence : 133672196
  Distance between 3'-terminus of neighbour sequence of sequence listing upward to telomere on chrosomal short arm and 5'-terminus of this base sequence : 17414
aggctgaagtcatgaatttatctttctccttaaaaagcttccattttaaagacttgtgttttttaatagtaatttaaaattataaacataactttctctgcttctatatctgggacatatatgaagaagccataaataaggtttggaagagcttgggagggtataactaccaattttactggccaagatagtgatatcatatttgatcacacacacacacacacacacacacacacacaacctaaaaaaactgaagactcatttgtttttgtcatgaaaagaaataataattaggaataagtgaaatgtctggaactttttttatagaaaccaaattttgttcacttggggacttttcaaggacaatagagagacactcctgtatatcacagaccttcaaatgctggaacaagttattg

SEQ ID NO: 3458 - DNA, 106 bp, Homo sapiens
  D2S2376
  Located on chromosome 2
  Distance between a terminus base of telomere on chromosomal short arm and 5'-terminus of this base sequence : 133679784
  Distance between 3'-terminus of neighbour sequence of sequence listing upward to telomere on chrosomal short arm and 5'-terminus of this base sequence : 7169
gcattaagtgaatgtactggaactcacatacacacacacataacacacacacacacacacacacacacacacacacacccttacccttgtgtgttttacatttgag

SEQ ID NO: 3459 - DNA, 346 bp, Homo sapiens
  chr2.fa.O7frz.143211198
  Located on chromosome 2
  Distance between a terminus base of telomere on chromosomal short arm and 5'-terminus of this base sequence : 133779295
  Distance between 3'-terminus of neighbour sequence of sequence listing upward to telomere on chrosomal short arm and 5'-terminus of this base sequence : 99405
aagcatagaactttcaaaggagttctcagtacccagcagagtcttcctgtgaggtgtgtgtgtgtgtgtgtgtgtgtgtgtgtgtgtgtgtgtgtgtgtgtttgtttgtttctgagctgggccggcagcatgatttttgtaaaccttaaagccaatgacaaaacccatagtcccagctgtgtccccaaatgttcctcaaggaggagggaagaataagaggaggccttttatgggcaagaaaatgtgtttctcctttaattaaataatattcagtgtgtagcgagaatattaggcaaccccagcaaatgtggagacggggaagtggtgacattgactggtggtacat

SEQ ID NO: 3460 - DNA, 143 bp, Homo sapiens
  D2S2385
  Located on chromosome 2
  Distance between a terminus base of telomere on chromosomal short arm and 5'-terminus of this base sequence : 133879665
  Distance between 3'-terminus of neighbour sequence of sequence listing upward to telomere on chrosomal short arm and 5'-terminus of this base sequence : 100024
tgacctttatccaccttcatcctccttcccgtgacccagtgtgtgtgcacacgtacacacacacacacacacacacacacacacacacacacacacacacacacaaacttattccaggagaaccattataaggttatgtgact

SEQ ID NO: 3461 - DNA, 303 bp, Homo sapiens
  chr2.fa.O7frz.143407116
  Located on chromosome 2
  Distance between a terminus base of telomere on chromosomal short arm and 5'-terminus of this base sequence : 133973080
  Distance between 3'-terminus of neighbour sequence of sequence listing upward to telomere on chrosomal short arm and 5'-terminus of this base sequence : 93272
gtatggatcttcatttgatagaacattagagtctgaaaatagaggctgacagacttcactggtgatgatcctggccctctagttctactgtttgaaaatgccgctaagtttgacacacacacacacacacacacacacacacacacacacacctttaaaacggtgaagctgtaggaaataggagtattggagaattaactgaaataccaatcaaccagtgttccatagggagaataatgtaactaatgattctacttggttgtgggaaggagaatacataagtaacagcaactaaacatcagc

SEQ ID NO: 3462 - DNA, 195 bp, Homo sapiens
  chr2.fa.O7frz.143582367
  Located on chromosome 2
  Distance between a terminus base of telomere on chromosomal short arm and 5'-terminus of this base sequence : 134148350
  Distance between 3'-terminus of neighbour sequence of sequence listing upward to telomere on chrosomal short arm and 5'-terminus of this base sequence : 174967
tcaggatcatgttcgaaagagattcaggatgagatttttacggttgttatctgggggctgggagaagaaatacacaccacacacacgggagaaggaatacacacacacacacacacacacacacacacacacacacacacacaggtggtaacttaccttcattctattgttctcatcctaacatctttaatcaag

SEQ ID NO: 3463 - DNA, 136 bp, Homo sapiens
  D2S2367
  Located on chromosome 2
  Distance between a terminus base of telomere on chromosomal short arm and 5'-terminus of this base sequence : 134232328
  Distance between 3'-terminus of neighbour sequence of sequence listing upward to telomere on chrosomal short arm and 5'-terminus of this base sequence : 83783
tgctactttcaactatctcttttccaagacacacacacacatacacacacacacacacacagacacacacacacacacacacacacacacacacacacactttaacctccttggtagcagacattgttatgcttgg

SEQ ID NO: 3464 - DNA, 470 bp, Homo sapiens
  chr2.fa.O7frz.143656607
  Located on chromosome 2
  Distance between a terminus base of telomere on chromosomal short arm and 5'-terminus of this base sequence : 134323888
  Distance between 3'-terminus of neighbour sequence of sequence listing upward to telomere on chrosomal short arm and 5'-terminus of this base sequence : 91424
acaataagtttggtaggcagtcctcagaatcatctgaatgtgtttaaaaactaccctttcctggctggccgcagtggctcacgcctgtaatcccagcactttgggaggccgaggcgggcagatcacgaggtcaggagattgacaccacggtgaaaccccatctctactaaaaatacaaaaaaaattagccgggagcggtggcgggcgcctgtagtcccagctactcgggaggctgaggccggagaatggcgtgaacccgggagtcagagcttgcagtgagccgagattgcgccactgcactccagcctgggcgacagagcgagactccatctcaaaacaacaacaacaacaacaacaacaacaacaacaacaaaaactaccctttcctgggtcccatcctctgagaatcaggtggaattggtctatggtttgtcctggggaatggacttagattttacagacaaggttga

SEQ ID NO: 3465 - DNA, 418 bp, Homo sapiens
  AC017082.3_175752
  Located on chromosome 2
  Distance between a terminus base of telomere on chromosomal short arm and 5'-terminus of this base sequence : 134372540
  Distance between 3'-terminus of neighbour sequence of sequence listing upward to telomere on chrosomal short arm and 5'-terminus of this base sequence : 48182
agacttccagaaagattggtagttacttttttaggcttcttatgaatgaaattctacatagacacacatacaacacatacacaacacacacacagacacacacacacacacacactagatctcactttaatcctctttttcttgttaaagaaaataacattctgttgattaacattgatggtaagataacttttaatataattaacttttctttcaactacagtctggtaaaataatcgtagaccttaaaaacatttcacatgaccctaattttttcaacttgttagtaaactatgtaggtcttccctgaaatctatattatctatgatgattttagccaaaatcctccctgccttgttttgagactagacccacttccaaatgtaccaattgcatacaagctttccaagatagaata

SEQ ID NO: 3466 - DNA, 323 bp, Homo sapiens
  AC017082.3_19760
  Located on chromosome 2
  Distance between a terminus base of telomere on chromosomal short arm and 5'-terminus of this base sequence : 134437901
  Distance between 3'-terminus of neighbour sequence of sequence listing upward to telomere on chrosomal short arm and 5'-terminus of this base sequence : 64943
gcataggaagtaacctaagaattcatttactgtactcattgttttcaccataaaattgtaaatattcatagtcagtaatcatgcagagccagtaacagtttagcagtatttctctttgtgtgtgtgtgtgtgtgtgtgtgtgtgtgtgtgtgtatctgttttagctacactctgaaaacatcctacatatagctaaatttatatgaagccacaatacccaggaggctaaatgattgcctgttagcattgatcatttgggggcataaaaagaaatttccggtacaaatcatatcacttttcttatgcattgtaagaactcctta

SEQ ID NO: 3467 - DNA, 107 bp, Homo sapiens
  D2S2288
  Located on chromosome 2
  Distance between a terminus base of telomere on chromosomal short arm and 5'-terminus of this base sequence : 134437980
  Distance between 3'-terminus of neighbour sequence of sequence listing upward to telomere on chrosomal short arm and 5'-terminus of this base sequence : -244
catgcagagccagtaacagtttagcagtatttctctttgtgtgtgtgtgtgtgtgtgtgtgtgtgtgtgtgtgtatctgttttagctacactctgaaaacatcctac

SEQ ID NO: 3468 - DNA, 454 bp, Homo sapiens
  AC017082.3_89747
  Located on chromosome 2
  Distance between a terminus base of telomere on chromosomal short arm and 5'-terminus of this base sequence : 134522715
  Distance between 3'-terminus of neighbour sequence of sequence listing upward to telomere on chrosomal short arm and 5'-terminus of this base sequence : 84628
gcatagttgtcagactgtcatctaataatggattgtagcatgtagcatacctgactgcagcaacagagatgcaaaaagactgggaagtttgaaggcctgagtccctactccgatctctctctgtctctttctctctctctctctctctccccaacccccccgcccccactctctcacttctcttattctccctcttgttttgtctcttgctcccaccttcacttttcttctttgtcttagcatccatagcagcagcaatagtcacaaagcctctagctcttccaccaacttctggacttagtgaaagctgagtaacacaacttggaagtacagaggagttaagacttcctaaaatgaccattgatcaataagaactggatcctaggagttgttgacatttaagtgcctctcctttctttcctctcctccctgctcttcatgaatggtactgaga

SEQ ID NO: 3469 - DNA, 223 bp, Homo sapiens
  HUMUT431
  Located on chromosome 2
  Distance between a terminus base of telomere on chromosomal short arm and 5'-terminus of this base sequence : 134630024
  Distance between 3'-terminus of neighbour sequence of sequence listing upward to telomere on chrosomal short arm and 5'-terminus of this base sequence : 106855
gagtcaggagaattgcttgaacctgggaagtggaggttgctgtgtgctgagatcgcaccactgcaatccagcctgggtggcagagtgagactaaaaaaaaaaaaaagaaagaaagaaagaaaaaaaagaaagtgagagagaaagaaagaaagaaagaaagaaagaaagaaagaaaggacttctgaacatagaaagctattaacttttcctcttctttttttgc

SEQ ID NO: 3470 - DNA, 437 bp, Homo sapiens
  chr2.fa.O7frz.144184166
  Located on chromosome 2
  Distance between a terminus base of telomere on chromosomal short arm and 5'-terminus of this base sequence : 134722614
  Distance between 3'-terminus of neighbour sequence of sequence listing upward to telomere on chrosomal short arm and 5'-terminus of this base sequence : 92367
ctaccatatgactcagcaatcttatatctaggtatatatgcaaaggaactgaaatcagcatgtcaaagaggtaactacattcccacgttcattgcagcattattctcaatcatcaagatatggaatcaatagatgaatggataaataaaatgtagtgtattcacacacacacacacacacacacacacacacacatgcacacacaggaatattatccagcctttaaaaaatgggcaaaatcgtatcatttgcaacaacatagatgaacctggaggatattgtgctaagtaaaataaccaggcacaaaaagccaaataccacatgatttcacttacatgttgaaattaaaaagtcaaactcaaagtaaaatagtcattatcagaggctgggtgtggggaaaaaggaatggaaaggtgttataccaagttccagttaga

SEQ ID NO: 3471 - DNA, 451 bp, Homo sapiens
  chr2.fa.O7frz.144375049
  Located on chromosome 2
  Distance between a terminus base of telomere on chromosomal short arm and 5'-terminus of this base sequence : 134928443
  Distance between 3'-terminus of neighbour sequence of sequence listing upward to telomere on chrosomal short arm and 5'-terminus of this base sequence : 205392
cgtatctgactttcagttgaaccaatatctgggaactgaaatagtttttgctgtttctgaaatttgtaatggggggcgctgaggaccaaaatctctaacatgtgctcttcaaatacaataaaatacagaaaaagtttagtaattaatccaggacaaatgtgaggtcaatttgtgtgtgtgtgtgtgtgtgtgtgtgtgtgtgtgtgtgtgtaggagaagggtgattcttgaggcatctaataagccccaggacttagagttttctccacattcccaatattgaattgaatttggaataacagatctaatacaatccaatacattttaatactagaaccttaccagagctctgtgtataggtctcagccaccttaaggcttaaaagtgacaaatattctacctattgtatctaaaatgatcttccaatacctgttcaagctgaacttgagta

SEQ ID NO: 3472 - DNA, 462 bp, Homo sapiens
  chr2.fa.O7frz.144506528
  Located on chromosome 2
  Distance between a terminus base of telomere on chromosomal short arm and 5'-terminus of this base sequence : 135061227
  Distance between 3'-terminus of neighbour sequence of sequence listing upward to telomere on chrosomal short arm and 5'-terminus of this base sequence : 132333
catctgtatttctgaagtgaattcaaaatttgcaaataaataaatgtatctatagtagtcgcggttctccagagaacagaaccaattgggtgtgtgtatgtgtgtgtgtgtttaataaaggaatttattataaggaattggtttatgtgatgatgaaggctgacaagttgcaagatctgcagtcagcaagctggagaccaaagatagccccgatgacgcagtttcagtccgaatgccattaggctcaggaccaagaaagaactaatgtttcagtttgagtttaaaggcagaagaaaatcagtgtcccagttcaaggcattcaggcaagagaacttcccccttatgagtgagggatagggatggcttttttgttctatttaggtcttcatctgattggatgaggctaacccacatgaaggagggccatctgcttcattcagtctaccaattcaaatgttaatc

SEQ ID NO: 3473 - DNA, 157 bp, Homo sapiens
  DISD22_0001898
  Located on chromosome 2
  Distance between a terminus base of telomere on chromosomal short arm and 5'-terminus of this base sequence : 135237246
  Distance between 3'-terminus of neighbour sequence of sequence listing upward to telomere on chrosomal short arm and 5'-terminus of this base sequence : 175557
gcagaggcacatatgtgctttttaataggtatacttgtgtgtgtgtgtgtgtgtgtgtgtgtgtatgtgtatgtatgtgtgtgtgtatgtgtgtgtgagagagagagaggaatttgtgaagacccctaaagtatgaaacccaggaagaagcctgaac

SEQ ID NO: 3474 - DNA, 386 bp, Homo sapiens
  AC069121.2_32855
  Located on chromosome 2
  Distance between a terminus base of telomere on chromosomal short arm and 5'-terminus of this base sequence : 135417629
  Distance between 3'-terminus of neighbour sequence of sequence listing upward to telomere on chrosomal short arm and 5'-terminus of this base sequence : 180226
cttacgcttgtaatcctagcactttgggaggccgaggcgggcggatcatgaggtcaggagatcgagaccatcctggccaatgcagtgaaaccccgtctctactaaaaaaaatacaaaaaggtagctactcgggaggctgaggcaggagaatggtgtgaacccgggaggcggagcttgtagtgagcccagatcgcgccactgcactccagcctgggcgacagagcgagactgtctcagaataaataaataaataaataaataaataaataaataaataaaaccaaatttttaaggaaaatgtaagtgaataatcacataaatgactaagtataaatgactaatcatgtaaatttattaaagatctttccaaattcaacattaaagtg

SEQ ID NO: 3475 - DNA, 410 bp, Homo sapiens
  AC069121.2_57506
  Located on chromosome 2
  Distance between a terminus base of telomere on chromosomal short arm and 5'-terminus of this base sequence : 135468746
  Distance between 3'-terminus of neighbour sequence of sequence listing upward to telomere on chrosomal short arm and 5'-terminus of this base sequence : 50731
gactgatagccgctatttaatattccccttggaaaacaagaggctggcatctggtttcccacagattcttcggtgtcacaaacaggttctgcaaactacaaaagaccttccgcagggccctgcccttgtgactaagggaagagaaagaaactctgtgtgtgtgtgtgtgtgtgtgtgtgtgtgtgtgtgtgtgaatatggacaactagcatcacaatttcatacttttgtcatttcgccaacaacaaaactgtggatgggaagttctaactagaaacctctggaaaagaaaggggatagggagaggtagagggagaaaatatgttccttctcaagatagtgcccactagacctttaatacatacctatttttccattcttagagatctctcattgactcatcaattcaac

SEQ ID NO: 3476 - DNA, 260 bp, Homo sapiens
  AC069121.2_108887
  Located on chromosome 2
  Distance between a terminus base of telomere on chromosomal short arm and 5'-terminus of this base sequence : 135489990
  Distance between 3'-terminus of neighbour sequence of sequence listing upward to telomere on chrosomal short arm and 5'-terminus of this base sequence : 20834
aggaacactgaatttacagatcagcaagatgctgcagcttcatctatttgttcttctggcatttcattccccagctcaggaagtcaacttcctgagagttgagaaacagaacataggtggtcttattaaaggacagcttgtttcaaccacaacaaaaataaataaataaataaataaataaataaataaataaataaataaatggatgcaagtcaaatttgaaataattagctcttctttaaattgatttgaagttgtcc

SEQ ID NO: 3477 - DNA, 162 bp, Homo sapiens
  D2S2304
  Located on chromosome 2
  Distance between a terminus base of telomere on chromosomal short arm and 5'-terminus of this base sequence : 135683003
  Distance between 3'-terminus of neighbour sequence of sequence listing upward to telomere on chrosomal short arm and 5'-terminus of this base sequence : 192753
gcatgtaaggtgatgcttctaaagaaggggagtgtgtgtgtgtgtgtgtgtgtgtgtgtgtgtgagagagagagagagagaggagagagagattgagagaaagctagagggaaagcgagagaaagagagagagagagaaatctggcacaatgttttacactg

SEQ ID NO: 3478 - DNA, 357 bp, Homo sapiens
  AC023468.5_18322
  Located on chromosome 2
  Distance between a terminus base of telomere on chromosomal short arm and 5'-terminus of this base sequence : 135739319
  Distance between 3'-terminus of neighbour sequence of sequence listing upward to telomere on chrosomal short arm and 5'-terminus of this base sequence : 56154
gacaattgaatcaacttggtagaaaattaatactcttctccctatcccacctcctatgcctatttcgatctccataaaattctgaatgtacgctcctctcctggaccagaaacattgcagctgatgtgagtttaaatcatgataggagggagacagagaaaaaaaagcaagcgtgtgtctttgtgtgttggggtgtgtgtgtgtgtgtgtgtgtgtgtgtgtgtgtatttaccaggagatacctgaagaatgcaataggcaagcaataaccatgacattcaatcagggatctagaagcttaccgactgtttgtactgatgtccagaattcagtgttaagacttgtctgaaacttgtc

SEQ ID NO: 3479 - DNA, 418 bp, Homo sapiens
  chr2.fa.O7frz.144963276
  Located on chromosome 2
  Distance between a terminus base of telomere on chromosomal short arm and 5'-terminus of this base sequence : 135867738
  Distance between 3'-terminus of neighbour sequence of sequence listing upward to telomere on chrosomal short arm and 5'-terminus of this base sequence : 128062
gtgaatagtactgcagtgaacatatgtgtgcatgtgtcttcacagcagaatgatttatattcttttgggtatatacccaataatgggatttctgggtcaaatgataactctgttttgagaaattgccaaactgctttctacaatggctgaactaatttacattctcatcagtagtgcgtaagtgttctcttttcctcacaacctcaccaacatctgttatttatttatttatttatttatttatttatttatttattcattttttgtgagggagtctcactctattgcccaggctggagtgcagtggtgcgatcttggctcactgcaacctccacctccctggttcaagtgattctcccatctcagcctcccgagtagctgggattacaggcacctgataccatgtctggctaacttt

SEQ ID NO: 3480 - DNA, 230 bp, Homo sapiens
  chr2.fa.O7frz.145047472
  Located on chromosome 2
  Distance between a terminus base of telomere on chromosomal short arm and 5'-terminus of this base sequence : 135962797
  Distance between 3'-terminus of neighbour sequence of sequence listing upward to telomere on chrosomal short arm and 5'-terminus of this base sequence : 94641
aagatttagtggaataggtttgtaaaccacctgaaaaaagtggcagtttcttatttctcacagagtgagattttcaataaatactggtatattggcaaagcgtataccggaggaaaataacacacatacacacacacacacacacacatacacaccccgggggagattggggagtgggggagattctttaaaaaaatgtgaaaaggggtcgtataaattgctaggaatca

SEQ ID NO: 3481 - DNA, 337 bp, Homo sapiens
  HUMUT1258
  Located on chromosome 2
  Distance between a terminus base of telomere on chromosomal short arm and 5'-terminus of this base sequence : 136055391
  Distance between 3'-terminus of neighbour sequence of sequence listing upward to telomere on chrosomal short arm and 5'-terminus of this base sequence : 92364
aaaggaaaggtagatagtgctttgcagaagaaaagaataacaaaatggataccattagaataaatttcacaagtttaaaactgcattaaaatccagtaatgaatgtatcaatttagagacagtcaagaataactgccctaaaataataagaaagctgaatcaattaattggaatgtctatctcactatctatctatgtgcctatctatctatcatctatctatctatctatctatctatctatctatctatctatctatctatctatctatctatcatctgtgtattagctcagaagaattccctttggaaattatcatgttatcccattcattcag

SEQ ID NO: 3482 - DNA, 431 bp, Homo sapiens
  chr2.fa.O7frz.145243755
  Located on chromosome 2
  Distance between a terminus base of telomere on chromosomal short arm and 5'-terminus of this base sequence : 136150751
  Distance between 3'-terminus of neighbour sequence of sequence listing upward to telomere on chrosomal short arm and 5'-terminus of this base sequence : 95023
gaatgccaggtcataatttattgttctttaactagcccttttgtgccccagagctctcagtgacacattagtgacatacttggggtcacagggattagtttgccatgctctgctttcctgggagagcagaaacctcactgaggatgcctgaaacatagagatagattgatgtagatagacagatagatagatagatagataagcagatagattggcagatagataatagatagatgatagataggtagatagataaatagatcagcaggtagattgggagatagatagatagatagatagatagatagatagatagataatagatagattggcaggtagttagacagatagataatgactctgtcatatgagtgagacttccagctcatagtgataatgacgctcaagagtaccgagttctgaattacctt

SEQ ID NO: 3483 - DNA, 447 bp, Homo sapiens
  AC013265.5_109655
  Located on chromosome 2
  Distance between a terminus base of telomere on chromosomal short arm and 5'-terminus of this base sequence : 136177072
  Distance between 3'-terminus of neighbour sequence of sequence listing upward to telomere on chrosomal short arm and 5'-terminus of this base sequence : 25890
attctttactcagaggtaaggaagtcataatacaaaaaggatatttgtgcatgcatgtttatagcagcacaatttgcaattgtaataatatggaagcagcccaaatgccggtcaatcaatgagtggataaataaattgtgacacacacacacacacacacacacacacacacacacaccccatggaataccactcagccctaaaaagaaatgaaataatggcatccacagcaacctggaatgaattagacaccgttattctaagtgaagtaattcaggaatggaaaaccaaacaatgtatgttctcactcataagtgggagctaagctatgaggttgcaaaagcataagaatgatactatggactttgggaactcaggagaaagagcgggggtgggtgatgagggataaaaaaactacacattgggtacagtgtacactgctcaggt

SEQ ID NO: 3484 - DNA, 208 bp, Homo sapiens
  D2S397
  Located on chromosome 2
  Distance between a terminus base of telomere on chromosomal short arm and 5'-terminus of this base sequence : 136246008
  Distance between 3'-terminus of neighbour sequence of sequence listing upward to telomere on chrosomal short arm and 5'-terminus of this base sequence : 68489
catgccaattcgtataacaatcacaaagcaaaaacaacacacacacacacacacacacacacacacacacacacacacacactgtatccagttatcaactttaaagcaaaaactatcctccccacgatatcttcactatcttctttctcttatagtttcaattcctagcagtagatgtactcataaaggaatcactgagaatagagtt

SEQ ID NO: 3485 - DNA, 340 bp, Homo sapiens
  chr2.fa.O7frz.145432769
  Located on chromosome 2
  Distance between a terminus base of telomere on chromosomal short arm and 5'-terminus of this base sequence : 136339921
  Distance between 3'-terminus of neighbour sequence of sequence listing upward to telomere on chrosomal short arm and 5'-terminus of this base sequence : 93705
ggaagtggtagaaaggaagtagattatacatatataagcatttttaatgcattttgatcaccagccttaaaatgtaattcatacataagatcactaatgtgttctattatttcttttctttctatttctttccttttcttctctgatttctattctattctattctattctattctattctattctattctattctttatattccagaccattttgctttattctactctatttcctgttctaaaaagatgataaaatgattaaacaactaaattggtgttttgattcaaaaatgtattacagccaaatgataaagattgatttgtacacttccagttat

SEQ ID NO: 3486 - DNA, 288 bp, Homo sapiens
  chr2.fa.O7frz.145508849
  Located on chromosome 2
  Distance between a terminus base of telomere on chromosomal short arm and 5'-terminus of this base sequence : 136415017
  Distance between 3'-terminus of neighbour sequence of sequence listing upward to telomere on chrosomal short arm and 5'-terminus of this base sequence : 74756
ttataggctgcataagtgaaacaaatctaatgctcttttaatatttgtactttttatctatataaatccataaattatctctgttatttaagtcatttgtagtaatttgttttttcatttgtacaaaaaacaatttcaacttgataccctggcattagtatgcacacatgcacacacacacacacacacacacacacacacacacacacaccagttgttgggttatataattctgatgttaccaagtattctatctttaggcatggctgcattataggaactcaactg

SEQ ID NO: 3487 - DNA, 241 bp, Homo sapiens
  chr2.fa.O7frz.145598657
  Located on chromosome 2
  Distance between a terminus base of telomere on chromosomal short arm and 5'-terminus of this base sequence : 136506127
  Distance between 3'-terminus of neighbour sequence of sequence listing upward to telomere on chrosomal short arm and 5'-terminus of this base sequence : 90822
cctggaagtcaccttagattagtaaaatcagaatctctcagagacctgggcattcacacacacacacacacacacacacacacacacacacacacacaaaatcatattttattttaatatgtagacaaggtttagggcaatttttctaagacattaacaagggaaagtaagctgagggagactaggagctgggccaaggaccatcacatattggtggagatccatctagtatctggtactg

SEQ ID NO: 3488 - DNA, 220 bp, Homo sapiens
  chr2.fa.O7frz.145719098
  Located on chromosome 2
  Distance between a terminus base of telomere on chromosomal short arm and 5'-terminus of this base sequence : 136626371
  Distance between 3'-terminus of neighbour sequence of sequence listing upward to telomere on chrosomal short arm and 5'-terminus of this base sequence : 120003
ttctatgccttcaatcatacatttttaagagacttttttaagggcagttttcagattctagaaacattgaggggaatgtgctgagagttcgcatacgctacctccccacctccacatacacacaggcacacacacacacacacacacacacacacactgcacatagtttcccatattattaacttcttgcattggtgtggtaagttcattaaaattgatg

SEQ ID NO: 3489 - DNA, 242 bp, Homo sapiens
  D2S150
  Located on chromosome 2
  Distance between a terminus base of telomere on chromosomal short arm and 5'-terminus of this base sequence : 136716483
  Distance between 3'-terminus of neighbour sequence of sequence listing upward to telomere on chrosomal short arm and 5'-terminus of this base sequence : 89892
ggaaaggctgcccattacagtcgtcattcagtcttgtaggatttgtgtaagaaggcaagttttgggggctcaaagatctaaagtctttactttttactttctctatgggttatctatgtgatggatatttttgctccaattctgccagggcccattagggtatgtgtatgtgtgtgtgtgtgtgtgtgtgtgtgtgtgtgtgtgtgtgtgtgtgtgtgtgtgtgtgtgttgcaggggtaggg

SEQ ID NO: 3490 - DNA, 289 bp, Homo sapiens
  HUMUT7418
  Located on chromosome 2
  Distance between a terminus base of telomere on chromosomal short arm and 5'-terminus of this base sequence : 136876475
  Distance between 3'-terminus of neighbour sequence of sequence listing upward to telomere on chrosomal short arm and 5'-terminus of this base sequence : 159750
caggagaatagcttgaaccaccgggaggcagaggttgcagtaagcagagatcacgccactgcattgcagcctgggcgacagagcgagattctgtctgaaaaaaatatctatctatctatcatctatctatcatctatctatctatctatctatctatctatctatctatctatctatctatcatctatctacctatctatctattttttgtacttttgtactatctatacccatagctatgatgagcactgcgtcttgctaaatattcatttgatttgacttctacccc

SEQ ID NO: 3491 - DNA, 235 bp, Homo sapiens
  HUMUT1418
  Located on chromosome 2
  Distance between a terminus base of telomere on chromosomal short arm and 5'-terminus of this base sequence : 136885637
  Distance between 3'-terminus of neighbour sequence of sequence listing upward to telomere on chrosomal short arm and 5'-terminus of this base sequence : 8873
ttactctgataccaaatgcagacaaagacacagaaaggaagaaaggaagaaagaaagaaagaaagaaggaaggaaggaaggaaggaaggaaggaaggaaagaaagaaagaaagaaagaaaaagaaagaaagaaagaaagaaagaaagaaacgaaagaaggaaggaaggaaggaaagtacaagccaatatcactgatgaacattgatgtaataatcctcaacaaaatactagcaaa

SEQ ID NO: 3492 - DNA, 202 bp, Homo sapiens
  DISD22_0001908
  Located on chromosome 2
  Distance between a terminus base of telomere on chromosomal short arm and 5'-terminus of this base sequence : 137009870
  Distance between 3'-terminus of neighbour sequence of sequence listing upward to telomere on chrosomal short arm and 5'-terminus of this base sequence : 123998
ggagaatggctactaggtgtgttttctttctccaagaaacaatgtatttagaaacaatatattgcttggctttatcctcaaagtaatcttgaggaaaagcatttagaaaacaagtccagagaagactacacacacacacacacatacacatgcacacacactcacacacacacacacaaatactctgagtagccagttccaa

SEQ ID NO: 3493 - DNA, 210 bp, Homo sapiens
  DISD22_0001915
  Located on chromosome 2
  Distance between a terminus base of telomere on chromosomal short arm and 5'-terminus of this base sequence : 137103965
  Distance between 3'-terminus of neighbour sequence of sequence listing upward to telomere on chrosomal short arm and 5'-terminus of this base sequence : 93893
acagagaagactgactgagatttctttctttctgcccacaactatctatctatctatctatctatctatctatctatctatcatctatctatctatcatcatctatctatctacatctttactcattttgaataggtactatattgttactttgatctgtttctgtgggaatatgtatgtacatatttgaagttgcaaatacctgtcatg

SEQ ID NO: 3494 - DNA, 418 bp, Homo sapiens
  AC023928.3_161321
  Located on chromosome 2
  Distance between a terminus base of telomere on chromosomal short arm and 5'-terminus of this base sequence : 137219439
  Distance between 3'-terminus of neighbour sequence of sequence listing upward to telomere on chrosomal short arm and 5'-terminus of this base sequence : 115264
ctagtcttgaactatgttagccaggctaatcttcaactactaacctcaagtgatccgcccacctcggcatcccaaagtgctgggattacaggcgtgagccaccatacccagccatttgaaactcaatcacctctttaaaggccctatctccaaatacagtcccattccaagatactgggtatcaggtcttcaacatatgaattcagggagagggaggcagaattcagcccataaaatgacaaaaaaaaaaattgtctatatatgtgtgtgtgtgtgtgtgtgtgtgtgtgtgtgtgtgtgtatataattttcccactgaaatttaatttatttagtttgagatgttaagtccaattcaatcaatatttactatatctatgtgccacacacagggatacctgagttgagattaatgaga

SEQ ID NO: 3495 - DNA, 405 bp, Homo sapiens
  AC023928.3_8657
  Located on chromosome 2
  Distance between a terminus base of telomere on chromosomal short arm and 5'-terminus of this base sequence : 137316243
  Distance between 3'-terminus of neighbour sequence of sequence listing upward to telomere on chrosomal short arm and 5'-terminus of this base sequence : 96386
gaaatgttgcagatgatcatactacaaggccaactgataccaccaagtatgaatatttatcaatgctacttggaaagcatatatatatatatatatatatatatatatatatatataacaaaaataagtagaaatacaaagatgggaaatttcttaagatattattaaataattacagatctacctgtatctacatgtagtctgtcaactcatttctatattttaagagcagagacagaagaatagttgtttcctatgtaaaagtaatcatttttctggaactcattttcccatgcctctgcagaaaccatcacatctttgctgaaacatgttattactttggtgtctctggtgcctcactcttcttttttgcagtgccttctgtggtcacttacctgagtctct

SEQ ID NO: 3496 - DNA, 254 bp, Homo sapiens
  D2S2286
  Located on chromosome 2
  Distance between a terminus base of telomere on chromosomal short arm and 5'-terminus of this base sequence : 137508218
  Distance between 3'-terminus of neighbour sequence of sequence listing upward to telomere on chrosomal short arm and 5'-terminus of this base sequence : 191570
atattcctttattgtgtctattgtgctcttaacacacacacacacacacacacacacatgcaataaagttccttaatattgaatattctatttcttctaataatctctaaggaaactcttctaatagtgaaatcaaccctctagataactaccttcaaatagaaaacatgattgcctaatttctattactctgagcttctcagtataccctcaagtctttaggaagattgtatcagttaagcttgaagcaagaa

SEQ ID NO: 3497 - DNA, 283 bp, Homo sapiens
  chr2.fa.O7frz.146845349
  Located on chromosome 2
  Distance between a terminus base of telomere on chromosomal short arm and 5'-terminus of this base sequence : 137719356
  Distance between 3'-terminus of neighbour sequence of sequence listing upward to telomere on chrosomal short arm and 5'-terminus of this base sequence : 210884
gacctaactgctaaattagacctcagtcccctaccctgacttttggggaggctgacatccaggtttctatgccccatgtgagatattaaaaggtttccctattgggggaaactgtctagaccaatgctccgaagaaagagataattggaggattgtgcctccacacacacacacacacacacacacacacacacacacacacacacaaaaggctcagtgcagctatttttaaagatgtttatcattacttaaggtctcctgcttgaactcagaatttctgatg

SEQ ID NO: 3498 - DNA, 276 bp, Homo sapiens
  chr2.fa.O7frz.146725761
  Located on chromosome 2
  Distance between a terminus base of telomere on chromosomal short arm and 5'-terminus of this base sequence : 137751912
  Distance between 3'-terminus of neighbour sequence of sequence listing upward to telomere on chrosomal short arm and 5'-terminus of this base sequence : 32273
aattcctgacctcgttatctatctgacttagattcccaaagtgctgggattataggcaaaattttttaatatgatccatttattatacacacacacacacacacacacacacacaccacacaaataaattgcctcccaaaatgttgggggagggcattaggagtctcggcttttgatgagatgattgtgaagaaaattttaataaccagtactgaaactcctctgtcttatgtagttcacttataagccaaagagtaagcgatccatacaaacata

SEQ ID NO: 3499 - DNA, 458 bp, Homo sapiens
  chr2.fa.O7frz.146923776
  Located on chromosome 2
  Distance between a terminus base of telomere on chromosomal short arm and 5'-terminus of this base sequence : 137818321
  Distance between 3'-terminus of neighbour sequence of sequence listing upward to telomere on chrosomal short arm and 5'-terminus of this base sequence : 66133
aaataacaatcacattcttgaaagattttttttttttaattccaattagagcagctaaggaaagaaacacaaaagaaaacagaaaaacccagggtggtagattcttgctgggtttatgagaaaatttaaccctgcacctggagtggtgatgaagaaaacacctttgggctgagtgaggacacagagaaaaatgacatggtagatgggtggtagagaagaagcatacaaaagaagagttagatttcactttctccatggttacagacaactcccttacagggtgggggaggagagtttggcggcaatgtgtaaaacgaagtaagagaattgtgcatctatctatctatctatctatctatctatctatctatctatctatctatctaatttatctaatttatctatttaagttatttaacaaacacttttaaagtgcttagtacttgccaggtatcttc

SEQ ID NO: 3500 - DNA, 292 bp, Homo sapiens
  D2S127
  Located on chromosome 2
  Distance between a terminus base of telomere on chromosomal short arm and 5'-terminus of this base sequence : 137887272
  Distance between 3'-terminus of neighbour sequence of sequence listing upward to telomere on chrosomal short arm and 5'-terminus of this base sequence : 68493
tctgatgtaatcagacttgcagtttatgtagatcactttgcgactatttaaacaataaatagaataaaatctccaagaaccttcacatttataagggttttatgtatatgcatctattttatctgcttggacacttaaagtttataccacagtcatatagactcacacacacacacacacacacacacacacacacacacacagttttacttcccacttctcattctacttccttactataaattaaaaatatctcaaacccatttctcaatatctgttaggtttgggtggg

SEQ ID NO: 3501 - DNA, 300 bp, Homo sapiens
  AC010740.6_130718
  Located on chromosome 2
  Distance between a terminus base of telomere on chromosomal short arm and 5'-terminus of this base sequence : 137887284
  Distance between 3'-terminus of neighbour sequence of sequence listing upward to telomere on chrosomal short arm and 5'-terminus of this base sequence : -280
agacttgcagtttatgtagatcactttgcgactatttaaacaataaatagaataaaatctccaagaaccttcacatttataagggttttatgtatatgcatctattttatctgcttggacacttaaagtttataccacagtcatatagactcacacacacacacacacacacacacacacacacacacacagttttacttcccacttctcattctacttccttactataaattaaaaatatctcaaacccatttctcaatatctgttaggtttgggtgggtgttgatgtttaggaatgct

SEQ ID NO: 3502 - DNA, 166 bp, Homo sapiens
  D2S2239
  Located on chromosome 2
  Distance between a terminus base of telomere on chromosomal short arm and 5'-terminus of this base sequence : 137890519
  Distance between 3'-terminus of neighbour sequence of sequence listing upward to telomere on chrosomal short arm and 5'-terminus of this base sequence : 2935
actcaatcctgggtgaaagagtgagacactctctctctctccctatacacacacacacacacacacacacacacacatatatatgtgtatatatatacacatatacacatatacatatacacatatatatgtatatatattctgatgccagaatgttccagagtat

SEQ ID NO: 3503 - DNA, 405 bp, Homo sapiens
  AC073319.1_80374
  Located on chromosome 2
  Distance between a terminus base of telomere on chromosomal short arm and 5'-terminus of this base sequence : 138044148
  Distance between 3'-terminus of neighbour sequence of sequence listing upward to telomere on chrosomal short arm and 5'-terminus of this base sequence : 153463
aattggatcagttagagttcctggaccttttaagttttggttacataacacaaggcccaatacaataagcatatatttaaaaggtaaaaataaaaacatttaactgaattgaactaatgaggatattttaaggaggttagtataatatttgtgtgtgtgtgtgtgtgtgtgtgtgtgtgtgtgtgtgtgtcagtcaagaacaaaagaaaagcaatacaaagaaaaagtctgcacaaataggtcatatgaggatcaccacattgctcagtggtcctgcaagggaaaccaacgatgaaccagcccatttgattcaatccatctcttcatgcacagacaccctcagaagccagccaatggaagttccttcagcacaaagcaggatggtatcaaacataccaatcacca

SEQ ID NO: 3504 - DNA, 174 bp, Homo sapiens
  D2S129
  Located on chromosome 2
  Distance between a terminus base of telomere on chromosomal short arm and 5'-terminus of this base sequence : 138097356
  Distance between 3'-terminus of neighbour sequence of sequence listing upward to telomere on chrosomal short arm and 5'-terminus of this base sequence : 52803
taaaaaagaccgactagaccaagtgttggcaaagatgtagggaaactgaaattcttatatattactggtagaaatgtaaaaaaagtacagccacattggaaaaatgtgtgtgtgtgtgtgtgtgtgtgtgtgtgtgtgtgtgtatcacataacctatcccttctactcacattt

SEQ ID NO: 3505 - DNA, 253 bp, Homo sapiens
  chr2.fa.O7frz.147364004
  Located on chromosome 2
  Distance between a terminus base of telomere on chromosomal short arm and 5'-terminus of this base sequence : 138253254
  Distance between 3'-terminus of neighbour sequence of sequence listing upward to telomere on chrosomal short arm and 5'-terminus of this base sequence : 155724
taccttgatctgttgaagtgaggcatgagattcagtaggacactggtaaattagcttttactttatctttataggaaagcaatttatagatgtctttttccctagtcatctcctgtcaagagggaaatgccaaacaactactccaactttactatgaggagagaaacacacacacacacacacacacacacacacacacacacacacacataacagtggggcatctagcctctaattcttgccaagcttaatt

SEQ ID NO: 3506 - DNA, 364 bp, Homo sapiens
  AC068943.1_64247
  Located on chromosome 2
  Distance between a terminus base of telomere on chromosomal short arm and 5'-terminus of this base sequence : 138285323
  Distance between 3'-terminus of neighbour sequence of sequence listing upward to telomere on chrosomal short arm and 5'-terminus of this base sequence : 31816
catttcaagacattagttggaccatgtttacaaatgtacatggtcaatgaatgttgaaagtatagtctgccttttcctcttttctatattgctggacagagcaatatagataaatttcttaggctgtagtttggaagcatgttaattaactaatttgtttccaatcatcttcttctctagatggagcgattgaaagacagatgggtaggtagatagataaagagtgagagagagagagagagagagagagacagaccgaccgacctagtatataggtgtgcacacatctatataatgtgataatttaaaaatgtttatttatattcaggttaatgcttaggataaggataccagaagtctgact

SEQ ID NO: 3507 - DNA, 472 bp, Homo sapiens
  AC068943.1_164617
  Located on chromosome 2
  Distance between a terminus base of telomere on chromosomal short arm and 5'-terminus of this base sequence : 138321724
  Distance between 3'-terminus of neighbour sequence of sequence listing upward to telomere on chrosomal short arm and 5'-terminus of this base sequence : 36037
ttcagtccttatcttgatacaaactcaagggcaagtactcttctgtatgttataatcagcattcctgtgaagatttcatacctcgatcaattacatttgaaaatatcctagaaaaatatcagtgtcatgggaagaggatttctctactcacttttgtaaagaactgggcaaggcatagcaaaggaaataatagaatgaagatataacctggaggaaataacacacacacacacacacacacacgcaaacacacacacagttgaatgattaaatcacatacacagtggaataattaaatcacgcacacacacgtagtggaatgatcagatcatgcacacacagtggaattattaaatcataacacacacacacacacatatatatatttgtgaaaacatctcattgtaccccataaatatgtacaattattatttgtcaattaatataaaggaactggagtaaggaatcagaa

SEQ ID NO: 3508 - DNA, 471 bp, Homo sapiens
  AC023086.2_20448
  Located on chromosome 2
  Distance between a terminus base of telomere on chromosomal short arm and 5'-terminus of this base sequence : 138450512
  Distance between 3'-terminus of neighbour sequence of sequence listing upward to telomere on chrosomal short arm and 5'-terminus of this base sequence : 128316
ttggaactgcactgtattagactaatatttttaggacaactaaaggacttcatgaagcaataaatggtataacttaggatcagtttcacaaactatttcaaccttttgtcctctatcatttagaaaactcagtagaagagataaggagaaaagccaaattcaagaactatttggggaccaaaaaatgacaattcagaaaaaaaagtactctttctcatttctattaacttcttaatctgaaatctcaaccataaagcaaaagataatgaattcatgttagaaaattgcttcattaaaaacatagtcctaggttatgagttcggcaatacagacacacacacacacacacacacacacacacacacacacaccccccacagtcatttgatgatatttctatatatatacacatatacgtatgtgcagaaatacatacgaaatttaataactccatgcattactattcctaaa

SEQ ID NO: 3509 - DNA, 461 bp, Homo sapiens
  AC023086.2_152121
  Located on chromosome 2
  Distance between a terminus base of telomere on chromosomal short arm and 5'-terminus of this base sequence : 138484791
  Distance between 3'-terminus of neighbour sequence of sequence listing upward to telomere on chrosomal short arm and 5'-terminus of this base sequence : 33808
taggctatttcaagataatggaagatctagcaggaagatcctgtttagggtattaaataggtctagtcatcataatttcaattatgaaggctataatttaaattatcactttaaatcagtttaaagaaagtcttctcttaagaaatttaccactcttcttcttcttcttcttcttcttcttcttcttcttcttcttcttcttcttcttcttcttcttcttcttcttcttcttcttcttctcctcctcctcctcctcctcctcctcctccttctcctccttctcctccttctcctccttctcctcctccttctttttttagaggaggtgtgtctcactatgttgtgcaatcaggtcttgaacgcctggcctcaagtgatcctcccaccttggcctcccaaactgttaggattataggtgtgagccgctgcatgcagagagaagtttaccgctcttataaaca

SEQ ID NO: 3510 - DNA, 353 bp, Homo sapiens
  AC023086.2_59149
  Located on chromosome 2
  Distance between a terminus base of telomere on chromosomal short arm and 5'-terminus of this base sequence : 138525850
  Distance between 3'-terminus of neighbour sequence of sequence listing upward to telomere on chrosomal short arm and 5'-terminus of this base sequence : 40598
ttgtaaactgataatccactcatctactatatttcctaagatatttccaagatatttttctatgctatttatcctaagataaattataagtatgttgccctttaattgaataagcctgtcatgaaggatccttgtaaaagaaaacccttattcaatgcaaaatactcatgttagtaggcaacaaatgtaaagaagtgcttgtgagtgtcctgaaataatcgtgtgtgtgtgtgtgtgtgtgtgtgtgtgtgtgtgtgtgtgtgtgtgatggggtggggctgaggaagaatggccactttatttggagaataggttttaagttagacaccctatttctgaaacattaggagttg

SEQ ID NO: 3511 - DNA, 263 bp, Homo sapiens
  D2S2334
  Located on chromosome 2
  Distance between a terminus base of telomere on chromosomal short arm and 5'-terminus of this base sequence : 138532096
  Distance between 3'-terminus of neighbour sequence of sequence listing upward to telomere on chrosomal short arm and 5'-terminus of this base sequence : 5893
gctaatatgtgtttgtgtccccactcccaggtgatacagttgtgcttatagcagaggtcaattagaaacatattttaattgaagttttcctcgggcagaaaattgtaagatcactgaagacaactgcagagtggtgtgtgtgtgtgtgtgtgtgtgtgtgtctgtgtgtctccatgtgtgtttatgtatgaggcagttgatatgaagcaatttgggcagacagacctaaatttagttctcaatttatgccacacaaatgtcga

SEQ ID NO: 3512 - DNA, 402 bp, Homo sapiens
  AC023086.2_130919
  Located on chromosome 2
  Distance between a terminus base of telomere on chromosomal short arm and 5'-terminus of this base sequence : 138575447
  Distance between 3'-terminus of neighbour sequence of sequence listing upward to telomere on chrosomal short arm and 5'-terminus of this base sequence : 43088
gctacgagagttatccagaaacatttgactggaccattgatttttcctgtcaataaaatttctcattgacagtagagatattctaaaacatttaattagttaattattattagagtggtggttattatgattgtaaaatgaccattttattatactgacagttgaaggtatccctaaggatttaaagaggaattaaaaaaagtgaatttggatttgaccgcataacatatagtcagaactatagtgaaacacacacacacacacacaccaagtaagcttttagagaaagacttactcccattcattcccaaagcacctcaaccctgcaaaaaagaaaagaaaagaaagaaaagaaaatgagctgttttaggattatacgtacagaatgagtgaaagacagtt

SEQ ID NO: 3513 - DNA, 123 bp, Homo sapiens
  D2S349
  Located on chromosome 2
  Distance between a terminus base of telomere on chromosomal short arm and 5'-terminus of this base sequence : 138575650
  Distance between 3'-terminus of neighbour sequence of sequence listing upward to telomere on chrosomal short arm and 5'-terminus of this base sequence : -199
gaatttggatttgaccgcataacatatagtcagaactatagtgaaacacacacacacacacacaccaagtaagcttttagagaaagacttactcccattcattcccaaagcacctcaaccctg

SEQ ID NO: 3514 - DNA, 365 bp, Homo sapiens
  AC012353.5_108939
  Located on chromosome 2
  Distance between a terminus base of telomere on chromosomal short arm and 5'-terminus of this base sequence : 138663090
  Distance between 3'-terminus of neighbour sequence of sequence listing upward to telomere on chrosomal short arm and 5'-terminus of this base sequence : 87317
tttggtgcataatttagagcacattagtacaactaatttacactaagctgattgttatgtgtctgtgttaatttattggtgatctttcctattttctatgtagaataataaatgtttgctgtaactgataaaactatgtaaataatgtattaagcaaaacttattaatttccctcacctgtccctctcccattgcccactgtcacatggcgtctctcaagttaaccttttattttttcacatatttctctctctacatataagacagatagacaggcagatagatacatagatagatagatagatagatagatagatagatagatagatagatagatcaatctatcacctgtacaggaatatggt

SEQ ID NO: 3515 - DNA, 233 bp, Homo sapiens
  AC012353.5_196319
  Located on chromosome 2
  Distance between a terminus base of telomere on chromosomal short arm and 5'-terminus of this base sequence : 138750712
  Distance between 3'-terminus of neighbour sequence of sequence listing upward to telomere on chrosomal short arm and 5'-terminus of this base sequence : 87257
aaggtttcaagtttcttaggctatttggaaaaaagaaagaaagaaagaaaaagaaagaaagaaagaaagaaagaaagaaagaaagaaagaaagaaagaaagaaggaaagaaagaaagaaagaatcatctagaacagcagtcatctgtgaaaacaactgacatttagtttcacatgtaaggtaaatccgaatggcatgagaacctttctactcacaggtatctaaagactcgtc

SEQ ID NO: 3516 - DNA, 476 bp, Homo sapiens
  AC012003.8_39262
  Located on chromosome 2
  Distance between a terminus base of telomere on chromosomal short arm and 5'-terminus of this base sequence : 138791083
  Distance between 3'-terminus of neighbour sequence of sequence listing upward to telomere on chrosomal short arm and 5'-terminus of this base sequence : 40138
ccacaactttcaacattatgagtttttaactaaaaatggtcattttatttttaattcatgatttctagataatatactctaggatctgtagcatatatatacattcctatatatatatatgtgtgtgtgtgtatatgtgtgtatgtatatatatatatatatagttctgccctagcataaactctgtgtgtgtgtgtgtgtgtgtgtgtgtgtgtgtgagcatgtacacaaaagtagtcctcaaaattctcattcctggcacaattcaataggtggaggaaaataggttaaccagcaaagcactaagaggcatccattgcatacctgtccctctggtccccaagcattcacccagactaataagaatttcctgaagcatgtacagttattcttatttgatgagtctggaatgctttatttttttcctccttaaaaatcaaaggaatcctacagatgctgacattaaacatactgat

SEQ ID NO: 3517 - DNA, 248 bp, Homo sapiens
  D2S2266
  Located on chromosome 2
  Distance between a terminus base of telomere on chromosomal short arm and 5'-terminus of this base sequence : 138791248
  Distance between 3'-terminus of neighbour sequence of sequence listing upward to telomere on chrosomal short arm and 5'-terminus of this base sequence : -311
tctgccctagcataaactctgtgtgtgtgtgtgtgtgtgtgtgtgtgtgtgtgagcatgtacacaaaagtagtcctcaaaattctcattcctggcacaattcaataggtggaggaaaataggttaaccagcaaagcactaagaggcatccattgcatacctgtccctctggtccccaagcattcacccagactaataagaatttcctgaagcatgtacagttattcttatttgatgagtctggaatgc

SEQ ID NO: 3518 - DNA, 459 bp, Homo sapiens
  chr2.fa.O7frz.147939329
  Located on chromosome 2
  Distance between a terminus base of telomere on chromosomal short arm and 5'-terminus of this base sequence : 138886381
  Distance between 3'-terminus of neighbour sequence of sequence listing upward to telomere on chrosomal short arm and 5'-terminus of this base sequence : 94885
agttgtacagaaatcaatgcacttcatctgtctcataaatctcagcaaatcagaggccttggcctagagttgagccatacaccatattttagaagtaaatacattcctaaacatattgtttcagtctgtttttctttattcccagccaattcgaatccttgctaagggagaatgcggtgataagaaaccagcaggatttatttatttatttatttatttatttatttatttttatctaattattgttaacaggcacagtaggcaagatcttcccactgcaacctggaagacaggggtggaggcagctcccactcaacgagagagcacgtaggggtacctatactagcccaccgttgtggctgagacttaaaactgccccacagcctagtattttcctacccaattctcttatcactctctgctttcactggtgctctgtctgcactatgatcacaaagt

SEQ ID NO: 3519 - DNA, 299 bp, Homo sapiens
  chr2.fa.O7frz.148018855
  Located on chromosome 2
  Distance between a terminus base of telomere on chromosomal short arm and 5'-terminus of this base sequence : 138968168
  Distance between 3'-terminus of neighbour sequence of sequence listing upward to telomere on chrosomal short arm and 5'-terminus of this base sequence : 81328
ctgtcaaacaggctaacattagctgaattttatcaagtatttatgtgccaggccctgttctaacttcctcacatacatttatccatttatttctcacaataatccactgagagaagtaatatcattaacatttgttacattaaaagattaaaacacacacacacacacacacacacagagataaagtaacgtgcccaagactacatagcttgaaagtgatgtccaagataaaaacttcagagttttcatcttagtagctatgtaatactctcctagtgactttgaaatagataccaaga

SEQ ID NO: 3520 - DNA, 460 bp, Homo sapiens
  chr2.fa.O7frz.148140162
  Located on chromosome 2
  Distance between a terminus base of telomere on chromosomal short arm and 5'-terminus of this base sequence : 139089587
  Distance between 3'-terminus of neighbour sequence of sequence listing upward to telomere on chrosomal short arm and 5'-terminus of this base sequence : 121120
tcttctatgattcagtgctcacagaagatcatagtgagacttgtactttattttctctttttactttaatttgctctctagcttattatttccacatctgtggggcttggacatttcccgtttctatatagcctaaatatagtctaagcatctcttttctctctcactctctctctctctctctctctctctctctgtgtgtgtgtgtgtgtgtgtgtgtgtatgaatctacagatatgtattcgtgtgtgtgtgtgtgtgtatatatatataaatctattcttataaacacatttaaacaccttttgggcagagattttttcctaaaccaattattttcacctctagcccacatttctcattacagggaatgtcatttatgctgtccccaagccagaaatctagaaccatcttagagttctccctattcttcactgcacatttagtggatcaaatgaac

SEQ ID NO: 3521 - DNA, 406 bp, Homo sapiens
  chr2.fa.O7frz.148249622
  Located on chromosome 2
  Distance between a terminus base of telomere on chromosomal short arm and 5'-terminus of this base sequence : 139198259
  Distance between 3'-terminus of neighbour sequence of sequence listing upward to telomere on chrosomal short arm and 5'-terminus of this base sequence : 108212
gtaggcctttagtgctacaaactttcctcttaacactgcttttgctgcatctcagggattttgatatgttttgtctctgttatgcatttcatatatgtgtgtgtgtgtgtgtgtgtgtgtgtatatatatatatatattctgccttgatttaattttttatttgaaagtcatttaagggcaagttttttgtttccaaataactgtgtggtttgagggatcttcttactattgatttctattttttattccactctgatccaagagtatgcttgatataatttcaatatttttgagtttgttaaggcttgttttgtggccaaaatgtggtttatcttagagtatgggtcatacgcagagaagaagaatgtatattctgtggttgttaggtggagtattctgtagatg

SEQ ID NO: 3522 - DNA, 349 bp, Homo sapiens
  AC016706.5_124292
  Located on chromosome 2
  Distance between a terminus base of telomere on chromosomal short arm and 5'-terminus of this base sequence : 139283046
  Distance between 3'-terminus of neighbour sequence of sequence listing upward to telomere on chrosomal short arm and 5'-terminus of this base sequence : 84381
caaagaatctgttatagactggatgtgtcttccccaaattcatatgttgaagtcttaaaacctagggcagctgtgtctggagacagacactttaaggataaatgaaatcataaaggtgtgaccccaatccaataggatcaatgtccttatataagacacaccaaagagcactctctctctctctctctctctctctctctctctctgccaggtgagaaagcacaagaaggcagctgcctgcaagaagccaggaagaggtcccccagcagaaaccgaatctgccatcaccttgatcattgacatcccagcttctagaatttaagaaaataaatttctaactttgaagcca

SEQ ID NO: 3523 - DNA, 324 bp, Homo sapiens
  AC016706.5_156591
  Located on chromosome 2
  Distance between a terminus base of telomere on chromosomal short arm and 5'-terminus of this base sequence : 139315330
  Distance between 3'-terminus of neighbour sequence of sequence listing upward to telomere on chrosomal short arm and 5'-terminus of this base sequence : 31935
tgaagtatgcatagaaagtctgtattccttttacaactttttatgagtcctaaaacatttcaaactaaaaaaaaattaaaggagataaggtggaaaatgtctctataggtactggtgctgcaaagattttgacaaaaaaatcaatacccattcctaatttttcaacatatagtaaagtagacatttgcacacacacacacacacacacacttttctcagtcctaaaatcaactaattcatttaacaaatgaaagaaaactttattaaatatatgctatctcagtgtgtaaagatgcccactaactccattagaatttagcattt

SEQ ID NO: 3524 - DNA, 270 bp, Homo sapiens
  D2S2149
  Located on chromosome 2
  Distance between a terminus base of telomere on chromosomal short arm and 5'-terminus of this base sequence : 139331793
  Distance between 3'-terminus of neighbour sequence of sequence listing upward to telomere on chrosomal short arm and 5'-terminus of this base sequence : 16139
atgagtctccacgcctggtcttggttaaaattttaagtgtgtgtgtgtgtgtgtgtgtgtgtgtgtgtgtgtgtgtgtgcgcgcgcgtgtgtgtgttttgtggaggggggagcatattcttaccagtaggcaggaatagaaaactgcagaagaagatcaaattgagatgaaggaaatgtaggatgtggggtttggtaacaattcaacagatattccttgtgcacctgttaaattcaggacagtatgctcattgctaggagaactttgtgc

SEQ ID NO: 3525 - DNA, 441 bp, Homo sapiens
  chr2.fa.O7frz.148458338
  Located on chromosome 2
  Distance between a terminus base of telomere on chromosomal short arm and 5'-terminus of this base sequence : 139397558
  Distance between 3'-terminus of neighbour sequence of sequence listing upward to telomere on chrosomal short arm and 5'-terminus of this base sequence : 65495
gcaaattgagtctatgaggatataataattttaaagacaatacttccatatgtcggatctttaacattataacacacctatcttaaaaaagagggacacgttggggtcttctcttcctcaagagatctgagagcatcagagctcacccatacatagagtgattaaatattgcccgttttcatcacccaggactcttgggacagcaatagaggctgtgacattcataggatttgtttgggaacaccagatctttgtagattaaaagtaaaaagctacactggcacttctgttttttttttttttttccttttccctgctaaattcttctttttatttacactcacgcgcgcacacacacacacacacacacacacacacacacatttactctgaagacccaatcagcctgggagaagagacttgcatatgaattctatcaag

SEQ ID NO: 3526 - DNA, 438 bp, Homo sapiens
  chr2.fa.O7frz.148547289
  Located on chromosome 2
  Distance between a terminus base of telomere on chromosomal short arm and 5'-terminus of this base sequence : 139496210
  Distance between 3'-terminus of neighbour sequence of sequence listing upward to telomere on chrosomal short arm and 5'-terminus of this base sequence : 98211
cataggataactgcagtggtagtgcagctaatgcagctcaaaaataaagggtggggggacagggaagaaaaggaccggaagtacacaatggtcactgatccgtagcatttctgaaatccaggcaagtttaagttgctgatttctatattagtgaccagtcctattttctggctgtcagccttagagttatctgtgcctgttacctcccactctgggctctttttctgtctcccgagttttgttgttgttgttgttgttgttgttgttttaatgtaggccctgtttgtagctgaaaagttatttcaaactgattctgacttagaaagagcaaaaggtccaaaccctttttttaaattttatattgtctgtgtgccttcaagtccaagtttctataaaaattataaaactttgtgtgtttcttgtatgctgaactatcat

SEQ ID NO: 3527 - DNA, 263 bp, Homo sapiens
  G09993
  Located on chromosome 2
  Distance between a terminus base of telomere on chromosomal short arm and 5'-terminus of this base sequence : 139671889
  Distance between 3'-terminus of neighbour sequence of sequence listing upward to telomere on chrosomal short arm and 5'-terminus of this base sequence : 175241
atccttctgaacctggaaccatttgagactatatatgtggcatatgcaaaaagccagcctttatcagttgaatacatagatgatagatagatagatagatagatagatagatagatagatagatgatagatagatagacaaatattgagatagatgaatgattgattagtctatattagcaaagcaccctttaaaaggtgatatggcttggatttgtgtccctgcccaaatctcatgttgaattgtaatccccaatgttggag

SEQ ID NO: 3528 - DNA, 376 bp, Homo sapiens
  chr2.fa.O7frz.148809478
  Located on chromosome 2
  Distance between a terminus base of telomere on chromosomal short arm and 5'-terminus of this base sequence : 139765833
  Distance between 3'-terminus of neighbour sequence of sequence listing upward to telomere on chrosomal short arm and 5'-terminus of this base sequence : 93681
ggatggtagcactgtttaaatatgttagttcttgccttctcccgcacagtataagtacctcaagagatacagagtaacttaggcacattgcaactttgtcttcttggctgtactatgtgtgtgtgtgtgtgtgtgtgtgtgtgtgagagagagagagagagagaagagagagtgtgtgtgtgtgtgcgcgcgtgtgtgtcagggtgaaggtctggggagtgggctgtgaagaaaaagaaaatattagatgtcattaatatgattatagctactcttcttacattaactcacttccttcctgcaacttttgttattattggttgaatctaaagaattttcagactaagctaagcttaagtcaatttgactaccattc

SEQ ID NO: 3529 - DNA, 420 bp, Homo sapiens
  chr2.fa.O7frz.148934102
  Located on chromosome 2
  Distance between a terminus base of telomere on chromosomal short arm and 5'-terminus of this base sequence : 139889989
  Distance between 3'-terminus of neighbour sequence of sequence listing upward to telomere on chrosomal short arm and 5'-terminus of this base sequence : 123780
cattacttgcttcacaggttacaacttgtcctagaggtttgctttgtgtaggccctcattgtattagcaaacatggtgtatttttaaaatgtagtcatatgccaacaataggaaatcatgagatttcatataaagactcctggtttcaaatatcttccaaaaaattagaagtttgacaacaatggaccttcattcctataggtggcaacactgggtagcagctctgtcccttagatggggcttaagctcttcgacacaacatccatgtttacccactgagcccaccattgaagccaagtcatcgctggtgaatatatctatatgaataccacaacattatgtgtgtgtgtgtgtgtgtgtgtgtattcatgcttatgatattcttacaatgaagtgtaaaataaagtatttcttgcaggc

SEQ ID NO: 3530 - DNA, 280 bp, Homo sapiens
  D2S1339
  Located on chromosome 2
  Distance between a terminus base of telomere on chromosomal short arm and 5'-terminus of this base sequence : 139991780
  Distance between 3'-terminus of neighbour sequence of sequence listing upward to telomere on chrosomal short arm and 5'-terminus of this base sequence : 101371
ggacatggacatctttgagggtcattagtcatcttaccacaggaaggaaggaaggaaggaaggaaggaaggaaggaaggaaggaaggaaggaaagggaggagaggagaggagaggtaggagggaagaagaaaaaaatagtatgaaaaaatcttgataaatttgaaaactgggtgaataatatgtggaattctctctatttttgttaatgttggaaaatttaataaaaacaatgaacagtgatgacttcggtgagaatttatgtcacctgcctcaaaattt

SEQ ID NO: 3531 - DNA, 326 bp, Homo sapiens
  AC018856.4_25061
  Located on chromosome 2
  Distance between a terminus base of telomere on chromosomal short arm and 5'-terminus of this base sequence : 140000107
  Distance between 3'-terminus of neighbour sequence of sequence listing upward to telomere on chrosomal short arm and 5'-terminus of this base sequence : 8047
gacatgtttatcttcacaagtttaggcacatcctagaaatgctgaataatatataatttatgaaaaaagtaaagctagtgtgtgtgtgtgtgtgtgtgtgtgtgtgtgtttgtatgtgatgactaaaggaaagaacaagttattcaaaggacaaagactaatccaatcattactgccaggcatataacacttaaagacatttctagtcaaaaaagtttaggtatgaagaaactacatgataatgaaaaatttatctacattttcctctgttcattcaactcatgttgtatttagttatttaaaagttatttgcagcttgtaaaaca

SEQ ID NO: 3532 - DNA, 318 bp, Homo sapiens
  AC018856.4_124991
  Located on chromosome 2
  Distance between a terminus base of telomere on chromosomal short arm and 5'-terminus of this base sequence : 140006510
  Distance between 3'-terminus of neighbour sequence of sequence listing upward to telomere on chrosomal short arm and 5'-terminus of this base sequence : 6077
gcatccataattaagtgatttcaggtcctatttattcagtgaggtcactgtagtgtaaaaatactctagtaactgtagtcccagctactcaggaggctgaggcaggagaatcacttgaacccagaaggcagaggttgcagtgagtcgagatagagccactgcacccctgcctggggaacagagggagactccatttcaaacaaacaaacaaacaaacaaacaaacaaacaaaccctagtaaaaacttgtaaattctcccagcattctctcaatccctcaaatttctccatctattggtgaccttcatatcgtcttcag

SEQ ID NO: 3533 - DNA, 442 bp, Homo sapiens
  AC018856.4_62224
  Located on chromosome 2
  Distance between a terminus base of telomere on chromosomal short arm and 5'-terminus of this base sequence : 140055771
  Distance between 3'-terminus of neighbour sequence of sequence listing upward to telomere on chrosomal short arm and 5'-terminus of this base sequence : 48943
tccattcctaagttacctcatttagaataatagtctccaatcccacccaggttgctgcaaatgctgtcgattcattccttttatagctgagtattccatcaaatatatatatatatatatatatatatatatatatatacacacacacacacgatatatatacattatatatatgaatattccatcatttgtgtgtgtatgtgtttgtgtgtgtgtgtgtgtgtatatatcacatatatcacactttctgtatccactcgttgattgatgggcatttgggttggttccacatttttgcaattgtgaattatactgctataaacatgagtgtacaagtatctttttcctacaatgacttcttttcttctgggtagatatccagtagtgggattgctggatcaaatggtagttccacttttagttctttaaggaatcttcacac

SEQ ID NO: 3534 - DNA, 442 bp, Homo sapiens; identical to SEQ ID NO: 3533
  AC013437.4_144020
  Located on chromosome 2
  Distance between a terminus base of telomere on chromosomal short arm and 5'-terminus of this base sequence : 140055771
  Distance between 3'-terminus of neighbour sequence of sequence listing upward to telomere on chrosomal short arm and 5'-terminus of this base sequence : -442

SEQ ID NO: 3535 - DNA, 361 bp, Homo sapiens
  AC013437.4_75090
  Located on chromosome 2
  Distance between a terminus base of telomere on chromosomal short arm and 5'-terminus of this base sequence : 140124513
  Distance between 3'-terminus of neighbour sequence of sequence listing upward to telomere on chrosomal short arm and 5'-terminus of this base sequence : 68300
tggagtaaatgattgcctaaattttaattttacttatattttatcataactatagctatttttccaaaaatatcaacaaaattgccaaatatctatcttttggccaaacactgaattattaaataatgtagtgcctccttttaaaaaatttcctcccattgttctccatctgcttgcttaacacatcttgaactaaaggctctattggcctaacacgcagtgcagaacatgtaacttcttgttgccatgttcctatgttcctgtgttcctgtgccttattattttgtcattattattattattattattattattattattattattatttgtctcccaagctagagtgcaatggtatgat

SEQ ID NO: 3536 - DNA, 468 bp, Homo sapiens
  chr2.fa.O7frz.149380828
  Located on chromosome 2
  Distance between a terminus base of telomere on chromosomal short arm and 5'-terminus of this base sequence : 140245716
  Distance between 3'-terminus of neighbour sequence of sequence listing upward to telomere on chrosomal short arm and 5'-terminus of this base sequence : 120842
tagtacatcggatacactccacaaatatgttttaagaatgaatactattcctctgtgatggtggaaccagtttggtggctaaggagggttagttgatacaaatacttgatatttatcaattagaaaaggggaggtggtaacaataaaatccctaggtatgtatcagggtttctcaacctaggcacgcttaatattttgtatcagataactctttgttgtgggggctgtcctgtgcattgtagaatattcagcagcatcactggcttctgccaactagatgttagtggaatctcaagttgtaacaaccaaaaatatctccaaacatttagaccccatttgagaaacacagacatatatgaacttgtgtgtgtgtgtgtgtgtgtgtgtgtgtatacacacatgatgatgatagataatagctttgttgcatattatttgcttttattgtactttgaatatgcgagatca

SEQ ID NO: 3537 - DNA, 94 bp, Homo sapiens
  D2S122
  Located on chromosome 2
  Distance between a terminus base of telomere on chromosomal short arm and 5'-terminus of this base sequence : 140350112
  Distance between 3'-terminus of neighbour sequence of sequence listing upward to telomere on chrosomal short arm and 5'-terminus of this base sequence : 103928
gagtgccctagatggaaggtaggtagttgtgtgtgtgtgtgtgtgtgtgtgtgtgtgtgtgtgtgtgcgcgctctctggcagaaagttaatctg

SEQ ID NO: 3538 - DNA, 434 bp, Homo sapiens
  AC068085.3_41015
  Located on chromosome 2
  Distance between a terminus base of telomere on chromosomal short arm and 5'-terminus of this base sequence : 140562869
  Distance between 3'-terminus of neighbour sequence of sequence listing upward to telomere on chrosomal short arm and 5'-terminus of this base sequence : 212663
attcgaacatgcttatttaatgtcctctggctttctgactggccaaatgcatgaacataaggaaccattcttcccatccctaatggtaatctcatgaaaacttttgaaacctatttattttatttatttatttatttatttatttatttatttatttattttttgagatggagttttcactcttgttgcccaggctggagtgcaatggcacgatctcggctcactgcaagctccgcctcctgggttcaagtgattctcctgcctcagccttctgagtagctggaattacaggcatgcgccaccacacccggctaaatttttgtatttttaatagagccggggtttcaccatgccggtcaggttggtctcaaactcctgacctcaggtgatctgcccatctcagcctcccaaagttgaaacctgttcgtttactg

SEQ ID NO: 3539 - DNA, 472 bp, Homo sapiens
  chr2.fa.O7frz.149663141
  Located on chromosome 2
  Distance between a terminus base of telomere on chromosomal short arm and 5'-terminus of this base sequence : 140652043
  Distance between 3'-terminus of neighbour sequence of sequence listing upward to telomere on chrosomal short arm and 5'-terminus of this base sequence : 88740
tttagaatctgtttcgacgtacaatttatttatcaactgggtactcagggagactctattttccagttcctcttgcatctacgtgtgaccacatgactgagttctggccaatggaatgtaggtggaaatatatacttgactttgagcttggtcataaaataaatacaccacttggcccccttctctgcctttctctctctctgtctctccacacacacacacacacacacacacacacacacacacacacttatgcatccagaagtgcagcactcagagatctcagagacaatagattaaaagagttcaaatccccaagtccctgcttagagggttgctatccagaagagtggcttgagctacatcagaccatgacatgaacaacaacaacaaaaaaactttactgtgttaagatttggaagtttttgttctaccagctagagagatcttgactaatgtgatgtccacgata

SEQ ID NO: 3540 - DNA, 384 bp, Homo sapiens
  AC010681.14_109963
  Located on chromosome 2
  Distance between a terminus base of telomere on chromosomal short arm and 5'-terminus of this base sequence : 140844359
  Distance between 3'-terminus of neighbour sequence of sequence listing upward to telomere on chrosomal short arm and 5'-terminus of this base sequence : 191844
aacattccagatacggcttgaatggactggggcaaacatgctagagcaaacaccaatgttcaatcctcccttgccttttcaattcctactaaaataatggtagggaatttatttaaaaggcataggcatacaaggataaaatgaaaaactgggaaggactgcaatggaaaagaatgtgaaccaaatttcagaagatggaaagcagatggatgagcggtggttgagcagagagggggaggcagaatgtgtccataagcatgcaggtgtgtgtgtgtgtgtgtgtgtgtgtgtgtgtgtgtgtgtgtgtgtgtatgtagttttagacaagaagaaggttgcgtgttccacagaaactcggaaaggctcaggaatttatcagtccag

SEQ ID NO: 3541 - DNA, 201 bp, Homo sapiens
  D2S132
  Located on chromosome 2
  Distance between a terminus base of telomere on chromosomal short arm and 5'-terminus of this base sequence : 140917924
  Distance between 3'-terminus of neighbour sequence of sequence listing upward to telomere on chrosomal short arm and 5'-terminus of this base sequence : 73181
caagatcctaattttagccactcataggtcatacaaattcttatcacaaacatattatatatcatagggctttatggtacttaaagaacactatctataaataaaagacaagttgaataaataaacttttggggtgtgtgtgtgtgtgtgtgtgtgtgtgtgtgtgtgtgtgtaggaaacactgagtatctggggaaaacc

SEQ ID NO: 3542 - DNA, 378 bp, Homo sapiens
  AC009957.8_169310
  Located on chromosome 2
  Distance between a terminus base of telomere on chromosomal short arm and 5'-terminus of this base sequence : 140961361
  Distance between 3'-terminus of neighbour sequence of sequence listing upward to telomere on chrosomal short arm and 5'-terminus of this base sequence : 43236
aaattagctggatgtggagatacccacctgcagtcccagctatcagtagggtaagatgggagagtcacttgagcccaggaggtcaaggatgaaatgggtcatgatcacatcattgcactccagcctgggcgacagagagagaccctgtcaaaagaggggaggggaggggagcggaggggagggaacagagaaaaggaaaaggaaaaggaaaaggaaaaggaaaaggaaaggaaaggaaaggaaaggaaaggaaaggaaaggaaaagaaaggaaaggagaaaggaggaaggagaaaggagaaaagagaaaagagaaaggaaaagagacgggaaaggaagatgtaattcttcagatgtttggatttcataagactgagac

SEQ ID NO: 3543 - DNA, 228 bp, Homo sapiens
  AC009957.8_117198
  Located on chromosome 2
  Distance between a terminus base of telomere on chromosomal short arm and 5'-terminus of this base sequence : 141013663
  Distance between 3'-terminus of neighbour sequence of sequence listing upward to telomere on chrosomal short arm and 5'-terminus of this base sequence : 51924
ttaatgacattatgctgagtccttttgcaatcggatggatggatggatggatggatggatggatggatggatggactgatggaaggatggatggatggatgggtgatggacattttagtgataggtaaggcatggatagggattgagaattataaaactttctgacacttcaaaaaaataattatatcttgtctctgtcgcacctagagaccaaagcatgatcaacta

SEQ ID NO: 3544 - DNA, 344 bp, Homo sapiens
  AC009957.7_163751
  Located on chromosome 2
  Distance between a terminus base of telomere on chromosomal short arm and 5'-terminus of this base sequence : 141056814
  Distance between 3'-terminus of neighbour sequence of sequence listing upward to telomere on chrosomal short arm and 5'-terminus of this base sequence : 42923
tcttaaatatttctcctatgcctctgtgtgtagttagaataaataaataggacaattcacattgtcctaaatcactaaaagatatattcttaccacagaaaaaataaagggtttcactgcaaataaaaattaaaccactgcagaaagtgtatttaaagtcactgaatagtggttaatatgcaataaacattattcactatacacagaatgaaagaggtgtgtgtgtgtgtgtgtgtgtgtgtgtgtgtgtgtgtgtgtgtgtgtgttatctttactcgctaatgttaacattatcagaccttggcacaggggattcaagacagtcatgaacttaactggatcaa

SEQ ID NO: 3545 - DNA, 435 bp, Homo sapiens
  chr2.fa.O7frz.150250002
  Located on chromosome 2
  Distance between a terminus base of telomere on chromosomal short arm and 5'-terminus of this base sequence : 141143019
  Distance between 3'-terminus of neighbour sequence of sequence listing upward to telomere on chrosomal short arm and 5'-terminus of this base sequence : 85861
tctaattcaattaaatggcactatgcactctaaaatgaacaacttttttatactcactcttatgagatggctctcaattttaatatagacaggtaaacttaaaataacttcaaactatcaatctatatttatgtattcattggcattattatattttgaaaatggtttgccttaaaaggaaaaacataaactgcaatctacagtgttctattcatcgtccctttccccttattgaaggcctccagaaaggccacaatggacttcttaaatagaatgggatatcaatgttaaaaaccacgtatttcttattaaatttaccttatctataaggtaaaaaggtgcctgctgctctatttaaataaacacacacacacacacacacacacacacacacacacacaaattgtggtccttcctaaagtgacttgtatttga

SEQ ID NO: 3546 - DNA, 475 bp, Homo sapiens
  AC009951.8_64289
  Located on chromosome 2
  Distance between a terminus base of telomere on chromosomal short arm and 5'-terminus of this base sequence : 141360830
  Distance between 3'-terminus of neighbour sequence of sequence listing upward to telomere on chrosomal short arm and 5'-terminus of this base sequence : 217376
tggtttgttacttgtcctaggtacacaaagataccaaactataaatagagttgttcaagagagtagtttggtagtgaaattggaaaactatttgggtttatttgggaataagagagtagggcagcagggatcctatagagactgaacgttaaaaaaataatgtgtcatttttgtgatatattaattaaattcttttaggtttaagtaagcataatgagactatctgaatgcgttacagtaattttctttctttctttctttctttctttctttctttctttctttcttctttctttctttctttctttctttctttctttctttctttctttcttttttttttttttttgagacagagactcactctgtcgcccaggctagggtgcagtggcatgatctcagctcactgcaacctctgcctcctagttcaagcaattctcctgcctcagcctcctgagtagctgacattacaggc

SEQ ID NO: 3547 - DNA, 347 bp, Homo sapiens
  AC010090.5_156028
  Located on chromosome 2
  Distance between a terminus base of telomere on chromosomal short arm and 5'-terminus of this base sequence : 141455829
  Distance between 3'-terminus of neighbour sequence of sequence listing upward to telomere on chrosomal short arm and 5'-terminus of this base sequence : 94524
ctaagaatatcaaatctgcttgagttgaagatgtgttgaggttgctgagatttggttcattgaacaactgggtgaagtaaatatagtttagatatgacttcacacttggaatttctttcagcagctcaatgggtgctgtgtgtgtgtgtgtgtgtgtgtgtgtgctacatgcctattttataactcaggtgttagttctttccttggacaccaggaaccagtggtctcactagaatggtattaactaaatttgagggaacaagtgagaatgatacagaaggtaaaaggaagctcagtgaagcaaatacattgagtcctgtttcctggataaatttagatcagtcaaa

SEQ ID NO: 3548 - DNA, 431 bp, Homo sapiens
  AC023128.2_20363
  Located on chromosome 2
  Distance between a terminus base of telomere on chromosomal short arm and 5'-terminus of this base sequence : 141564354
  Distance between 3'-terminus of neighbour sequence of sequence listing upward to telomere on chrosomal short arm and 5'-terminus of this base sequence : 108178
caattcctagacctaatccaactcacagatccagagtcccttattgagagtggggcagcagatcccttgaggaagtaacctgcaatgctgatataaggatatatggtgaatctgcctctgtattttctttactctgggaagtgggattgctatactacaacatgtggcatgtgcttaaatgtttccatgaatatgtggtgctgtctttctcatagccaaaatgtgtgcttccaggagccaaggagcagaagtggaaatggtttctctctctctctctctctctctctctctctctctcatacctaataaagtcatttgaaaaatttttgttcatgatccataaacttgagctgggtagctttggaggtcccaatccttatgaaataaatacttcttccaggcaccacagtcatggtttcgttaagttagaa

SEQ ID NO: 3549 - DNA, 366 bp, Homo sapiens
  AC023128.2_125727
  Located on chromosome 2
  Distance between a terminus base of telomere on chromosomal short arm and 5'-terminus of this base sequence : 141631554
  Distance between 3'-terminus of neighbour sequence of sequence listing upward to telomere on chrosomal short arm and 5'-terminus of this base sequence : 66769
agaatgaggtttaaggtctgttagggaagacacacgttaatcagataatcacacaataaatgtagactgacagatttaggtagtaataataatagcactagagccataaaactcaattgaatggttttaggtgtgtgtgtgtgtgtgtgtgtgtgtgtgtgtgtgtatgtgtgttctcatgtgatcatattaacttttatgaaggattctgtctgcggtgtaattggtattgccaacagtggatacgagcaaaccagtcaggaagtccagaaaagacagcaatgctattttatactaaacagtagtgacgatgagagaagtagacagatgacccaattactacttcagtaaaggatttagaggaat

SEQ ID NO: 3550 - DNA, 298 bp, Homo sapiens
  D2S381
  Located on chromosome 2
  Distance between a terminus base of telomere on chromosomal short arm and 5'-terminus of this base sequence : 141631663
  Distance between 3'-terminus of neighbour sequence of sequence listing upward to telomere on chrosomal short arm and 5'-terminus of this base sequence : -257
aactcaattgaatggttttaggtgtgtgtgtgtgtgtgtgtgtgtgtgtgtgtgtgtatgtgtgttctcatgtgatcatattaacttttatgaaggattctgtctgcggtgtaattggtattgccaacagtggatacgagcaaaccagtcaggaagtccagaaaagacagcaatgctattttatactaaacagtagtgacgatgagagaagtagacagatgacccaattactacttcagtaaaggatttagaggaatttaagcattaatatttatcaagtgcctataatgtgccaaat

SEQ ID NO: 3551 - DNA, 245 bp, Homo sapiens
  AC023128.2_166703
  Located on chromosome 2
  Distance between a terminus base of telomere on chromosomal short arm and 5'-terminus of this base sequence : 141672555
  Distance between 3'-terminus of neighbour sequence of sequence listing upward to telomere on chrosomal short arm and 5'-terminus of this base sequence : 40594
gatttcaaactcatctagtaggaagctgggcttctagcctcagcaataggcaggttcttttcctgccttgttttctttatgggcatctcgtgactaggacttcttcacacacacacacacacacacacacacacacaattgacagttcaagtcctgggagtcatcaaagtttaaactttgactggcccctgtgcgaataatggattcaaggaagagagataagtatccaagtgatctatcagaag

SEQ ID NO: 3552 - DNA, 412 bp, Homo sapiens
  AC012670.4_91770
  Located on chromosome 2
  Distance between a terminus base of telomere on chromosomal short arm and 5'-terminus of this base sequence : 141777479
  Distance between 3'-terminus of neighbour sequence of sequence listing upward to telomere on chrosomal short arm and 5'-terminus of this base sequence : 104679
gacctgtctcctagtccataatgtaccatcatgcacattcagagatagaatgacaagttgctataaaactggagatcaacaactatactatgggactgatagaccataccagctatacaagctagctctattccagagatactacatatacatatgttacatgtatatatcacacacacacacacacacacacacacacacacacacacacacacacagagcattcaattcagcaaggaaaagaaaaacagtaaaaatattgaccaggaccacttggcttccatagctggggagattttagacaccgagaagagggactgacagtaaaatatgttcacacttgtggaggatataggtattttatggctagtgtaattaattagtaactctgcatataatttaaccatagtgg

SEQ ID NO: 3553 - DNA, 233 bp, Homo sapiens
  D2S2313
  Located on chromosome 2
  Distance between a terminus base of telomere on chromosomal short arm and 5'-terminus of this base sequence : 141777552
  Distance between 3'-terminus of neighbour sequence of sequence listing upward to telomere on chrosomal short arm and 5'-terminus of this base sequence : -339
gatcaacaactatactatgggactgatagaccataccagctatacaagctagctctattccagagatactacatatacatatgttacatgtatatatcacacacacacacacacacacacacacacacacacacacacacacacagagcattcaattcagcaaggaaaagaaaaacagtaaaaatattgaccaggaccacttggcttccatagctggggagattttagacacc

SEQ ID NO: 3554 - DNA, 431 bp, Homo sapiens
  AC012670.4_179116
  Located on chromosome 2
  Distance between a terminus base of telomere on chromosomal short arm and 5'-terminus of this base sequence : 141849201
  Distance between 3'-terminus of neighbour sequence of sequence listing upward to telomere on chrosomal short arm and 5'-terminus of this base sequence : 71416
agttaatgacagtaaatcaacgacagctttcttattcaaccctacctttgcaaagctattgaaaaatttgaattaaaagccaattaatcctgtattaatgaggtctctttcaattgacggagataaaaagtcaactcaatctctcttttatattttcttatgtttccaggaattctgtcctgtggactcttttcttcccttgccacatctctcctccccttgctcgttttcctctctctctctctctcacacagacacacacacacacacacacacacacacacacacacacacacacatatttttaatctctctccctcccttttccaggacttactttcctgtatgatggattcattttaaacaagctgtctccacatgatggcaaatatcatgatggcaaatatgatgctgaatatctgtaatggata

SEQ ID NO: 3555 - DNA, 347 bp, Homo sapiens
  AC074093.3_173684
  Located on chromosome 2
  Distance between a terminus base of telomere on chromosomal short arm and 5'-terminus of this base sequence : 141905455
  Distance between 3'-terminus of neighbour sequence of sequence listing upward to telomere on chrosomal short arm and 5'-terminus of this base sequence : 55823
gttatctgatccatttatggtcagagcaagattgtttcttgctatatatttttggatttttaatttttgtcatcaactgaggatggttatatcacttcacaaatagctttctagatttccactgctttaatcattttgttttgctttgccttgctttattttgctttattttattttattttattttattttattttattttattttattttaagggggaggtcatgtacaaaatcaggcttataatctcacaaatacagcatcccttgtttgatatttggatctttcttctttcattttggcaagaaatactgtgggaataagtgtttctgccaagtatcagttat

SEQ ID NO: 3556 - DNA, 167 bp, Homo sapiens
  chr2.fa.O7frz.151227156
  Located on chromosome 2
  Distance between a terminus base of telomere on chromosomal short arm and 5'-terminus of this base sequence : 142101956
  Distance between 3'-terminus of neighbour sequence of sequence listing upward to telomere on chrosomal short arm and 5'-terminus of this base sequence : 196154
agataagctccaaagtattcctaccctatccttgtccctcttcttttgattcaaactcagggagagggagagggagagagggagggagggagagagggagagagagagagagagagagagaccaacctgttgttcttacttgagtcacattcctaccatttatgtag

SEQ ID NO: 3557 - DNA, 300 bp, Homo sapiens
  D2S372
  Located on chromosome 2
  Distance between a terminus base of telomere on chromosomal short arm and 5'-terminus of this base sequence : 142358445
  Distance between 3'-terminus of neighbour sequence of sequence listing upward to telomere on chrosomal short arm and 5'-terminus of this base sequence : 256322
gctgtgtaaggtatccagtatctattacagacatcatattttaatatatatatatgtgtgtgtgtgtgtgtgtgtgtgtgtgcatatatatatatatgttatttgtacagggacctcagatatcattctgagacagagagtgcattccaatgtagatagaaagacccttaaatagccacactggttgtcccagatctctcctcactttgcttgtgcttctttattaattaattcttttatttttttttataaagatgagatcttactacattgcctaggctggccttgaactcctgagct

SEQ ID NO: 3558 - DNA, 96 bp, Homo sapiens
  D2S302
  Located on chromosome 2
  Distance between a terminus base of telomere on chromosomal short arm and 5'-terminus of this base sequence : 142486575
  Distance between 3'-terminus of neighbour sequence of sequence listing upward to telomere on chrosomal short arm and 5'-terminus of this base sequence : 127830
aagagtgactgtcatttcgtggtgtgtgtgtgtgtgtgtgtgtgtgtgtaaatatatataatacattatatattccaaaccaaaaactaaggcaaa

SEQ ID NO: 3559 - DNA, 481 bp, Homo sapiens
  AC012448.7_124342
  Located on chromosome 2
  Distance between a terminus base of telomere on chromosomal short arm and 5'-terminus of this base sequence : 142586837
  Distance between 3'-terminus of neighbour sequence of sequence listing upward to telomere on chrosomal short arm and 5'-terminus of this base sequence : 100166
aagtgcattgataatgcagaatttggggaaatttttctctcaatattgaaataattgtataaacaggtgtcctacccgatagaaatataaataaatatctcagttacactagtttatacttatattgcatttatggtttagaaaaatctggtcattatacaaaagctatatatggaccatgtgccactctactaactcatttgaaaataacatgtagtaagctgtgagagttaaacaactctttattttgcctatactggcttaaaaattaatctcaaaaatgagatggaacccccacctctgacacattcatcattcttgttgttattgttgttgtttctcttgtagtcctcagggaatgcatgtgagcatgcacacacacacacacacacacacacacatgcacacacacacacgttccttatacacacaatatactttgcttagagggtcttattctttctctttgccaacatacagc

SEQ ID NO: 3560 - DNA, 207 bp, Homo sapiens
  D2S2362
  Located on chromosome 2
  Distance between a terminus base of telomere on chromosomal short arm and 5'-terminus of this base sequence : 142587111
  Distance between 3'-terminus of neighbour sequence of sequence listing upward to telomere on chrosomal short arm and 5'-terminus of this base sequence : -207
tcaaaaatgagatggaacccccacctctgacacattcatcattcttgttgttattgttgttgtttctcttgtagtcctcagggaatgcatgtgagcatgcacacacacacacacacacacacacacatgcacacacacacacgttccttatacacacaatatactttgcttagagggtcttattctttctctttgccaacatacagc

SEQ ID NO: 3561 - DNA, 315 bp, Homo sapiens
  chr2.fa.O7frz.152035393
  Located on chromosome 2
  Distance between a terminus base of telomere on chromosomal short arm and 5'-terminus of this base sequence : 142891115
  Distance between 3'-terminus of neighbour sequence of sequence listing upward to telomere on chrosomal short arm and 5'-terminus of this base sequence : 303797
aatgcaatgttcgtatatttctacagataaatatttgatctacacacaactggtcaatcaatatatgacaagacatgtaatacaatcttgtttgaggtttattagaacacacacacacacacacacacacaaatatcctgaaaattattcttgaaatacatctgtgaattgatacagtatatttccatatgcttatataactttctattagaaaggtattttttaaggagatgcaggtgtcaaatgttagaattctgtgtgggagcattatgaaataaacatgatgatgtggcatgagacgttctttaagcctat

SEQ ID NO: 3562 - DNA, 121 bp, Homo sapiens
  D2S2301
  Located on chromosome 2
  Distance between a terminus base of telomere on chromosomal short arm and 5'-terminus of this base sequence : 143064089
  Distance between 3'-terminus of neighbour sequence of sequence listing upward to telomere on chrosomal short arm and 5'-terminus of this base sequence : 172659
aaccctatgtaccatgagagtgagtatacacacacacacacacacacacacacacacacacacacatctgttacatctgtgctgcctttgttcctttgacccaaggcaacactgatttcat

SEQ ID NO: 3563 - DNA, 428 bp, Homo sapiens
  chr2.fa.O7frz.152317573
  Located on chromosome 2
  Distance between a terminus base of telomere on chromosomal short arm and 5'-terminus of this base sequence : 143154349
  Distance between 3'-terminus of neighbour sequence of sequence listing upward to telomere on chrosomal short arm and 5'-terminus of this base sequence : 90139
ctattcaaggatcaacgtgacaggaatcatacatttttactgtatctgcaaatgaaaggtaacaaatccccgtaatttcaaaacaaaataaaatcctcaaaaccaaacagcattactattttctccacacacagtaaaccatgtgtttaaaatttaggttcatatatatgtatgtgtgtgtatatatgtgtgtgtgtgtgtgtgtgtgtgcatgtgtatacatatattttttgattattatttttaatttctttttttttgagatagaggtcacactatattgcccaggctggttgcataggtcagtattttttattcaagaacaaaataagtctaatttttaaatagcattatcaactaatttctgtggacaatttccaatagtgtctctgatcaccataagccttagactatcatgaaagcaattc

SEQ ID NO: 3564 - DNA, 248 bp, Homo sapiens
  DISD22_0001926
  Located on chromosome 2
  Distance between a terminus base of telomere on chromosomal short arm and 5'-terminus of this base sequence : 143509120
  Distance between 3'-terminus of neighbour sequence of sequence listing upward to telomere on chrosomal short arm and 5'-terminus of this base sequence : 354343
tcctgatagtttagctaaccaatcattttcagattctaatatctttgggtaagaagtattcaaaataaataaatgagagagataagtagatcattagataaacagcagtgatatagatttttttctctctccacacacacacgcacacacacaaacacacacacacacaactgtaaagtgttaagcatgattttttaagccttcacgataaaatatatttatttgccaagctaatttagaggaacagt

SEQ ID NO: 3565 - DNA, 104 bp, Homo sapiens
  DISD22_0001929
  Located on chromosome 2
  Distance between a terminus base of telomere on chromosomal short arm and 5'-terminus of this base sequence : 143606215
  Distance between 3'-terminus of neighbour sequence of sequence listing upward to telomere on chrosomal short arm and 5'-terminus of this base sequence : 96847
caggaactctcacccgagccccacccactagccacaaaacaaaacaaaacaaaacaaaacaaaacaaaaaacacagtttattctcattcctctccctctcaagt

SEQ ID NO: 3566 - DNA, 175 bp, Homo sapiens
  DISD22_0001932
  Located on chromosome 2
  Distance between a terminus base of telomere on chromosomal short arm and 5'-terminus of this base sequence : 143724408
  Distance between 3'-terminus of neighbour sequence of sequence listing upward to telomere on chrosomal short arm and 5'-terminus of this base sequence : 118089
accatggagtgtggtgtgtatatgggtggggggtggtaggtaggttaatgtttctctctgtctctctctctgtctctctctctctctctctctctgtctctctctctctctatatatatatatacataaaatagttaaaacaatatattaaagaagacaatgattgattcaagag

SEQ ID NO: 3567 - DNA, 212 bp, Homo sapiens
  D2S2270
  Located on chromosome 2
  Distance between a terminus base of telomere on chromosomal short arm and 5'-terminus of this base sequence : 143812963
  Distance between 3'-terminus of neighbour sequence of sequence listing upward to telomere on chrosomal short arm and 5'-terminus of this base sequence : 88380
aagtaggaggctcgcttgagcccaaaagttggagaccagcctgggcaaaatagtgagaccccatctcaaaaaaaaaaaagaaatttaaagaaatagaaagttagggttgttggttttttacacacacacacacacacacacacacacacacacacttcaagacacatgaatttttatatattcatatattcatactttgccttattcctaaa

SEQ ID NO: 3568 - DNA, 227 bp, Homo sapiens
  D2S151
  Located on chromosome 2
  Distance between a terminus base of telomere on chromosomal short arm and 5'-terminus of this base sequence : 143853055
  Distance between 3'-terminus of neighbour sequence of sequence listing upward to telomere on chrosomal short arm and 5'-terminus of this base sequence : 39880
aactaagacacacaaccccgccaggcttttcctgcttctacctgtattgctcatttccactttcaaaataccccactagtctcttccaccttccttccttgtcatttcactgccataaattacatcacacattaaccaggttaaagtgcatgcatgtaaacacacacacacacacacacacacacacacacacacacacacacacatcatagatgccactgaattgg

SEQ ID NO: 3569 - DNA, 229 bp, Homo sapiens
  AC062032.2_171875
  Located on chromosome 2
  Distance between a terminus base of telomere on chromosomal short arm and 5'-terminus of this base sequence : 143853089
  Distance between 3'-terminus of neighbour sequence of sequence listing upward to telomere on chrosomal short arm and 5'-terminus of this base sequence : -193
cttctacctgtattgctcatttccactttcaaaataccccactagtctcttccaccttccttccttgtcatttcactgccataaattacatcacacattaaccaggttaaagtgcatgcatgtaaacacacacacacacacacacacacacacacacacacacacacacacatcatagatgccactgaattggggctgaagagaagaaactttggaacttcaaataagt

SEQ ID NO: 3570 - DNA, 449 bp, Homo sapiens
  chr2.fa.O7frz.152675816
  Located on chromosome 2
  Distance between a terminus base of telomere on chromosomal short arm and 5'-terminus of this base sequence : 143929332
  Distance between 3'-terminus of neighbour sequence of sequence listing upward to telomere on chrosomal short arm and 5'-terminus of this base sequence : 76014
ttaagttggagctgtctattagacatccaaatggagattttgtattaagcagttgtataaattcagtctgcagctcatgagaaagctctggagtgaagagctaattggggagtcaccaaagagagatgatattgaaagacacttggattaatgagattactaaggctacagttaaaggaaatgaaccttgaatagaactgatgcatatgctggtagagaggcttccacctgagaatattagttgaaagggttaggtaagcccagtgctgctgatggccttactgtctgcacttagagacaaactacctacaaataaaaccaccatagagggcaagaagggggagagagagagagagagagagagacagagagagagagagagagagagagagagagagagagacagaggcggagccctggagacattacctgtgatcctagatctagct

SEQ ID NO: 3571 - DNA, 335 bp, Homo sapiens
  chr2.fa.O7frz.152881981
  Located on chromosome 2
  Distance between a terminus base of telomere on chromosomal short arm and 5'-terminus of this base sequence : 144129314
  Distance between 3'-terminus of neighbour sequence of sequence listing upward to telomere on chrosomal short arm and 5'-terminus of this base sequence : 199533
tttaaatgcagaagtattccagaggccaaaaggatgtaaatggaattttcacagccaaagcttcatgggaaagcttttaaattttccattaaaaatctgagtaattattagggataaattttaacaacctgcaagtaaatttgcaacaagtccccgggtaattctgagcctctctttatcttttcttttcagctctcagaatcctaaatagattcaaccctttttccaaatggactgtcatttacacacacacacacacacacacacacacagtgttgtgctcaagctaatatgtgcttacagagagctgattgttattccggaaattgtaaact

SEQ ID NO: 3572 - DNA, 101 bp, Homo sapiens
  Z66888
  Located on chromosome 2
  Distance between a terminus base of telomere on chromosomal short arm and 5'-terminus of this base sequence : 144245584
  Distance between 3'-terminus of neighbour sequence of sequence listing upward to telomere on chrosomal short arm and 5'-terminus of this base sequence : 115935
cagaacagaaggcacaagatgtgtgtgcatgtgtgtgtgtgtgtgtgtgtgcatctgtatgtgtttgtgtgatgtgtgtgattgccaactttttgccttcc

SEQ ID NO: 3573 - DNA, 419 bp, Homo sapiens
  AC012666.3_88667
  Located on chromosome 2
  Distance between a terminus base of telomere on chromosomal short arm and 5'-terminus of this base sequence : 144264314
  Distance between 3'-terminus of neighbour sequence of sequence listing upward to telomere on chrosomal short arm and 5'-terminus of this base sequence : 18629
tcttccactactgataggctacaggattatatctgggaacaaaattccctacagtacagtttgtgggaataaaagaataaaaacatgccatggaaagacattataaaaaccttccctagagactttttgtgttttttttcttatcaaacctatgaatataaaatggagatacacacacacacacacccacccacacatacatatatacatatatctatgcgtatgtatacatatacatacatagagataggtgggaatagatgatgatatagatagatagatagatagatagatagatagatagatagatagatagatagatagatatgctgcatacatgtaaaatggaaggggcaatacttaaacacagccctgcagcagggatagacaaactgttctccagtcctgttagtttgtga

SEQ ID NO: 3574 - DNA, 152 bp, Homo sapiens
  D2S1399
  Located on chromosome 2
  Distance between a terminus base of telomere on chromosomal short arm and 5'-terminus of this base sequence : 144276646
  Distance between 3'-terminus of neighbour sequence of sequence listing upward to telomere on chrosomal short arm and 5'-terminus of this base sequence : 11913
cattggtccaggtaaactgccagttaaacctttagaggaaggaaggaaggaaggaaggaaggaaggaaggaaggaaggaaggaaggaaggaaggaaggaaaggcagaattagcaggattccaaaagcaactgaccttgtggaaccttgtgaa

SEQ ID NO: 3575 - DNA, 365 bp, Homo sapiens
  AC012666.3_171548
  Located on chromosome 2
  Distance between a terminus base of telomere on chromosomal short arm and 5'-terminus of this base sequence : 144328190
  Distance between 3'-terminus of neighbour sequence of sequence listing upward to telomere on chrosomal short arm and 5'-terminus of this base sequence : 51392
tatgtgtaaacgtaaagccaagcttcatgcacaaataactaacactcagtataaagtggcaattaaaaagaaaaatattctctctctctctctctctctctctctctctctctctgaggctgaaaaactgcattttcaaaaagaaagcaattttctctccaaagaggtagagaacagaattcacctttggggtaaactattcctttttgatttgacatcattgcttcaagtgggcttctttagtgacacaaatggaaaggaagttcccacccattattgttcttggggaagactgtgaagtaaactgagtgcaggtgttttctactgagaaaataagtgttctgtttggtaatgtaaaccaacag

SEQ ID NO: 3576 - DNA, 357 bp, Homo sapiens
  AC012666.3_11059
  Located on chromosome 2
  Distance between a terminus base of telomere on chromosomal short arm and 5'-terminus of this base sequence : 144347911
  Distance between 3'-terminus of neighbour sequence of sequence listing upward to telomere on chrosomal short arm and 5'-terminus of this base sequence : 19356
tcaaccatagtacaggaacgaccatccccaaaacccacacagtgaaagttgacataatttctcatgcccaaggatgaagatctcattcttttagtttgatcctctgggataagctatacagacattaagacacagctagaaggcaagaaggcaggcaggcaggcaggcaggcaggcaggcaggcaggcaggcagtaaggaagcaaggaaggaaggaaggaaaggaggaagtggggaggggagaaaaaacattgaagacataaaaatttcatttctttgtttttttctttttttggaaacaaggtcttgctctgtcaccaagcctgaaatgcagtagtgtaatcaaggctcatttcag

SEQ ID NO: 3577 - DNA, 440 bp, Homo sapiens
  AC012666.3_12842
  Located on chromosome 2
  Distance between a terminus base of telomere on chromosomal short arm and 5'-terminus of this base sequence : 144349622
  Distance between 3'-terminus of neighbour sequence of sequence listing upward to telomere on chrosomal short arm and 5'-terminus of this base sequence : 1354
gtctttgaggattcaactcaggcgtcctcccactcaggaagcttttctagaaaaacccagactgacttggatgcctcttctaaggctcccaaagcattctgccgctgaaattgtcagcttttaaaaatatatatctcaccaattacaccagctgctcgagggcaggaactgtaccttaatctctgttgtacctctaatatccatcctagggtctggaacagtgtgtgtgtgtgtgtgtgtgtgtgtgtgtgtctgtgtgtgtgtgtgtctgtgtgtatgtgtgtatgtagccacaaacatatatagaatagagaaagacaaagaaaacaaaaagcacctggctccggaatctttgcctctcagaggtagctggcaagcagacaggaaatggccaatgttgactgagttctctctctctctctaaagactggaaataagcc

SEQ ID NO: 3578 - DNA, 325 bp, Homo sapiens
  AC012666.3_7917
  Located on chromosome 2
  Distance between a terminus base of telomere on chromosomal short arm and 5'-terminus of this base sequence : 144364796
  Distance between 3'-terminus of neighbour sequence of sequence listing upward to telomere on chrosomal short arm and 5'-terminus of this base sequence : 14734
tcagcctggagtttgagaccagcctggccaatatggtgaaaccctgtctctactacaaatacaaaaattagccgagtgtggtggcactcgcctgtaatcccagctactcaagaggctgaggcaggagaatcgctggaacccaggaggtggagggttgcagtgagctgagattgcaccactgcactcctgcctgagcaacacagtgagactccatcccaaaacaaacaaacaaacaaacaaacaaaaaaaacccattgggtgagacctgtaagaatgataggataacactttcatgattaggctactagtcagttggctttgagtt

SEQ ID NO: 3579 - DNA, 165 bp, Homo sapiens
  G08173
  Located on chromosome 2
  Distance between a terminus base of telomere on chromosomal short arm and 5'-terminus of this base sequence : 144550750
  Distance between 3'-terminus of neighbour sequence of sequence listing upward to telomere on chrosomal short arm and 5'-terminus of this base sequence : 185629
tggaagcaaggcaattttagatcattttaatgcagttattccagctgaataattccccagatatataaaaaattttagatagatgatagatagatagatagatagatagatagatagagacatagatatagatatagaagacagataccatgtacagacatatgg

SEQ ID NO: 3580 - DNA, 476 bp, Homo sapiens
  AC009480.3_56742
  Located on chromosome 2
  Distance between a terminus base of telomere on chromosomal short arm and 5'-terminus of this base sequence : 144614969
  Distance between 3'-terminus of neighbour sequence of sequence listing upward to telomere on chrosomal short arm and 5'-terminus of this base sequence : 64054
ctctgatgcttaaattctttacataaaatggtatagtattttcatgtaacctacgtatatcctcccatatgcttatagattacctataatacataccacaatgtaaatgctacataagtattataatagttgctatactgtatttttgttattttttgttttattatttttattctttttcaaaaatattttgatcctcagttaattgcagaaactgccaatactaagggccgattctgtgtgtgtgtgtgtgtgtgtgtgtgtgtgtgtgttcattagcaaatcaagcttcacatatttttatttaatttttgaataaaagtaatttaaggatctttgttatataacatcaaaataaaagacagagttaatctcttctttctttctttctaaaatagtcctacccattaataggtattttaaagcacactgaagggtaaattgttacttataaaacaaaggcatactgattacct

SEQ ID NO: 3581 - DNA, 260 bp, Homo sapiens
  AC009480.3_143360
  Located on chromosome 2
  Distance between a terminus base of telomere on chromosomal short arm and 5'-terminus of this base sequence : 144716757
  Distance between 3'-terminus of neighbour sequence of sequence listing upward to telomere on chrosomal short arm and 5'-terminus of this base sequence : 101312
tacaggtgagacagattaccagaggagtttgcagtatgtcagttcatgctattttttcttccgtagttgagaggaagtccatggcaccattagtatagtgtgtgtgtgtgtgtgtgtgtgtgtgtatacacacatacatgtactctttatatatagtagcatgtatatatatagtgtatgtatgtgtatatttatatatattctcaaaataaacttttcagctccccattcccaggacctacataatggcactcagacat

SEQ ID NO: 3582 - DNA, 387 bp, Homo sapiens
  AC019226.2_98145
  Located on chromosome 2
  Distance between a terminus base of telomere on chromosomal short arm and 5'-terminus of this base sequence : 144813100
  Distance between 3'-terminus of neighbour sequence of sequence listing upward to telomere on chrosomal short arm and 5'-terminus of this base sequence : 96083
tcatacctagcaaagatgtcactcacatataaaggtaacaggtatagccttatcaaataagaatgaacttatttagtacacagagccaataaagccttgtgtggagtgtgtgtgttgcaggaggatatggggaactcaatgacaaaatccagccaactaaagcataattaaaaacacaattttatacagacacacacacacatacacacacacacacacacacacactagtgacctttgaatccactaaaataaaaaactaaaaccaaaaaaaggtaaataattatagtagcaggtggaaacataagtcgttacacagtgaaaataatcattcaacaaaaaaatgaaaaaaaagtggcatgaatgcatacggttgctaatttcattc

SEQ ID NO: 3583 - DNA, 414 bp, Homo sapiens
  chr2.fa.O7frz.153608562
  Located on chromosome 2
  Distance between a terminus base of telomere on chromosomal short arm and 5'-terminus of this base sequence : 144853160
  Distance between 3'-terminus of neighbour sequence of sequence listing upward to telomere on chrosomal short arm and 5'-terminus of this base sequence : 39673
gaatagctcaagcctgtaattccaacaactgggaggtgaggtaggaggatttatcacttgaggctagtagttcagggtcagcctgtgcaatgtagtgagatctgatccctacaaaatcaaaatagtagctgagcttggtgtggtgcacactgtagtcccagctactcaggaggctggagaggatctcttgaactcaggttgaggctgcagtgagccatgatcatgccactggactctgtgctgagcaacagagtgagaccctgtctctaaataaataaataaacaaataaaaaaacagtaaaaaaaagttcagttcaatccttatctgtattaaacttcctttaacttgtgtggagttacatttaatattttcttatatgaagttcaaaggttataacaatttctgatccaatg

SEQ ID NO: 3584 - DNA, 177 bp, Homo sapiens
  D2S2335
  Located on chromosome 2
  Distance between a terminus base of telomere on chromosomal short arm and 5'-terminus of this base sequence : 144929149
  Distance between 3'-terminus of neighbour sequence of sequence listing upward to telomere on chrosomal short arm and 5'-terminus of this base sequence : 75575
gaggagtcagaattaaattgcttattttacacacacacacacacacacagagagagagagagatcacacacacacacacacacacacacacacagagagagagagagagagagagagagagagaggaagagagagagagagagagatccaaatcgtttgtatagggcatttgtagga

SEQ ID NO: 3585 - DNA, 376 bp, Homo sapiens
  AC019070.4_31550
  Located on chromosome 2
  Distance between a terminus base of telomere on chromosomal short arm and 5'-terminus of this base sequence : 145090685
  Distance between 3'-terminus of neighbour sequence of sequence listing upward to telomere on chrosomal short arm and 5'-terminus of this base sequence : 161359
aaatagtttacaggctcagtaggatggctcatacctgtaatcccatcactttgggaggcctgtgtgctacaatcgcttaagtccaggagtttgagaccagcctgagcagcatcgtgagacctcgtcgaagaagaagaagaagaagaagaggaagaggaagaggaaataataataatttacagatgaagaaattaagactgagagaggttaggtctgttgtctaaggtcacacacaactagcaattatagtagctggtattcaaacctgatcagtctggcttcaaagtgcattctctttctagtatgcttttgaactgcctagaaaaataatggcaatttctgaaatgcaacagtatgattcacgatagttgctagg

SEQ ID NO: 3586 - DNA, 324 bp, Homo sapiens
  AC027262.2_69280
  Located on chromosome 2
  Distance between a terminus base of telomere on chromosomal short arm and 5'-terminus of this base sequence : 145167217
  Distance between 3'-terminus of neighbour sequence of sequence listing upward to telomere on chrosomal short arm and 5'-terminus of this base sequence : 76156
tatacctcataggattgaagtgaggattatttgagatgttaacagacaaaatataactgtgagtaatatgctccatgaaggggctctattaatataattaaccccactcagatatttattttaaaccacacatacacacacacacacacacacacacacacacacacacacatagcatttattattgaaactgatactttaagtgctttgtgaatgttaatccttataacacctctattagttagatactgttattgttgtcatttacagataggaagctgtggcccagagaagataagtaactttcctaaggtctaagcaagt

SEQ ID NO: 3587 - DNA, 127 bp, Homo sapiens
  D2S2365
  Located on chromosome 2
  Distance between a terminus base of telomere on chromosomal short arm and 5'-terminus of this base sequence : 145167314
  Distance between 3'-terminus of neighbour sequence of sequence listing upward to telomere on chrosomal short arm and 5'-terminus of this base sequence : -227
ttaaccccactcagatatttattttaaaccacacatacacacacacacacacacacacacacacacacacacacatagcatttattattgaaactgatactttaagtgctttgtgaatgttaatcct

SEQ ID NO: 3588 - DNA, 237 bp, Homo sapiens
  AC027262.2_135206
  Located on chromosome 2
  Distance between a terminus base of telomere on chromosomal short arm and 5'-terminus of this base sequence : 145200522
  Distance between 3'-terminus of neighbour sequence of sequence listing upward to telomere on chrosomal short arm and 5'-terminus of this base sequence : 33081
tagtgacttactagatgccaatttgccaaacccagaatgttgcttagctttgtactttgcacacaaagcccatttccttattccaaactaaatatgtttatgcatacacacacacacacacacacacacacacacacacacgaacatgcatatgcccatgtattttcttactacaaagtcagatggtggaacaattctgaatgtatatgtagatagttaactgtcctcaattaccat

SEQ ID NO: 3589 - DNA, 389 bp, Homo sapiens
  AC073119.2_110226
  Located on chromosome 2
  Distance between a terminus base of telomere on chromosomal short arm and 5'-terminus of this base sequence : 145200522
  Distance between 3'-terminus of neighbour sequence of sequence listing upward to telomere on chrosomal short arm and 5'-terminus of this base sequence : -237
tagtgacttactagatgccaatttgccaaacccagaatgttgcttagctttgtactttgcacacaaagcccatttccttattccaaactaaatatgtttatgcatacacacacacacacacacacacacacacacacacacgaacatgcatatgcccatgtattttcttactacaaagtcagatggtggaacaattctgaatgtatatgtagatagttaactgtcctcaattaccatattgtgtcttacattgtaaaagacccttgagcaacattaaacaatatgcgacttccttttatttttcttgttacaagtcttactgagatatccagttgttgttttttattacttccataaattatagttagttagcaagtgcttattgaatg

SEQ ID NO: 3590 - DNA, 238 bp, Homo sapiens
  D2S2184
  Located on chromosome 2
  Distance between a terminus base of telomere on chromosomal short arm and 5'-terminus of this base sequence : 145238583
  Distance between 3'-terminus of neighbour sequence of sequence listing upward to telomere on chrosomal short arm and 5'-terminus of this base sequence : 37672
attccattggtgtatgtctctgtcttggtaccagtaccatactgttttggttactgtagccttgtagtatactttttgtgtgtgtgtgtgtgtgtgtgtgtgtgtgtagagagagagaatatatatatgtatatatatagagagagagacagagacagagacagagagagagagtgagagagagttggataatgtgatgtttccacctttgttccttttacttaggattgctttggct

SEQ ID NO: 3591 - DNA, 471 bp, Homo sapiens
  AC073119.2_157410
  Located on chromosome 2
  Distance between a terminus base of telomere on chromosomal short arm and 5'-terminus of this base sequence : 145272804
  Distance between 3'-terminus of neighbour sequence of sequence listing upward to telomere on chrosomal short arm and 5'-terminus of this base sequence : 33983
cagaacaatagtctggatatgaagggaagacctcaatggtgagaggaccctgtggagtaactgtggtccaggatagctcttccaggttaaaaacttttcttattctcaagagtgatgagcccgtgggatctaacacagaccatctatatttacaagaaattaatttacataccagattatttatctgtgtgtgtgtgtgtgtgtgtgtgtgtgtaaaactgaaatacttgagcttgctatccgagtaagtaacttaattatatcagagcacctatgaaatccatcaaataatcagaaggttatccaatggtggccatggaggtagaacaaaataagttagagtgtttcaaggattattttacccaggctgaggaagagccttgtcacacagaatatggtaatatctccctgatgactaggagaaagtaaacaggttataagatctcaagtatacctttgaaagacttgatg

SEQ ID NO: 3592 - DNA, 435 bp, Homo sapiens
  chr2.fa.O7frz.154000679
  Located on chromosome 2
  Distance between a terminus base of telomere on chromosomal short arm and 5'-terminus of this base sequence : 145416319
  Distance between 3'-terminus of neighbour sequence of sequence listing upward to telomere on chrosomal short arm and 5'-terminus of this base sequence : 143044
tgtaatctcagcactttggtaggccgaagtgggtagatcacctgaggtcaggagttcgagaccagcctggccaacatggtgaaccccgtctctaccaaaaataccaaaattagctgggcttggtggcgggtgcctgtaatcccagctactcgtgaggctgaggcaggagcatcacttgaacctgggaggcagagtttgcagtgagctgagatcacaccactgcactccagcttaggcaacaaaagcaaaactgtgtctcaaaataaataaataaataaataaataaataaataaaataaaaagtaaggttaatgtgatttttttaagtattaaatattctgggggaacagaaaataatatctgaatctgctctattttttgtagatgttgaaaaaaatgcaaagtttcaacacagagttagctcatagtcaaagt

SEQ ID NO: 3593 - DNA, 476 bp, Homo sapiens
  chr2.fa.O7frz.154267260
  Located on chromosome 2
  Distance between a terminus base of telomere on chromosomal short arm and 5'-terminus of this base sequence : 145503017
  Distance between 3'-terminus of neighbour sequence of sequence listing upward to telomere on chrosomal short arm and 5'-terminus of this base sequence : 86263
ctgcttgtttacttcatatcctagttttttttttaagtggagatctaaagttatgttgtttttttactgctgcctaagcaagagttcagtcttatgtgtaatagtgtaatttacataagtaattccctgtttattgacatttaggtgctctctctctctctctctctctctgtctctctttttgtcttataaacagtgccatgatgaccatttttatatagccattattacccactttttttggggggggggttgaattccataaacagagttggtgggtcaaagggatacctttttaaaggaaaggaaatcacgtagtgcctgtgcttgagtttagttatttttaaaagcctagtaacctaccaaagtataacgcagcatgtaacaatgtaacaaggaattgatattacctctgtctaccctttccccaaaaaagacaaaccagaactctggtacctacttccaggattctacat

SEQ ID NO: 3594 - DNA, 241 bp, Homo sapiens
  D2S2277
  Located on chromosome 2
  Distance between a terminus base of telomere on chromosomal short arm and 5'-terminus of this base sequence : 145778069
  Distance between 3'-terminus of neighbour sequence of sequence listing upward to telomere on chrosomal short arm and 5'-terminus of this base sequence : 274576
aactttcaggacaggtaggggggtgtgtgtgtgtgtgtgtgtgtgtgtgtgtgtgtgtgttggagagatgggggtggggaggagaaagaagaactggagtttgctgttgaaagagaagccatatataggagtattccaaatagaatttctaagaaaaatactcttaatgataaaatatcagataacccaatggatagtgataacatgactgacaggaaaaatgcctggagttgttcttgaa

SEQ ID NO: 3595 - DNA, 353 bp, Homo sapiens
  chr2.fa.O7frz.154807536
  Located on chromosome 2
  Distance between a terminus base of telomere on chromosomal short arm and 5'-terminus of this base sequence : 145899443
  Distance between 3'-terminus of neighbour sequence of sequence listing upward to telomere on chrosomal short arm and 5'-terminus of this base sequence : 121133
caattagaaatatgcaggtcacctctgtttatcttccccctctgctcaatacatactctgcctggctgtctcaccttacttttgtttttatgtttatttctttctgtaaaaacttttcttcctcctacctctctctcctctctctctctttctctgtcacgccacacacacacacacacacacacacacacacacacacacacacacatatcacatctgggtaattatacctaaagcattttctactcttttgaacagttgttaaacataaaaaggtaagttagaaaaaagagtaaagtcaatagggttattttaatttggaaaaaaaaaatagttctggagacagaaatgac

SEQ ID NO: 3596 - DNA, 146 bp, Homo sapiens
  D2S2324
  Located on chromosome 2
  Distance between a terminus base of telomere on chromosomal short arm and 5'-terminus of this base sequence : 146066081
  Distance between 3'-terminus of neighbour sequence of sequence listing upward to telomere on chrosomal short arm and 5'-terminus of this base sequence : 166285
gtttgagtgtgctaacatcctttcttactctgagaaacaggggaagtgtgtgtgtgtgtgtgtgtgtatacatgtatatatgaatgtgtgtgtatatatatatatatgcagtatattcttttgagttttaagttcaggggtacatg

SEQ ID NO: 3597 - DNA, 252 bp, Homo sapiens
  AC007364.2_142803
  Located on chromosome 2
  Distance between a terminus base of telomere on chromosomal short arm and 5'-terminus of this base sequence : 146230340
  Distance between 3'-terminus of neighbour sequence of sequence listing upward to telomere on chrosomal short arm and 5'-terminus of this base sequence : 164113
cagaattccttgtcagttcagttcaggatggaagaattctcccgcaggaccctggcaataggcgttctgccctgtctgaggaatcctcgaggatcctgaaatgggctgcccttgatccagtgtgtcaccatgtctccctaactctaaccaccccaggaggtaaaagagctttctcctctctattacacacacacacacacacacacacacatcctttccttaaactcttttgtggttatcacagtgactggt

SEQ ID NO: 3598 - DNA, 132 bp, Homo sapiens
  Z67120
  Located on chromosome 2
  Distance between a terminus base of telomere on chromosomal short arm and 5'-terminus of this base sequence : 146344180
  Distance between 3'-terminus of neighbour sequence of sequence listing upward to telomere on chrosomal short arm and 5'-terminus of this base sequence : 113588
caatgccaaggactgcagaagtcacacacacatgcacacacacacacacacacacacacacacatacaaaaaactgacaaaaaacctccactcatctctcttgaaagaggtagcaacatctctggttcattg

SEQ ID NO: 3599 - DNA, 301 bp, Homo sapiens
  AC007364.2_17310
  Located on chromosome 2
  Distance between a terminus base of telomere on chromosomal short arm and 5'-terminus of this base sequence : 146355952
  Distance between 3'-terminus of neighbour sequence of sequence listing upward to telomere on chrosomal short arm and 5'-terminus of this base sequence : 11640
aggcactagaagccatagttagtgatggaagaggagatgccatgtctcatacacacacacacacacacacacacacacacacacacacacactttacattcacatacatacactctcatacacatgcatttatacacacattcacatgcattcacacacatgcatacacacaaacaccacacacacaccaggcttccaattcttggtcaggccctggctgggaaatgggagaaaatttaaagaggacaatgggtttctattattatgctgaactgaactgcttaaagctttaaagtaactg

SEQ ID NO: 3600 - DNA, 313 bp, Homo sapiens
  AC007364.2_12992
  Located on chromosome 2
  Distance between a terminus base of telomere on chromosomal short arm and 5'-terminus of this base sequence : 146360088
  Distance between 3'-terminus of neighbour sequence of sequence listing upward to telomere on chrosomal short arm and 5'-terminus of this base sequence : 3835
tggcttatcacctagttattctaggcatggtggggtagtcacaaccagtaaaccttctaatgtactctctttccaggaacgcatagacaaggtaaagaggacaagtctattataagcttaaatacttaataacttagtggggtaaagatttaataccagcatcttgccagcagaagttaaaaatggacagaaagagccacaaagaaacaacaggaacccccgctacccccaccacacacacacacacacacacacacacacacacacacacacatcagaattttgcctactacagaatgcaattctacaaatc

SEQ ID NO: 3601 - DNA, 463 bp, Homo sapiens
  chr2.fa.O7frz.155371338
  Located on chromosome 2
  Distance between a terminus base of telomere on chromosomal short arm and 5'-terminus of this base sequence : 146475942
  Distance between 3'-terminus of neighbour sequence of sequence listing upward to telomere on chrosomal short arm and 5'-terminus of this base sequence : 115541
ctagactgaaccaaatgttcatttccagagccaagtgcagtgcctcattcccataatcccagcacattgggaggctgaggctggcagatcacttgaggccaggagttttcgaccagtctgggcaatatagcaagaccccatctctacaaaaaagtaaaaagttagccaggtgtggtggcacacacctgtagtcctagctacttaggaggctgaggcaggtggatcatttgagcccaggaatcggaggctgcagtgagccatgactgtgccactgtactctaacctgggcaacagagtgagaccctgtctctaaaaaaataaaaaataaaaaaaaccacacatgcgtgcgcgcacacacacacacacacacacacctctatataccaaagggtgaattccctgtcttctgagaatttggggcagtatttgtctgccctatttgtttagttgacagaaccactga

SEQ ID NO: 3602 - DNA, 343 bp, Homo sapiens
  AC007394.3_152453
  Located on chromosome 2
  Distance between a terminus base of telomere on chromosomal short arm and 5'-terminus of this base sequence : 146486449
  Distance between 3'-terminus of neighbour sequence of sequence listing upward to telomere on chrosomal short arm and 5'-terminus of this base sequence : 10044
tgagttaggcaggtaacagtagtcctcaaggagataaaacactacagcagtggctggtgtgtgtgtgtgtgtgtgtgtgtgtgtgtgtgtgtgtgtgtgtgtgtgtgtgtgttggggggaagcagctattcacaagagcagaacaatttaaaactttgtgccaatgagcatagctgggtccagggtgcattacagacgaagactgaaacaataatgaacatttttccaaaattgaggagcttcgtttctccctagcatgatttcagtgtcttcctaggacaacagatgaagaccatgatgggagtttccagaggtccctctatgtctaatgaatctgaaagct

SEQ ID NO: 3603 - DNA, 447 bp, Homo sapiens
  chr2.fa.O7frz.155549830
  Located on chromosome 2
  Distance between a terminus base of telomere on chromosomal short arm and 5'-terminus of this base sequence : 146641834
  Distance between 3'-terminus of neighbour sequence of sequence listing upward to telomere on chrosomal short arm and 5'-terminus of this base sequence : 155042
ggtagcttaatgcctgtaaattcagcactttgtgagaccagcatgggaagattccttgagccgagatatttgagactagcttgggcaacatggagagatcccatctctacaaaaaaaaaaaaaattaaccaagagaggtggccagtacctgtggtcccagctacttggggagactgaggcaggaggattgcttgagcccaggaggttgaggctgtggtaagccatgtttgtgccactgcactccagcctgggcctcagagtgagaccctgtctccaatatatatgttatatatatcagatacgtatccatatacatatataacatatatataattgtgtgtgtgtgtgtgtgtgaaggggagagagagagaaaggttctccggccctactcagaaattttgatttcctagatctggggcagggcttagaaattagcatttcttacca

SEQ ID NO: 3604 - DNA, 262 bp, Homo sapiens
  AC073271.2_173953
  Located on chromosome 2
  Distance between a terminus base of telomere on chromosomal short arm and 5'-terminus of this base sequence : 146806613
  Distance between 3'-terminus of neighbour sequence of sequence listing upward to telomere on chrosomal short arm and 5'-terminus of this base sequence : 164332
cctgattgtgtactgaattgacaggcaaatgggtcaagagaaacttgttcctacagccatcttgaaatatcctgaaaacagaagaagaatggaaactacccatagctcagaacacatgactaccatcatctctgactatacacacacacacacacacacacacacacacacacaggcccatgtgcataaatttgcaatcagccaatcagccaagcctgccctactcaatcttgaagcttcttatagtcacaccaaagcatca

SEQ ID NO: 3605 - DNA, 320 bp, Homo sapiens
  chr2.fa.O7frz.155797999
  Located on chromosome 2
  Distance between a terminus base of telomere on chromosomal short arm and 5'-terminus of this base sequence : 146890238
  Distance between 3'-terminus of neighbour sequence of sequence listing upward to telomere on chrosomal short arm and 5'-terminus of this base sequence : 83363
ttattcctattaatggcattaaagttgatgttttagatctatctagaagtaactgcaactaaaatcaaaaacaaaaggagagaataagtgagagagcacatgtgcgtgtgtgtgtgtgtgtgtgtgcatgcatgcgtgtatgcatgtgtgtgcacgtgtgccatcacaaaagtggccctgtggtcgaccctttgagtaaacattcacttgagcctctgacctgaacccacattgacccaccccagctggacattcacagggctccacagcagacaccttctttacgtaacttggccatgtcttggctataagatcctctg

SEQ ID NO: 3606 - DNA, 332 bp, Homo sapiens
  AC073271.2_28598
  Located on chromosome 2
  Distance between a terminus base of telomere on chromosomal short arm and 5'-terminus of this base sequence : 146927247
  Distance between 3'-terminus of neighbour sequence of sequence listing upward to telomere on chrosomal short arm and 5'-terminus of this base sequence : 36689
ctaatctgtctttccagacctctgaggtcaagcatctcctgagccagcttgcatttattgaggcccctgacaaccgcaaaaacaaaaacaatggtatttttaggtgttccatttaacaaatggccttcactcacacacacacacacacacacacacacacacacacacacacacgaggtaatgtgtcatgctgctcctcacatgttaatttcaagactcgttaaaaaaatccattccgtgaaaaaattcatttcactgcagaaagcactgtacaactttaaagttgtatggagaacattccttcttatgactatttcagtacacttccgtga

SEQ ID NO: 3607 - DNA, 479 bp, Homo sapiens
  chr2.fa.O7frz.156163812
  Located on chromosome 2
  Distance between a terminus base of telomere on chromosomal short arm and 5'-terminus of this base sequence : 147118601
  Distance between 3'-terminus of neighbour sequence of sequence listing upward to telomere on chrosomal short arm and 5'-terminus of this base sequence : 191022
gagtaacgaggtctatgcctacttgttaatactggcagaattggcggtgtgtgtgtgtgtgtgtgtgtgtgtgtgtgtgtgtgtgtgagagagagagagagagagagagaaaggccacctcagtctcttatctgattcaattttctttgtttaaatgtctgcagaggctcctaaaaaactttcattttcatttagttgtgtaaattaacttggctttaggtactatgaaaagagattcagtgtctaataaatcgggtagtgtgatgagcggtgcttactatttctaaaataaatcataattttgcttattaaatagttcatggatgaaccagtaggaccactttgtgatttcaatgttttatactttaaaattgttctcttaggcttctcaattcagattgccccccaagacattaactagatttggcttttcagttatttggcaccatcactatctcctttatcagttcaaatcatag

SEQ ID NO: 3608 - DNA, 379 bp, Homo sapiens
  chr2.fa.O7frz.156254969
  Located on chromosome 2
  Distance between a terminus base of telomere on chromosomal short arm and 5'-terminus of this base sequence : 147193488
  Distance between 3'-terminus of neighbour sequence of sequence listing upward to telomere on chrosomal short arm and 5'-terminus of this base sequence : 74408
gtattcactattcattacgtggaggtggatcatcataaagatcttcatccttattatcttcatatagagtaggctgaggaggaggaggaagaggaggttttggtcttgtctgagaaatggcaaaggcagaaaaaaatccacatataagtggactcatgcaattcaaaatcatgttgttcaagggtcaattgtacatacacatatatacatgtatatatatctagatagatgatagatagatgatagatagatagatagatagatagatagatagatagatagatcactctggatattataagccaacaaaacaatgccttccaagctggaaatgtgatatacaaacgagccaaactatcaaacatggtatcagaataaa

SEQ ID NO: 3609 - DNA, 101 bp, Homo sapiens
  DISO7_10000993
  Located on chromosome 2
  Distance between a terminus base of telomere on chromosomal short arm and 5'-terminus of this base sequence : 147209172
  Distance between 3'-terminus of neighbour sequence of sequence listing upward to telomere on chrosomal short arm and 5'-terminus of this base sequence : 15305
taatcaggcataggaaatctcctaatacacatacacacacacacacacacacacacacacacacgtagagagaacatgagcgtgttgaattaagcaaacta

SEQ ID NO: 3610 - DNA, 418 bp, Homo sapiens
  chr2.fa.O7frz.156335204
  Located on chromosome 2
  Distance between a terminus base of telomere on chromosomal short arm and 5'-terminus of this base sequence : 147274515
  Distance between 3'-terminus of neighbour sequence of sequence listing upward to telomere on chrosomal short arm and 5'-terminus of this base sequence : 65242
catattaggtgcaaatggttagagtgggccagatgtaattttgtacgtcagcaaaatctgcctgcggaaatattttgatatctcatgttgctgaaaataattgagctcattaaatggtaagttccatccccactgttctctcaacacacacacacacacacacacacacacacacactttaacataatcagtaaaggccgatgaacttgggagaaagtagttttgctctgatggttaaaagttaatagaatgaagccttctataggtggatgtgcggctgctattgtgctcagatgaattttgaaaccaaattagattcattttaattttcctcagaagaataagcaaaacaactgttaggttggtgcaaaatgaactgcagtttttgccattactttaatgtaaatgcagacctagt

SEQ ID NO: 3611 - DNA, 435 bp, Homo sapiens
  chr2.fa.O7frz.156436556
  Located on chromosome 2
  Distance between a terminus base of telomere on chromosomal short arm and 5'-terminus of this base sequence : 147375655
  Distance between 3'-terminus of neighbour sequence of sequence listing upward to telomere on chrosomal short arm and 5'-terminus of this base sequence : 100722
tcagttatccaagatgcataagtcctagagcttgtgactttgaacacaagcaaacaaatccttttccatttaagaaaacaatgtgcctagagctaccaatacttgttgtatacttaaaatttattaaaagagtggatctctgatctgcagatctctgatctcctgttaaatgttcttgccatgaaaagggaaagaagaaagaaagagagagagggggcaggagggagggaggaaagaaggcaggcaggaaagaagaagggaagggaagggaagagaagggggacggagggaaggaaggaaggagggaaagagggagggagggagggaaggaaggaaggaaagaaggaaggaaggaaggtaggtaggtaggtaggtaggtaggtaggtaggtaggtaggtaggtaaagcaagctagttctattaaagcctcaatga

SEQ ID NO: 3612 - DNA, 178 bp, Homo sapiens
  AC005036.1_104089
  Located on chromosome 2
  Distance between a terminus base of telomere on chromosomal short arm and 5'-terminus of this base sequence : 147571077
  Distance between 3'-terminus of neighbour sequence of sequence listing upward to telomere on chrosomal short arm and 5'-terminus of this base sequence : 194987
catagtcatgtgagccaattacttgaaatctctctctctctctctctctctctctttctctctctctctctctctctctctctctctgtctttctgtgtgtgtgtgtacgtgtgtgcatatacacattctattggttctgtttctctggagaactctaatacagattttggaactagg

SEQ ID NO: 3613 - DNA, 186 bp, Homo sapiens
  D2S356
  Located on chromosome 2
  Distance between a terminus base of telomere on chromosomal short arm and 5'-terminus of this base sequence : 147583610
  Distance between 3'-terminus of neighbour sequence of sequence listing upward to telomere on chrosomal short arm and 5'-terminus of this base sequence : 12355
ctggaccagggactgacatttcaagggaaagccctggaagcccctgcagtactgagattacagacctccaaactcattggcactctctgtttctctgtctgtctttatctctctctcttatacacacacacacacacacacacacacagtgtaagaaaatcaaccacactacccttagcataagcc

SEQ ID NO: 3614 - DNA, 200 bp, Homo sapiens
  AC005036.1_142625
  Located on chromosome 2
  Distance between a terminus base of telomere on chromosomal short arm and 5'-terminus of this base sequence : 147609619
  Distance between 3'-terminus of neighbour sequence of sequence listing upward to telomere on chrosomal short arm and 5'-terminus of this base sequence : 25823
atcagcctaaatactcttggacatctgttattcagatgttattcagattttatatatatatatatatatatatatatatatatatatatatatataatcataaatgatcaatttataataatttaaaattgattttaaattattatattagggaatacaatattgaaaaatgagggctccatgtaccatagattatctga

SEQ ID NO: 3615 - DNA, 243 bp, Homo sapiens
  AC023469.3_60742
  Located on chromosome 2
  Distance between a terminus base of telomere on chromosomal short arm and 5'-terminus of this base sequence : 147627469
  Distance between 3'-terminus of neighbour sequence of sequence listing upward to telomere on chrosomal short arm and 5'-terminus of this base sequence : 17650
taacgtaagtcttagttgttccacattcttcctaatacttgaagtatgtacacacacatacacacatacacacacacaaattttatatatatatatatatatatatatatatatatatatatatataatttttgttattcttgtggttgtgtagtggtgtctcactggggtataatttatacttgctggatgaccaatgaggctaagcactttgtatatgtttattgactttctgaatttcct

SEQ ID NO: 3616 - DNA, 218 bp, Homo sapiens
  AC005036.1_160508
  Located on chromosome 2
  Distance between a terminus base of telomere on chromosomal short arm and 5'-terminus of this base sequence : 147627469
  Distance between 3'-terminus of neighbour sequence of sequence listing upward to telomere on chrosomal short arm and 5'-terminus of this base sequence : -243
taacgtaagtcttagttgttccacattcttcctaatacttgaagtatgtacacacacatacacacatacacacacacaaattttatatatatatatatatatatatatatatatatatatatatataatttttgttattcttgtggttgtgtagtggtgtctcactggggtataatttatacttgctggatgaccaatgaggctaagcactttgtata

SEQ ID NO: 3617 - DNA, 274 bp, Homo sapiens
  AC023469.3_134913
  Located on chromosome 2
  Distance between a terminus base of telomere on chromosomal short arm and 5'-terminus of this base sequence : 147643589
  Distance between 3'-terminus of neighbour sequence of sequence listing upward to telomere on chrosomal short arm and 5'-terminus of this base sequence : 15902
tatttcaaagatgtgatccaaggttacagtcatgtggtaaccatattattttttaagagaccctaaaattaagcagaatgttacttcccaattacccaacaattatctcaaatgaatggtagcaggcaaaacacacacacacacacacacagaggcaaactcaaactacctctgatgccccaaacccaagataagcccattcagcatgttgaagctaagcccaaaccacttccttatgaaattggagccttccttaagctaccaagaccagttc

SEQ ID NO: 3618 - DNA, 125 bp, Homo sapiens
  D2S2275
  Located on chromosome 2
  Distance between a terminus base of telomere on chromosomal short arm and 5'-terminus of this base sequence : 147643692
  Distance between 3'-terminus of neighbour sequence of sequence listing upward to telomere on chrosomal short arm and 5'-terminus of this base sequence : -171
tatctcaaatgaatggtagcaggcaaaacacacacacacacacacacagaggcaaactcaaactacctctgatgccccaaacccaagataagcccattcagcatgttgaagctaagcccaaacca

SEQ ID NO: 3619 - DNA, 254 bp, Homo sapiens
  AC023469.3_218329
  Located on chromosome 2
  Distance between a terminus base of telomere on chromosomal short arm and 5'-terminus of this base sequence : 147749243
  Distance between 3'-terminus of neighbour sequence of sequence listing upward to telomere on chrosomal short arm and 5'-terminus of this base sequence : 105426
tgaagtttccacagattatcaccagcaacacagtgatgccctgatagatggcaacaaaacaaaaacaaaagcctctacatatgaggttgtaaaactgaattctagattatcccgtacacacacacacacacacacacacacaagtgagcaaaaaatcttctttaggacagaggagggactttgcatgtagagtaaataatgtattccatacaatgcttggaatttccttggggaaaggtactctagcattccag

SEQ ID NO: 3620 - DNA, 432 bp, Homo sapiens
  AC018731.4_157148
  Located on chromosome 2
  Distance between a terminus base of telomere on chromosomal short arm and 5'-terminus of this base sequence : 147838880
  Distance between 3'-terminus of neighbour sequence of sequence listing upward to telomere on chrosomal short arm and 5'-terminus of this base sequence : 89383
atcaatgcaagtaaatgatttaacatgaatgaagctaagaggtatttaatgtaagtcacagaggactttgcaagggatgtaacacttttttattcttattttgtataatttctggatttcttcaaaatgtatgtaaactagccctttgacacttacatattcccagacattcaaaaattcccagcttttgagaatctttttgatacctcctggctctcttccaaattatgttttcatcataagccaactttcctggacagatcttcacatcactaaagttttaccctctcactcaatggctattttcatacacacatacacacacacacacacacacacacacacacacacagacacacacccctaatgtgatataaaaattagcagagcacaacaaaactttaaaactatattgatgtaaaggtgatggac

SEQ ID NO: 3621 - DNA, 377 bp, Homo sapiens
  AC018731.4_58914
  Located on chromosome 2
  Distance between a terminus base of telomere on chromosomal short arm and 5'-terminus of this base sequence : 147873995
  Distance between 3'-terminus of neighbour sequence of sequence listing upward to telomere on chrosomal short arm and 5'-terminus of this base sequence : 34683
tccttaaattgtctgcaaatacactgcggttcatttgggtagatttctttttaaagaaagtctatatattattattaaaataatagcacatgtttattagtagacaatttagaaagtatattcaaaccaaaaaataaaagaaaatgaaattatccatattttcctcctacttctaaaatatgttttgtgactcttttgttccatcatgttcccatcctcactccctctgtataggtgggtgtatgtgtgtgtgatgcttatgggttgtgtggggtgtgtgtgtgtgtgtgtgtgtgtgtgtggtattggggggctgtcgaggggtgtgggagtgtcatgtcaaaaccctattaaccctattaaggattcaagaggcc

SEQ ID NO: 3622 - DNA, 381 bp, Homo sapiens
  chr2.fa.O7frz.157076332
  Located on chromosome 2
  Distance between a terminus base of telomere on chromosomal short arm and 5'-terminus of this base sequence : 147970802
  Distance between 3'-terminus of neighbour sequence of sequence listing upward to telomere on chrosomal short arm and 5'-terminus of this base sequence : 96430
cgaggaatgctctagtaaattacgccctctcctaatataaaagttatttattgatgttatcatgcactcaataaatatgttgcacatgagctgcagcactctgtgccttggatatctcatgtaaatctacacagatgtgaggtgaatattatgttacacatttgtctccctgactacatggcaatgaactcctcccaggctttctataaagacacacacacacacacacaccagtattacatacagtctaatgtgtgttggaaggggtaggataccagaagtagtaaaaaacaaaggagagcgtagtcccctctacctgaggaggtcagggaagtttccttcacagaagaggtgaaaattgagttgattcattaaggtaga

SEQ ID NO: 3623 - DNA, 433 bp, Homo sapiens
  chr2.fa.O7frz.157170249
  Located on chromosome 2
  Distance between a terminus base of telomere on chromosomal short arm and 5'-terminus of this base sequence : 148064611
  Distance between 3'-terminus of neighbour sequence of sequence listing upward to telomere on chrosomal short arm and 5'-terminus of this base sequence : 93428
acttctgagctacagaactgtaagataataaatgtggccgggcgcagtggctcacgcctgtaatcccagcaatttgggaggcagaggcgggtggatcacttgaggtcaggagttcaagaccagtctggccaacatggtgaaaacctgtctctactaaaaatacaaaaattacctgggcatggtggcgcatgcctataatcccagctacttgggaggctgaggcaggagaatcatttgaacccaggaggcagaggatgcagtgagctgagatcgtgccactgcactccagcctgggcgatagagcaagactctatctcaaaaataaataaataaataaataagtgttgttttaagccactaagtgtgttgtaatgttttacagcagtgatagaaaggtaatgcatctcttaataatcagtttcatgcagactta

SEQ ID NO: 3624 - DNA, 359 bp, Homo sapiens
  chr2.fa.O7frz.157359363
  Located on chromosome 2
  Distance between a terminus base of telomere on chromosomal short arm and 5'-terminus of this base sequence : 148110598
  Distance between 3'-terminus of neighbour sequence of sequence listing upward to telomere on chrosomal short arm and 5'-terminus of this base sequence : 45554
tcacctgagttctcgagttagagaccagcctgaccaacatggagaaaccccatctttactaaaaatacaaagttggacgggcatggtggcacatgcctgtaatcccagctacttgggaggcagaggcaggagaatccgggaggaggaggctgcagtgagccgagatcatgccattgcactccagcctgggcaacaagagtgaaacttccgtctctgaatgaatgaatgaatgaatgaatgaatgaatgaacaaaaagaataggagaccccaaaaaggaagtgtcttggactggagaacttgttcatacagtgatagcctttattttcttatagaactgttaattgaaatagctaaatgg

SEQ ID NO: 3625 - DNA, 458 bp, Homo sapiens
  M2_148121081
  Located on chromosome 2
  Distance between a terminus base of telomere on chromosomal short arm and 5'-terminus of this base sequence : 148121034
  Distance between 3'-terminus of neighbour sequence of sequence listing upward to telomere on chrosomal short arm and 5'-terminus of this base sequence : 10077
taaatgtaatatgatgaagattggccaaaaacatttatacttcccttttttattttattttattttattttattttattttatttatttttgagacggagttttgctcttgttgcccaggctggagagcagtggcacgatctcggctcactgcaacctccgcctcccaggttcaagctattctcctgcctcaacctcccgagtagctgggattacaggcatgtgccaccacacccggctaattttgtatttttatagagacggggtttctccatgttggtcaggctggtcttgaactcctaacctcgggtgatccctccgccttgctcttccaaatcctgggattacaggtgtgagccactgtgcccagcatatttcccttttttttaaaaaaaaaaaaaaaaagaaagatgaccttatgtaaaattctgagagtattggatttgaagtatattgacc

SEQ ID NO: 3626 - DNA, 277 bp, Homo sapiens
  chr2.fa.O7frz.136608491
  Located on chromosome 2
  Distance between a terminus base of telomere on chromosomal short arm and 5'-terminus of this base sequence : 148381104
  Distance between 3'-terminus of neighbour sequence of sequence listing upward to telomere on chrosomal short arm and 5'-terminus of this base sequence : 259612
taaattgtagagaaatggtttcatcagccgacgcgtggagggtggggtgggttttactcagcctgcatactgtgaaaagagtgagtgtggtttgtgaactaggtgtggaaattgtgtgtgtgtgtgtgtgtgtgtgtgtgtgtgtaggagagagagagaccaatcccaccatgagaacccagaaattgtgtttgatttgggtccctgtctagtcacctgtctgtctgtagatgactgaggattccacaaatgaaggtcagcagtatctattgagctg

SEQ ID NO: 3627 - DNA, 361 bp, Homo sapiens
  chr2.fa.O7frz.138086359
  Located on chromosome 2
  Distance between a terminus base of telomere on chromosomal short arm and 5'-terminus of this base sequence : 148708597
  Distance between 3'-terminus of neighbour sequence of sequence listing upward to telomere on chrosomal short arm and 5'-terminus of this base sequence : 327216
cagtagcgatacagtgccttttcttttattttctctttcttttcttttctttttttctttctttcatttatttatttatttatttatttggagactgagtctcgctctgtcgcccaggctgtagtgcagtggcgcaaccttgggtcactgcaacctccgcctgccaagttcaagcgattcttctgccacagcctcccatgtagctgggatttcaggtgcctgccccaccgtgcctgactcagtttcgtattttcagtagagacagggtttcacaatgttggcgaggctggtctccaactcctgacctcgggatgacagacgtgagccactgcgttcagtgtacagtgccatttcttagaca

SEQ ID NO: 3628 - DNA, 136 bp, Homo sapiens
  D2S112
  Located on chromosome 2
  Distance between a terminus base of telomere on chromosomal short arm and 5'-terminus of this base sequence : 148962671
  Distance between 3'-terminus of neighbour sequence of sequence listing upward to telomere on chrosomal short arm and 5'-terminus of this base sequence : 253713
agccattgctatctttgaggctgtgtgtgtgtgtgtgtgtgtgtgtgtgcacgcgcgtgaaatgctttgccctttgatagtcacaagggtcacccattctttcattctgtcctctgataccttctcaccgccactc

SEQ ID NO: 3629 - DNA, 258 bp, Homo sapiens
  chr2.fa.O7frz.138376899
  Located on chromosome 2
  Distance between a terminus base of telomere on chromosomal short arm and 5'-terminus of this base sequence : 149057171
  Distance between 3'-terminus of neighbour sequence of sequence listing upward to telomere on chrosomal short arm and 5'-terminus of this base sequence : 94364
gagttgaataacagtcagattgtcttaaaaccatcttataatccacgatgtgtgatgggcgtgtgtgtgtgtgtgtgtgtgtgtgtgtgttaaagcacctgatgatgacaattcttctccactttcaatgcaccaaagaatcaactggagatcttgctaaaaggcagaatcagatcagtcagtctgggggcaggcctgggattctgcatttctaacaagctcccaggtgatgcagataaactggtccaagactaagtt

SEQ ID NO: 3630 - DNA, 309 bp, Homo sapiens
  chr2.fa.O7frz.138493644
  Located on chromosome 2
  Distance between a terminus base of telomere on chromosomal short arm and 5'-terminus of this base sequence : 149199223
  Distance between 3'-terminus of neighbour sequence of sequence listing upward to telomere on chrosomal short arm and 5'-terminus of this base sequence : 141794
aaatgactaggagaaagatgtttaaattcaaaactgctaagcacggacacctacctaaacacacacacacacacacacacacacacacacacacacacacacccttcctctgaagctttccagggatagctatagaaatttcattttaagcaagggaaaaaaaaatagaatcaccccctcacaaaaatgtttgagtatattttggtctcttggtcagggccaataaagatctcttgttgtgagccaactagaacagaaatggagtgagagatgtactactttatgtggtctgaatgtgattagcgatta

SEQ ID NO: 3631 - DNA, 266 bp, Homo sapiens
  AC016909.7_135313
  Located on chromosome 2
  Distance between a terminus base of telomere on chromosomal short arm and 5'-terminus of this base sequence : 149386358
  Distance between 3'-terminus of neighbour sequence of sequence listing upward to telomere on chrosomal short arm and 5'-terminus of this base sequence : 186826
ggaaggtctgaatgaggtctacggatatgcaattttagcaaccaccacacatctttctgatgcaaagggctcccagaaacacaccttgagaaacactgggatatggtttattttattttattttattttattttattgcctgtagctttatattatctcagacattgttgtggaatcagaagtactttaaaacttccacatgggtctgtgctcttctgttactgtatctaaacttggtggagggagctttcatccttctactgaaa

SEQ ID NO: 3632 - DNA, 398 bp, Homo sapiens
  AC016909.7_102247
  Located on chromosome 2
  Distance between a terminus base of telomere on chromosomal short arm and 5'-terminus of this base sequence : 149440237
  Distance between 3'-terminus of neighbour sequence of sequence listing upward to telomere on chrosomal short arm and 5'-terminus of this base sequence : 53613
taaggcttatacacgaatttgaacataactattaaagtaaattaaatgggatttagtaaatggccaaataacactgtggtgggagccaagggagcagacagaagcaaactatcaagtttgggtatgaatttcaatgtctaagatgaagttagacctagtctaacttcaagactcctacgtggtggctcatgcctgtaatcccaacactttgagagaccaaggcaggagaacagctggaggccaggagttcaagatcagcctgggaaatacagtgagacccccttctctaccaaaacaaaacaaaacaaaacaaaacaaaacaaaacaaaacaaaattagctgcacatagtggtgtgcacctgtaaacccaatttgatggtatctggaggcaaacagtg

SEQ ID NO: 3633 - DNA, 281 bp, Homo sapiens
  AC012489.5_179109
  Located on chromosome 2
  Distance between a terminus base of telomere on chromosomal short arm and 5'-terminus of this base sequence : 149460533
  Distance between 3'-terminus of neighbour sequence of sequence listing upward to telomere on chrosomal short arm and 5'-terminus of this base sequence : 19898
tggtacagtaactcagaagcaacaaagatccagagaaatgaaaagaaaagaaaagaaaagaaaagaaaagaaaagaaaagaaaagaaacatggtgaggaagaaggacaagacccaccccccaccctgccccatccagggataagaagaagcaaagaagctggtgaactggtgaggcctgggggccagtgatgaaggaaatcatccagaagcctaggaataaaatgtcatttaggtctcacagtctgcaatgaacacgtccttatttccgtattctgaggct

SEQ ID NO: 3634 - DNA, 424 bp, Homo sapiens
  AC012489.6_143852
  Located on chromosome 2
  Distance between a terminus base of telomere on chromosomal short arm and 5'-terminus of this base sequence : 149477256
  Distance between 3'-terminus of neighbour sequence of sequence listing upward to telomere on chrosomal short arm and 5'-terminus of this base sequence : 16442
aaacctagatggtacagcctactacacacccaggctatatggtacctaggttagaatcctatataccatgttactgtactgaatactgtaggcaactgtaacacaatggcaagtatttgtgtatctaaacatatctaaacataaaaaaggtacagtaaaaacatggtataatcttacgagaccaccatcacacatctttataaggtacatgactctttgtgtgtgtgtgtgtgtgtgtgtgtgtgtgtgtgtgtgtatctgtagaagtatcctgtaataatcagagcccaatagctaattaaaacaaagaaaagccattggggtggtaaatgaaaagccaaaagactttggaatgtgacagccagatttcaggtctaacatttatttagcagtttggcaaatgatcttacacaaacttccttta

SEQ ID NO: 3635 - DNA, 248 bp, Homo sapiens
  D2S2256
  Located on chromosome 2
  Distance between a terminus base of telomere on chromosomal short arm and 5'-terminus of this base sequence : 149614139
  Distance between 3'-terminus of neighbour sequence of sequence listing upward to telomere on chrosomal short arm and 5'-terminus of this base sequence : 136459
atttgtccaagatcattccgctctctcttaaggatctttattccaaagtccaggtgctttgctacatctccctccactactttatttacatctctgttacctccatgatcatgcctttggctctggcattgctaactggatcattcttaactgacaggttagacaagcatgtaaacacacacacacacacacacacacacacacacacacacacacacactgtacataaacacaatggctgcatgggt

SEQ ID NO: 3636 - DNA, 344 bp, Homo sapiens
  AC011755.5_176273
  Located on chromosome 2
  Distance between a terminus base of telomere on chromosomal short arm and 5'-terminus of this base sequence : 149636432
  Distance between 3'-terminus of neighbour sequence of sequence listing upward to telomere on chrosomal short arm and 5'-terminus of this base sequence : 22045
atggtaaaactccgtctaccacaattacaaaaattagccaggcgtggtgacacgcacctatagtcccagctacttgggaggctgaggtgtgaggatggtttgagcccaggaggtgtaggctgcagcgaggtgaggctgcaccactacactccagcctggggaacctgagccagaccctgtctcaataataataatcatcatcatcatctacaagttgattagattatttccaaagggaccaacagagatacctttgcaaatcctgcatgatatgcacaattatatatatgaaattggtactctgtagagttgcttatctcctcactttatcacctaagtgatcc

SEQ ID NO: 3637 - DNA, 309 bp, Homo sapiens
  AC011755.5_44621
  Located on chromosome 2
  Distance between a terminus base of telomere on chromosomal short arm and 5'-terminus of this base sequence : 149642239
  Distance between 3'-terminus of neighbour sequence of sequence listing upward to telomere on chrosomal short arm and 5'-terminus of this base sequence : 5463
agataactagctcatctcacgaacgggtatcagggactgaaagaggaactggatgacacagaatagacggttcagcagaaactcattcctggaactggtaaaaagcacacagctcagatcctcctgatagcactgagtcagctacactaatgtctttgttgttttgtttttgttttgttgttgttgttgttgttgccttttttaaaaagcatgccatgctgttattgttactgctgttactacactaagcattttgtacacaggatatacactctatgatgaaaactatacatgcaatgtctgatcatg

SEQ ID NO: 3638 - DNA, 173 bp, Homo sapiens
  Z67636
  Located on chromosome 2
  Distance between a terminus base of telomere on chromosomal short arm and 5'-terminus of this base sequence : 149868757
  Distance between 3'-terminus of neighbour sequence of sequence listing upward to telomere on chrosomal short arm and 5'-terminus of this base sequence : 226209
cttgcccgaccctaaatattgttctatttcttgtagattcttccaaaattatagtcactcaatacttattcctattagttgggtcacacacatacacagacacacacacacacacacacacacacacacacacacacacatacacagaggctaatgtgaatatagggtctttc

SEQ ID NO: 3639 - DNA, 366 bp, Homo sapiens
  chr2.fa.O7frz.139238925
  Located on chromosome 2
  Distance between a terminus base of telomere on chromosomal short arm and 5'-terminus of this base sequence : 149915373
  Distance between 3'-terminus of neighbour sequence of sequence listing upward to telomere on chrosomal short arm and 5'-terminus of this base sequence : 46443
tctatccttatgccatgaaacacattttactgatgtgtttaatcagtggggttcccataagctggtctgcagtcaggtggatgtgtgtgtgtgtgtgtgtgtgtgtgtgtaggtgagttttcaccagtcatacctgagccccttgactgccatgtgatgagccttggcccttgcccctcagctgggcagcccaggctctgtggctcctggtcttgcctacacacctgggtagcccacaccctactttctccaggcctacaaaccccagctatagtgtctcagcttccctacctcctcttagaatattctgaattgaatgaattaagagactggcttccaattttgctaacatacttacctgaaact

SEQ ID NO: 3640 - DNA, 407 bp, Homo sapiens
  chr2.fa.O7frz.139309188
  Located on chromosome 2
  Distance between a terminus base of telomere on chromosomal short arm and 5'-terminus of this base sequence : 149985421
  Distance between 3'-terminus of neighbour sequence of sequence listing upward to telomere on chrosomal short arm and 5'-terminus of this base sequence : 69682
aacatgtatctagagcagttcaagagcaaaaatgcataaagcaggaggaaggaagaataaagagagttccatttaaagtactgtatgatccagcaaacccacaaatgggtacatatccaaaggaaatgaaattagtatgaaagaaagtgaatcagaggtatctgtgctcccatgtttattgcagcactactcccaacagacaagatagggaatcaacctaagtgtctgtcaacagatgaatggataaagaaaatgtgatatctatctatctatctatctatctatctatctatctatctatacacacacacacacacacacacgtacatacatatacacacacacaatggaatactattcagccataaaaagaaggaaatactgtcatttctacaacatagatggac

SEQ ID NO: 3641 - DNA, 224 bp, Homo sapiens
  D2S114
  Located on chromosome 2
  Distance between a terminus base of telomere on chromosomal short arm and 5'-terminus of this base sequence : 150079087
  Distance between 3'-terminus of neighbour sequence of sequence listing upward to telomere on chrosomal short arm and 5'-terminus of this base sequence : 93259
cttgggttccaactcagaagacaagtcagaacattgaacatttctccagatactcaatgtgaaaagaatccaaatagaaacagtttcaatttcaaaatattttttgatacatacacattcctgaggatgaatgagcctgtgtgtgtgtgtgtgtgtgtgtgtgtgtgtgtgtgtgtgtgtttggggagagagtgtaggtaggaggggacgagagaccataaaca

SEQ ID NO: 3642 - DNA, 277 bp, Homo sapiens
  Z16484.1_233
  Located on chromosome 2
  Distance between a terminus base of telomere on chromosomal short arm and 5'-terminus of this base sequence : 150079150
  Distance between 3'-terminus of neighbour sequence of sequence listing upward to telomere on chrosomal short arm and 5'-terminus of this base sequence : -161
aagaatccaaatagaaacagtttcaatttcaaaatattttttgatacatacacattcctgaggatgaatgagcctgtgtgtgtgtgtgtgtgtgtgtgtgtgtgtgtgtgtgtgtgtttggggagagagtgtaggtaggaggggacgagagaccataaacatcaacatccacacactagaaatccataaaccacagaaagaatcagagacaaaaagtgggttctccctgcagtgtaccagttcatgaaaaagtagccttcatagttgtctgctaaac

SEQ ID NO: 3643 - DNA, 404 bp, Homo sapiens
  AC069477.2_99777
  Located on chromosome 2
  Distance between a terminus base of telomere on chromosomal short arm and 5'-terminus of this base sequence : 150483535
  Distance between 3'-terminus of neighbour sequence of sequence listing upward to telomere on chrosomal short arm and 5'-terminus of this base sequence : 404108
ggagcatctgtattagaagctaagacacagtctaccccttggctactcagcttccatatgtactcttctctacacatttaaactccctaataataataataataataataataacaacaataataagccagaaacagaggtggcttcctcagcatcaggttcctgaagcacaggcagcttctcctgcacccattcatacttataattccttttctagcaaccaaccaagagagcaatacaaggctattaatgaggaaattccacaacttcttttatagttcacatcagtcagttctttttatctgagtccttcttatacaaagtccttcttacacgaagttgtgtgcaaatgtgcgtgcgtgcatgtgtgtgtagaactaactctggcactagataatcttgtt

SEQ ID NO: 3644 - DNA, 341 bp, Homo sapiens
  AC068547.4_159070
  Located on chromosome 2
  Distance between a terminus base of telomere on chromosomal short arm and 5'-terminus of this base sequence : 150554139
  Distance between 3'-terminus of neighbour sequence of sequence listing upward to telomere on chrosomal short arm and 5'-terminus of this base sequence : 70200
cacgttcatggatcagaagaattaatatcattaaaatgaccatattacccaaagcaatctccagattcactgtaatccctgtcaaaataccaataacattcttcaaagaaatagaaaaaaaatctaaaattcatatggaaccagaactcaaatagccccacacacacacacacacacacacacacacacacacacacacacacacacaaatcctgagcaaaacgaacaaagctggaggcatcacaaaacctgaccttaaaatatactacaaagctacagtacctaaaacagcatggtattggtataaaaaacagatacatgttatccacggaagacatgtt

SEQ ID NO: 3645 - DNA, 345 bp, Homo sapiens
  AC068547.4_22910
  Located on chromosome 2
  Distance between a terminus base of telomere on chromosomal short arm and 5'-terminus of this base sequence : 150616377
  Distance between 3'-terminus of neighbour sequence of sequence listing upward to telomere on chrosomal short arm and 5'-terminus of this base sequence : 61897
tttaatttcctaaacctgctaacccccaattttaaattcactttgattttttcaaagaaaaaaaaagtagagtggctgggcgtgtgtgtgtgtgtgtgtgtgtgtgtgtgtgtgtgtgtgtgtgtcccttgggaatccctgataaaatatattgtgttcaatcatttctgaccattccctagattcctcttgattcctggaggaattaaagttattgaatttcaattcattccaacaaccatttattgagtgcccatcttgaggcaagcaagggtagggtaaggatagggagatgaataaaccaattacattttatttaaagaaagacattcatacttcaaagtg

SEQ ID NO: 3646 - DNA, 198 bp, Homo sapiens
  D2S2236
  Located on chromosome 2
  Distance between a terminus base of telomere on chromosomal short arm and 5'-terminus of this base sequence : 150616447
  Distance between 3'-terminus of neighbour sequence of sequence listing upward to telomere on chrosomal short arm and 5'-terminus of this base sequence : -275
agtggctgggcgtgtgtgtgtgtgtgtgtgtgtgtgtgtgtgtgtgtgtgtgtgtcccttgggaatccctgataaaatatattgtgttcaatcatttctgaccattccctagattcctcttgattcctggaggaattaaagttattgaatttcaattcattccaacaaccatttattgagtgcccatcttgaggcaag

SEQ ID NO: 3647 - DNA, 129 bp, Homo sapiens
  DISO7_10000994
  Located on chromosome 2
  Distance between a terminus base of telomere on chromosomal short arm and 5'-terminus of this base sequence : 150777612
  Distance between 3'-terminus of neighbour sequence of sequence listing upward to telomere on chrosomal short arm and 5'-terminus of this base sequence : 160967
aactttcaccgatgtgccaatatatactatatatttatatatatatatatgtgtcatgttttattattctaaaactacattatttataatggctgatcccaatttagtgggtgtgcagtaattatattg

SEQ ID NO: 3648 - DNA, 138 bp, Homo sapiens
  DISO7_10000995
  Located on chromosome 2
  Distance between a terminus base of telomere on chromosomal short arm and 5'-terminus of this base sequence : 151216475
  Distance between 3'-terminus of neighbour sequence of sequence listing upward to telomere on chrosomal short arm and 5'-terminus of this base sequence : 438734
ttggatcatcttaacacataaggggactgtgtgtgtatgtgtgtgtgtgtgtgagagagttagagagagagagagagagagagagagagtgagagagagagagaaacatgccaccacgccaacattccattgttcatg

SEQ ID NO: 3649 - DNA, 233 bp, Homo sapiens
  Z66771
  Located on chromosome 2
  Distance between a terminus base of telomere on chromosomal short arm and 5'-terminus of this base sequence : 151260422
  Distance between 3'-terminus of neighbour sequence of sequence listing upward to telomere on chrosomal short arm and 5'-terminus of this base sequence : 43809
tgacctgcttttccagagacaaacgtttttcttcaaaaccctcttcctactagacatatggttcttacctcctggctctggctttttttcctcctggctctggcttttttgtttttccatccatgctgtggtgctctgtgtgtgtgtgtgtgtgtgtgtgtgtgtgtgtctgaatacttgtggtggaggagccagtgacacagggaaaccagtgcagcagccataataataac

SEQ ID NO: 3650 - DNA, 326 bp, Homo sapiens
  AC068086.2_68092
  Located on chromosome 2
  Distance between a terminus base of telomere on chromosomal short arm and 5'-terminus of this base sequence : 151413571
  Distance between 3'-terminus of neighbour sequence of sequence listing upward to telomere on chrosomal short arm and 5'-terminus of this base sequence : 152916
gacttgagttgactgctacagtttatgatcttccctaaacatcgacgttcctggaaatctttggcctctgagctgacttcttctctgttgcttgtgagccaggaatttaacagctctgttgtatgtgcaggctgcagatgcttctcttcagcttttgctatccaatgtgtgtgtgtgtgtgtgtgtgtgtgtgtgtgtgtgtgtgtgtgtgttggataaacttaaaaaacctgttgcttccatgcaacggcccacacaacttgggactcatggtcagcctcaccttccacattggctaaaactctacaggaaacagtttatggagt

SEQ ID NO: 3651 - DNA, 467 bp, Homo sapiens
  AC012443.5_108462
  Located on chromosome 2
  Distance between a terminus base of telomere on chromosomal short arm and 5'-terminus of this base sequence : 151530463
  Distance between 3'-terminus of neighbour sequence of sequence listing upward to telomere on chrosomal short arm and 5'-terminus of this base sequence : 116566
atgtttagaaagtcacatgcacaatgaaaatgtgtgtttcaggtttgtggagaaaaacagcgctttgagaagttgatggaacatttcaggaatgaagacaataacatagattttatggtgagttatttcagtattcaataaagcaaactcagtttcaatactttttttctaaatacacacacacacacacacacacacacacacacacacatatttatattacaaaggacagggaattgcaattaatatgctatagatccaatctagaatgtccctcttaatctgtatttctctttgatttccattttattccttacatacacggtatagtaaagacaaaagtactaatcatagcaaataaaggggaagccgtgcagttggaaacagccatgcctggtgcaaatgctgccattgtttaattgttgatgatgctgcataagaatccttaaggtagaagcaatcttgac

SEQ ID NO: 3652 - DNA, 280 bp, Homo sapiens
  D2S2299
  Located on chromosome 2
  Distance between a terminus base of telomere on chromosomal short arm and 5'-terminus of this base sequence : 151703771
  Distance between 3'-terminus of neighbour sequence of sequence listing upward to telomere on chrosomal short arm and 5'-terminus of this base sequence : 172841
ccacgttgctgcaaatggcaggattttcttctttttgtggctgaataatattccatcacacacacacacacacacacacacacacacacacacatcattttctttattcattcatccattgatggacactgtattagtttgttctcacactgctataaggaaatacccaagactgggtaatttacaaatgaagaaggtttaattgactcacagttccacatggctggggaggcctcaggaaaattacaatcatggagaaaggggaagcaggcatcttcat

SEQ ID NO: 3653 - DNA, 439 bp, Homo sapiens
  chr2.fa.O7frz.158933148
  Located on chromosome 2
  Distance between a terminus base of telomere on chromosomal short arm and 5'-terminus of this base sequence : 151787651
  Distance between 3'-terminus of neighbour sequence of sequence listing upward to telomere on chrosomal short arm and 5'-terminus of this base sequence : 83600
gacttcctggactggttaatagagatagtggtctgacttcctgcaagtctgatttatagatagtagtttaacctcttgggcttgttcctgtagataatgagttggcttctgggctggttgctgcaatttgtgggtcagagttgtatttttatatatgtctatttgtatattcagtttttcaattttattacccttaaatgcaaatctagtatcatttggtataccacttttattttcaacataattacatgtaagtaactacagaagcatacacacacacacacacacacaccccacacacaaagagacacacaactattaaaaatgttttgtaagtgaaacctgaaataattttatgcaacatcaagcatacatcaagagagatgtgtatcacgcttttgaaaaaactaaattgttggtactcaagatttatgttaaa

SEQ ID NO: 3654 - DNA, 293 bp, Homo sapiens
  chr2.fa.O7frz.159158750
  Located on chromosome 2
  Distance between a terminus base of telomere on chromosomal short arm and 5'-terminus of this base sequence : 152093035
  Distance between 3'-terminus of neighbour sequence of sequence listing upward to telomere on chrosomal short arm and 5'-terminus of this base sequence : 304945
caggtttcagtatgctttgtacttgggagttccagctttatcttgctctttcccaccatacacccacctttaagctctagcatcagatgtgaagaaaacagccttacagggactgctcaactggcccccacaattgtgtaaggtcaagtcactgtaacatttcccatttagagggaagatgaggtacataattagctttacacacacacacacacacacacacacacacacatccacccacccaaacatgtaaaatgggtatttatgtgtttgtacacagaccttcatgaagc

SEQ ID NO: 3655 - DNA, 226 bp, Homo sapiens
  chr2.fa.O7frz.159501258
  Located on chromosome 2
  Distance between a terminus base of telomere on chromosomal short arm and 5'-terminus of this base sequence : 152418333
  Distance between 3'-terminus of neighbour sequence of sequence listing upward to telomere on chrosomal short arm and 5'-terminus of this base sequence : 325005
gtggagttgcataagacagtagagataaatgattattttaactcaagccatttaatgtctgaggttgatatgactttcacatgattcttggtcattctctttttcttttgtgaaatctcagtttatagcctttgcccattattctgttgctttgtgtgtgtgtgtgtgtgtgtgtgtgtgcacgtgtgttcatgcacacatacactttactgtttgtaggcaatca

SEQ ID NO: 3656 - DNA, 446 bp, Homo sapiens
  AC012501.4_118203
  Located on chromosome 2
  Distance between a terminus base of telomere on chromosomal short arm and 5'-terminus of this base sequence : 152535084
  Distance between 3'-terminus of neighbour sequence of sequence listing upward to telomere on chrosomal short arm and 5'-terminus of this base sequence : 116525
tatacgaatggttcctaggaactattggttctcaaaccagatatttaagagtaaataaattgtgtttataatagcatatcaaaactgttgcaaagtaaaatttcttagcatgcatagttaggttatgtcactcaaaaagaggaagcttcactgaggtgggaggattattagagcccaggagtttgaagctacagtgagatataatcacacccctgcactccagcccgggcaaagcaaggccctgttttacacacacacacacacacacacacacacacaaacacacaatacaaaacaggggcagcttcagcaatgcaacattcagtgatgctgatccaaagcaagtaagcttgctaatgtgtttcttattctgtccagaagacaaagtgtcctggcgtgtggaattcatttgttcggttcttgtgacaggaatatctgttaagatg

SEQ ID NO: 3657 - DNA, 270 bp, Homo sapiens
  chr2.fa.O7frz.159623437
  Located on chromosome 2
  Distance between a terminus base of telomere on chromosomal short arm and 5'-terminus of this base sequence : 152540530
  Distance between 3'-terminus of neighbour sequence of sequence listing upward to telomere on chrosomal short arm and 5'-terminus of this base sequence : 5000
ctcatacatcactggtaggactacacaatggtacaatcctttagaaatctgtttggcaatttcttaaaatgttagacattcacctactataagcacaccccagcctgggcaacagaacgagactctgtctcaaaacaaacaaacaaacaacaacaacaaaaacaacaacaacaaaataaaaagactaattcatttcactccttggcatttacccaagagaataaaaacatttgtccacagaaaaatgtatccaggaataccagtacaata

SEQ ID NO: 3658 - DNA, 385 bp, Homo sapiens
  AC012501.4_86637
  Located on chromosome 2
  Distance between a terminus base of telomere on chromosomal short arm and 5'-terminus of this base sequence : 152599774
  Distance between 3'-terminus of neighbour sequence of sequence listing upward to telomere on chrosomal short arm and 5'-terminus of this base sequence : 58974
ttatacaaatgagaaagccagtagtgacagaaatatttaggtctgattgtgtcatgcagtttcatctctccttaactcagcatttttctgatgaattttttcaaagtatatttgaaagaaatgcatctggaatttaaaccagtttcttaagttgtagaccaagcactgttgaaccaaatattagtgtctcagaaaaggtctgttaccaaatccagaaacccgggatgctgtatatgtgtgtgtgtgtgtgtgtgtgtgtgtctgtgtacgcgcacataagtgtgccacacaaactttgtaccttcattgtcttttttgtgtgccttattggagaactgaagtgacaatcatttttcaccctatgttaatgcctaatttaagtcgg

SEQ ID NO: 3659 - DNA, 79 bp, Homo sapiens
  D2S2241
  Located on chromosome 2
  Distance between a terminus base of telomere on chromosomal short arm and 5'-terminus of this base sequence : 152735481
  Distance between 3'-terminus of neighbour sequence of sequence listing upward to telomere on chrosomal short arm and 5'-terminus of this base sequence : 135322
cacttttggttgacttaaagaagtgtgtgtgtgtgtgtgtgtgtgcgcgcgcacatatgtgtgtgtgcatgtgtatgtg

SEQ ID NO: 3660 - DNA, 480 bp, Homo sapiens
  AC068537.2_165092
  Located on chromosome 2
  Distance between a terminus base of telomere on chromosomal short arm and 5'-terminus of this base sequence : 152763008
  Distance between 3'-terminus of neighbour sequence of sequence listing upward to telomere on chrosomal short arm and 5'-terminus of this base sequence : 27448
atctgtctagcttcaacagtaaatgctttgatatttcctaggaacttttgtgttttcattttaaaccagtgatggcagaaagaagcaaataaatggataaacgtgtgtgacaagaaacaattacctctcacctccagctatcactgtccttcagcaactggaagtcagcattaaaaaatcacctgatgggaatttcagggaaattagcagctctcactaaagtcctatatcagtatttcctcttcataataatatatatatatatatatatatcccaggccatgggaatagtcaatgtatttatttaaaagatcctacatcattttacaggtagcctgggagaaattatagtttgatgtgaataatacataacaagtgagattagtagaagagtgaaatttgttatgacaattgttggtatgaatttttatgttttctttatgttatttccatattgttcctagcctatttccataatag

SEQ ID NO: 3661 - DNA, 471 bp, Homo sapiens
  chr2.fa.O7frz.160027450
  Located on chromosome 2
  Distance between a terminus base of telomere on chromosomal short arm and 5'-terminus of this base sequence : 152893285
  Distance between 3'-terminus of neighbour sequence of sequence listing upward to telomere on chrosomal short arm and 5'-terminus of this base sequence : 129797
aaatctaggttcagaacagtcaccgcatcaccgatcacttctttcatactcttagttaaaacaatttggccgggcgcggtggctcacgcctgtaatcccagcactttaggaagccgaggtgggcggatcacgaggtcaggagatcgagaccatcctggctaacatggtgaaaccccgtctctactataaatacaaaaaattaactgggcgcggtggcgggcgcctgtagtcccagctactggggaggctgaggcaggagaatggcgtgaacccgggaggcggagcttgcggtaagccgagatagcgccactgcactccagcctgggctacagagcgagactccgtctcaataaataaataagtaagtaagtaagtaaataaataaataaataaataaataaataaataaataaataaaacaattcatgaccatccctgatttgaggcgtgaggaaacagaaatagactcca

SEQ ID NO: 3662 - DNA, 236 bp, Homo sapiens
  chr2.fa.O7frz.160192992
  Located on chromosome 2
  Distance between a terminus base of telomere on chromosomal short arm and 5'-terminus of this base sequence : 153042888
  Distance between 3'-terminus of neighbour sequence of sequence listing upward to telomere on chrosomal short arm and 5'-terminus of this base sequence : 149132
ggatttcgtgataactattgatactgagcatcaatttctctctctctctgtctctccgtctctctctctctctctctgtgtgtgtgtgtgtgtgtgtgtgtgtgtgtgtgtgtgtgtgtgtgtgtgtgtttggccacacttgttttatgaactatctgttcaatcttttgttcatttttaaaattggattgcctgtggcttgcctttttacttttctaaatgaggtctatgaaaga

SEQ ID NO: 3663 - DNA, 152 bp, Homo sapiens
  D2S321
  Located on chromosome 2
  Distance between a terminus base of telomere on chromosomal short arm and 5'-terminus of this base sequence : 153233585
  Distance between 3'-terminus of neighbour sequence of sequence listing upward to telomere on chrosomal short arm and 5'-terminus of this base sequence : 190461
caaattgggtgactaggagatttgtggttttgctgattgtttatgtttgtgtgtgtgtgtgtgtgtgtgtgtgtgtgtgtataaacatacatatacaaagagaaacacataaatgccacttttaatatggatagtagaattaattttgcaca

SEQ ID NO: 3664 - DNA, 401 bp, Homo sapiens
  chr2.fa.O7frz.160474371
  Located on chromosome 2
  Distance between a terminus base of telomere on chromosomal short arm and 5'-terminus of this base sequence : 153323474
  Distance between 3'-terminus of neighbour sequence of sequence listing upward to telomere on chrosomal short arm and 5'-terminus of this base sequence : 89737
tctaccatagaaagctaccattaagaacaccaacctttctcttactttaagaaaaatgggataggccaggtgcggtggctcacacctataatcccagcatttgggaggccaaggcaggtggatcacctgaggtcaggagttcgagaccaacctagccaacatggtgaaactctgtctctgctaaaaatacaaaaattagccaggtatgatggcaggcacgttgggaggctgaggcaggagaattgcttgaacctgggaggcagagtttgcactgatctgagatctccccactgcactccagcctgggtgacagggcaaggctctgtcaaaataaataaataaataaataaataaataaataaataaataaaacaccagagattaaagttgcttatctttcc

SEQ ID NO: 3665 - DNA, 457 bp, Homo sapiens
  AC073226.3_204409
  Located on chromosome 2
  Distance between a terminus base of telomere on chromosomal short arm and 5'-terminus of this base sequence : 153421192
  Distance between 3'-terminus of neighbour sequence of sequence listing upward to telomere on chrosomal short arm and 5'-terminus of this base sequence : 97317
gcctatgaactaagaattcgttttacatttctaaatgattttttaaaatcaaattaagtatattatatcaaaattctatcaaattcagatttcagtgttcataaaaaaaactttaattacaacacacatgcttatttgtttctgtgttatgtatgactgtctcaactctacaacagcaaagttgaataagtacaacagagactatatgtctcacaaacgctatttgctctccggccctttacagacaaatttgccaaccactggtttatacaattttatacagttgtatctatatgtacagtaaagtgtattatataattaagagtgtgcgtgtgtgtgtgtgtgtgtgtgtgcgagatttcttagggtatttaagctttaaaatatttaaagcatttttttcttatggagctcactgtttcatttgcctgaggtaagctcactgttcttagtacca

SEQ ID NO: 3666 - DNA, 285 bp, Homo sapiens
  AC009227.3_19768
  Located on chromosome 2
  Distance between a terminus base of telomere on chromosomal short arm and 5'-terminus of this base sequence : 153421364
  Distance between 3'-terminus of neighbour sequence of sequence listing upward to telomere on chrosomal short arm and 5'-terminus of this base sequence : -285
acagcaaagttgaataagtacaacagagactatatgtctcacaaacgctatttgctctccggccctttacagacaaatttgccaaccactggtttatacaattttatacagttgtatctatatgtacagtaaagtgtattatataattaagagtgtgcgtgtgtgtgtgtgtgtgtgtgtgcgagatttcttagggtatttaagctttaaaatatttaaagcatttttttcttatggagctcactgtttcatttgcctgaggtaagctcactgttcttagtacca

SEQ ID NO: 3667 - DNA, 366 bp, Homo sapiens
  AC009227.3_148607
  Located on chromosome 2
  Distance between a terminus base of telomere on chromosomal short arm and 5'-terminus of this base sequence : 153550091
  Distance between 3'-terminus of neighbour sequence of sequence listing upward to telomere on chrosomal short arm and 5'-terminus of this base sequence : 128442
ctaatgcatgtaatcctagcactttgggaagccaaggcaggcggattacctgaggtcgggagttcaagaccagcctgaccaacatggagaaaccctatctctactaaaaatacaaaattagccaggtgtggtggcacatacctgtaatcccagctactcaggaggctgaggcaggggaatcacttgagcccagggggtggaggttgcggtgacccgtgattgtgccattgtactctagcctgggaaacaagagcgaaactctgtctcaaaaaataaataaataaataaataaataaataaataaataaataaataaaatatgtaaaattgatgaaataaacagacatagaactgttctttcaaatg

SEQ ID NO: 3668 - DNA, 291 bp, Homo sapiens
  AC009227.3_155893
  Located on chromosome 2
  Distance between a terminus base of telomere on chromosomal short arm and 5'-terminus of this base sequence : 153557589
  Distance between 3'-terminus of neighbour sequence of sequence listing upward to telomere on chrosomal short arm and 5'-terminus of this base sequence : 7132
cgacagatgaattagttctcacgagatctgatcgtttaacagcttggcacttcctccttctctctctctctctctctctctctctctctctctcctgctttgccattgtgaagatgtgcatgctcccacttcaccatctgctgtgactgtaagtatcctgaggcctccagtcatgcttcctattaagcctgtggaactgtgagtcaattaattctctttatttttttttaaagtaaatcactcagtctacagtagttctttataacagtgtcagaatggactaatacacga

SEQ ID NO: 3669 - DNA, 353 bp, Homo sapiens
  AC073226.2_68736
  Located on chromosome 2
  Distance between a terminus base of telomere on chromosomal short arm and 5'-terminus of this base sequence : 153570873
  Distance between 3'-terminus of neighbour sequence of sequence listing upward to telomere on chrosomal short arm and 5'-terminus of this base sequence : 12993
atctactcatccagcaactgacacttatgttgtttccatatcttggctcttatgaagcaatgagcacaggagtgcaaatatctctttaacataataaattctttctttctttctttctttggggtatatacccaatagtggaattgctgtatcatgtggttgtcctatttttaatattttgaggcgtttccatactgttatccataatggttgttctaatttacattcccaccagcagtgcacaagggttttcttttctctatctattctccaacacttgttattttttgtctttttgatgacagccattctaagaagtttgaagtgatatgtcatagtggctttaatttcca

SEQ ID NO: 3670 - DNA, 294 bp, Homo sapiens
  chr2.fa.O7frz.160834254
  Located on chromosome 2
  Distance between a terminus base of telomere on chromosomal short arm and 5'-terminus of this base sequence : 153596286
  Distance between 3'-terminus of neighbour sequence of sequence listing upward to telomere on chrosomal short arm and 5'-terminus of this base sequence : 25060
gttcagagcataacaggtacagttaataagtacttcatagaagcattaaaatttccaaagaccttgttaataacaagaacagtaccatttagaacattactgtggatttatataataagtatccttcaaaaagcttgaaataaaatgaatttgctaaagttgttcagttgatgagttgtctctccaaataaagtgggtgagggaaaacacacacacacacacacatacacacacacacacacacacacacacacacacacaaaaccagtagcttcctgagcgctcaactatgac

SEQ ID NO: 3671 - DNA, 277 bp, Homo sapiens
  AC010730.10_38053
  Located on chromosome 2
  Distance between a terminus base of telomere on chromosomal short arm and 5'-terminus of this base sequence : 153626855
  Distance between 3'-terminus of neighbour sequence of sequence listing upward to telomere on chrosomal short arm and 5'-terminus of this base sequence : 30275
aatagtgtaatgaattcctgtcagggttcattttacagtttcctaggattattgctataattcttctccctttatttattgaatcttagtgtcaaaattcattggaaattcttgggaagaaactcacaggtgtgtgtgtgtgtgtgtgtgtgtgtgtgtgtgtgtgtgtcagagagagagagaaagagagagatagagaatccatttgcatgtgctgtttattttctagaaattcctctatttctgtctcattctgacaatgctatctggtttatag

SEQ ID NO: 3672 - DNA, 238 bp, Homo sapiens
  chr2.fa.O7frz.160960075
  Located on chromosome 2
  Distance between a terminus base of telomere on chromosomal short arm and 5'-terminus of this base sequence : 153825260
  Distance between 3'-terminus of neighbour sequence of sequence listing upward to telomere on chrosomal short arm and 5'-terminus of this base sequence : 198128
tgcagaacttgtctatatggagggtcaactgtatgtgtgtgtgcgtatacacagatatatatatatatatatatatgtatatatgtgtatatatatgtgtgtgtgtgtgtgtgtgtgttttcaaatatttcaagatatttcaattttgaaatttatttggaaaaagaatcacagggagcacaagaaaattcataaagtctttttaaaactacattggaaattaataggcaccaaactc

SEQ ID NO: 3673 - DNA, 175 bp, Homo sapiens
  chr2.fa.O7frz.161042449
  Located on chromosome 2
  Distance between a terminus base of telomere on chromosomal short arm and 5'-terminus of this base sequence : 153944060
  Distance between 3'-terminus of neighbour sequence of sequence listing upward to telomere on chrosomal short arm and 5'-terminus of this base sequence : 118562
tggaaatctatttctgtcacagtctgtgaacaaatgtctggccaggttttattttatacttcttcgtggaagataaaacaaaacaaaacaaaacaaaacaaaacaaaacaaaacggattaaaattaacatctataacttcaatattctgaatctaagaatgtatctcaagtccac

SEQ ID NO: 3674 - DNA, 450 bp, Homo sapiens
  AC022925.2_144276
  Located on chromosome 2
  Distance between a terminus base of telomere on chromosomal short arm and 5'-terminus of this base sequence : 154063103
  Distance between 3'-terminus of neighbour sequence of sequence listing upward to telomere on chrosomal short arm and 5'-terminus of this base sequence : 118868
atacctaagcgtaggaacaaagaatacagtgaatcattcttacttcagggccataggaaatcttacacatataaacttcctagcaggatcttaaatgaggagaaactttctagggattacggaggcaaagagaagatgggggacattccagaaagtatcttgaagaaatatggcatacttggggtatacaagctgttcactgttcaaatgatcaaatggaggggaggagcagagagagaaataggcatgggtcaaatcacagagatccttgattacatgccgtgtgtgtgtctgtgtgtgtgtgtgtgtgtgtgtgtgtgtgtacttaaactttcctatagcttcatgaagctacctctcaaatatttattcctaggtctggccactttcttgatgttcagacacacatttccaactactttcagagcatttcatattggtactccatca

SEQ ID NO: 3675 - DNA, 330 bp, Homo sapiens
  D2S1388
  Located on chromosome 2
  Distance between a terminus base of telomere on chromosomal short arm and 5'-terminus of this base sequence : 154118351
  Distance between 3'-terminus of neighbour sequence of sequence listing upward to telomere on chrosomal short arm and 5'-terminus of this base sequence : 54798
ttttagagtatgtggcatgtgcagataagaggaatgtattttctgtggttgatgggtgaagcgttctatagatagatagatagatagatagatagatagatagatagctagatagatatagatagatagatagatatagatatatctgttaggtctatttcatcaagtgtttagtttaggtccccaaatatctttgtcagttttgtgccttgatgatatttctaatactgtcagtgagatgttgaagtctcccactattattgtgtggttatctaagttttttttgtagttgtctatgaatttgtttgataaatctggatgcaccagtgt

SEQ ID NO: 3676 - DNA, 358 bp, Homo sapiens
  AC022925.2_84899
  Located on chromosome 2
  Distance between a terminus base of telomere on chromosomal short arm and 5'-terminus of this base sequence : 154134341
  Distance between 3'-terminus of neighbour sequence of sequence listing upward to telomere on chrosomal short arm and 5'-terminus of this base sequence : 15660
ataattagtgagcttgagttgaacacaggctatttgaaaatacacagccacaggagaccaaagaaaaaagaacaaaaaagaattaagcatgctacaagatctagaaaatagcaaaaaaaaaaaaaaaataggcaaatctaagagttattgccatagagagaaggcagataaagagatggtgtagaaagtttattcacagttcattcaaaggaaaatatctatgtgtgtgtgcatatatatatatatatatatatatatatatatatacatataacatgtataaaatatattatatataatatatataatatatattttttcaaatacaagaaggctatagaacaccaagcagatttaa

SEQ ID NO: 3677 - DNA, 286 bp, Homo sapiens
  chr2.fa.O7frz.161583491
  Located on chromosome 2
  Distance between a terminus base of telomere on chromosomal short arm and 5'-terminus of this base sequence : 154364460
  Distance between 3'-terminus of neighbour sequence of sequence listing upward to telomere on chrosomal short arm and 5'-terminus of this base sequence : 229761
caaagacaggccttgtttaaaagaaaaaaaagaaaaagaaagaaagagagaaacagagaaagaaagaaagaaagaaagaaagaaagaaagaaagaaagaaagaaagaaagaaagaaagaaagaaagaaagagaaaagaaagaaagaaagaaagaaagaaagaaagaaagaaagaaagaaagagagagagaggaaggaaggaaggaatgattcaaggagagtaacaaattctttagtaatagatagaaggagacctgtactcagttactcattcgtttatctgaaac

SEQ ID NO: 3678 - DNA, 260 bp, Homo sapiens
  D2S142
  Located on chromosome 2
  Distance between a terminus base of telomere on chromosomal short arm and 5'-terminus of this base sequence : 154451696
  Distance between 3'-terminus of neighbour sequence of sequence listing upward to telomere on chrosomal short arm and 5'-terminus of this base sequence : 86950
tgaaaagttttgagatggagagattatcttagattacccagggctgttcaatgcaatcacaagactcttgaaaagaaaagaaggtaggagagtcagagtcagaaaagaagacaaaagtaaaggggtgtgtgtgtggatgtgtgtgtgtgtgtgtgtgtgtgtgtgtgagagagagagagagagagagagaaagagagagagatttgaagatggaacttttggagaggaaataattcttctctacccgttcagtgtctcca

SEQ ID NO: 3679 - DNA, 376 bp, Homo sapiens
  chr2.fa.O7frz.162011473
  Located on chromosome 2
  Distance between a terminus base of telomere on chromosomal short arm and 5'-terminus of this base sequence : 154813218
  Distance between 3'-terminus of neighbour sequence of sequence listing upward to telomere on chrosomal short arm and 5'-terminus of this base sequence : 361262
tctaatttagtcattctgccttacaatcagccattacatcccttggggaaatgtaaaatttaaacagacattaaactcaaataacttccctgcctatcagagaaatgacaaggaaatactgttacatatcatgtcatttatgacacttgtgattaagagcatatatatatatattatatatatatatatacacacacacacacacacacacacacacacatgttgaatgctaaagaactggatgtactgaacggatgtatttggatattcccaaattttaaaaggaaaaaaatcatagtaaaataaattataaagtaaaaatacagttttagttggtatcaactttaaaaagctgtgcttcaaatgttgatagaac

SEQ ID NO: 3680 - DNA, 346 bp, Homo sapiens
  chr2.fa.O7frz.162095572
  Located on chromosome 2
  Distance between a terminus base of telomere on chromosomal short arm and 5'-terminus of this base sequence : 154859753
  Distance between 3'-terminus of neighbour sequence of sequence listing upward to telomere on chrosomal short arm and 5'-terminus of this base sequence : 46159
tatttctcatatcagttgtcttgacatttaatgtttatgtatatttacatatatgtatatatatgtgtgtatatatgtatgtaaaattgtatatacatatatataattgtatacatctttggatatgtaattatatacaatatgtatataaaattgtaaaaatacatatatatatatatacatgtacacacacacacacacacacacacacaataattctgggaaattctgcctaattgcagtttcctgtgtttctgctgggactagaaaataatttgctaaaatgaaaaatatgtgtctctctttaaaaaaaaattgaaaatactaaagctgtctccttcacttt

SEQ ID NO: 3681 - DNA, 371 bp, Homo sapiens
  chr2.fa.O7frz.162170592
  Located on chromosome 2
  Distance between a terminus base of telomere on chromosomal short arm and 5'-terminus of this base sequence : 154934004
  Distance between 3'-terminus of neighbour sequence of sequence listing upward to telomere on chrosomal short arm and 5'-terminus of this base sequence : 73905
ttcactttggtcagaatgtaagaatctgttaaagaatatatatacatatatacacacacacacacacacacacacacacacatgcacatatatatatttttaaatggtttctgataaaatctgccagtactccagagagtgctaactgaagtgaaaacagagtaattccattttctgaaatgttttcagttcagttcaagggaaagaagataggtgaaaatagctaacatgcatgctacccgcagtgtgttaacttactataaccaaaacatttcattttgaattatatgttacacatttgtatgattacaagagtaaaaaggaaaaaaaaatgccatttagaatatcttgattcctaacttgagtaatca

SEQ ID NO: 3682 - DNA, 156 bp, Homo sapiens
  D2S141
  Located on chromosome 2
  Distance between a terminus base of telomere on chromosomal short arm and 5'-terminus of this base sequence : 155005215
  Distance between 3'-terminus of neighbour sequence of sequence listing upward to telomere on chrosomal short arm and 5'-terminus of this base sequence : 70840
ttttccaaacagatacagtgaacttcataaaacaataatgaatttctagtgacccaggtagtggtactctgtgtgtgtgtgtgtgtgtgtgtgtgtgtgtgtgtgtgtgtgtggtggataaggaggtgtggctggggagtgggggtagtaattagt

SEQ ID NO: 3683 - DNA, 408 bp, Homo sapiens
  chr2.fa.O7frz.162352984
  Located on chromosome 2
  Distance between a terminus base of telomere on chromosomal short arm and 5'-terminus of this base sequence : 155069811
  Distance between 3'-terminus of neighbour sequence of sequence listing upward to telomere on chrosomal short arm and 5'-terminus of this base sequence : 64440
aagtcttagccagagcaattaggcaagagaaagaaataaaagatatcgaaataggaaaaaaagaagtcaaactatctctcttcgctgataataggattctatacctagaaaaccctgaaaattccaccaaaaggctcctgagttaatgaacaacttcagtaaagttttgggaaataaagtcaatgtataaaaatcaatagcacttctgtatagcaatatcattcaagctcagagccaaatcaagaatgcagttccatttacaatagacacacacacacacacacacacacacacacacacacacacacatatctaggaatacatctaatcaaggaattgaaagctctctacaagcagagctacaaaacactcctgaaaaaaatcatagataactcgaccaaatctaaa

SEQ ID NO: 3684 - DNA, 403 bp, Homo sapiens
  AC068552.2_217895
  Located on chromosome 2
  Distance between a terminus base of telomere on chromosomal short arm and 5'-terminus of this base sequence : 155202048
  Distance between 3'-terminus of neighbour sequence of sequence listing upward to telomere on chrosomal short arm and 5'-terminus of this base sequence : 131829
attcggatctcctagtaaagttagcagcactccacagaatcacatttcaaaagttccaatttaaagggttgtttttcttccacaactggctatttcctggaacaccactcataggacttgtatgaaatatactatgagcatgaacttatttgttttatttgcaagaatggctcagtgttagcaatagacaggggcatgcacacacacacacacacacacacacacacaaacacacacaaacacacacacttacaaccagacaacagctataactggctgcaagacgttgaatacttctctcctccttgctcctgttccagcttccagaaatgtttactttaacctttgattctcctgtccgtgtttcttgctcttccttttgacttaacatcagtggattcct

SEQ ID NO: 3685 - DNA, 298 bp, Homo sapiens
  AC068552.2_199760
  Located on chromosome 2
  Distance between a terminus base of telomere on chromosomal short arm and 5'-terminus of this base sequence : 155221613
  Distance between 3'-terminus of neighbour sequence of sequence listing upward to telomere on chrosomal short arm and 5'-terminus of this base sequence : 19162
gaggtttattgcaagacaaaggaaactcagtaaaaaagtttcaagtgggaaagtggaattattagatttttgcagggagatcactctagctatagtgggtgtattagtcagggtttctcagaaaagtagaaccaatagggtgtgtgtgtgtgtgtgtgtgtgtgtgtgtgtgtgtgtgtgtgtgtgtgtggagagacagagagagagagatttattataaggaattggctagtgcaattatggcatatcccaagattcgtctagtgagtcagcaagctggagaccaaggtaagtattt

SEQ ID NO: 3686 - DNA, 319 bp, Homo sapiens
  AC073847.1_14612
  Located on chromosome 2
  Distance between a terminus base of telomere on chromosomal short arm and 5'-terminus of this base sequence : 155316998
  Distance between 3'-terminus of neighbour sequence of sequence listing upward to telomere on chrosomal short arm and 5'-terminus of this base sequence : 95087
ctttcttagacacaagctttccaaatattttctcccagttattgtcttgtcttttcattcttttaaaggtgtcttttgaggagctaaaattttctttttataaagtccagtctatcaatattttttcttttatggatcctgctcttggcatcacatctaagaaatgtttgtctaacccaaggttgcacaaagattctctacttttttgtcttctacaagttgtattatgttatcttgtacattacgtttatggtttgttgttgttgttgttgttgttgttgttgttgttgtttttaggtggagtctcactctgtcagtc

SEQ ID NO: 3687 - DNA, 202 bp, Homo sapiens
  D2S2360
  Located on chromosome 2
  Distance between a terminus base of telomere on chromosomal short arm and 5'-terminus of this base sequence : 155495488
  Distance between 3'-terminus of neighbour sequence of sequence listing upward to telomere on chrosomal short arm and 5'-terminus of this base sequence : 178171
agctaggcacagatacagagaaaataaaactcgtgtgtgtgtgtgtgtgtgtgtgtgtgtgtgtgtgtttatctatttctttccatcatctatctatgtatctatgatgaaggtaaaatagttaatttaaaagttgactaaactggtggagttttgatctaaaaataaggtagaattctactcatggaaattacccattttt

SEQ ID NO: 3688 - DNA, 396 bp, Homo sapiens
  chr2.fa.O7frz.163066599
  Located on chromosome 2
  Distance between a terminus base of telomere on chromosomal short arm and 5'-terminus of this base sequence : 155517718
  Distance between 3'-terminus of neighbour sequence of sequence listing upward to telomere on chrosomal short arm and 5'-terminus of this base sequence : 22028
ggtcaggagttcaagactagactggccaacatggtaaaccccgtctctactaaaaatacaaaaaattagcctgttgtggtgccaggtgtctgtaatcccagctactcaggaggctaaggcaggagaatcacttgaacctgagaggtggaggttgcagtgagctgagattgtgccattgcactccagcctgggcaacaagaatgaaactctgttaaaaaaataataataaataaaaggaaggaaggaaggaaggaaggaaggaaggaaggaaggaaggaaggaaggaaggaagaaagaaaataaatagatgggttaagccctggactgaacaaggttgaaaaacaattaatgaggtagaagattttagtaagaaagtcactcagaagttcagaaaga

SEQ ID NO: 3689 - DNA, 475 bp, Homo sapiens
  chr2.fa.O7frz.163214713
  Located on chromosome 2
  Distance between a terminus base of telomere on chromosomal short arm and 5'-terminus of this base sequence : 155698226
  Distance between 3'-terminus of neighbour sequence of sequence listing upward to telomere on chrosomal short arm and 5'-terminus of this base sequence : 180112
taactgcttaaatgctaaccagctttgtggagtttgtttgagatgaatgactattttcagattgcatttcagccatttatattacaatgctgtatcagtgcaaaataacagagttgctgtgagctgccacccagctgctcatttccctgtcagaagctgtttcttttcagaggtaatctggtaagaggcaacttgccacctgaaagaatattggtggatgtcaaaaagaaagacactctacacacacacacacacacacacacacacacacacacacacactaacacacacagagcaagagagagagagagactattactaaaaaagtatttaataataagaatgcaagttgatgtaaaaccctatgtaaaagttttggatcaaactgtagaagattgaaatgtttagaggtcttgaaaataaattgtattgactttttagcaacaataatgatttaattccaaggatgtttaac

SEQ ID NO: 3690 - DNA, 313 bp, Homo sapiens
  chr2.fa.O7frz.162973227
  Located on chromosome 2
  Distance between a terminus base of telomere on chromosomal short arm and 5'-terminus of this base sequence : 155784704
  Distance between 3'-terminus of neighbour sequence of sequence listing upward to telomere on chrosomal short arm and 5'-terminus of this base sequence : 86003
ttatgtatttgatacagtctgcactgtatttcttattttgtaggggattagggagaggagaggacaggagaggagaggagaggagaggagaggagaggagaggagaggagagatgtatcattccaagtctgcttagcctttctccacttagacactcaagtttctgttcccattttcatgtatctcctgaaaatgtcatttcagttcccagcatcaattctatagaatgaattttatgactcttctctgggcatttttcaaatgatctttgagtaacacatcttcaaggctattactcacatctggcatagac

SEQ ID NO: 3691 - DNA, 331 bp, Homo sapiens
  AC011308.6_125934
  Located on chromosome 2
  Distance between a terminus base of telomere on chromosomal short arm and 5'-terminus of this base sequence : 155838591
  Distance between 3'-terminus of neighbour sequence of sequence listing upward to telomere on chrosomal short arm and 5'-terminus of this base sequence : 53574
tgtaggaaatgagaatttagtcagatgattcttaagtgttctggaaaacaaaaaacaaaaattagactgagagttatacaaagcaaaatttagttgtcaatacataagattggtggaggctacctctccattttacctaagcaggaaaacataatatttaaggacatatattatttccaaataaaattccactcttctctctctctctcgctctctctctctctctctcacacacacacacacacacacacacacacacgagatacccttcctcattctttctttattttaaagtactgcacctatttggtttcaaaataggagccttcta

SEQ ID NO: 3692 - DNA, 481 bp, Homo sapiens
  chr2.fa.O7frz.162810527
  Located on chromosome 2
  Distance between a terminus base of telomere on chromosomal short arm and 5'-terminus of this base sequence : 155947111
  Distance between 3'-terminus of neighbour sequence of sequence listing upward to telomere on chrosomal short arm and 5'-terminus of this base sequence : 108189
ttctaaggcagtttgattacacaggaatttgggatacagattttattgaaggattgatctggaggttctaggagaagccttggaatggccataggccctatattaactgggagaccgaaaccctgcgtcagggagagggggtagtgggagggaagaaaggaggggaggggagagaaggaaggagggtagtgaaggaaggaggggaggggaggggaaggaaggaaggaagggagggaagaaggaagggaggggaggggaggaaacaggaaagagggaagagggaggggaggaaggaaggggagcggaggggagaggagggaagggacgaagagaagggagcgagggagggagggagggagggagggaggaaggaaggaaggaaggaaggaaggaaggaaggaagaaggaaggaaaaaactctatgtcctgaggaaaccctgggcccaccatcatttattcatcaaacttattcatccaatca

SEQ ID NO: 3693 - DNA, 206 bp, Homo sapiens
  DISD22_0001974
  Located on chromosome 2
  Distance between a terminus base of telomere on chromosomal short arm and 5'-terminus of this base sequence : 156095571
  Distance between 3'-terminus of neighbour sequence of sequence listing upward to telomere on chrosomal short arm and 5'-terminus of this base sequence : 147979
catagccattggataatttgggatgggaatactggggttcacagatatgagatacaaattaatataaacatcaaaatatatatacgcatatatacacatacacacataggtagagagtgtttatgtatacacgcatacacacacacacacacacacacacacacacacactgccagttcactaaaatacacgtacaggatgaggca

SEQ ID NO: 3694 - DNA, 103 bp, Homo sapiens
  DISD22_0001981
  Located on chromosome 2
  Distance between a terminus base of telomere on chromosomal short arm and 5'-terminus of this base sequence : 156281055
  Distance between 3'-terminus of neighbour sequence of sequence listing upward to telomere on chrosomal short arm and 5'-terminus of this base sequence : 185278
ttgtttctgtcagcaacaatcaacacacatacacacacacacacacacacacacacacacgtacacacaggttttgctaaaatgtgatcctatgcagggcagt

SEQ ID NO: 3695 - DNA, 464 bp, Homo sapiens
  AC019201.2_122726
  Located on chromosome 2
  Distance between a terminus base of telomere on chromosomal short arm and 5'-terminus of this base sequence : 156371502
  Distance between 3'-terminus of neighbour sequence of sequence listing upward to telomere on chrosomal short arm and 5'-terminus of this base sequence : 90344
ttagtcagtggcgatcaacattgaggcaagaccctccacaagcaagaacattataactcaggctgaagttgcatgtgaacattagcattttagcaataaagtatttttgaattaaggtagtatattttttagacataatgttcttgtacacttaatagactacagtatagtgtaaatataacttgtatatgctctgggaaaccaaaaaaatgtgctactcactttattgtgatatttgctttattgtggtggtctggaacaaaagccacaatatctccaaggtatgcttgtatatatatatatatatatatatatatgattagaatgaaatgtggatactatgcctttttccttctccacaaaccacaaaaaataaatgggcttccaattataatggtctgtcattcagactcctaagctgctgtttaaattctgcttttcgattcaccttctatggtttcttt

SEQ ID NO: 3696 - DNA, 418 bp, Homo sapiens
  AC019201.2_47829
  Located on chromosome 2
  Distance between a terminus base of telomere on chromosomal short arm and 5'-terminus of this base sequence : 156462291
  Distance between 3'-terminus of neighbour sequence of sequence listing upward to telomere on chrosomal short arm and 5'-terminus of this base sequence : 90325
aataccttggcaactaaagaatacatcaattataaagatattcacgtaaaatctatatttatagatatgtacagatatgtatacaggtatatgtggggtgtgtgtgtgtgtgtgtgtgtgtgtgtgtgtgtattaggaagacagagagagagattgattttaaaaacattttcaggctaagaggcacataaattaaatcatcactattaatggatgacagcagtccactgtaccctaggaatctgataaagttaggtaaatatttttaatttttattcttaatattttaaaatgccaaatggaaattatacatttgcttaatataaggccacccactcaggccaactgactcacccatttttataaatgactactaaaattgtaccaattcattgtaatactgaccttaagctgatgt

SEQ ID NO: 3697 - DNA, 317 bp, Homo sapiens
  chr2.fa.O7frz.163774580
  Located on chromosome 2
  Distance between a terminus base of telomere on chromosomal short arm and 5'-terminus of this base sequence : 156470772
  Distance between 3'-terminus of neighbour sequence of sequence listing upward to telomere on chrosomal short arm and 5'-terminus of this base sequence : 8063
cattgaataaaggtgataagtcacatccagatgtggatggacgagctctagggagaactttcaccttagtgttccccaaatagacactcctccactctgcttaccttctggagctgcctggattcgctctgccccctataggggacttgtctttgagaatggtaagtggatcggcagagaaaggccaataggaagcaacagttggaatgatcctcaccttctccacttttgttttcagagtctagaaagttatgtgtgtgtgtgtgtgtgtgtgtgtgtgtgtgtgtgtgtgtgtgtgtagcagaaggaactacaga

SEQ ID NO: 3698 - DNA, 390 bp, Homo sapiens
  AC019201.2_38370
  Located on chromosome 2
  Distance between a terminus base of telomere on chromosomal short arm and 5'-terminus of this base sequence : 156471736
  Distance between 3'-terminus of neighbour sequence of sequence listing upward to telomere on chrosomal short arm and 5'-terminus of this base sequence : 647
tctgtacatgttcaatacagctacaaccatccatttttattttctaatattttcaatccattgttgattgaattcacagatgtggaacccatggatacagaggactgactgcatatatatatatatatatatatatatatatatatctcatatatttatttatttctgtatatgtatgtgtatatatgtatatgtatatacatatgtgtatatgtaagtgtgtatatgtattattgaagtcctaagaagacactagctgaatttacagactggaagggatcttagagtcatctcatctactcccttagtttgcaggtaaacaaatgaaggctcagaaaagatggcagtcttgctcaaaggaatagagtaatttaatggcagaactatgac

SEQ ID NO: 3699 - DNA, 158 bp, Homo sapiens
  DISO7_10009088
  Located on chromosome 2
  Distance between a terminus base of telomere on chromosomal short arm and 5'-terminus of this base sequence : 156646474
  Distance between 3'-terminus of neighbour sequence of sequence listing upward to telomere on chrosomal short arm and 5'-terminus of this base sequence : 174348
gcaattgaagaactaagggaacatacacacacacacacacacacacacacacacacacacacacacacggattaagggaaggggaagaattgtttaaagtagtatatgaaaaacttgtttgagtattgtttaatccctagaggctaactgtcaaacgg

SEQ ID NO: 3700 - DNA, 438 bp, Homo sapiens
  AC013731.8_83226
  Located on chromosome 2
  Distance between a terminus base of telomere on chromosomal short arm and 5'-terminus of this base sequence : 156841056
  Distance between 3'-terminus of neighbour sequence of sequence listing upward to telomere on chrosomal short arm and 5'-terminus of this base sequence : 194424
tgtcaatagtgctaaggttgagaaaccccggattaaggtgtccaagccaaagggctgtatccttgtgtgcacagggcttgtgtggaaggctgtatcctgctggaggagtggaggagccttttgcctcttgctttacacacacacacacacacacacacacacacacacacactttatgtcgaaaggccacaagtactgttacaggaccccaacacttacccaaaggtagccgttgggtcagggtttctgcactaaagtcccttctgtggttgccaggaatatgttttagggcaggggtcccaatccagaccccaagagagggttcttggatctcacgcaagaaagaattcagggcgagtccgcagtgtaaagtaaaagccagtttattaagaaagcaaagtggtgaaaggacacctactccatagacaaagtaggatg

SEQ ID NO: 3701 - DNA, 466 bp, Homo sapiens
  AC013731.8_111747
  Located on chromosome 2
  Distance between a terminus base of telomere on chromosomal short arm and 5'-terminus of this base sequence : 156873881
  Distance between 3'-terminus of neighbour sequence of sequence listing upward to telomere on chrosomal short arm and 5'-terminus of this base sequence : 32387
taataggatgcctatctgttctacaaacatcaaatatgggtctatttccttttaaacgcagtcgtctaaagcttgctcagcagtagacaagctacactgctattacagatttctgttatcggccccattatttatctcttttggattaagtattagtacttaacatttgctttttaaccaaggttgaggatactagagtgtattataaatagggtttctctttggtttttaaaattttcctactaaatatataaaaacaaaatgccttccatagaacacacacacacacacacacacacacacacacacacacacacacacacacaaacacaatagggagttgagtcacagaggaaagacggcactaaggcaactgctattatgattagagtatgctaggctatagcactcactggatattccatttttttaaaaaaacagcaattgcaattaaagtatgatatgc

SEQ ID NO: 3702 - DNA, 242 bp, Homo sapiens
  D2S284
  Located on chromosome 2
  Distance between a terminus base of telomere on chromosomal short arm and 5'-terminus of this base sequence : 156873989
  Distance between 3'-terminus of neighbour sequence of sequence listing upward to telomere on chrosomal short arm and 5'-terminus of this base sequence : -358
atttctgttatcggccccattatttatctcttttggattaagtattagtacttaacatttgctttttaaccaaggttgaggatactagagtgtattataaatagggtttctctttggtttttaaaattttcctactaaatatataaaaacaaaatgccttccatagaacacacacacacacacacacacacacacacacacacacacacacacacacaaacacaatagggagttgagtcaca

SEQ ID NO: 3703 - DNA, 225 bp, Homo sapiens
  Z23467.1_187
  Located on chromosome 2
  Distance between a terminus base of telomere on chromosomal short arm and 5'-terminus of this base sequence : 156874053
  Distance between 3'-terminus of neighbour sequence of sequence listing upward to telomere on chrosomal short arm and 5'-terminus of this base sequence : -178
tttaaccaaggttgaggatactagagtgtattataaatagggtttctctttggtttttaaaattttcctactaaatatataaaaacaaaatgccttccatagaacacacacacacacacacacacacacacacacacacacacacacacacacaaacacaatagggagttgagtcacagaggaaagacggcactaaggcaactgctattatgattagagtatgct

SEQ ID NO: 3704 - DNA, 411 bp, Homo sapiens
  AC013731.8_43962
  Located on chromosome 2
  Distance between a terminus base of telomere on chromosomal short arm and 5'-terminus of this base sequence : 156905380
  Distance between 3'-terminus of neighbour sequence of sequence listing upward to telomere on chrosomal short arm and 5'-terminus of this base sequence : 31102
tatggtcacagcactgcattacagactgggcgacagagtaagaccctgtcaaaaaaaaaaaaaaagaaacaaaagaaaagaaagataaagagagagaaggaaaggaaaggaaaggaaaggaaaggaaaggaaaggaaaggaaaggaaaggaaaggaaaggaaaggaaaggaaaggaaaggaaaggaaagggaaagggaaaaggaaaaggaaaggaaaggggagaggggagaggggagaggggaaaaggaaaagaagaaggaagggaaaggaaaggaaaggaaaggaaaggaggaaggtaggaaaagaaaggaaggaaggaagggaaagaaagaaagagagaaacagagagaaagagaaagaaagaaaaaaaaacaaaaagcattaataatttcaagctcataaacttggta

SEQ ID NO: 3705 - DNA, 289 bp, Homo sapiens
  AC011900.5_71100
  Located on chromosome 2
  Distance between a terminus base of telomere on chromosomal short arm and 5'-terminus of this base sequence : 157062210
  Distance between 3'-terminus of neighbour sequence of sequence listing upward to telomere on chrosomal short arm and 5'-terminus of this base sequence : 156419
aactttaactccgaactcagactgttctcctctaccctaacagctcagctttaaatagttctattttactctggcagacaggcagtgggcattcatagatctttgcaatattaaacactcagagaaccagctggtgcgtgtgggtatgtgtgaaagagtgtgtgtgtgtgtgtgtgtgtgtgtgtgatcctcacatgaggaatctgggctcttatgattctttaagcccctcactcagaaatctgatgtcacattctctgggagtgaggattcataatcagaggttatc

SEQ ID NO: 3706 - DNA, 470 bp, Homo sapiens
  AC011900.5_92569
  Located on chromosome 2
  Distance between a terminus base of telomere on chromosomal short arm and 5'-terminus of this base sequence : 157083653
  Distance between 3'-terminus of neighbour sequence of sequence listing upward to telomere on chrosomal short arm and 5'-terminus of this base sequence : 21154
tttcttaaagctgcacataaagctacaattatctcaaaattaaaactttacttaaaaataagtggaaagtatgggaagtatgtttagaattaattttgattaaaattatgttaaatgtatagattaatttgggttgttctgatatgtttacagtatagatctttccatctgggagcatgtctttgtgtgtgtgtgtgtgtgtgtgtgtgtgtgtgcacaccacacttcggaaggtcctttaacaaatcttagtaatttttaaaacaaattaaaaattttattattccttacttttccttcattgctgtgcttcttattctaaaagtttcaaaatagaatgtctatctatataaaataggtttaaaatagtggatttccatacttcaagtccttttctatgatattatcttacttactatcaaaagaaatcttctcaaagttctgattggtcatagcctttagtgaaacaa

SEQ ID NO: 3707 - DNA, 155 bp, Homo sapiens
  D2S2395
  Located on chromosome 2
  Distance between a terminus base of telomere on chromosomal short arm and 5'-terminus of this base sequence : 157131559
  Distance between 3'-terminus of neighbour sequence of sequence listing upward to telomere on chrosomal short arm and 5'-terminus of this base sequence : 47436
gctgtcttagttgggtggaatacctagtagaaaattaatctggaaggaaggcatttgcagtgtgtgtgtgtgtgtgtgtgtgtgtgtgtgtgtgtgtgtgtgttttgcttttgtttttttttactacttatgcttattggttctttcatttgctg

SEQ ID NO: 3708 - DNA, 439 bp, Homo sapiens
  AC011900.5_143487
  Located on chromosome 2
  Distance between a terminus base of telomere on chromosomal short arm and 5'-terminus of this base sequence : 157134498
  Distance between 3'-terminus of neighbour sequence of sequence listing upward to telomere on chrosomal short arm and 5'-terminus of this base sequence : 2784
catctatgctattgtcttccagttttctgccaaacatttgagcagcagagattagaaagcaatcattttcagaccattttacgtccagggattttcatatgggcaatatcttaaaaattcaacatacacaaaagttataaaatgaagtctctttcccagctgtaatgcagaaactgagctacttctccagagaagatttgatgcttctagtgaatctgtgctctgtgtgtccttccaaagatgttctaagcacattacacacacacacacacacacacacacacacacacacacacataaacacacatcatttttatttctacacaaagagtagaatgctctgtacattgttcttttctggctttaaaaaaatttaacaatttatctttgagattattccatataagtttataaagagtttatgaagagcatcctttct

SEQ ID NO: 3709 - DNA, 469 bp, Homo sapiens
  AC025057.3_115455
  Located on chromosome 2
  Distance between a terminus base of telomere on chromosomal short arm and 5'-terminus of this base sequence : 157134658
  Distance between 3'-terminus of neighbour sequence of sequence listing upward to telomere on chrosomal short arm and 5'-terminus of this base sequence : -279
tgtaatgcagaaactgagctacttctccagagaagatttgatgcttctagtgaatctgtgctctgtgtgtccttccaaagatgttctaagcacattacacacacacacacacacacacacacacacacacacacacataaacacacatcatttttatttctacacaaagagtagaatgctctgtacattgttcttttctggctttaaaaaaatttaacaatttatctttgagattattccatataagtttataaagagtttatgaagagcatcctttctctctgtctcaatctctcactcataatggcagcatattttcccataatatgaatgtaaaataatttatttaacccatatcatattcatgggcataaatggtatttctaatattttgctgcaatgaataaccatgtacatactcttgtcattcctagtatgtttaattgtacatgtaggacacctttctaga

SEQ ID NO: 3710 - DNA, 401 bp, Homo sapiens
  AC011900.5_176572
  Located on chromosome 2
  Distance between a terminus base of telomere on chromosomal short arm and 5'-terminus of this base sequence : 157167699
  Distance between 3'-terminus of neighbour sequence of sequence listing upward to telomere on chrosomal short arm and 5'-terminus of this base sequence : 32572
catttcaaagccttagaaagtccagggcatcatgaattatacacttgtcttttctgtatttctgtattgctgtcttaccagtgcttatggaagtgtaagaaagggactttgcattataaagtactttgttttacacacatacacacacacacacacacacacacagagctactcagaattgggtgcaccaattcaaagctgttgaatacaagaaaatataaatatatacattttatcttttataagataaaagatttcttatcaaccttccaccacaacaaacaatgagtattccaggggcagatcatagggcatccactgagccttccaaaaaaggaagaaggacttatggtgaaggaacttaaacccggatagaaaaataaccagatgtagcattgtag

SEQ ID NO: 3711 - DNA, 342 bp, Homo sapiens
  AC025057.3_36452
  Located on chromosome 2
  Distance between a terminus base of telomere on chromosomal short arm and 5'-terminus of this base sequence : 157167758
  Distance between 3'-terminus of neighbour sequence of sequence listing upward to telomere on chrosomal short arm and 5'-terminus of this base sequence : -342
ttctgtattgctgtcttaccagtgcttatggaagtgtaagaaagggactttgcattataaagtactttgttttacacacatacacacacacacacacacacacacagagctactcagaattgggtgcaccaattcaaagctgttgaatacaagaaaatataaatatatacattttatcttttataagataaaagatttcttatcaaccttccaccacaacaaacaatgagtattccaggggcagatcatagggcatccactgagccttccaaaaaaggaagaaggacttatggtgaaggaacttaaacccggatagaaaaataaccagatgtagcattgtag

SEQ ID NO: 3712 - DNA, 161 bp, Homo sapiens
  D2S2380
  Located on chromosome 2
  Distance between a terminus base of telomere on chromosomal short arm and 5'-terminus of this base sequence : 157335509
  Distance between 3'-terminus of neighbour sequence of sequence listing upward to telomere on chrosomal short arm and 5'-terminus of this base sequence : 167409
ggaggagccttaacgtccaaggaatacagtgtgtgtgtgtgtgtgtgtgtgtgtgtgcgcgtgtgtgtgtgcacgcacgtgcatgtgtgtgtgtgtgtttaaaagagaaatagcaaccaaagatagaagaaaaaacagaaaaatgtgctggcaagaatgcc

SEQ ID NO: 3713 - DNA, 331 bp, Homo sapiens
  chr2.fa.O7frz.170092567
  Located on chromosome 2
  Distance between a terminus base of telomere on chromosomal short arm and 5'-terminus of this base sequence : 157509423
  Distance between 3'-terminus of neighbour sequence of sequence listing upward to telomere on chrosomal short arm and 5'-terminus of this base sequence : 173753
ttatgctatttgaagagctaagacctcatttatctactactgttgggaaacacagtattctttatcaacaaattttaaaattgaagtttcgataactgagtgccaaagtgtgtgtgtgtgtgtgtgtgtgtgtgtgagagagagagagagagagagtattcagtgggcattttgtaaatacacatattcttgcattggtctaaagtcttcagtgctgcccctgatagaacattaagagtcagaaaaaaacaggcctataaagagaaattattcccaggacccatccctactgctagttacctgaaccctctttctaagaatggtaaaagct

SEQ ID NO: 3714 - DNA, 291 bp, Homo sapiens
  chr2.fa.O7frz.170315400
  Located on chromosome 2
  Distance between a terminus base of telomere on chromosomal short arm and 5'-terminus of this base sequence : 157714913
  Distance between 3'-terminus of neighbour sequence of sequence listing upward to telomere on chrosomal short arm and 5'-terminus of this base sequence : 205159
cacctcttaatcaatacttgctagtgtcattgtcaaagcactgaaataaaggtggagatattctcttctgcttttcttaatattttatgtgaactcccttcttataaattcctatttttaaaaccacaaaataaaggaggcccctattccttttttcttctatcatattttcatatacattcttggagctgatgtgtgtgtgtgtgtgtgtgtgtgtgcgtgtgtaatagatatgaaacaacatcgcactttatcaattattattgttggttaacatctcagtcaacctca

SEQ ID NO: 3715 - DNA, 290 bp, Homo sapiens
  chr2.fa.O7frz.170532148
  Located on chromosome 2
  Distance between a terminus base of telomere on chromosomal short arm and 5'-terminus of this base sequence : 157928226
  Distance between 3'-terminus of neighbour sequence of sequence listing upward to telomere on chrosomal short arm and 5'-terminus of this base sequence : 213022
gtttcaagcaattcttgtgactcagccacccaagtagccaggattacagccatgtgctaccacacctggctaatttgtgtgtgtgtgtgtgtgtgtgtgtatgtgtgtgtgtgtgtatttttaatagagataggcttttgtcatgttggccaggctggtctcaaacttctggcctcaggtgatctgcccacctcagcctcccaagtgctaggattatgggtatgagatactgcgcccagcatattgatcttttgagtgaccttcgtgtcttgatctccttcagtttagtt

SEQ ID NO: 3716 - DNA, 124 bp, Homo sapiens
  Z67228
  Located on chromosome 2
  Distance between a terminus base of telomere on chromosomal short arm and 5'-terminus of this base sequence : 158037178
  Distance between 3'-terminus of neighbour sequence of sequence listing upward to telomere on chrosomal short arm and 5'-terminus of this base sequence : 108662
tcatgtgcttttcattccaattcttttctgtacgtatgtatgcgtgtgtgtgtgtgtgtgtgtgtgtgtgtgtgtgtttggctcactttaaaaaaagaaaacataaaaaccagtttcccaggtt

SEQ ID NO: 3717 - DNA, 440 bp, Homo sapiens
  chr2.fa.O7frz.170771950
  Located on chromosome 2
  Distance between a terminus base of telomere on chromosomal short arm and 5'-terminus of this base sequence : 158168072
  Distance between 3'-terminus of neighbour sequence of sequence listing upward to telomere on chrosomal short arm and 5'-terminus of this base sequence : 130770
ttgtaattctagccaaagtcagaatcaatctgacagagttgttatgtacaggtaaggaagagggaattacagaatcactcagccaacagacattttttgagcacttaatgtgtgctactatgtagaatgttctttaagtatcagataatctatcttcacagagttcacaattgaattaaaggatttaggatattttatatctatctatctatctatctatcatctatctatctatctatctatctatctatctatctatctatctatctatctacaagtagagaaacattttctcacctcaaaacagaatcaacaacccagaagtaaacaaaaatatctttggtcagcccaaagtgaagtttcataatctacatactaaatacatgtagttgccttgtagaaaagtagttcaatactagtctactgactcctacgtaaca

SEQ ID NO: 3718 - DNA, 465 bp, Homo sapiens
  chr2.fa.O7frz.170888039
  Located on chromosome 2
  Distance between a terminus base of telomere on chromosomal short arm and 5'-terminus of this base sequence : 158284173
  Distance between 3'-terminus of neighbour sequence of sequence listing upward to telomere on chrosomal short arm and 5'-terminus of this base sequence : 115661
tacagtcttgattctggatgaccacatgcccagctgcaattgtgtagttatgttaattcagaagaaaagaaaagtggatgttggaggacaattagctggctctgacacactccaaagcacaaacaggagaattaacttcagccttatgtgagggggagacatttccttcatttgagcagaagaaaaagacagatgacattacagctatttttgcaggtttgatattgagaaattgagagaattttcatctagtgactttgtgtgtgtgtgtgtgtgtgtgtgtgtgtgtgtgtgtgtgtgtagaggaaatgatatcagttttttgtgcatgtgggccagattgaatcagatttgagaaaagtgatggagctaaaaaatgctgtgttgaaaatctggttgatattggaggccatgaatttatattgaaaccagtctccagctttgtaccattttcactagcagtga

SEQ ID NO: 3719 - DNA, 412 bp, Homo sapiens
  chr2.fa.O7frz.170968488
  Located on chromosome 2
  Distance between a terminus base of telomere on chromosomal short arm and 5'-terminus of this base sequence : 158363767
  Distance between 3'-terminus of neighbour sequence of sequence listing upward to telomere on chrosomal short arm and 5'-terminus of this base sequence : 79129
cttcaaatactgtcctgattagaggggctttaggctgtactacagaaaatttcataaaagcatacatatatatatttgctagatttaactccagagtagaagtcttaacaagcttttcaagacacgatatataaaatcggttgagtattgcctctgaagtttatttgattgatgaaattgacctagatatgtaattactgtcttcagtttctgcatctgtaagatggggattgcaatactacctaacacataaattcttgcaagacaaatatacacacacacacacacacacacacacacacagaaagagagagagagagagagagcacctatagagcccatagtgaattagcttttgctatttttacctggtataatgcaaaatgtggtagattaaattgagtcgagaatg

SEQ ID NO: 3720 - DNA, 133 bp, Homo sapiens
  DISO7_10009107
  Located on chromosome 2
  Distance between a terminus base of telomere on chromosomal short arm and 5'-terminus of this base sequence : 158436629
  Distance between 3'-terminus of neighbour sequence of sequence listing upward to telomere on chrosomal short arm and 5'-terminus of this base sequence : 72450
gatctctacctgtcctgctctctgctaaaggtgaatttctctctttctttctctctctctctctctctgtgtgtgtgtgtgtgtgtgtgtgtagtgtgtggtatctctttgaaggggcttgttactcggattc

SEQ ID NO: 3721 - DNA, 476 bp, Homo sapiens
  AC018872.4_95204
  Located on chromosome 2
  Distance between a terminus base of telomere on chromosomal short arm and 5'-terminus of this base sequence : 158787492
  Distance between 3'-terminus of neighbour sequence of sequence listing upward to telomere on chrosomal short arm and 5'-terminus of this base sequence : 350730
accatcagatcttgtgatacttattcactaccatgagaacaggatgggggaaaccacccccatgattcagtcatctcccactgggtccctcccacaacacatgggaattataggagtataattcaagatgagatatgggtggtgacacagcaaaaccatagcacccctgaaccaaaagataacataaaattggaagacaagcatacagtgggagaagattctgtgccacatatgagataaagaattaataagagtatataattgtctcatataagccactatactattttctccacttatctgtgtgtgtgtgtatatatatatatatatatatatatgatatgtatatagatacataaattttttcagcttttaacaaagaaaaaatagaacctgcagaataaatattgaactatttcctatctcacatgtttaattttgagaaatgtgctgttttacaaacagctttactgaag

SEQ ID NO: 3722 - DNA, 406 bp, Homo sapiens
  chr2.fa.O7frz.171672298
  Located on chromosome 2
  Distance between a terminus base of telomere on chromosomal short arm and 5'-terminus of this base sequence : 159029605
  Distance between 3'-terminus of neighbour sequence of sequence listing upward to telomere on chrosomal short arm and 5'-terminus of this base sequence : 241637
ttatctgcttattccagttcagggtcacaggtggccagagcctatcctggcagctcagggctcaaggtgggaacctaccctggccaggacctcattttattacagggcacacttgcacacacacacacacacacacacttactcgcactgggaccatttagacatcaaaattaacctgacctgcacatctttgggaagtggggggaaatgagtctctggagagaacccacatagacatacagagaaagtgcacacttcacacagacagtggcctaatcccggaatagattttttttttcctcaaccatgttagataaaaatgatgttgaagaaaatgaccttattggaggaccagctatacacatgagcataggtaagcccatagaaaaggacctccacgaatcta

SEQ ID NO: 3723 - DNA, 131 bp, Homo sapiens
  DISD22_0001990
  Located on chromosome 2
  Distance between a terminus base of telomere on chromosomal short arm and 5'-terminus of this base sequence : 159085484
  Distance between 3'-terminus of neighbour sequence of sequence listing upward to telomere on chrosomal short arm and 5'-terminus of this base sequence : 55473
ctcatgacctattcctggggtacatatttctctccctccctcccttcctttctctctctctctctctctctctctctctttctgtctctgagatgagcaactaaaatgtagtgaatgtggattactcagtg

SEQ ID NO: 3724 - DNA, 394 bp, Homo sapiens
  AC008107.2_56237
  Located on chromosome 2
  Distance between a terminus base of telomere on chromosomal short arm and 5'-terminus of this base sequence : 159280602
  Distance between 3'-terminus of neighbour sequence of sequence listing upward to telomere on chrosomal short arm and 5'-terminus of this base sequence : 194987
ttaagccacctatgactgtacttattgatacacatatgcatagtgaagtgataactatggtcaagaaaattaacattcccattatctcatatagttaacttcctttcttgctttctttttctttctttctctttctctttttctttctttctttctttttctttcttttctttctttctttctttctttctttctttctttctttctttctttcttttctccttccttctccttccttccttttttccttttcttttcttttctttcttttcttgtggtaagtgtacctaaaacctactctcttaacaaagtaccactaagcaatacaatgttgttaactatagccttcataccatacattagatctctagacttactcattctgcgtaactgc

SEQ ID NO: 3725 - DNA, 304 bp, Homo sapiens
  chr2.fa.O7frz.165515725
  Located on chromosome 2
  Distance between a terminus base of telomere on chromosomal short arm and 5'-terminus of this base sequence : 159370548
  Distance between 3'-terminus of neighbour sequence of sequence listing upward to telomere on chrosomal short arm and 5'-terminus of this base sequence : 89552
ccagtttattgagcaccagccatgtgttgggctctggactagagatgtggtggatataaaggtaaataaatacttggctctaagctctggggacctcccagtttggcaagagatgacaacagtgaagacattgaggtgtctacaaagtgttgtgacctcacggagaagagcgagactctcctttcggaagctggtaagggtgtgtgtgtgtgtgtgtgtgtgtgtatgtgtgtccgtgtgtgtgtgtgtcattggaggagccaggtgttttattttggcagtgatgtcctatgacagagttaag

SEQ ID NO: 3726 - DNA, 91 bp, Homo sapiens
  D2S2370
  Located on chromosome 2
  Distance between a terminus base of telomere on chromosomal short arm and 5'-terminus of this base sequence : 159475499
  Distance between 3'-terminus of neighbour sequence of sequence listing upward to telomere on chrosomal short arm and 5'-terminus of this base sequence : 104647
tgaggttgtgtctcagtgtcatcagagagtgtgtgtgtgtgtgtgtgtgtgtgtgtgtgtgtgtgtgtgtgtcttgtcagggatctttcat

SEQ ID NO: 3727 - DNA, 224 bp, Homo sapiens
  D2S2190
  Located on chromosome 2
  Distance between a terminus base of telomere on chromosomal short arm and 5'-terminus of this base sequence : 159520745
  Distance between 3'-terminus of neighbour sequence of sequence listing upward to telomere on chrosomal short arm and 5'-terminus of this base sequence : 45155
gtgggatgactgtttgagcccaggaagtcaaggctccagtgagccactccagcctgggtaatggagtgaggccttatctctaaagcaagcacacacaccacacacacacacacacacacacactcactctctctcttttcttcctgtctctcacacacaactgtgggcattttaaaaactcatttccaaggaatcctaaactctgagaccttctggaaacaggc

SEQ ID NO: 3728 - DNA, 454 bp, Homo sapiens
  AC009506.3_158347
  Located on chromosome 2
  Distance between a terminus base of telomere on chromosomal short arm and 5'-terminus of this base sequence : 159860333
  Distance between 3'-terminus of neighbour sequence of sequence listing upward to telomere on chrosomal short arm and 5'-terminus of this base sequence : 339364
tactagcagaaaggaatgcagaatcattaaatgtcaaaaaattaaaaatatgagaaataactataaaaagtttggtgaggagggcatttttcagcttaaaagtaggaaaattattgttaaatctaaagaactgaaaagttaatatattttgtgtgtgtgtgtgtgtgtgcgcgtgtgtgcgcgcgctaggagagagagagagccaggatcacactctgttacccaggctggagtgtgtgcatgcacaggagagagaaagagagagagacagagacaggatctcactctgttacacaggctggagtgcaataatagctcattgcagccttgagctcctgggttcgagcaatccttccacttcagcctcccaagtagccaggcctacgggtgcatgccaccacacccagctgatttttttttttaaattttgtgtagagaccaagatcttgctatg

SEQ ID NO: 3729 - DNA, 216 bp, Homo sapiens
  AC009961.9_118098
  Located on chromosome 2
  Distance between a terminus base of telomere on chromosomal short arm and 5'-terminus of this base sequence : 159932402
  Distance between 3'-terminus of neighbour sequence of sequence listing upward to telomere on chrosomal short arm and 5'-terminus of this base sequence : 71615
gtacttaatgccactgagttgtaggctttaaacgattaaaatggttaaatttatgttacataagtgttataatttttaaaagtggttaaaatagttttgttatatatatatatatatatatatatatatatatatatatatattacaatttttaaaaattgagttgtcaattaaaataaaattgtcagcccttattggatagaagtcctgtattgt

SEQ ID NO: 3730 - DNA, 219 bp, Homo sapiens
  D2S306
  Located on chromosome 2
  Distance between a terminus base of telomere on chromosomal short arm and 5'-terminus of this base sequence : 159961478
  Distance between 3'-terminus of neighbour sequence of sequence listing upward to telomere on chrosomal short arm and 5'-terminus of this base sequence : 28860
aaaggctaaacaactaaacatcaatagggatttagagaaaaggtactatagaatgaaaaaagttagatgaagatgcatgcttaaatttgatttcattttataaattaaatggttaaaaaaactccatcaataccagtatttctgtaaacatatataacacacacacacacaaacacacacactcttttatgattgtgtgaccatgcagaaagtaaggtg

SEQ ID NO: 3731 - DNA, 186 bp, Homo sapiens
  D2S156
  Located on chromosome 2
  Distance between a terminus base of telomere on chromosomal short arm and 5'-terminus of this base sequence : 160047881
  Distance between 3'-terminus of neighbour sequence of sequence listing upward to telomere on chrosomal short arm and 5'-terminus of this base sequence : 86184
ccagccttgattgtcacactgtcttatttccatactatcttattggttattgtattagtcagggttctccagagaaacagagaaccaactctgtgtgtgtgtgtgtgtgtgtgtgtgtgtgtgtgtgtgtgtgtgtctgaaaagatagggaaagaagtcacatggatatttcaggcaaacagaggg

SEQ ID NO: 3732 - DNA, 432 bp, Homo sapiens
  chr2.fa.O7frz.166436381
  Located on chromosome 2
  Distance between a terminus base of telomere on chromosomal short arm and 5'-terminus of this base sequence : 160236449
  Distance between 3'-terminus of neighbour sequence of sequence listing upward to telomere on chrosomal short arm and 5'-terminus of this base sequence : 188382
attcagcttagaaatccaagagatcactgatgcccggttggacattgtcatgatgatactaactttcatttaaggctgggagaaggtgagaatggccaccttcagtttaagccaagcacattaatctcgatggcataggctgaaaatccatgtcactctcctggtgttgtgacctttttctttcctcactgaattcagagttctatgtctttcctgctatatactggctcctggaagatgaaatggtatttactttctcttcatcagtttcctgaaattgtacaatatttaataaacacacatgtatgtgcatacgtgtgtgtgtgtgtgtgtgtgtgtgtgtgtctgattaataaaatagaaatagaaaagcagtgccataggaaggaaaagcagcatacctgctatacctgctaactatgagatctggtg

SEQ ID NO: 3733 - DNA, 258 bp, Homo sapiens
  chr2.fa.O7frz.166318088
  Located on chromosome 2
  Distance between a terminus base of telomere on chromosomal short arm and 5'-terminus of this base sequence : 160308034
  Distance between 3'-terminus of neighbour sequence of sequence listing upward to telomere on chrosomal short arm and 5'-terminus of this base sequence : 71153
cttacaatgagctatccatcttagccgccttgggagtatgcccattaaaagaaaaatcatttactaaagtgcaaggtagaaatgttaaaaaacaaacaaaaaaacaaacaaacaaacaacttttagtggtagatagagtgttagtccctgtatcggtttgctactagggttgccataacaaaataccacaaactgagtggcttcaatgacagaaatttcttttctcataattctggaggctggaagcgtgagattaca

SEQ ID NO: 3734 - DNA, 379 bp, Homo sapiens
  chr2.fa.O7frz.166725757
  Located on chromosome 2
  Distance between a terminus base of telomere on chromosomal short arm and 5'-terminus of this base sequence : 160505354
  Distance between 3'-terminus of neighbour sequence of sequence listing upward to telomere on chrosomal short arm and 5'-terminus of this base sequence : 197062
gccttagactacaatccaacttggaacctggtaagtcaagttctacttagtgaaagacataagtaaaggcaggaattggattcaaatatattttcttgaatgcagctagctgatttgcttatgaggtttaaatttttttaacttaatataacaatatttacttacagatttaatttagatatggctcttgatattgggaacacaaaaatcaacattaagtcccttcaataagaactccacagcctaataggagggttcaaagtgtgtgtgtgtgtgtgtgtgtgtgtgtgtgtgtgtgtgtagagagagagagatatacaaaaactaagagtgtgtaactgcccagggagcaccatagatgaaggaactaaccatacat

SEQ ID NO: 3735 - DNA, 117 bp, Homo sapiens
  HUMUT503
  Located on chromosome 2
  Distance between a terminus base of telomere on chromosomal short arm and 5'-terminus of this base sequence : 160691557
  Distance between 3'-terminus of neighbour sequence of sequence listing upward to telomere on chrosomal short arm and 5'-terminus of this base sequence : 185824
ctacaggtgaaagccagcacacccagctaatttttaaatttatttatttatttatttatttatttatttatttatttatttgtagagatgaggtcttgctacgttgccgaggttggt

SEQ ID NO: 3736 - DNA, 152 bp, Homo sapiens
  D2S1353
  Located on chromosome 2
  Distance between a terminus base of telomere on chromosomal short arm and 5'-terminus of this base sequence : 160774797
  Distance between 3'-terminus of neighbour sequence of sequence listing upward to telomere on chrosomal short arm and 5'-terminus of this base sequence : 83123
gagcaggatttgtaaccctggcagtattgatgttttgggccagataataataccaatattattatattattattattattattattattattattattattattattgcaaaagggtgggctgtcctacgagatgttaagcaatgtccctgg

SEQ ID NO: 3737 - DNA, 455 bp, Homo sapiens
  chr2.fa.O7frz.164815536
  Located on chromosome 2
  Distance between a terminus base of telomere on chromosomal short arm and 5'-terminus of this base sequence : 161044004
  Distance between 3'-terminus of neighbour sequence of sequence listing upward to telomere on chrosomal short arm and 5'-terminus of this base sequence : 269055
gtttctgaacagtgtctttatgacaaaagttttaattttgataaagtccactgtattgtttttcttttatttgtgcttttgttttatatatatatatatatttgagtcaaggacttactctgttgccccggctatagtacagtggtttgatttcagctcactgtggccttgacttcctaggcctgaacaatcctcctgcctctacctcctgagttgctgggactacaggtgtgggccatgacacccaagtcatatatatatatatatatattttttttttttttttttgtagagatgaggttttgccatgtttttcatgctggtctcatactcctgagctgaagcagtccacccaccttggcctcccaagatgctgggattacaggtgtgagccattgcacccaacctataattttacctatgttaatttttgtgtatgatttgaggcatcacat

SEQ ID NO: 3738 - DNA, 297 bp, Homo sapiens
  AC005539.1_52830
  Located on chromosome 2
  Distance between a terminus base of telomere on chromosomal short arm and 5'-terminus of this base sequence : 161388285
  Distance between 3'-terminus of neighbour sequence of sequence listing upward to telomere on chrosomal short arm and 5'-terminus of this base sequence : 343826
ttaggagtgtatcaggtaaacaatacatcaatggattttcaaaaagttgtcttttatctatgtttaatacatttacaaatactgtgattcctgatatatttttactcctttcttcttattttttttctaattgtgtgtgtgtgtgtgtgtgtgtgtgtgtgtgtgtatgtttctttttaccgccttcctacattctatagaatgattaagttctctgtgctgggcgcaatggctcacgcctgtaatcccagcactttgggaggctgaggtggacagattacttgacgtcaggagttt

SEQ ID NO: 3739 - DNA, 386 bp, Homo sapiens
  AC005539.1_71409
  Located on chromosome 2
  Distance between a terminus base of telomere on chromosomal short arm and 5'-terminus of this base sequence : 161406849
  Distance between 3'-terminus of neighbour sequence of sequence listing upward to telomere on chrosomal short arm and 5'-terminus of this base sequence : 18267
ttgtaggcaacaggtcaattggtcttttaaaaaaaaaaaaaaaattctctcagtcaccctgtcttttcattagagagtctggtccatttgcaatcaatgctattattgataaataaggacttactactgcctctttgttatttttctgtgtgtgtgtgtgtgtgtgtgtgtgtgtgtgtgtgtatgaaggtcttctattccttctttccttccttcctgtctttctttgactaaaggtgattttctctggtgtatgatttaattacttgctttttattttttgtatatctatactatgtttttaaatttgaagttatcatgaagcctgtaaatactgtcatataacccgttgttttaaagtgatgtcaacttaacactgattgcat

SEQ ID NO: 3740 - DNA, 303 bp, Homo sapiens
  AC005539.1_126448
  Located on chromosome 2
  Distance between a terminus base of telomere on chromosomal short arm and 5'-terminus of this base sequence : 161461857
  Distance between 3'-terminus of neighbour sequence of sequence listing upward to telomere on chrosomal short arm and 5'-terminus of this base sequence : 54622
ccttcaggatacagatctatcactctaaaaaactcctgcatgctagttctttgtcttaaaaaatatatatactgatgtacatgtaaaatggaagctacaaggatatttgtaaaataaagtgtacattttatccatatgaaatcaagatagaatttctctctctctctctgtctttcttgtgtgtgtgtgtgtgtgtgtgtgtgtgtgtgtgtgtgtgtgtgtgtgttttaaaggattgtatttccttccactttggaggatataaattcttgagaaataacctatacaggctatcattaaaga

SEQ ID NO: 3741 - DNA, 403 bp, Homo sapiens
  AC005539.1_198747
  Located on chromosome 2
  Distance between a terminus base of telomere on chromosomal short arm and 5'-terminus of this base sequence : 161534119
  Distance between 3'-terminus of neighbour sequence of sequence listing upward to telomere on chrosomal short arm and 5'-terminus of this base sequence : 71959
agtgctatgagtgatcagtagaaggtgggacctttcaccatggaactgtccacatacttggggcagaaattggagaatctggtggagatttgacaggagctggaggagctggatgtctcagttgattcaataagataagccagcagatcagtaacaatgcatgcaagatgttgctatacatggcactttctgaggaccttcagagcagatagatgatagatagatagatagatagatagatagatagatagatagatagatagatagacagatagacagatagatagacagatagctgccccttcacttaccacttttcaagtatcacacaaaatgcctcctgtggccaaaacaaactgaggaccataaggaaaaaataattacaggaaatgtaattccagta

SEQ ID NO: 3742 - DNA, 255 bp, Homo sapiens
  D2S2357
  Located on chromosome 2
  Distance between a terminus base of telomere on chromosomal short arm and 5'-terminus of this base sequence : 161629276
  Distance between 3'-terminus of neighbour sequence of sequence listing upward to telomere on chrosomal short arm and 5'-terminus of this base sequence : 94754
  misc_feature (1)...(3742): n = A,T,G or C
gacatgcaaagtgagcagatgaaaaagaaaacagtaaataaacaggaaaaaggagacttaacagtgcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgtttgaaaggaatgtgtgtactgctcttgttgggtggagtattctatactatctgttgggttaagttggcttataacatta

SEQ ID NO: 3743 - DNA, 405 bp, Homo sapiens
  chr2.fa.O7frz.166866300
  Located on chromosome 2
  Distance between a terminus base of telomere on chromosomal short arm and 5'-terminus of this base sequence : 161783431
  Distance between 3'-terminus of neighbour sequence of sequence listing upward to telomere on chrosomal short arm and 5'-terminus of this base sequence : 153900
acttgaatgtaactcttgaactacagatatgtgtagttatgtatcactatgtcatattcaaactacaaacatttatacagtagtcatattgttatcactttgagaaataacaggagtcacttagatgcagaaattttcttcagctatttatagtgagaatggggaataatggtttctcctattttctttagcttattaagctttgtattgtaaatgtgtgtttgttactttcatggccttaacagaaatgaaaatttaataaagccttcctgtgataaacaccacacacacacacacacacacacacacacacacacacacacacatatgtatataaatagttttgctgttgaggaaagggctttgaaataggtgataaatgtaaatccattgacatctatcaat

SEQ ID NO: 3744 - DNA, 423 bp, Homo sapiens
  AC073190.2_89935
  Located on chromosome 2
  Distance between a terminus base of telomere on chromosomal short arm and 5'-terminus of this base sequence : 161924385
  Distance between 3'-terminus of neighbour sequence of sequence listing upward to telomere on chrosomal short arm and 5'-terminus of this base sequence : 140549
atcagtatgaatgcatggttatttatcttatattttatgttataattcaatactaccttatttatcttattgctcaatttgttccatctttggccattggaagctctttcagtggacaccagtgtccctttaatataatcccatcatctcgtgtgtgtgtgtgtgtgtgtgtgtgtgtgtgtgtgtgtgtgtgtatttccccctgcacttccttaccttctggcataagaatatactccaaactcatcatacatatttcctgccccaattctagaattggccattttccaaggaaccctggttccttttattggagaaacatattaaaagccaagatctgggcactgagagtgctcattgctactgggagtacaagagtcattacttttaggtcgtttcagctgacagagcaagtaacatgtt

SEQ ID NO: 3745 - DNA, 371 bp, Homo sapiens
  AC064863.2_124615
  Located on chromosome 2
  Distance between a terminus base of telomere on chromosomal short arm and 5'-terminus of this base sequence : 161935590
  Distance between 3'-terminus of neighbour sequence of sequence listing upward to telomere on chrosomal short arm and 5'-terminus of this base sequence : 10782
  misc_feature (143)...(144): n = A,T,G or C
acagtatgtgccacttatgaacttggggacatttgcactttagaatagtagaaatagtcagatgtccacattataaaacacagggtgcatgttggaaccacttgtcacctagccaagcagaatgaagcgcactggctctccanngaggccctgccacctcagacacacatacagggccctggctgtgatgctgctccatgcctggtgaaaaccagacacacacacacacacacacacacacacacacacacacacacagtttaagtaagtatttgatgggatcttgaagacgaatggcatgaggactaattaaagtcatagatcccatgagagcaaataggcatgtttggatgacatttaggaaccatctc

SEQ ID NO: 3746 - DNA, 371 bp, Homo sapiens; identical to SEQ ID NO: 3745
  AC073190.2_41346
  Located on chromosome 2
  Distance between a terminus base of telomere on chromosomal short arm and 5'-terminus of this base sequence : 161935590
  Distance between 3'-terminus of neighbour sequence of sequence listing upward to telomere on chrosomal short arm and 5'-terminus of this base sequence : -371
  misc_feature (143)...(144): n = A,T,G or C

SEQ ID NO: 3747 - DNA, 307 bp, Homo sapiens
  AC064863.2_242506
  Located on chromosome 2
  Distance between a terminus base of telomere on chromosomal short arm and 5'-terminus of this base sequence : 162027913
  Distance between 3'-terminus of neighbour sequence of sequence listing upward to telomere on chrosomal short arm and 5'-terminus of this base sequence : 91952
ctggtatgacaatgtatgcatatggtcccagctacttgagaggctgaggtgggagaattgcttgaacctaggagtttcagtctggtatgggcaacatagtgaaactctatctatacacacacacacacacacacacacacacacacacacacacacacacacacacagtggtctagctaagcactgataccatgctctcacagacagccaatctgcaaagattgggaaagtattttatattcttttgttggctccaggcatttaggaaaactctgtcaaaacactagatggccactaagttaataga

SEQ ID NO: 3748 - DNA, 418 bp, Homo sapiens
  chr2.fa.O7frz.167250162
  Located on chromosome 2
  Distance between a terminus base of telomere on chromosomal short arm and 5'-terminus of this base sequence : 162089793
  Distance between 3'-terminus of neighbour sequence of sequence listing upward to telomere on chrosomal short arm and 5'-terminus of this base sequence : 61573
tgacaacctcatggtagatacttttttcctctctcctgtggtatggactggacttagtaactgtttctccttccaatcacacacacacgttagcttgtgtacagacacacacacacacacacacttctcaagatgaaaaaactcgtgtgataagacttgctgccttcttccatgattcatttcccccttttccatatgctctctgcctgcataaatacctttagcctattcattaattccctggtaaatgtattcaattcttccctctgttccttttttccaacactccatttgctttttagaagttttagctctaaccttatgctctctgtctctctaaccctgcagtgattgtcactgtctttctgtgtttctctttcctcaaagtcttataaaatagaacatactgcaaagcagt

SEQ ID NO: 3749 - DNA, 403 bp, Homo sapiens
  AC009313.3_95172
  Located on chromosome 2
  Distance between a terminus base of telomere on chromosomal short arm and 5'-terminus of this base sequence : 162175026
  Distance between 3'-terminus of neighbour sequence of sequence listing upward to telomere on chrosomal short arm and 5'-terminus of this base sequence : 84815
atgatcatacttgataatggtcactgcacagcagcccagagtttatagattatcctttccatctctccctctattcctttctcctctcttatttctttctcactgtcattgggtcttagacgttagataggttaacatttgttatcttcctcatttatagagaattacaagtatgaactattaatcctgctattagaaattgtatcagtactaatagagagacctccatctcaaaaagccacacacacacacacacacacacacacacacacacacacacacgtaatcacaaaataggccaaaacaggtcatgttggaaatgcaagatctgcagccatgatactttgcatatgttatgcagagtcccacacttagagtgctaatgattgagagtcatgatacc

SEQ ID NO: 3750 - DNA, 437 bp, Homo sapiens
  AC009299.3_168180
  Located on chromosome 2
  Distance between a terminus base of telomere on chromosomal short arm and 5'-terminus of this base sequence : 162265808
  Distance between 3'-terminus of neighbour sequence of sequence listing upward to telomere on chrosomal short arm and 5'-terminus of this base sequence : 90379
tactggaatttcagccactactgtgcctctactgcagtgtggccatcatcaggacaaaaccatagaaaactgggaatgcactctaagccaattacttactacacattttttactctcctccaatatatgcaaagttcagtcttcagtgttttcaggtagttggtttgtgtgtgtgtgtgtgtgtgtgtgtgtgtgtgtgtgtgtgtgtgttgtccaaagtttgtaactgttatttgcagaagaatggtttgttaggtgctcactcctccacaatggaatctgagctcctaaagtctagttttttggtttttttctggctgagtatggtcaggatgtggtccaaaatcacccaacatataaagaacccagaaaatatgacccagttataagagaacagacatcaaccctaagatgattcagacactgaaattatcaga

SEQ ID NO: 3751 - DNA, 437 bp, Homo sapiens; identical to SEQ ID NO: 3750
  AC009313.3_185881
  Located on chromosome 2
  Distance between a terminus base of telomere on chromosomal short arm and 5'-terminus of this base sequence : 162265808
  Distance between 3'-terminus of neighbour sequence of sequence listing upward to telomere on chrosomal short arm and 5'-terminus of this base sequence : -437

SEQ ID NO: 3752 - DNA, 416 bp, Homo sapiens
  chr2.fa.O7frz.167699075
  Located on chromosome 2
  Distance between a terminus base of telomere on chromosomal short arm and 5'-terminus of this base sequence : 162538647
  Distance between 3'-terminus of neighbour sequence of sequence listing upward to telomere on chrosomal short arm and 5'-terminus of this base sequence : 272402
gttgccttaaacctatagtcctagctatttgggaggctgaggtgggaggatcacttgaatccaggaggcagagattgcagtaagccatgatcacaccacagcactccagtctgggtgacagagcgagaccctgtctctctctctctctctctctctctctctcacacacacacacacacacacacacacacacacacacacacacacacagaaaatctcacagaaaatatatgttgagactccctgggaccatagacccattgtgagacacattcatttccataactttagcctggcataatatctaaatcatagtcaatactatgtagatatgaagggatatatttctttatggtgccctttattaacactcactgctgaattccttggcaaactgcttattttctgtcagttca

SEQ ID NO: 3753 - DNA, 455 bp, Homo sapiens
  chr2.fa.O7frz.168012618
  Located on chromosome 2
  Distance between a terminus base of telomere on chromosomal short arm and 5'-terminus of this base sequence : 162688877
  Distance between 3'-terminus of neighbour sequence of sequence listing upward to telomere on chrosomal short arm and 5'-terminus of this base sequence : 149814
tttgtcaattaactcggtaaacattttactaactttcttttgtattccatttacaactttgtttgctatcagtatttctctatgaagtaagctttctctttctttccttccttccttccttccttccttccttccttccttccttccttccttccttccttccttccttctttctttttgagatggggtcttgccatgttgctcttgctggagtgcagtcgctggttacaggcatggtcatcacagtgcactgcagcctctgaatcctggtctcaagctatcctcctacctcagcctcccaagtagctggaactgcaggcacacaccaccctccctggcctgcattttctttaaaaatcacagctcaaatgaaacattgaactatttgaaacattatttaatttagtttaccagtaaggtgaatttcatgggtaacaaggtattactgaaatgct

SEQ ID NO: 3754 - DNA, 372 bp, Homo sapiens
  chr2.fa.O7frz.168099876
  Located on chromosome 2
  Distance between a terminus base of telomere on chromosomal short arm and 5'-terminus of this base sequence : 162796661
  Distance between 3'-terminus of neighbour sequence of sequence listing upward to telomere on chrosomal short arm and 5'-terminus of this base sequence : 107329
tcatgtaggtctacctgttcatttttgctttcttgcctaagcttttggtttgatatctaaaaatatcaccaagcccaatgtcaaggagattttcctctttgttttcttccaaaagttttgcaattttaaatcttacgtctatgtcttaagccattttgagtttgtgtgtgtgtgtgtgtgtgtgtgtgtgtgtgtgtggtgtaagatatggttccagttttattcttttgcatgtggatattctaccatttgttgaaaagactgttctttccacatggtatcttcttggttgctttgtcaaaagtcagttgaatgtgtatgtctgggcttatttctggactttacactctgttccattgatacatgtctgtt

SEQ ID NO: 3755 - DNA, 459 bp, Homo sapiens
  chr2.fa.O7frz.168182224
  Located on chromosome 2
  Distance between a terminus base of telomere on chromosomal short arm and 5'-terminus of this base sequence : 162904576
  Distance between 3'-terminus of neighbour sequence of sequence listing upward to telomere on chrosomal short arm and 5'-terminus of this base sequence : 107543
aatgtcttgaagtgaatgtcacccaaattttgatggcacatttatcaccttaaaaattattgatttagtcattggtgctgataggcactgcagtatgtgtgaaaagaaaagtaagtactgaaagatactttggcttgaaatattaagcaaaaactccaaaaatactaaaacacacacacacacacacacacacacacacacacacacaccacactgccccaaataggaaagataagcggtcctcttctgtttcatgtaacacctataaagagattattctttaagttacatagctagagcctgaaagactttataaagttaaacataaatgtataattttcagaaatatccaggctactgtagctgcactaaatcaagagaaaatagagaaaatgattaactcagaaataagcaaactccctaagaatgctgaaatagttagctatccagctcaatttc

SEQ ID NO: 3756 - DNA, 360 bp, Homo sapiens
  chr2.fa.O7frz.168931325
  Located on chromosome 2
  Distance between a terminus base of telomere on chromosomal short arm and 5'-terminus of this base sequence : 163035983
  Distance between 3'-terminus of neighbour sequence of sequence listing upward to telomere on chrosomal short arm and 5'-terminus of this base sequence : 130948
ggctcaagtatactccttaggtacctaacccgtaactctagacacaatagcttaattataattacttttatgtagtgcattcccttatatatggagattttatatatatatatatatatatatatatatatatatatatatatatatatatcttcataacaatgcaacagttctgtaaggtaggtctttttgtactttttacaaattaagacactggagttcaaagagcctaagtattgttctttatatatatatatatatatagcacatatttgtgtatatagttacatttgaaaaaaaaaagtgttctgaaaagcacagtgtccacagcaagcctgagactgttaaagaaacctaagt

SEQ ID NO: 3757 - DNA, 352 bp, Homo sapiens
  chr2.fa.O7frz.169060204
  Located on chromosome 2
  Distance between a terminus base of telomere on chromosomal short arm and 5'-terminus of this base sequence : 163164831
  Distance between 3'-terminus of neighbour sequence of sequence listing upward to telomere on chrosomal short arm and 5'-terminus of this base sequence : 128488
tttgttagaactgtccaagttaactaagcagctgtcaagtggaatagctacacataactcttccatttgggctgggcttcctgtcaacatggtggctgattttcaaagataagcatcttaaacagggcttgctttatggatttgtgtcctgtgtagttacacaagactcacacacagaagagggctctgtgcttgccactgttttgaaagaagaggctgctcattttcattttctcctgggttccacaaattttatcactggtccagattatgacagagagagagagagagagagaggagaaagatagaggggggtggggagaggaactagtcagaagctatattgccttct

SEQ ID NO: 3758 - DNA, 386 bp, Homo sapiens
  chr2.fa.O7frz.169162046
  Located on chromosome 2
  Distance between a terminus base of telomere on chromosomal short arm and 5'-terminus of this base sequence : 163266879
  Distance between 3'-terminus of neighbour sequence of sequence listing upward to telomere on chrosomal short arm and 5'-terminus of this base sequence : 101696
gagtgacataaacattgaaagttacatttccctcctaagagttaaaaaaaaccaaaaacacagttagtttagatagatagatagatagatagatagatagatagatagataaatagatagagactagaagtctctttaaagtccaattaagtcctgaattctacatgacctagaatgagaacaaaatcaacagagtatcagaaagtaaaaatatgttcccataagataacatagtcagttgtttagttttgaaaaaaaaaaatttctaaagaaaaagtaaacatgagaaaatgtactaatgcggcacctgaggaccatatacttttttggattataaatcattactaccacttcatagtgatgttattgagaatcaattctaccag

SEQ ID NO: 3759 - DNA, 413 bp, Homo sapiens
  chr2.fa.O7frz.169288578
  Located on chromosome 2
  Distance between a terminus base of telomere on chromosomal short arm and 5'-terminus of this base sequence : 163393275
  Distance between 3'-terminus of neighbour sequence of sequence listing upward to telomere on chrosomal short arm and 5'-terminus of this base sequence : 126010
tttagtatcgatgtcagtgatctacacgctgtgttaacagagttaacagtagtttgatccattgcggtgtgggtagaatataatatattttctatttgttttttacctaaaaagagaaattgtgttttactgattttaatataggacttgactttgggctatggttgtggtcttcaaaagagttactcctaccccttggagttcatggtggtggtggtggtggtggtggtggtggtggtggtggtggttgtggttgtggttgttgttgttgttttaggatatgaatttccaggtcctcaacttccacacatacttgttcctaaaattgatttgctttccttaagacttgcctcaatcccctctggcaccgtccactttgtaatgcctatgcctcctcagtccttaaatttagg

SEQ ID NO: 3760 - DNA, 123 bp, Homo sapiens
  DISO7_10000997
  Located on chromosome 2
  Distance between a terminus base of telomere on chromosomal short arm and 5'-terminus of this base sequence : 163510886
  Distance between 3'-terminus of neighbour sequence of sequence listing upward to telomere on chrosomal short arm and 5'-terminus of this base sequence : 117198
aatcatcaggagagtgagagcaagagagagagagagcaagagagagagagagagagagagagtcaaaagagtaagattaggaaatagaaaacaaaatataaagcaatacaggtggcactagta

SEQ ID NO: 3761 - DNA, 105 bp, Homo sapiens
  DISO7_10000998
  Located on chromosome 2
  Distance between a terminus base of telomere on chromosomal short arm and 5'-terminus of this base sequence : 163528009
  Distance between 3'-terminus of neighbour sequence of sequence listing upward to telomere on chrosomal short arm and 5'-terminus of this base sequence : 17000
ggcagataaattcaacttgagatacattaggaaattgtgtgtgtgtgtgcatgtgtgtgtgtgtgtgtgtgtgtgtgtgtgttgagatggctgtatgactgaagt

SEQ ID NO: 3762 - DNA, 103 bp, Homo sapiens
  DISO7_10001000
  Located on chromosome 2
  Distance between a terminus base of telomere on chromosomal short arm and 5'-terminus of this base sequence : 163532569
  Distance between 3'-terminus of neighbour sequence of sequence listing upward to telomere on chrosomal short arm and 5'-terminus of this base sequence : 4455
tattgagggtgcctgacctaaacaagttgagtctttcaacacacacacacacacacacacacacacagagagacacacacacacagtcttaagagaaagccaa

SEQ ID NO: 3763 - DNA, 189 bp, Homo sapiens
  DISO7_10001001
  Located on chromosome 2
  Distance between a terminus base of telomere on chromosomal short arm and 5'-terminus of this base sequence : 163546681
  Distance between 3'-terminus of neighbour sequence of sequence listing upward to telomere on chrosomal short arm and 5'-terminus of this base sequence : 14009
tttcataatatggccttgtagcatttaatttaatttaatttaatttaatttaatttaataattagcatgtgtaaatgctatatactgttatgtagtgtttctccaagtaatttataatgtcttgagtatctatactaggttttatatttctgtgtttctagaatctacccactgcccaatgtggactct

SEQ ID NO: 3764 - DNA, 152 bp, Homo sapiens
  DISO7_10001004
  Located on chromosome 2
  Distance between a terminus base of telomere on chromosomal short arm and 5'-terminus of this base sequence : 163599229
  Distance between 3'-terminus of neighbour sequence of sequence listing upward to telomere on chrosomal short arm and 5'-terminus of this base sequence : 52359
gagctgaatatggtagacaaagcaaaaataacaaaactaggctagataataataataataataataataataataaggcactacatttttctctatacagattggcagaaattttaatcaggacaaaaatgttggtgtcagatatttggaga

SEQ ID NO: 3765 - DNA, 462 bp, Homo sapiens
  AC034297.2_128740
  Located on chromosome 2
  Distance between a terminus base of telomere on chromosomal short arm and 5'-terminus of this base sequence : 163926712
  Distance between 3'-terminus of neighbour sequence of sequence listing upward to telomere on chrosomal short arm and 5'-terminus of this base sequence : 327331
tatgttccatgatctaatccagaataccatatggcatttagtacaagtttaattttgaattgtagcttgattttttttttatttttcaaaatctcttttcagttctgtatctggcatatacaaaccttactattggttttatttaaaaagaagtaatttgatccaatgtaaaagaaataatatgccaggaagaacaaaaattcactaaatcatgagttacacacacacacacacacacacacacacattactgttaaagacagacagaatgattactacagtataatccaagattctttttaaaattttctttgcgtaccttcctaaggatgctgcctgccctaagcgtctcctgaaacgttttgtatatgcacctatgcacctgaggattccaggcagcattaagggagagtgacacaggaatgctgctatatacctgaatgtagataacagcaagaatgc

SEQ ID NO: 3766 - DNA, 437 bp, Homo sapiens
  AC034297.2_45861
  Located on chromosome 2
  Distance between a terminus base of telomere on chromosomal short arm and 5'-terminus of this base sequence : 163972192
  Distance between 3'-terminus of neighbour sequence of sequence listing upward to telomere on chrosomal short arm and 5'-terminus of this base sequence : 45018
ggtcaagagaagttgatgttaacttcccaaagtctaatgagatgaactaatctcagggaaaatttcaatatgggtagagagaaggtatatacacatttacatgctccacagtcatgtaagctctctgaaaagattatattatattattattattattattattattattattattattattattattattttggagacagagtctcaccctgttgcccaggctgcagtgcagtggtgcaatctcagctcacttgcaacctccacctcccaggttcaagcgattctcgtgcctcagcctcccaagtactgggattacaggcatgcaccaccacacctggctaatttttgtatatttaggagagacggaatattgccatgttggccgggctggtgaaaagttttattaagacatcttatgaaccaaacataaattcatc

SEQ ID NO: 3767 - DNA, 232 bp, Homo sapiens
  AC019197.6_72122
  Located on chromosome 2
  Distance between a terminus base of telomere on chromosomal short arm and 5'-terminus of this base sequence : 164120252
  Distance between 3'-terminus of neighbour sequence of sequence listing upward to telomere on chrosomal short arm and 5'-terminus of this base sequence : 147623
atctaaaggaaagaagctacagactgaaagattggaaatgtttaaaagtagcaaaatccaaaccaaaccgtaagaagacagtgtggagtgtgtgtgtgtgtgtgtgtgtgtgtgtgtgtgtgtgtgtgttgtaagaatcaggtggtgtgtcctactgaaaagcctgtgcattttaccaattggtgccttttggggaaaataagagcaatctaacaagtctaatgcatacacg

SEQ ID NO: 3768 - DNA, 150 bp, Homo sapiens
  D2S2157
  Located on chromosome 2
  Distance between a terminus base of telomere on chromosomal short arm and 5'-terminus of this base sequence : 164120299
  Distance between 3'-terminus of neighbour sequence of sequence listing upward to telomere on chrosomal short arm and 5'-terminus of this base sequence : -185
gtagcaaaatccaaaccaaaccgtaagaagacagtgtggagtgtgtgtgtgtgtgtgtgtgtgtgtgtgtgtgtgtgtgtgttgtaagaatcaggtggtgtgtcctactgaaaagcctgtgcattttaccaattggtgccttttggggaa

SEQ ID NO: 3769 - DNA, 351 bp, Homo sapiens
  AC019197.6_51465
  Located on chromosome 2
  Distance between a terminus base of telomere on chromosomal short arm and 5'-terminus of this base sequence : 164140928
  Distance between 3'-terminus of neighbour sequence of sequence listing upward to telomere on chrosomal short arm and 5'-terminus of this base sequence : 20479
tcaaggaattagtaaatgctaaagaaagtgggacaggtctcaagcatcctttagagaagtttggcaattagaagcatgtgtgtgtgtgtgtgtgtgtgtgtgtgtgtgtgccactgttcatttttacctctcatctcctatctcatccaatacctaatattctctagggaaatggaatcctggctgaaaggcaggcttgtccttcagctgtcacagtgcccaagaagtgcacagaagggagtcctttttttttttttttaaatttatgctgtggttctgggagccagagatagagaaaaaaaaagttgtcctggagtctgttgcattgtgactgaatcaagttatccataa

SEQ ID NO: 3770 - DNA, 243 bp, Homo sapiens
  AC013463.2_145782
  Located on chromosome 2
  Distance between a terminus base of telomere on chromosomal short arm and 5'-terminus of this base sequence : 164235009
  Distance between 3'-terminus of neighbour sequence of sequence listing upward to telomere on chrosomal short arm and 5'-terminus of this base sequence : 93730
gattcatcttgccagaggtataaaaatactagttttttttctaagaaccaacatttgtctgtatttattctattactttttatatttcataaactacctttctatctatatctctatctatctatctatctatctatctatctacctatctatctatctatcctcttcctcatcatctcactgcttcttgtttcttagggattatttccttgtttttaaattattcctcagctcactgaattt

SEQ ID NO: 3771 - DNA, 338 bp, Homo sapiens
  AC013438.4_144916
  Located on chromosome 2
  Distance between a terminus base of telomere on chromosomal short arm and 5'-terminus of this base sequence : 164399883
  Distance between 3'-terminus of neighbour sequence of sequence listing upward to telomere on chrosomal short arm and 5'-terminus of this base sequence : 164631
tatgtcctacttcaagtgacctattaaaatagctctcaatagtttgctttaatacaactgcctttaatagcttttaaatttagtgtttgtttgagtagactttatggtgatttgtaaaatgatatggatatagtatatagaaaattttaacagaaatgtaaataataattataatttagggaaacggtgccctcttgctctatttcacacacacacacacacacacacacacacacaggcacacatatacacacaaaaaaaatctctatttccaaatcttgttcacaaggagctctctaactccatgagtaatttttacaaccaataacagattaacc

SEQ ID NO: 3772 - DNA, 423 bp, Homo sapiens
  AC011303.6_143721
  Located on chromosome 2
  Distance between a terminus base of telomere on chromosomal short arm and 5'-terminus of this base sequence : 164455908
  Distance between 3'-terminus of neighbour sequence of sequence listing upward to telomere on chrosomal short arm and 5'-terminus of this base sequence : 55687
gaggtttgtgaccataaatttagaatggtgccaatctgccacggggtgttatttttccccaatagggctcagcagaccaacaagcacaggggaccctctagttttatataccaatagcaagtcattctttatttaatttagttttttgtttgttatagcaataaagaaaaattgtgtttctttgaaatggtattttgtgtgtgtgtgtgtgtgtgtgtgtgtgtgtgtgtgtgtgtgtgtgtgttctctagattatagtgccctcacgtggctgatgcacatcatttacttatgagtgttttcatatggatgaaaaaactgagaattaagcatgggccttacagcacagctactaaaattaaaaaataataattattattattgttttgactaaaaccagtactagatgcaaatgaactttct

SEQ ID NO: 3773 - DNA, 465 bp, Homo sapiens
  AC011303.6_96649
  Located on chromosome 2
  Distance between a terminus base of telomere on chromosomal short arm and 5'-terminus of this base sequence : 164553036
  Distance between 3'-terminus of neighbour sequence of sequence listing upward to telomere on chrosomal short arm and 5'-terminus of this base sequence : 96705
ttatgccttcacactagcatactcattcatgtgtactacaaataaacttatgtttccccatcagacaatgccctaagcattgaaagttaaaatggtttttatccatttatgtattcattatttgtgccactacagggaacgtttgggttagaagcaagcagcctgattttaaaaattgaaattaaatttctaccagtaccttagtaggaaaatcaagtcgaagttatctagtcatagttttggcatgtctcttttattcaggatatgaggaattgctggagcttttttcttttttgcagtttatcctattaaacacacacacacacacacacacacacacacacacacacacagagcacagtaagttaattcctacaccacttaactttgcacataactgttttctcaagaaggcactgaagtgagctggcaaccatatattagttactgcgttagtgaagaaca

SEQ ID NO: 3774 - DNA, 140 bp, Homo sapiens
  D2S111
  Located on chromosome 2
  Distance between a terminus base of telomere on chromosomal short arm and 5'-terminus of this base sequence : 164553320
  Distance between 3'-terminus of neighbour sequence of sequence listing upward to telomere on chrosomal short arm and 5'-terminus of this base sequence : -181
ttttcttttttgcagtttatcctattaaacacacacacacacacacacacacacacacacacacacacagagcacagtaagttaattcctacaccacttaactttgcacataactgttttctcaagaaggcactgaagtg

SEQ ID NO: 3775 - DNA, 255 bp, Homo sapiens
  AC011303.6_86792
  Located on chromosome 2
  Distance between a terminus base of telomere on chromosomal short arm and 5'-terminus of this base sequence : 164563019
  Distance between 3'-terminus of neighbour sequence of sequence listing upward to telomere on chrosomal short arm and 5'-terminus of this base sequence : 9559
ctagcatgcagatccttctaaggagagcagtcacaggtctactgtgagaattgctttctgtatagcttgaaacctacatttattgtcaaaaccaataataattttttttaaaaaaagagaaatagagagaggttagtcgggagagattcttagtggcaaataatgactaaatgagtttctatctatcatctatctatctatctatctatctatctatctatctatgtatctgtcaatgaattgacatgtaaatca

SEQ ID NO: 3776 - DNA, 270 bp, Homo sapiens
  AC060823.3_13939
  Located on chromosome 2
  Distance between a terminus base of telomere on chromosomal short arm and 5'-terminus of this base sequence : 164580488
  Distance between 3'-terminus of neighbour sequence of sequence listing upward to telomere on chrosomal short arm and 5'-terminus of this base sequence : 17214
ggattacaggtcaggatttaataaaactagttatttttacattttattttattttaagttctggggtatgtgtgcaggatgtgcaggtttattacataggtatccaggacattcttaagagaaatttctctctctttctctctctttctttctctctctttctttctctctctctctctctgtatctctctctctctctctctcctttctcctccaagtgtgtggcagtaagaatacaataatcaaaggtacagaacaatttggtgtcac

SEQ ID NO: 3777 - DNA, 404 bp, Homo sapiens
  AC011303.6_47736
  Located on chromosome 2
  Distance between a terminus base of telomere on chromosomal short arm and 5'-terminus of this base sequence : 164580585
  Distance between 3'-terminus of neighbour sequence of sequence listing upward to telomere on chrosomal short arm and 5'-terminus of this base sequence : -173
aggtatccaggacattcttaagagaaatttctctctctttctctctctttctttctctctctttctttctctctctctctctctgtatctctctctctctctctctcctttctcctccaagtgtgtggcagtaagaatacaataatcaaaggtacagaacaatttggtgtcacagatgatattcctgctaaagcaccagcagtttcacacaccatggcttctgaatcatctatgcaaatgtcaacatagtgaaaagaagcagataacatctcagtgtaattatgaacagtattttgacctcatggtgcctctgaaagggtttcagggacccccaaggctctgtggactcactttgagaaccactgatcaaatagaaacccctattgcttagttgtgcttacact

SEQ ID NO: 3778 - DNA, 288 bp, Homo sapiens
  D2S2195
  Located on chromosome 2
  Distance between a terminus base of telomere on chromosomal short arm and 5'-terminus of this base sequence : 164600259
  Distance between 3'-terminus of neighbour sequence of sequence listing upward to telomere on chrosomal short arm and 5'-terminus of this base sequence : 19270
atttcaacatttcaatatattcttctagaactttctctacacacacacacacacacacacacacacacacacaaacgttaacttatatgtactctttcaatgtcaataaataggtttttactgtgaatatacaatgccatttacatggcacaatagtgttctagtatttgttcaccagtttcatacaattattgatcctagaagcttgagattctactgtgttgaaaaaagatgtgagccttaatgcactttactcatgtgttttatattgatgtgtatggcatcatc

SEQ ID NO: 3779 - DNA, 445 bp, Homo sapiens
  chr2.fa.O7frz.172649548
  Located on chromosome 2
  Distance between a terminus base of telomere on chromosomal short arm and 5'-terminus of this base sequence : 164749235
  Distance between 3'-terminus of neighbour sequence of sequence listing upward to telomere on chrosomal short arm and 5'-terminus of this base sequence : 148688
tgcctggaatatttcttgtagaaaagatctgagaggttgggcacagtggctcatgactataatcccagcactttgggagggtgaggcaggaggattgcttgagcccaggcatttgagaccaccatgggtctcaaatccccatctctaaaaaaattaaaaagaaaaatagccaagtatggtggtgcatgcctgtggtcccagctacttgggagaatcacttgagcccaggaggttgaggctgcagtgagccatgattgcaccactgcactcaagcctgggtgacagagcaagaccctgtctcaaagcaaaacaaaaacaaaaaacaaaaagaaagaaagaaaaagaaagaaagagagagagagaaagaaagaaagaaagaaagaaagaaagaaagaaagaaagaaaggaaaagaaaaaaagaaagacgaaaggaagtaaagatctg

SEQ ID NO: 3780 - DNA, 460 bp, Homo sapiens
  AC019140.3_24158
  Located on chromosome 2
  Distance between a terminus base of telomere on chromosomal short arm and 5'-terminus of this base sequence : 164792071
  Distance between 3'-terminus of neighbour sequence of sequence listing upward to telomere on chrosomal short arm and 5'-terminus of this base sequence : 42391
tagtttgctccaaatgataaaggaaacatggaaattttttgagaagtgctctttaaaggtaaaagaagttggatcctgcttttataaaatgcagtataagcattcttctgctcttttgtttctcttctatccaaggaaatataaactcttaaaatgtagaggggaaacaaacctctttataccttcctttttacagtccaagtctgaggttacgtttggctttggaaagaatatttcttgtaacaaatagcccatgtcatgagagtagcacagataaaagacaaacatagactctttgggatgtttctatgcatccagtagtacctgagaatacacacacacaaacacacacacacacacacacacacacacacacacacacacacacggtataatgtatgtattgccctatgcaccctgtagatgtgaaagcagagctgtagctaataccactctttgg

SEQ ID NO: 3781 - DNA, 207 bp, Homo sapiens
  D2S2363
  Located on chromosome 2
  Distance between a terminus base of telomere on chromosomal short arm and 5'-terminus of this base sequence : 164851950
  Distance between 3'-terminus of neighbour sequence of sequence listing upward to telomere on chrosomal short arm and 5'-terminus of this base sequence : 59419
gtcatcaattctagtcccaaattttatgctagtaaattgtattacttaggaaggacactcagtgggaggcttgtgtgtgtgtgtgtgtgtgtgtgtgtgtgtgtgtgtggctttatttatttatttttgcctaaattcctcctctgtataaaagggagcgtaataatattctctgtgtgcttattaatatgacaggggctttatgta

SEQ ID NO: 3782 - DNA, 253 bp, Homo sapiens
  D2S2384
  Located on chromosome 2
  Distance between a terminus base of telomere on chromosomal short arm and 5'-terminus of this base sequence : 164938652
  Distance between 3'-terminus of neighbour sequence of sequence listing upward to telomere on chrosomal short arm and 5'-terminus of this base sequence : 86495
cagattgacttatattgcctgccgatgcctctcccctttctgtgacatttctaccccaaaatttttattccacaaaaggcttaatggaaagagaaattttgcatgttttgcaaataatccaaaagggtgtgtgtgtgtgtgtgtgtgtgtgtgtgtgtgtgtgtgtatacagacaagagcaaaagcagactatatttatatcgtatcaagcaaataatagaagtatacacaggacacctcaccctgctcaggt

SEQ ID NO: 3783 - DNA, 378 bp, Homo sapiens
  AC011241.6_9412
  Located on chromosome 2
  Distance between a terminus base of telomere on chromosomal short arm and 5'-terminus of this base sequence : 164953169
  Distance between 3'-terminus of neighbour sequence of sequence listing upward to telomere on chrosomal short arm and 5'-terminus of this base sequence : 14264
cttccatagtgataattatcgcacaaaatcgatacaaaggaaatacctgctgaatgttctgcctcagtaggttttcctttggtcttttaccttagaaaactgcatgatagcatttttctattattttgacatttcatgtaggaagcatgttattcacaacttatgttttataaaatctttttctgatgatgatgatgatgacacttgttaatttccatctccttccttcactgtaagtttttctattccctgagacaactatttctctcacttgtcctaaaccccaaggatacaagagatgcataggaaaatatctatgaagtgtgtgggaggagacaacagggcagggttccagaggtctgtggtttattgcacgta

SEQ ID NO: 3784 - DNA, 157 bp, Homo sapiens
  D2S2330
  Located on chromosome 2
  Distance between a terminus base of telomere on chromosomal short arm and 5'-terminus of this base sequence : 164991389
  Distance between 3'-terminus of neighbour sequence of sequence listing upward to telomere on chrosomal short arm and 5'-terminus of this base sequence : 37842
agtcatcttatagaaaatagcaagcccttacaataagtcccaattatttcccccattttacacacacacacacacacacacacacacacagccagccagagacacacaaagaaaaagtatcttgctctaattcacccaacaattaagttgtaaaact

SEQ ID NO: 3785 - DNA, 380 bp, Homo sapiens
  AC011241.6_141810
  Located on chromosome 2
  Distance between a terminus base of telomere on chromosomal short arm and 5'-terminus of this base sequence : 165064737
  Distance between 3'-terminus of neighbour sequence of sequence listing upward to telomere on chrosomal short arm and 5'-terminus of this base sequence : 73191
actccagtccatctgtctaaacatgcggtgctgctcagtttctctgaatcactcagtgcttaaaagaatctgagcagctttttgagtttgatataatatagatgagccaatactgaattacttcatcaacagtttactatgatctcaagagctaaaaacgttaattttctcttacatagagtgtatgcttctatgtttacccttctgtttggggagaagaggaagagcaatctgtgtgtgtgtgtgtgtgtgtgtgtgtgtgtgtgtgtgtgttgtgtatcccaataactcataagggcatcagtgtgacatacttttaaggtcatgctctttcaccaagaaatatctgtaatccacacgttagcatggtacatactaaa

SEQ ID NO: 3786 - DNA, 257 bp, Homo sapiens
  DISD22_0002004
  Located on chromosome 2
  Distance between a terminus base of telomere on chromosomal short arm and 5'-terminus of this base sequence : 165139319
  Distance between 3'-terminus of neighbour sequence of sequence listing upward to telomere on chrosomal short arm and 5'-terminus of this base sequence : 74202
ttgtcaacgtgggtatgcctctgtgtgtgtgtgtgtgtgtgtgtgtgtgtgtgtgtgtgtgcgcgcgcgctccccttctcccccaatttgtaatgtaaaaaatctccatatcattagaatattctgttaacaaaaagtgactgggcaaacaataaaataaaaaatgtaatctttattagttttgcacattttaaatgttggttagcattatttagcataatagtagcattttccagcatgcagttcacgaatacagt

SEQ ID NO: 3787 - DNA, 171 bp, Homo sapiens
  DISD22_0002014
  Located on chromosome 2
  Distance between a terminus base of telomere on chromosomal short arm and 5'-terminus of this base sequence : 165409327
  Distance between 3'-terminus of neighbour sequence of sequence listing upward to telomere on chrosomal short arm and 5'-terminus of this base sequence : 269751
agcagatgccataccagccctggattgcctgtccagacgtgtgtgtgagtgtgtgtgtgtgtgtgtgtgtgtgtgtgtgtatgtgtgtgtctatgtatgaaataaaattttatcttaagtcttaaattagattactcttatttgggttttctgtctcatgcagacaaatct

SEQ ID NO: 3788 - DNA, 227 bp, Homo sapiens
  AC017070.8_49556
  Located on chromosome 2
  Distance between a terminus base of telomere on chromosomal short arm and 5'-terminus of this base sequence : 165600256
  Distance between 3'-terminus of neighbour sequence of sequence listing upward to telomere on chrosomal short arm and 5'-terminus of this base sequence : 190758
catgattgcactgccatactccagcctgggcaacagagtgggactctgtctctaaataaataaataaataaataaataaataaataaataaatagaaaagaaattctactagagaagcttataaagcaaaatgtttggtgctgctcagattaggataaatggaacacatttaataggttctctgaggggtctacttttttacaacagtgaaggtagatggtacctac

SEQ ID NO: 3789 - DNA, 392 bp, Homo sapiens
  AC017070.6_7723
  Located on chromosome 2
  Distance between a terminus base of telomere on chromosomal short arm and 5'-terminus of this base sequence : 165636023
  Distance between 3'-terminus of neighbour sequence of sequence listing upward to telomere on chrosomal short arm and 5'-terminus of this base sequence : 35540
taataggaaatgtgctttcactacatacagagctttactccaggaactgtcaaatacagagctctactccgggaactgtcaaaagacacaacagagacagttaacaaagtccttaatcttcagggacctgtaactaaatgaaatacaccacagtaccccaaacaacaaacaaccaaatacagaacatgtattaggtaactatataagtagataattatgcaactgtgcacacacacacacacacacacacacacacacacacacaattataggtatttggaatgttctcccactttcacagagacttttctgacctctgtactcagtacccagcgcttgtagacctggatatggtctttccaatctttgagcatttatgcaattaacataac

SEQ ID NO: 3790 - DNA, 460 bp, Homo sapiens
  chr2.fa.O7frz.175140267
  Located on chromosome 2
  Distance between a terminus base of telomere on chromosomal short arm and 5'-terminus of this base sequence : 165819235
  Distance between 3'-terminus of neighbour sequence of sequence listing upward to telomere on chrosomal short arm and 5'-terminus of this base sequence : 182820
agcttacagtagcgatacaagttttccaaaatcctatttttgcttgaaagcttgaatttattatcaacaacaaatattgtcagatttatttatttatttatttatttatttatattttttgagacagtctcactctgtcacccaggctggagtgcagtggtgtgatctcggctcactgcaacctccgcctcccgggttcaagcgattctcttgcctcagcctctcgaggagctgggactacaggtgcccgccaccatgtccaggtaatttttttttttttgtatttttagtagagatgaagtttcaccatgttagccaggatggtctcgatctcctgacctcgtgatccacatgcctcggcctcccaaagtgctgggattactggcgtgagccaccgcgcccggccatcagctttttgttttttttttttttaagtgtcagtcttacttcattctgaaaa

SEQ ID NO: 3791 - DNA, 480 bp, Homo sapiens
  chr2.fa.O7frz.175217474
  Located on chromosome 2
  Distance between a terminus base of telomere on chromosomal short arm and 5'-terminus of this base sequence : 165951282
  Distance between 3'-terminus of neighbour sequence of sequence listing upward to telomere on chrosomal short arm and 5'-terminus of this base sequence : 131587
ccttgtaatcaactcatttcactatcatgctgtctgcaaagggcagagacttcagatgtgaggatagaaacacaaacaggtgcacacacacacacacacacacacacacacacacatgatacagcacagacttaaactctggtttgaaagactgaagggtctgattccagcacaagtttaaattgataggaaagaagagccaatgactgcatcacaaggtccctatgcagaaacatgcctcacatttaaacttctactccatctccacagctcactccacccaagttatcttctcatgtctctctcattcaaaactcacaaaaatataaggagacaaggaatcccctgaattcccattggaggctagagcctctgagggagatgagataggaactgccagaaagctgccccaagtcctggtgggacagtgttgtcatcacacaaactgtttagctgtggtgtcagattcctcagttattg

SEQ ID NO: 3792 - DNA, 358 bp, Homo sapiens
  AC067940.2_154332
  Located on chromosome 2
  Distance between a terminus base of telomere on chromosomal short arm and 5'-terminus of this base sequence : 166117424
  Distance between 3'-terminus of neighbour sequence of sequence listing upward to telomere on chrosomal short arm and 5'-terminus of this base sequence : 165662
gccagtgaggctagaatataagcaggcagaaaaatgtgaaatgagagactggcctagcctcccgcccacatctttctcccatgctggatgcttcctgccctcgaacatcggactccaagttcttcagttttgggacttggactggctctccttggtcctcagcctgcagatggcctattgtggaaccttgtgatcatgtgaattaataataaactcccctttatatatacacacacacacacacacacacacacacacacacacacacacacatatatatatatatttcattagctctgtccctctagagaatcctaatacagattttgataccaggaatggttctagaggaacagaa

SEQ ID NO: 3793 - DNA, 246 bp, Homo sapiens
  chr2.fa.O7frz.175596884
  Located on chromosome 2
  Distance between a terminus base of telomere on chromosomal short arm and 5'-terminus of this base sequence : 166233662
  Distance between 3'-terminus of neighbour sequence of sequence listing upward to telomere on chrosomal short arm and 5'-terminus of this base sequence : 115880
ttataagatagtatctgcaagccttgtggtaacctcaaatcaaaaaacataaaatgggtacaaaaaaataaaaagcaataaattaaatcataccaagagagaaaatcattttcactgaaaagaagacaggaaggaaggaaagaaggaagagaagaccacaaaacaacaagacaactaataaaacatggcaggggcaagttcttacctatcaataataacattgaatgtaaatggactaaattctcc

SEQ ID NO: 3794 - DNA, 423 bp, Homo sapiens
  AC019086.6_12893
  Located on chromosome 2
  Distance between a terminus base of telomere on chromosomal short arm and 5'-terminus of this base sequence : 166324207
  Distance between 3'-terminus of neighbour sequence of sequence listing upward to telomere on chrosomal short arm and 5'-terminus of this base sequence : 90299
tgcttatgataaacttatttcagatattaataattggtatttaattttctgtgaattcaggtatattttcatatggggatgaggagatgtagtttttatcttttttctgtaagaaattggtggccttcaggttttttcttacttcttaatgtggagtggtcttatcgtggtctttttctctggtcacatatttatactttttgtgtgtgtgtgtgtgtgtgtgtgtgtgtgtgtgtgtgacaagggtctcactctgttccccaggctggagtgcagtggtgtgatctcagctactgcaacctctgactcccaggttcaagtgattctcatgcctcagccccccaagtagctgggattatgtatttttaatagagatggggtttcaccatgttggccgggctagtttcgaactcttgatctcaa

SEQ ID NO: 3795 - DNA, 417 bp, Homo sapiens
  chr2.fa.O7frz.175784524
  Located on chromosome 2
  Distance between a terminus base of telomere on chromosomal short arm and 5'-terminus of this base sequence : 166434250
  Distance between 3'-terminus of neighbour sequence of sequence listing upward to telomere on chrosomal short arm and 5'-terminus of this base sequence : 109620
tctaacgttgtcctttagatgtacttttcagtggacactcgtatttcccttccattattcattgagatagtattgctctactgtttcctctcccattttagtcggggaaatgtgtccaacttgaactaatttcagttcttactgattctagttctgaaataagacttgaacttatgtgcatcatttccactggattgatttaaaaataaaatattgtcttatctggaattatgaagcgtttacatgaatcctggctaaatctttggcgtattaaaacccaaaagcttctcttactccatgacagtaagttgttctttctgtttctttccaatacttacgtggctcaataagttttgtgtgtgtgtgtgtgtgtgtgtgtgtgtgtgtgtgtgtgtgtgtcaagcatttactatctgc

SEQ ID NO: 3796 - DNA, 410 bp, Homo sapiens
  chr2.fa.O7frz.175876102
  Located on chromosome 2
  Distance between a terminus base of telomere on chromosomal short arm and 5'-terminus of this base sequence : 166526010
  Distance between 3'-terminus of neighbour sequence of sequence listing upward to telomere on chrosomal short arm and 5'-terminus of this base sequence : 91343
atgcaactagtaagtgaacgaactacagtttgagcccaagaggtctagctcaagaagttatatactctgaattattatggcatattatcttccaagctgctcacattttctgttggcaaagtgatgttattaaataacttggaggttttaagaatttttttaaaaaattagtagactgtgtgtgtgtgtgtgtgtgtgtgtgtgtgtgtgtgtgtagttttaggtttagagaaaaattgaatggaaaatatggagtattcccatatacccttcaccctgccatcatcaccccctgacccctgcactccccagttttcccttttatttacatcttgcattattagtggtacttttgttacagttgatgagccaatattaaaacactattgttggctaaagtgcatagttta

SEQ ID NO: 3797 - DNA, 194 bp, Homo sapiens
  DISO7_10000961
  Located on chromosome 2
  Distance between a terminus base of telomere on chromosomal short arm and 5'-terminus of this base sequence : 166603336
  Distance between 3'-terminus of neighbour sequence of sequence listing upward to telomere on chrosomal short arm and 5'-terminus of this base sequence : 76916
cccagttaaagagtgattaagatggaaggattattgtctatattcatatatatatatatatgtatgtatgtgtgtgtgtatgtgtgtgtgtatatatatatgtgtgtgtgtatgtgtgtgtgtatatatatatgtgtgtgtgtatatatatatacacgtatgtatgtatacacacacacctgatagaagaggca

SEQ ID NO: 3798 - DNA, 221 bp, Homo sapiens
  DISO7_10000960
  Located on chromosome 2
  Distance between a terminus base of telomere on chromosomal short arm and 5'-terminus of this base sequence : 166603336
  Distance between 3'-terminus of neighbour sequence of sequence listing upward to telomere on chrosomal short arm and 5'-terminus of this base sequence : -194
cccagttaaagagtgattaagatggaaggattattgtctatattcatatatatatatatatgtatgtatgtgtgtgtgtatgtgtgtgtgtatatatatatgtgtgtgtgtatgtgtgtgtgtatatatatatgtgtgtgtgtatatatatatacacgtatgtatgtatacacacacacctgatagaagaggcagcttgaggcaaagcaacaatgaattac

SEQ ID NO: 3799 - DNA, 297 bp, Homo sapiens
  G08180
  Located on chromosome 2
  Distance between a terminus base of telomere on chromosomal short arm and 5'-terminus of this base sequence : 166648934
  Distance between 3'-terminus of neighbour sequence of sequence listing upward to telomere on chrosomal short arm and 5'-terminus of this base sequence : 45377
tttctcactgctggaaaagggaggtgtaaatatggaggaagagaaaaccgaatgaacttagtagtattggattaaaattgtaagtatccatgtatggtttttaataagtagatatcaaaatgaacacagatgttaagtgtgtatatgcatttacctgtgagtatgtgtgcgtatacacacacacagataaaaagatagatagatagatagatagatagatagatagatagatagatgatagatatttcataactgtccacctcagagcctagagtcaatgcctcctcagtagctcct

SEQ ID NO: 3800 - DNA, 448 bp, Homo sapiens
  AC069165.2_72666
  Located on chromosome 2
  Distance between a terminus base of telomere on chromosomal short arm and 5'-terminus of this base sequence : 166694511
  Distance between 3'-terminus of neighbour sequence of sequence listing upward to telomere on chrosomal short arm and 5'-terminus of this base sequence : 45280
caagcaatctatgactgagaaggagaagcggaaggtaagctgtcatggctggctgggcgcatgtgccatagagagggatggacttgctgcccttagctacgaacacaagagaacgggttgattcctccttctctgtgggattcctgcagagatgtagcttgacagagcataaaaggggattccaaatcattactggcgtgcgcgcgcgcgcgcgcgcacacacacacacacacacacacacacacacacaccacatacattttaaactttattttaattcttttaaatagaagggatctcactgtgctgcccaggctggcatcaaagtcctaggctcaagggatcctcccacctcagcctctcaagtagctgggactacaggagcatgctactttgcctggaccacatgtatttttaaaaaatattattgacagatgacaaatgagac

SEQ ID NO: 3801 - DNA, 434 bp, Homo sapiens
  AC069165.2_97118
  Located on chromosome 2
  Distance between a terminus base of telomere on chromosomal short arm and 5'-terminus of this base sequence : 166810192
  Distance between 3'-terminus of neighbour sequence of sequence listing upward to telomere on chrosomal short arm and 5'-terminus of this base sequence : 115233
caaacatcaaactcaaagttcttcagtttttagactcagactggccttccttgcccctcaagcttgcagacagcctattgtgggaccttgtgatcatgtgtaagttaatacttaataaactcctatatatatataaaatgatatatatcctattactcccatatatatatatacacacacacacacacacacacacacacaaaataggatatatatcctataaacgcctataaatatgtatatatatgtgtatatgtgtgtgtgtatacatatatggatatatatcctattagttctgtccctctagagaacgctgtccctaatacagcccagtagtgggattactggatgaaatggtagttccatatttagttctttgagaaatctccattctgttttccataaaggttgtactaatttacattctcaccagc

SEQ ID NO: 3802 - DNA, 116 bp, Homo sapiens
  DISO7_10009100
  Located on chromosome 2
  Distance between a terminus base of telomere on chromosomal short arm and 5'-terminus of this base sequence : 166877168
  Distance between 3'-terminus of neighbour sequence of sequence listing upward to telomere on chrosomal short arm and 5'-terminus of this base sequence : 66542
ttcttcctgctcatattgtctctctctatctttctacacacacacacacacacacacacacacacacacacacacacacgaagacactcgtttagggtccaggagtgctgctacct

SEQ ID NO: 3803 - DNA, 313 bp, Homo sapiens
  chr2.fa.O7frz.168604369
  Located on chromosome 2
  Distance between a terminus base of telomere on chromosomal short arm and 5'-terminus of this base sequence : 167017899
  Distance between 3'-terminus of neighbour sequence of sequence listing upward to telomere on chrosomal short arm and 5'-terminus of this base sequence : 140615
tcgtgatctgaataccatttagataaatgcatataatgctaaaactttgaggcaattttcacattatatgcagcactcctaggcttatcctcagagcatccaattctggactgcacaactatgaagcctgacactctacagctattaccacctgctctactatctttaatcctattgcaaatagatagatcaatagatagatagagagatagatgatagatcgatagatagataacagatagaaataaataaataaataaataaataaataaataaataaataaaagacatggatacagataggttagaacaa

SEQ ID NO: 3804 - DNA, 467 bp, Homo sapiens
  chr2.fa.O7frz.168491485
  Located on chromosome 2
  Distance between a terminus base of telomere on chromosomal short arm and 5'-terminus of this base sequence : 167130618
  Distance between 3'-terminus of neighbour sequence of sequence listing upward to telomere on chrosomal short arm and 5'-terminus of this base sequence : 112406
ttacatatgcaccatggaatactatgcagccataaaaaaggatgagttcatgttctttacagggacatggatgaaattggaaatcatcattctcagcaaactattgcaaggacagaaaaccaaacaccacatgttctcactcacaggtgggaattgaacaatgagcacacatggacacaggatggggaacatcacacgccagggcctgtcgtggggtggggggagggggagggatagcattaggagatatacctaacataaatgacgagttaacgggtgcagcacaccaacatggcacatgtatacatatgtaacaaacctgcacgttgtgcacatgtaccctagaacttaaagtaaaatagtataaataaataaataaataaataaataaataaataagactgcttaaaaattagatactgagttttaattatcaagttgtaagtatcattacaataaacaggcaa

SEQ ID NO: 3805 - DNA, 252 bp, Homo sapiens
  chr2.fa.O7frz.168397612
  Located on chromosome 2
  Distance between a terminus base of telomere on chromosomal short arm and 5'-terminus of this base sequence : 167224702
  Distance between 3'-terminus of neighbour sequence of sequence listing upward to telomere on chrosomal short arm and 5'-terminus of this base sequence : 93617
tgcatagtcaatgagcgtccccgcacctccgacttacaaagagcggccgccggctggcgggagggaggagcgcgagtgcgggaggggctgggctccctccagtgcgcccgtgggcgcgcaggcgcgagcgtgtgtgtgtgtgtgtgtgtgtgtgtgtgtgtgtgtgtgtgtgtgtgtgtgtgtgtgtgccctttcactgtagcagccagggctccaaacattcctttctgtactgaagagttcctcaattgt

SEQ ID NO: 3806 - DNA, 105 bp, Homo sapiens
  DISO7_10001012
  Located on chromosome 2
  Distance between a terminus base of telomere on chromosomal short arm and 5'-terminus of this base sequence : 167226033
  Distance between 3'-terminus of neighbour sequence of sequence listing upward to telomere on chrosomal short arm and 5'-terminus of this base sequence : 1079
ctcagcaggatggagcccaaaccaatacacacacacacacacacacacacacacacacacactgtgtcgccatgtaaaatatatttctcatatgcatctcagcca

SEQ ID NO: 3807 - DNA, 212 bp, Homo sapiens
  DISD22_0002023
  Located on chromosome 2
  Distance between a terminus base of telomere on chromosomal short arm and 5'-terminus of this base sequence : 167343298
  Distance between 3'-terminus of neighbour sequence of sequence listing upward to telomere on chrosomal short arm and 5'-terminus of this base sequence : 117160
cattaatcagtttgtcacctaattgaaagctaaattttcaaccaaatgttaatagcaaaactagttgtttgtttaatatctttaagcatagtctgcaaaaataaaggggggaggcaaatcaccatacaaagtgtgtgtgtgtgtgtgtgtgagtgtgagtgtgtgtgtggtaaaattctagtatgaaaatgacacaatcatttatgagcatg

SEQ ID NO: 3808 - DNA, 235 bp, Homo sapiens
  DISD22_0002026
  Located on chromosome 2
  Distance between a terminus base of telomere on chromosomal short arm and 5'-terminus of this base sequence : 167427868
  Distance between 3'-terminus of neighbour sequence of sequence listing upward to telomere on chrosomal short arm and 5'-terminus of this base sequence : 84358
agcctaagccatagaatcatgagcaaataaatgattgctgtttcaagactaaaatatatatatatatatatatatatatagatagatagatagatagatagatagatagatatagatacctcatctgtttcatttccttcttgaagttcttttccagtctgttgaaattttggttcaatcttcttagatatttcaccaactctctgcttttcttcttcataggccatggcaagta

SEQ ID NO: 3809 - DNA, 446 bp, Homo sapiens
  chr2.fa.O7frz.173525254
  Located on chromosome 2
  Distance between a terminus base of telomere on chromosomal short arm and 5'-terminus of this base sequence : 167521163
  Distance between 3'-terminus of neighbour sequence of sequence listing upward to telomere on chrosomal short arm and 5'-terminus of this base sequence : 93060
gttgcaaatgacaagatcttactctttcttatagctgaatagtactccattgtatatatgtaccacatttttgtttgtttgtttgtttgacacagagtctcgctgtcgcccaggctggagtgcagtggcgtgatctcggctcactgcaggctccgccccccggcgttcacgccattctcctgcctcagcctcctgagtaactgggactacaggcgcctgccaccacgcccggctaattttttgtattttcaggagagacatggtttcaccgtgctagccaggatggtctcgatctcctgacctcgtgatccgcccacctgggcctcccaaagtgctgggattacaggcgtgagccaccgcgcccggccatgtaccacatttctttatccattcatctgctgatgaacacataggttgcttccaaatcttggctattgtaaacagtg

SEQ ID NO: 3810 - DNA, 301 bp, Homo sapiens
  chr2.fa.O7frz.173792063
  Located on chromosome 2
  Distance between a terminus base of telomere on chromosomal short arm and 5'-terminus of this base sequence : 167692614
  Distance between 3'-terminus of neighbour sequence of sequence listing upward to telomere on chrosomal short arm and 5'-terminus of this base sequence : 171005
tagataagagcattgagctaaactccaagcctatgcagcaacaagcagggtatcacatatgtgacctttatccattggatgtattaaggcactgagaccattgtcctgaatatccatccctttgctttaatgacaatataggcatatattccttatttcttctttttatattttggggaccctctgaagatagcagagacaagcagctccttctgtgtgtgtgtttgtgtgtgtgtgtgtgcgtacgtgtgtgtgtatgtgtgtgtgtgtataattctacttaccaacctatgaagtagca

SEQ ID NO: 3811 - DNA, 245 bp, Homo sapiens
  chr2.fa.O7frz.173865831
  Located on chromosome 2
  Distance between a terminus base of telomere on chromosomal short arm and 5'-terminus of this base sequence : 167724243
  Distance between 3'-terminus of neighbour sequence of sequence listing upward to telomere on chrosomal short arm and 5'-terminus of this base sequence : 31328
cagtgaattgtagaaaatggttaccctttatacaaattttagaaatacatttaagtgtagattactctgtatggatttacacacacacacacacacacacacacacatatacagttttaagaaaagggtggaaaaacaaatcataaatatataatgaaaacttctaaacaggagtcaaaattgaatttgaaggcggtagtcaagtaagttttacttttgctgcctgctaacaatttctagaagca

SEQ ID NO: 3812 - DNA, 310 bp, Homo sapiens
  chr2.fa.O7frz.173951674
  Located on chromosome 2
  Distance between a terminus base of telomere on chromosomal short arm and 5'-terminus of this base sequence : 167831075
  Distance between 3'-terminus of neighbour sequence of sequence listing upward to telomere on chrosomal short arm and 5'-terminus of this base sequence : 106587
taccatatgatctagcaatcctagtacttagtatatatccaaaggatataaaatcagtatgttgaaaggatatctgcattcctatgtttgctgcagcactattcacaatagctaagatatagagtcaatctaagtgttcataaatgaataaatgggtaaagaaaacacggtgtaaaaatgcagtacatatatatataatataatacacacacacacacacacacacacagtgaaatacaattagccttaaaaaaacaagacagtcctgttagttgcaatagtatgaatgatcctaaagaatgtcaagtta

SEQ ID NO: 3813 - DNA, 123 bp, Homo sapiens
  D2S1395
  Located on chromosome 2
  Distance between a terminus base of telomere on chromosomal short arm and 5'-terminus of this base sequence : 167986504
  Distance between 3'-terminus of neighbour sequence of sequence listing upward to telomere on chrosomal short arm and 5'-terminus of this base sequence : 155119
atcccaaacacgatgttgattatctgtcttttatctatctatctatctatctatctatctatctatctatctatcatattaaactcattatcattctatgggatgtaggtttcctttcatgcc

SEQ ID NO: 3814 - DNA, 152 bp, Homo sapiens
  D2S1379
  Located on chromosome 2
  Distance between a terminus base of telomere on chromosomal short arm and 5'-terminus of this base sequence : 167986504
  Distance between 3'-terminus of neighbour sequence of sequence listing upward to telomere on chrosomal short arm and 5'-terminus of this base sequence : -123
atcccaaacacgatgttgattatctgtcttttatctatctatctatctatctatctatctatctatctatctatcatattaaactcattatcattctatgggatgtaggtttcctttcatgcctattttacagatgaaggaattgagtttga

SEQ ID NO: 3815 - DNA, 441 bp, Homo sapiens
  chr2.fa.O7frz.174238220
  Located on chromosome 2
  Distance between a terminus base of telomere on chromosomal short arm and 5'-terminus of this base sequence : 168008295
  Distance between 3'-terminus of neighbour sequence of sequence listing upward to telomere on chrosomal short arm and 5'-terminus of this base sequence : 21639
cttaatctgcactatagaccaaacgcagcttatagatatttacagaaaatttcatacaatggctgcagagtacacattcttctcctcaacacatggatcattctcaaggatggaccatgtgttaggccacagaacaagtcttaaaagatttaaattacaagttcacagaacaaatattcaactcacataaggccagtcctgtttagcaactctctctcattcctgggtcaccaacctgtcagcttgctattcttgaagaaatggcaccaagcctatctctgtagttttgctgcatttcatattgagtgggtttttggcttgaggttttttcatgtggggggtgtgtgtgtgtgtgtgtgtgtgtgtgtgtgtgtgtgtgttttaagatatttcaacttcttagcaggaaattttttgctgctgatttaaatctaattgaag

SEQ ID NO: 3816 - DNA, 159 bp, Homo sapiens
  chr2.fa.O7frz.174140797
  Located on chromosome 2
  Distance between a terminus base of telomere on chromosomal short arm and 5'-terminus of this base sequence : 168072391
  Distance between 3'-terminus of neighbour sequence of sequence listing upward to telomere on chrosomal short arm and 5'-terminus of this base sequence : 63655
ttatgcctgtaaggataaatgtagagtactggtttgctaggggtgccgtaacaaaatgccacagattgagtagcttaaaccagagaagagaaaaaaacttttttttgttttgttttgttttgttttgcagttttagaggttagaagtcaagatcaagtt

SEQ ID NO: 3817 - DNA, 217 bp, Homo sapiens
  D2S399
  Located on chromosome 2
  Distance between a terminus base of telomere on chromosomal short arm and 5'-terminus of this base sequence : 168080701
  Distance between 3'-terminus of neighbour sequence of sequence listing upward to telomere on chrosomal short arm and 5'-terminus of this base sequence : 8151
caaacatcctacctgcacagaataaggctctaataacaaagaattatctggttcaaaatattaacagtgacaagatttagaaatcctgttctggagttagactgcgcttttcacatggcagacctgattatgtcatgtgtgcatgtgtatacacacacacacacacacacacacacacacacacacacttaaaaacattcaataacttcccattgag

SEQ ID NO: 3818 - DNA, 101 bp, Homo sapiens
  DISD22_0002029
  Located on chromosome 2
  Distance between a terminus base of telomere on chromosomal short arm and 5'-terminus of this base sequence : 168168874
  Distance between 3'-terminus of neighbour sequence of sequence listing upward to telomere on chrosomal short arm and 5'-terminus of this base sequence : 87956
atacatggttgggtgtcaagaattttgtgtgtgtgtgtgtgtgtgtgtgtgtgtgtgtgtgtgtgtgtagactggccacgatagatgagtgttatttgtgt

SEQ ID NO: 3819 - DNA, 465 bp, Homo sapiens
  chr2.fa.O7frz.174539379
  Located on chromosome 2
  Distance between a terminus base of telomere on chromosomal short arm and 5'-terminus of this base sequence : 168397273
  Distance between 3'-terminus of neighbour sequence of sequence listing upward to telomere on chrosomal short arm and 5'-terminus of this base sequence : 228298
ttatcatgctatttaggcagtatgtcatttataaattttctttggcaacacacttcctgttttgctgtcctctatgtgtaggaatgcttagtaaatagagtgagcctttggggaatagagggcttgtttcattaagtagaataaaatctttactatttagaactctcaaaaaagtaatttttttagattgaaacattttccgaatagaattattttcttttaatcaaaagtctgcaaatatatatatatatatatgtgtgtgtgtgtgtgtgtgtgtgtgtgtgtttaattttaaacatttggatggaaaggtttataatatataaattatatttatttttgaatttgaaacaatatataaaataaaacttagcctttacccattgatactgtattaacatgagacatcaacacagaagagcccagtgcctgctgagatgtgtaagacctaagtgtacatgaagc

SEQ ID NO: 3820 - DNA, 178 bp, Homo sapiens
  DISO7_10001013
  Located on chromosome 2
  Distance between a terminus base of telomere on chromosomal short arm and 5'-terminus of this base sequence : 168515542
  Distance between 3'-terminus of neighbour sequence of sequence listing upward to telomere on chrosomal short arm and 5'-terminus of this base sequence : 117804
gagaccgcacaatcacacaataaattttttaaaaagtattactgcagggtttattttgaaatttatgtgtgtatatatatatatatacacacacacacacacacacacacacacatacacatacacatacacatacacatacacatgtatataatactgatctctatcaaccaccatg

SEQ ID NO: 3821 - DNA, 418 bp, Homo sapiens
  chr2.fa.O7frz.176863434
  Located on chromosome 2
  Distance between a terminus base of telomere on chromosomal short arm and 5'-terminus of this base sequence : 168632909
  Distance between 3'-terminus of neighbour sequence of sequence listing upward to telomere on chrosomal short arm and 5'-terminus of this base sequence : 117189
aagttccgtgataatcagtctattctttcttctctgtgtcagttatcccttgctgtgtgacaaaatcatcccaaaacttagtggcttaaacaacacttatttttatatatatacacatatatacacacacacgtacatatatgtgtgtgtatatatatgtatatatacacatatatagtatatgtatacatacacacactaggataataaatatatatatataaatatatataaggaaactataggataacaaatgttgtttattatatacactatacatacagtatccttccatttatttatttttatttaacttttaagttgtggggtacatatgcaggtttgttacagaggtaaacttgtgtaatgggggtttgttgtacagaatatttcatcacctaggtattaagtctaggac

SEQ ID NO: 3822 - DNA, 473 bp, Homo sapiens
  AC016772.6_50598
  Located on chromosome 2
  Distance between a terminus base of telomere on chromosomal short arm and 5'-terminus of this base sequence : 168743040
  Distance between 3'-terminus of neighbour sequence of sequence listing upward to telomere on chrosomal short arm and 5'-terminus of this base sequence : 109713
gactcggtaattcataaggaatagaaatttattggcttatggttctggaggctgagaaagctagtatcgaggtgccagcatctggcaggggccttcttgccgcatcataacatgatggaaggcattacatggcaaaagggcaaagagagggcaacaggcgcacgcacacacacacacacacacacacacacacacacacaccacacagagacagagagagagagagagaaagaagagggccaactttcccacttttataatgaacccattccccagataatggcattaatccctttactctgccctcatggcctatcacctctcattagtccctaccttccaacatttttacattggggattaagttcccacacatgcctctgatagctgtgatatttaaaattgccactgaacatttgacaaacatacttggtgagtttgaagtcagactaaataacaataagcctcatgag

SEQ ID NO: 3823 - DNA, 387 bp, Homo sapiens
  AC009967.6_160869
  Located on chromosome 2
  Distance between a terminus base of telomere on chromosomal short arm and 5'-terminus of this base sequence : 168865912
  Distance between 3'-terminus of neighbour sequence of sequence listing upward to telomere on chrosomal short arm and 5'-terminus of this base sequence : 122399
tttaaggttctagcattgtcagggaaatggtaaaagcattttaacaactataggtagccctttttcccacagaaagtattctggttctcaaggtcacctgggatatcacattgtaactcattgctttattccacatctctctctctctccctccctctctctccccctctctccctctctccctccctccttcacacacacacacacacacacacacacacacacacacacaccattcttagaataacaatgccaacatgcagtttgggtatgaatttttaataattccagattttattttatttatttattgagttagttagtttgtttgttttgagatagtctctctctctgtcgcccaggctggagtgcagtggtatgatctcg

SEQ ID NO: 3824 - DNA, 376 bp, Homo sapiens
  AC009967.6_109318
  Located on chromosome 2
  Distance between a terminus base of telomere on chromosomal short arm and 5'-terminus of this base sequence : 168894070
  Distance between 3'-terminus of neighbour sequence of sequence listing upward to telomere on chrosomal short arm and 5'-terminus of this base sequence : 27771
gattcaccttcaaacatctattagcaagaaaacacaaaagtagtcctacaatctattcccaaaattcagggagaccctagatttctggcttttaggcaatctgatattcatcttgcgcgcgcgcgtgcgcgcgcacacacacacacacacacacacacagaaatagaaaaacttagcaagcctagcagccttcagagtggtactcttggcctggagttttgatttagttgagttttctgccccttagtgatgaattctctcaattgccctaaccaaaagtctaaaatattataatcatctgccttgaataatttttcatggatttttttccccctcgcatttaaagtccaggttagaatgataagtccattctacg

SEQ ID NO: 3825 - DNA, 446 bp, Homo sapiens
  AC009967.6_64334
  Located on chromosome 2
  Distance between a terminus base of telomere on chromosomal short arm and 5'-terminus of this base sequence : 168939074
  Distance between 3'-terminus of neighbour sequence of sequence listing upward to telomere on chrosomal short arm and 5'-terminus of this base sequence : 44628
gttacatcagacggagtaatttagaacagaaatttatttattccagtctggaagctgggaagtccaagattaaggcatttgtgtgtgtgtgtgtgtgtgtgtgtgtgtgtgtgtgtgtgtgtgtgtgtgtgtgtgtgtgtctggtgaggccttcttgcatactcacatggcagaagcggggaagagggcaaacagggcctaaggtagttccctccagcacttgcttaaggcagagccctcatgacttaatcacatccccaaaggcttccgcctcttaataccaccacagtggagattaagtttcaatgtgaattttgtaggggacacacgttcagactggtgctctgcctctgcccctcgcccccaaaaagtttatgtccttttcacatacaaatacattcattccattccagtaactccagaagtcttaacttgttctagcacca

SEQ ID NO: 3826 - DNA, 424 bp, Homo sapiens
  AC009967.6_26097
  Located on chromosome 2
  Distance between a terminus base of telomere on chromosomal short arm and 5'-terminus of this base sequence : 168977236
  Distance between 3'-terminus of neighbour sequence of sequence listing upward to telomere on chrosomal short arm and 5'-terminus of this base sequence : 37716
gtactggaacctaggtctcctaacttttggtgtgacatgataattatgctctgcctctctttattgtattgtattgtattgtattgtattgtattgtatttttttgagacagagtcttgctctgttgcccaggctggagtgcagtggcgtgatctcagcccactgcaacctctgcctcctgggttcaagcgattctcctgcctcagcctcccgagtagctgggattacaggtacctgccatcatgcccagctaattttaatttttgtatttttgtagagacagggttttaaccatgttggccaggctggtcttgagctcctgacctcgggtgatctgccagccttggcctcctaaagtgctgagattacaggcatgagccaccacgcccggccctacgtctctttctttaaacgcaaggctgag

SEQ ID NO: 3827 - DNA, 432 bp, Homo sapiens
  AC021781.3_108163
  Located on chromosome 2
  Distance between a terminus base of telomere on chromosomal short arm and 5'-terminus of this base sequence : 169056854
  Distance between 3'-terminus of neighbour sequence of sequence listing upward to telomere on chrosomal short arm and 5'-terminus of this base sequence : 79194
atactttcaattccaatccatccctctaggagtcattcttgttttctctctttctcagtttccagagtaactctgtaactctctacttctgcagtgagatacctgacacctataactctctctctctctctctctctatctgtgtatctatctatctggatagatatatttaacttttttagttaaaaattacatatatttaactaaaatgttatatatatatatataacttttttaaaaatcaactcccttatatataaccactttcttctaatcttttaccatacaaatgccctcccgtgccaggttgtcgagtcctgacactctgtgctaggacatgttcagaaagggaagagaggggatgggtagatttaattttttgaaatggccaacatcattgagagttaactttgatgaataagttgagtgatc

SEQ ID NO: 3828 - DNA, 310 bp, Homo sapiens
  AC021781.3_46438
  Located on chromosome 2
  Distance between a terminus base of telomere on chromosomal short arm and 5'-terminus of this base sequence : 169205687
  Distance between 3'-terminus of neighbour sequence of sequence listing upward to telomere on chrosomal short arm and 5'-terminus of this base sequence : 148401
cagtaagataacagacttgtatggttttcagccgctaactttgtggtaatttgttatgcagcagtagaaaattaatacggatgcctttccacattaaatcagtgctggcctatgtgatcagtacagtatggaggaagcaacaatgtgtgactttgtttctgtgtgtgtgtgtgtgtgtgtgtgtgtgtgtgtgtgcgcgcgcgcatgtgtatttgtagagatggggtctctctttgttgcccagcctggtcttgaacttctggcctcaagcaatcctcccaactctgtgtgactttgacgactacatcac

SEQ ID NO: 3829 - DNA, 384 bp, Homo sapiens
  DISO7_00004141
  Located on chromosome 2
  Distance between a terminus base of telomere on chromosomal short arm and 5'-terminus of this base sequence : 169314164
  Distance between 3'-terminus of neighbour sequence of sequence listing upward to telomere on chrosomal short arm and 5'-terminus of this base sequence : 108167
caccttcagaaaggcctaacgcagcaagaaagataacaatataggctgagtgcagtagctcacacctgtaatctcagcactttgggaggctgaggctagaggatcacttgagcccaggagttcaagaccaacctgagcaatatagtgagacctcgtctctgcaaaaaattttaaaaattagccacacctggtggcatccatctgtggtcccagctactcaggtggctgaggtaggaggattgcttgatcctaggaggcagaggttgcagtaagccaagatcataccactgcactccagcctggcaacagagcaagaccttgttacacacacacacacacacacacacagacacacacgatacagtattgctagttggatcaatt

SEQ ID NO: 3830 - DNA, 229 bp, Homo sapiens
  D2S2381
  Located on chromosome 2
  Distance between a terminus base of telomere on chromosomal short arm and 5'-terminus of this base sequence : 169402785
  Distance between 3'-terminus of neighbour sequence of sequence listing upward to telomere on chrosomal short arm and 5'-terminus of this base sequence : 88237
agttgctcagtaaatatctcttatgaatgttgagtgttgtatgagtattaaatatgtaacagtaggttttaaataatttttcctgttattctcataggtaaaccattcttatcagaccatatgtttatttttctattagaaaatttctgtctttctgtacacacacacacacacacacacacacacacacacacacacacagatccagatattcctcgacttccaatga

SEQ ID NO: 3831 - DNA, 108 bp, Homo sapiens
  D2S335
  Located on chromosome 2
  Distance between a terminus base of telomere on chromosomal short arm and 5'-terminus of this base sequence : 169501661
  Distance between 3'-terminus of neighbour sequence of sequence listing upward to telomere on chrosomal short arm and 5'-terminus of this base sequence : 98647
attcatcattttctattactctgtgtgtgtgtgtgtgtgtgtgtgtgtgtgtgtgtgtgtgtgtatatatacataaaaatgaatatactcagccctcttgaaaattaa

SEQ ID NO: 3832 - DNA, 385 bp, Homo sapiens
  AC064826.3_20235
  Located on chromosome 2
  Distance between a terminus base of telomere on chromosomal short arm and 5'-terminus of this base sequence : 169532213
  Distance between 3'-terminus of neighbour sequence of sequence listing upward to telomere on chrosomal short arm and 5'-terminus of this base sequence : 30444
taggcaaccatacattgttaagttttcagtttcagctgactggagctactggcttcaggtaaataatagctcatctcaaggtagctacatgtcacaaaacactcaatggggattggaacaatgcctgtaaggagtgtgtgtgtgtgtgtgtgtgtgtgtgtgtgtgtgtgtgtgtgtgttttgtttgttactattcaaggacaatattttccaggaatgagaccaatgtacattttgccactcataagaagttgcatgggaaaccctgagttaattggcaccatgtttctaattaattctaataatagttagaatcctttaattgggccccctgagcaatgatccagcactgccctttattgtgaactgattagacataaggaag

SEQ ID NO: 3833 - DNA, 283 bp, Homo sapiens
  AC064826.3_109670
  Located on chromosome 2
  Distance between a terminus base of telomere on chromosomal short arm and 5'-terminus of this base sequence : 169545549
  Distance between 3'-terminus of neighbour sequence of sequence listing upward to telomere on chrosomal short arm and 5'-terminus of this base sequence : 12951
tacttgcaatgttatgctatgtaaaaaaaaacaaccccagtttacataagtgttcatagaaaatgatcctacatacatgaatatacgtgtgtgtgtgtgtgtgtgtgtgtgtgtgtgttcaggaaaagcagtcaccaaaatactgagtgtttatctctgaggggtggattatatgtgatttttattttcattttgcttctgtatttttgatttgcatatttttttaaaaattacaaatacaacaggaataaattgttccgtagtgccagaaatgttatacagt

SEQ ID NO: 3834 - DNA, 384 bp, Homo sapiens
  chr2.fa.O7frz.177535741
  Located on chromosome 2
  Distance between a terminus base of telomere on chromosomal short arm and 5'-terminus of this base sequence : 169651734
  Distance between 3'-terminus of neighbour sequence of sequence listing upward to telomere on chrosomal short arm and 5'-terminus of this base sequence : 105902
ttctcttgaaggagtaggataaacaccctcttgagtattgctttttacacagacacacaccacacacacacacacacacacacacacatacacacagcatagttcatagtcacttgatttgccacctgcagtttataatagaatggacctgtgggattataaaccactttatttctgcacagaatttctcagcttgaggccaaattgaagggcattagtcatcagtaatttgcagatgtttttaatgtttttcacccaagagaggtttcaggcagctaaagctaagataaatttcctcatgctttggtggggaaatgaaaaatctgatcatttagttaatcatttgtaagagctgtgggtatgtattgttccttagtgactgca

SEQ ID NO: 3835 - DNA, 461 bp, Homo sapiens
  AC012594.6_26363
  Located on chromosome 2
  Distance between a terminus base of telomere on chromosomal short arm and 5'-terminus of this base sequence : 169847708
  Distance between 3'-terminus of neighbour sequence of sequence listing upward to telomere on chrosomal short arm and 5'-terminus of this base sequence : 195590
aattaggaactaaggatagctgagcttgtgggcaacttcggtggaatagaaagaaatgttttttaagtgttgacaggttgaggaactcttagatcagatccatctcagttatggcacatattcaagagtattcaaaaacaaggctaagaatcatggagggcttgttcacatagagcagaagctgtactgtgcttggagggcttgaatttgtaagtcccctgtctcacctctcctgggtctaaccattcaggcttttctgagtgctttttggaaagccaggatgtgattcatccctatttcactctctctatatatatatatgcatacatacacacacacacacacacacacacacacacacacacacacactacagatatagatacaggacagcagaggcacctgtggagaagtgatattgtactatttgagatttgatagataccattacctgatgctga

SEQ ID NO: 3836 - DNA, 471 bp, Homo sapiens
  AC068280.4_103680
  Located on chromosome 2
  Distance between a terminus base of telomere on chromosomal short arm and 5'-terminus of this base sequence : 169847708
  Distance between 3'-terminus of neighbour sequence of sequence listing upward to telomere on chrosomal short arm and 5'-terminus of this base sequence : -461
aattaggaactaaggatagctgagcttgtgggcaacttcggtggaatagaaagaaatgttttttaagtgttgacaggttgaggaactcttagatcagatccatctcagttatggcacatattcaagagtattcaaaaacaaggctaagaatcatggagggcttgttcacatagagcagaagctgtactgtgcttggagggcttgaatttgtaagtcccctgtctcacctctcctgggtctaaccattcaggcttttctgagtgctttttggaaagccaggatgtgattcatccctatttcactctctctatatatatatatgcatacatacacacacacacacacacacacacacacacacacacacacactacagatatagatacaggacagcagaggcacctgtggagaagtgatattgtactatttgagatttgatagataccattacctgatgctgattatagtgta

SEQ ID NO: 3837 - DNA, 198 bp, Homo sapiens
  chr2.fa.O7frz.177639465
  Located on chromosome 2
  Distance between a terminus base of telomere on chromosomal short arm and 5'-terminus of this base sequence : 169962862
  Distance between 3'-terminus of neighbour sequence of sequence listing upward to telomere on chrosomal short arm and 5'-terminus of this base sequence : 114683
ttacctacatgagagcaatcagggttctccagagaaacaaaaccagtaggggtgtgtgtgtgtgtgtgtgtgtgtgtgtgtgtgtctgggtaagtgtgggtaagtgtgggtaagtgtgtgtggtgtgtagactcagtacagtctagagacagaatccctttcttcctcgtcacgggacttcaatcttttaaggccttc

SEQ ID NO: 3838 - DNA, 257 bp, Homo sapiens
  Z67280
  Located on chromosome 2
  Distance between a terminus base of telomere on chromosomal short arm and 5'-terminus of this base sequence : 169991110
  Distance between 3'-terminus of neighbour sequence of sequence listing upward to telomere on chrosomal short arm and 5'-terminus of this base sequence : 28050
gggaaaacctgcctggtgctctaactagaggattttatcaacggagaaaaggcagtgggggaagggaagggaattagttaatgaaattctaacaggtggtggctatttttctttatttctattttttccttctttcaatattgttgtttcactgtttggccataatgtttgtgtgtgtgtgtgtgtgtgtgtgtaataataaaaattgtattaatgtctcacttaaatttttctcttttggtgtttgtagcaataat

SEQ ID NO: 3839 - DNA, 268 bp, Homo sapiens
  D2S376
  Located on chromosome 2
  Distance between a terminus base of telomere on chromosomal short arm and 5'-terminus of this base sequence : 169991113
  Distance between 3'-terminus of neighbour sequence of sequence listing upward to telomere on chrosomal short arm and 5'-terminus of this base sequence : -254
aaaacctgcctggtgctctaactagaggattttatcaacggagaaaaggcagtgggggaagggaagggaattagttaatgaaattctaacaggtggtggctatttttctttatttctattttttccttctttcaatattgttgtttcactgtttggccataatgtttgtgtgtgtgtgtgtgtgtgtgtgtaataataaaaattgtattaatgtctcacttaaatttttctcttttggtgtttgtagcaataataacaacaacaacaa

SEQ ID NO: 3840 - DNA, 301 bp, Homo sapiens
  AC007277.2_133327
  Located on chromosome 2
  Distance between a terminus base of telomere on chromosomal short arm and 5'-terminus of this base sequence : 170036278
  Distance between 3'-terminus of neighbour sequence of sequence listing upward to telomere on chrosomal short arm and 5'-terminus of this base sequence : 44897
aaacagaaattgactgaacactacaaagttgtaaaacatgcatacacacacacacacacacacacacacacacactctagacacacacactacacacacatacactctttctctctctctctctcacacatacacacacacacacacacacacacacatacacacacacaccccaagaatcaaacagaatctcagcaggaaacagattgcacactcaaattaggataattggagtattgtttaataaagggattattttttaaggttggggcaagatatagtgaaaccataaaggatagtg

SEQ ID NO: 3841 - DNA, 277 bp, Homo sapiens
  AC007277.2_123140
  Located on chromosome 2
  Distance between a terminus base of telomere on chromosomal short arm and 5'-terminus of this base sequence : 170046347
  Distance between 3'-terminus of neighbour sequence of sequence listing upward to telomere on chrosomal short arm and 5'-terminus of this base sequence : 9768
cagtataaatctgtaaggcagaaccactctgtcttctagagagagtctctagaagaattctgttattctagaaattggactgcttctaggggatactatatatatatatacacctagtatacatatatatgtagtaaacatatgtaataaacatatatgtatactgtgtgtatatatatatatatatatatatgtatgctatgttgtactagcaaagtttaactgaatttagaatcaaactgaattatctaataactagtaggatgtagcatgcttg

SEQ ID NO: 3842 - DNA, 339 bp, Homo sapiens
  AC007277.2_115631
  Located on chromosome 2
  Distance between a terminus base of telomere on chromosomal short arm and 5'-terminus of this base sequence : 170053968
  Distance between 3'-terminus of neighbour sequence of sequence listing upward to telomere on chrosomal short arm and 5'-terminus of this base sequence : 7344
tcaaattgtataagcttcaggtcccacaaaaccttatatatgtgtgtgtgtgtgtgtgtgtgtgtgtgtgtgtgtgtgtgtatgaaagcgtaaatagtatatgtttttaatctttgtataaatgcagaatatatttatcactctgcagggttttatttttccttgaaatgtttccaatatttatcacgttgatacatatagaactctcattaatttcatgactacaacacaatattctcttttttattgtcattttggttgttcatgatttctcgctattataaatgacgctgtgatggatgttcttgtatatatctcttcatgtagaagcacaagaaa

SEQ ID NO: 3843 - DNA, 258 bp, Homo sapiens
  AC007277.2_101532
  Located on chromosome 2
  Distance between a terminus base of telomere on chromosomal short arm and 5'-terminus of this base sequence : 170067968
  Distance between 3'-terminus of neighbour sequence of sequence listing upward to telomere on chrosomal short arm and 5'-terminus of this base sequence : 13661
tgtgcttcaagctaagacttaccctttgtgtgcaaatcccaatcccatctatattccagtcaccacctcctccttgcagcctttcctaccttgcttttctctggttgttccaatctgcccaatgagtatgcactctttcccagcgcgcgcacacacacacacacacacacacacacacacttgttgctatcactttcctctctactttcctgaaggcggcaactaccaggtacagaaggtaatcattaaatcctcatt

SEQ ID NO: 3844 - DNA, 374 bp, Homo sapiens
  AC007277.2_59401
  Located on chromosome 2
  Distance between a terminus base of telomere on chromosomal short arm and 5'-terminus of this base sequence : 170110066
  Distance between 3'-terminus of neighbour sequence of sequence listing upward to telomere on chrosomal short arm and 5'-terminus of this base sequence : 41840
tttatttgactaaaccaagacaaccaagtccctgaaagaatgtttccttcaggggtcaagagctgaggaccactgatatgagcctcctggaatatgttcatttggaaacttaaaattacattgcactggaactatcttttagtttggtcgaacttcatggacaaagcatttgcttttgtgcgtgtgtgtgtgtgtgtgtgtgtgtgtgtgtgtaggcaataatttccttgtcaaggctgaaatatcacttgtataacacaggagatacccatttctcagctttgttagcaacaactgtaaccatttactttttggttaagcttggtttgttttttatgacatataggaaggtgcttatagctatactgatcagg

SEQ ID NO: 3845 - DNA, 166 bp, Homo sapiens
  D2S2284
  Located on chromosome 2
  Distance between a terminus base of telomere on chromosomal short arm and 5'-terminus of this base sequence : 170110184
  Distance between 3'-terminus of neighbour sequence of sequence listing upward to telomere on chrosomal short arm and 5'-terminus of this base sequence : -256
cattgcactggaactatcttttagtttggtcgaacttcatggacaaagcatttgcttttgtgcgtgtgtgtgtgtgtgtgtgtgtgtgtgtgtgtaggcaataatttccttgtcaaggctgaaatatcacttgtataacacaggagatacccatttctcagctttg

SEQ ID NO: 3846 - DNA, 143 bp, Homo sapiens
  G09281
  Located on chromosome 2
  Distance between a terminus base of telomere on chromosomal short arm and 5'-terminus of this base sequence : 170115393
  Distance between 3'-terminus of neighbour sequence of sequence listing upward to telomere on chrosomal short arm and 5'-terminus of this base sequence : 5043
tcccaattaaccgtctgagaaccaaagaataggccacatagatggaagagatcttaataagaatggtgaatagtcagtattcactcattcactcattcattcattcattcttcattcattcgtcatttgttgagagtgtgcca

SEQ ID NO: 3847 - DNA, 316 bp, Homo sapiens
  AC007277.2_22289
  Located on chromosome 2
  Distance between a terminus base of telomere on chromosomal short arm and 5'-terminus of this base sequence : 170147116
  Distance between 3'-terminus of neighbour sequence of sequence listing upward to telomere on chrosomal short arm and 5'-terminus of this base sequence : 31580
atgtccacagtcctagctactcacgaggtggaggtaggagctccaggagctcaagactgcagtgagccatgatcctaacactgcactctagcctgggtgacagagcaagaccctgtctaaacaaagaaacaaacaaacaaaaaaaaaaaacagctgaagcacagtctttcctatttccctcctgattatactgaaaaatacatattggtgtcaagacagatacgtacagatagatagatagatagatagatagatagatagatagatagatagatggcaaagtgagaaaattaagtgaagactatgcaggaactaa

SEQ ID NO: 3848 - DNA, 336 bp, Homo sapiens
  AC007405.3_158888
  Located on chromosome 2
  Distance between a terminus base of telomere on chromosomal short arm and 5'-terminus of this base sequence : 170204374
  Distance between 3'-terminus of neighbour sequence of sequence listing upward to telomere on chrosomal short arm and 5'-terminus of this base sequence : 56942
ctgttaacatttggctcattcattaaatcaacacaactttatgtatcaccttcagtgtgccttgccgtgtcccagatgctggatatgattcctaacctcgtggcttccagtttgagtgtgtgtgtgtgtgtgtgtgtgtgtgtgtgatttcctcatttgcaaaatggttataacaatagtgtctaacttatagggttgctgtggggattaagttgtacaggttaacatggaatacaagggaatgaaataatggtgtttgcagcaacctggatagagttggagactattattctaagtgaatagataactaagtgaattaaataactcaagaatgaa

SEQ ID NO: 3849 - DNA, 119 bp, Homo sapiens
  D2S2177
  Located on chromosome 2
  Distance between a terminus base of telomere on chromosomal short arm and 5'-terminus of this base sequence : 170204460
  Distance between 3'-terminus of neighbour sequence of sequence listing upward to telomere on chrosomal short arm and 5'-terminus of this base sequence : -250
gattcctaacctcgtggcttccagtttgagtgtgtgtgtgtgtgtgtgtgtgtgtgtgtgatttcctcatttgcaaaatggttataacaatagtgtctaacttatagggttgctgtggg

SEQ ID NO: 3850 - DNA, 358 bp, Homo sapiens
  AC007405.3_123626
  Located on chromosome 2
  Distance between a terminus base of telomere on chromosomal short arm and 5'-terminus of this base sequence : 170239555
  Distance between 3'-terminus of neighbour sequence of sequence listing upward to telomere on chrosomal short arm and 5'-terminus of this base sequence : 34976
ccttagtatgataatcaggaagttcagtatttgaagaaagttgaaaaaatataaactacttaataaaatattaatataaataaagccatatgaagttgccattatttgaccattttttatccacgaatggtaatttcatatggtttgacctaatatatgaatgtttaattgtcaaagaatagtagggtatgtgtgtgtttgtgtgtgtgtgtgtgtgtgtgtgtgtgtatgtggtgtgttgcaggaaagattgttgcttttaataaataatatctattattaaattccctaaatgcattggttaatttatatgatgtttcttgacaaatattaactacaggatatgtaaagtccatgt

SEQ ID NO: 3851 - DNA, 459 bp, Homo sapiens
  AC007405.3_5375
  Located on chromosome 2
  Distance between a terminus base of telomere on chromosomal short arm and 5'-terminus of this base sequence : 170305755
  Distance between 3'-terminus of neighbour sequence of sequence listing upward to telomere on chrosomal short arm and 5'-terminus of this base sequence : 65842
atgacctcatcttaacatgattacatccgcaaagacccgatttccaaataaggtcacattcacaggaaccagggattaggacttgaacatatctttttgaggaacacaattcaacccatgacaccttttaccagctaggccaaaaagacacatgcacacacaggccaaaaagacacaggcacacatgcgcgcgcgcgcgcacacacacacacacacacacacacacacacatacacacatgccttctcattctactgcaacttctggaacttaggacactctgagtcaccaaattctatttccagtgggagtccttgaggatgtcctcttgcctccttttcttgttccaggagctctctctaatcagcaatcctcatcaaagcagttgctttccaattgcctccagttcaaggactttggggcctctgtctgagatgcttagaaacagctcagactgtg

SEQ ID NO: 3852 - DNA, 464 bp, Homo sapiens
  chr2.fa.O7frz.178462388
  Located on chromosome 2
  Distance between a terminus base of telomere on chromosomal short arm and 5'-terminus of this base sequence : 170459477
  Distance between 3'-terminus of neighbour sequence of sequence listing upward to telomere on chrosomal short arm and 5'-terminus of this base sequence : 153263
aggaagctcacagaaattaaactttaaaaatatttctactatggccggatgcagtggctcacacctgtaatcccagcactttgggaggccgaagtgagtggatcacgaggtcagaagttcaagaccagcctggccaagatggtgaaaccccaatctctactaaaaatacaaaaattagctggacgtggtggcgcatatctgtaatcccagctacttgggaggctgaggcaggagaatcacttgaacccagggggcggaggttgcagtgagctgagatcatgccattgcactccagcgaaactccatcttaaaaaaaaaaaaaaaaaatatatatatatatatatattcattcattcctactaatgaagttaaaattcattgtcaaagtgaaatatcaataaattttgttatattagttcagaaaccacaatagtgttaattttcatagtggtttcaacataacc

SEQ ID NO: 3853 - DNA, 289 bp, Homo sapiens
  chr2.fa.O7frz.178556419
  Located on chromosome 2
  Distance between a terminus base of telomere on chromosomal short arm and 5'-terminus of this base sequence : 170553655
  Distance between 3'-terminus of neighbour sequence of sequence listing upward to telomere on chrosomal short arm and 5'-terminus of this base sequence : 93714
caaaagtacttctatcctgcaactgtttcttctcatgtttacttaatgatctataaatatctgtattttgatatatataaaatttcaccccaaaggaattcattaattatcaactatacagataaaacctgggaatcattttccagataagcaactccttaaatggaaagatacactaaaataataataataataataataataataatggtaatagtaattatttctttgaatcttaaggacaatgtataatctgtagtcatttctgtgccactagacttaaccatta

SEQ ID NO: 3854 - DNA, 222 bp, Homo sapiens
  G10091
  Located on chromosome 2
  Distance between a terminus base of telomere on chromosomal short arm and 5'-terminus of this base sequence : 170744125
  Distance between 3'-terminus of neighbour sequence of sequence listing upward to telomere on chrosomal short arm and 5'-terminus of this base sequence : 190181
ccataatccctggcatacagtagatgctgagaaaatattttttgaatataacaatagatagatagatagatagatagatagatagatagatagatagatagacagagagagagatagatagatgatctagtcattcaatggcagcaaaagaaaagacatttcctcctgagtgtctctttagccaagaaaaaaatttcccttaagaagtccttccccttgaga

SEQ ID NO: 3855 - DNA, 308 bp, Homo sapiens
  chr2.fa.O7frz.178847701
  Located on chromosome 2
  Distance between a terminus base of telomere on chromosomal short arm and 5'-terminus of this base sequence : 170845046
  Distance between 3'-terminus of neighbour sequence of sequence listing upward to telomere on chrosomal short arm and 5'-terminus of this base sequence : 100699
gagtagctaggactataagtgcatatcactgcgcccagctaatttttaaaatttttaaattacattattgttattattactattattattattattattattattattattattgtagagacgggtcttgctttgttgcccaggctggtaaatccaactcctgcatcaagcgatcttcctgcctggcctcccatactgctgggattacaggcatgagtgagccacaacaccagcctgagtttcttacttgtgtgactaacaaaaaacacaaacatagagccaatgcctttctactttgcatacaatgg

SEQ ID NO: 3856 - DNA, 247 bp, Homo sapiens
  chr2.fa.O7frz.178972248
  Located on chromosome 2
  Distance between a terminus base of telomere on chromosomal short arm and 5'-terminus of this base sequence : 170969594
  Distance between 3'-terminus of neighbour sequence of sequence listing upward to telomere on chrosomal short arm and 5'-terminus of this base sequence : 124240
tgtcacttagatgtactgtagcagggtacctcaaagttaatttgctgtatggtcactggcaaagaaaatacacacacacacacacacacacacacaacacacacacacaacacacacacacacatacacacacaagttcatttgcaattacaaaattcaaaatgttcaaaaatgaaaagtaaatcaccctctcatcctctttctcggtctgtttctgaactctctaggtttgttcttgcattactat

SEQ ID NO: 3857 - DNA, 394 bp, Homo sapiens
  AC064826.3_50621
  Located on chromosome 2
  Distance between a terminus base of telomere on chromosomal short arm and 5'-terminus of this base sequence : 171036682
  Distance between 3'-terminus of neighbour sequence of sequence listing upward to telomere on chrosomal short arm and 5'-terminus of this base sequence : 66841
attcaaacctctaggtcttgagcagattgtaggaggttctggcccagtgaactcacctggaacactcaaatgaaggaagtaaaagggtgtgaggcaagaggagcagtgacagccttaagtgtgagctaattcaccccaagagcaagcaaaagtgcaaataaaactcaagggtgtggaaaagtgtggagtgatgattaggattcaggcctctccttgcctagccttcctccattctctctctctcaacctctcactctctctctctctctctctgtctctgtctcatttaacagagcactggattgcgaatggagtgcaagtagagactgagaatcaccactgtagtgattgtatctgtgtggcaaatcatcttaaagatttcttgtatttggaa

SEQ ID NO: 3858 - DNA, 456 bp, Homo sapiens
  chr2.fa.O7frz.179047124
  Located on chromosome 2
  Distance between a terminus base of telomere on chromosomal short arm and 5'-terminus of this base sequence : 171044408
  Distance between 3'-terminus of neighbour sequence of sequence listing upward to telomere on chrosomal short arm and 5'-terminus of this base sequence : 7332
gctttagtttctgtagctgtaaagtaaagattagaatacctgtcattttatttttccagctttattgaggcataattgacatataaaactatatatatatatattctttttctctttctttctctctctctttctttctttcttctttcttttttttttgaaatagggtcttgatctgttgcccagggtggagtgaagtggcacaaccatagctcactacagccttgacttcctgggtgcaaacaatcctcctgcctcagcctcccaaagtgctggggttacagatgtgtgccaccatgcctggccaaaattatatatatttaaggagtacagtgtgatgaccaatatactatacattgtgaaatgattaccacaatcaagttagttaacacattcatcacctacaaagcctaccacttgtgtgtgtgtttagtgagaacacgtaagatctactgt

SEQ ID NO: 3859 - DNA, 438 bp, Homo sapiens
  chr2.fa.O7frz.179508764
  Located on chromosome 2
  Distance between a terminus base of telomere on chromosomal short arm and 5'-terminus of this base sequence : 171150689
  Distance between 3'-terminus of neighbour sequence of sequence listing upward to telomere on chrosomal short arm and 5'-terminus of this base sequence : 105825
tggcaagtaggtatggactatataaaggataaggaggtgtatatatatatatatatatacacacacacatatatatgaaggtagtctcatatatcacacacacacatatatatatactagagatagaatagtctcatatcacacacacacatatatatactagagatagaatagtctcatatatcacacacacacacacacacacacacacacacacacatatatatatatatatatatatactagagatagaatcttgctatgttgcccaggctggaatgcagtggcacaaagcacaatcatagctactatagcctcgaactcctggactcaaaggatcctcctgcctcagtctcccaagtaactgaaactatcttctgctttaaccaactagaagatcgttttgagttcactctgcctattgtatcttatgctatg

SEQ ID NO: 3860 - DNA, 358 bp, Homo sapiens
  chr2.fa.O7frz.179615204
  Located on chromosome 2
  Distance between a terminus base of telomere on chromosomal short arm and 5'-terminus of this base sequence : 171198386
  Distance between 3'-terminus of neighbour sequence of sequence listing upward to telomere on chrosomal short arm and 5'-terminus of this base sequence : 47259
gtgtctattcagcggttaaagcaaaacacacacacacacacacacacacacagacacacacacacacacaccaccgccaccaccatcaccacaaccaacaaacgggagaactaggaaggaaaactctggaacttagaaactacccttggacacaaaattcccttctctttcacagagtctttctttccactctctcattttagaacaaaagggttgtgccacctcctttggatgtgaagaggatgtgctgacacgtgtgctcgggagccagactttgtggccttggggaaaggactgaatatttctgtgcttcgtcgtttgcatctgtggaatgcaggtgatactgagctcttccttg

SEQ ID NO: 3861 - DNA, 355 bp, Homo sapiens
  AF166335.1_7881
  Located on chromosome 2
  Distance between a terminus base of telomere on chromosomal short arm and 5'-terminus of this base sequence : 171373595
  Distance between 3'-terminus of neighbour sequence of sequence listing upward to telomere on chrosomal short arm and 5'-terminus of this base sequence : 174851
tggttagttgaagagtaaggaagcacccagtaatgcctctttacccaagagctctgtttgctttgctcggtgatatcaatgtcactgtggtttcttcattttgaaaaggaagttcatttgtactgaggtggttttaagtgtgtgtgtgtgtgtgtgtgtgtgtgtgtgtatgatgcaaatgataataaacatttcagacccagagggcagaatgtcactgaacctaagccctcctgagccaaataactcctttgtccttgcagaatcaggagcccttctcttcaggatatgctgccattatgataaagcattgtgatgtaaagttaacgagaggatccttatccaagtgaatcac

SEQ ID NO: 3862 - DNA, 314 bp, Homo sapiens
  AC020681.3_26903
  Located on chromosome 2
  Distance between a terminus base of telomere on chromosomal short arm and 5'-terminus of this base sequence : 171496200
  Distance between 3'-terminus of neighbour sequence of sequence listing upward to telomere on chrosomal short arm and 5'-terminus of this base sequence : 122250
aggagactttcagtaaccagacaattgaataggacctacttgaagatggtgcaaacaggcagtggtgaattttgctgttgcttgaaagctttcctctgcacttactcttttttcccgtgtgtgtgtgtgtgtgtgtgtgtgtgtgtgtgtgtatttttttttaaaaatagaaatggggtctcactatgttgcccaggctggtctcaaactcctgggctcaagccatcctcccacctcggcctcccaaagtgatgataggtgtgagccaccatgcccggactgcacttaatctttgcttatggtaattagcatta

SEQ ID NO: 3863 - DNA, 266 bp, Homo sapiens
  AC020681.3_81820
  Located on chromosome 2
  Distance between a terminus base of telomere on chromosomal short arm and 5'-terminus of this base sequence : 171686722
  Distance between 3'-terminus of neighbour sequence of sequence listing upward to telomere on chrosomal short arm and 5'-terminus of this base sequence : 190208
ttagttcttgccgtgttagaagatatagatgaaatctatttatattattattattattattattattttggagaccgagtctcgctctgtcgcccaggctggagtgcaatggcgcaatctcagctcactggaaactctgcctctcgggttcaagcgattcccctgcctcagcctcctgagcagctgggattacaggtgcgcaccatcatgcctagctaatttttgtatttttagtagagacagggtttcaccatgttgactaagct

SEQ ID NO: 3864 - DNA, 385 bp, Homo sapiens
  chr2.fa.O7frz.180344005
  Located on chromosome 2
  Distance between a terminus base of telomere on chromosomal short arm and 5'-terminus of this base sequence : 171909555
  Distance between 3'-terminus of neighbour sequence of sequence listing upward to telomere on chrosomal short arm and 5'-terminus of this base sequence : 222567
ccaggacttataattgttatctgtgggagagctggcctgaattgaattacttttgtgaccagaagcagaactctattatcccactttacaggtgaatttaaaatacgcgcgtgtgcgcgcgcacacacacacacacacacacacacacagagcgagtcttagtactttgcccaaggtcatacagctggtaagtggcagaaccatgatttgaagacaggcaaatccaagtcttaggatttcttccaatgggagcttttaatggtgtgaattttcaggacaatggaaggaagtctacaaaatattctggaacgtatagggccttatggtgtcaattccttatgcaccagactcatcccaagatctcattactcagtggatacttcat

SEQ ID NO: 3865 - DNA, 437 bp, Homo sapiens
  chr2.fa.O7frz.180521705
  Located on chromosome 2
  Distance between a terminus base of telomere on chromosomal short arm and 5'-terminus of this base sequence : 172087051
  Distance between 3'-terminus of neighbour sequence of sequence listing upward to telomere on chrosomal short arm and 5'-terminus of this base sequence : 177111
tttatgccataagtgaagttattttaaaacacaaatcaggccaggcgcagtggttcatacctgtaatcccagcactttgggaggccaggaaaggtggattacttgaggtcaggaattcgagaccagcctggccaacatgacgaaaccccatctctacaaaaaatacaaaaattagccagatgtggtggcctacacctgtggtcccagctactcaggaggcggagatgggaagatcgcttgagccaggaggtggcggctacagtgagtagtgactgggccactgcactccagcctgggtgacagagtgcgaccccgtctcaacacacacacacacacacacacacacacacacacacaaatacaaatcaatttgtttaactaagtctacctttcttttgtagctatatttgattcagaaatacagttgagccttgaat

SEQ ID NO: 3866 - DNA, 452 bp, Homo sapiens
  AC013461.6_92966
  Located on chromosome 2
  Distance between a terminus base of telomere on chromosomal short arm and 5'-terminus of this base sequence : 172180689
  Distance between 3'-terminus of neighbour sequence of sequence listing upward to telomere on chrosomal short arm and 5'-terminus of this base sequence : 93201
cttctccagtatttccaatgatagttttctaattgcagtttccaagaaatgacattgatttgagtttatgcatctgtaaaagatccaatcacagcagcatatggaaaacattatagttgacttatttatttatttatttatttatttatttatttatttcagatagagtctcgctctgttgctcaggctggagttcagtggcatgatgtcggctcactgcagcctctgcctcctggtttcaagtgattctcgtgcctcagcctcctgagtagctgggactacaggcgcgcaccaccagcccagctaatttttgtatttttagtagagaggaggttttgccatgttggccaggctggtctcaaacttctgacctcaagtgatccactcgcctcaggcccccaaagtgctgggattacaggtttgagccactgagtccagcctaaattgacttt

SEQ ID NO: 3867 - DNA, 313 bp, Homo sapiens
  AC013461.4_180890
  Located on chromosome 2
  Distance between a terminus base of telomere on chromosomal short arm and 5'-terminus of this base sequence : 172232067
  Distance between 3'-terminus of neighbour sequence of sequence listing upward to telomere on chrosomal short arm and 5'-terminus of this base sequence : 50926
ctattcaacattgtactgaaggttttagccagtgtgatcaggcaagaaaaagaagtaataggcatccagattggaaaggaagaaataaaactatcttatctgacaacctataggtagaaaatcctaaggaatgcgcacacacacacacacacacacacacacacacacacaaaagctactaaaactaacaaacatgtttagaagggtcacaggatgcaagatcagcatttaaaaatctattgtatttctatatactgagagtgaacaacctaaaaattaaattaagaaagaattccatttacagtagcatcaa

SEQ ID NO: 3868 - DNA, 385 bp, Homo sapiens
  AC013461.6_48175
  Located on chromosome 2
  Distance between a terminus base of telomere on chromosomal short arm and 5'-terminus of this base sequence : 172308714
  Distance between 3'-terminus of neighbour sequence of sequence listing upward to telomere on chrosomal short arm and 5'-terminus of this base sequence : 76334
gaattatgtctgagcttgctctaggaaacattccaggtccactcttatttatgagggcattttcagcatgtgaggtgcttggtacattagccttaatcctcaggattcttcattcttcaaaaaacacagagccaggagcagtggctcatgcctctatcccagctacttgggaggctgaggtgggaggactgcttgaggccaagcgttcaagaccatcttgggcaacatagcgagacactaactctaaaaaagaaatttaaaaaaatagatagatagatagatagatagatagatagatagatagatagatagatagacagacagacagacagatagagagaatgtgcatttatggtccaggggtcaaatttggtacaaagacatg

SEQ ID NO: 3869 - DNA, 420 bp, Homo sapiens
  AC013461.4_53991
  Located on chromosome 2
  Distance between a terminus base of telomere on chromosomal short arm and 5'-terminus of this base sequence : 172372932
  Distance between 3'-terminus of neighbour sequence of sequence listing upward to telomere on chrosomal short arm and 5'-terminus of this base sequence : 63833
ctgatgttatcaacaccagaaccctcagttctctctctctttttataatgagacaataacagtatattttaattgggatttcatattaaaatagcattatactagaacaatacaataatagtttcagattttaaaacaattacaattctccatttcaccctatatgctacagtaaacttttggaaagaacttgttttatgttcgttttctctctctctctctctctctctctctctctctctctctctctctctctctccccctctccctccctctcggtagattgtatttaataaaataaaatcttaggccgggtacggtggctcaggcctgtaatcccagcactttgggaggccgagggaggtggatcacgaggtcaggagatcgagaccatcctggctaacatggtgaaatcctgtc

SEQ ID NO: 3870 - DNA, 461 bp, Homo sapiens
  chr2.fa.O7frz.180882467
  Located on chromosome 2
  Distance between a terminus base of telomere on chromosomal short arm and 5'-terminus of this base sequence : 172444161
  Distance between 3'-terminus of neighbour sequence of sequence listing upward to telomere on chrosomal short arm and 5'-terminus of this base sequence : 70809
catcttgaacaaagaattgaacaaaacacacaaagcaaggaaggaatgaagaggtttactgaaaatgaaagtacactccacagtgtgtggagtggacccaagcataggggctcaagggccccgttacagaattttggggaatttaaataccctctagaggattccattggctacttggggtacaccctatgtaaatgaggaggatgaagtaaagttacaaagttgtttattgtggagaggatatttgctgtcgtagctgaagggtgaatcagccttatgttccctgcctccagaccctgttttcatgccatatatatatatatatatatatatatatatagctatatatagtatttgcatacattgttctttctatatttaacttttatactttattttatgtatatcacacattttaacaaaaatgtatcaaactactcatacggtattacaatctgatc

SEQ ID NO: 3871 - DNA, 181 bp, Homo sapiens
  HUMUT6478
  Located on chromosome 2
  Distance between a terminus base of telomere on chromosomal short arm and 5'-terminus of this base sequence : 172508828
  Distance between 3'-terminus of neighbour sequence of sequence listing upward to telomere on chrosomal short arm and 5'-terminus of this base sequence : 64206
ctcctcagcagtctccatggctccgtagcccttggggaagactgggcccagatgtttctttctttctttctttctttctttctttctttctttctttctttctttctttctttctttctttctttctttccttctttctttttgagatggagtcttgctctgttgcccaggctggagtgta

SEQ ID NO: 3872 - DNA, 304 bp, Homo sapiens
  chr2.fa.O7frz.180987182
  Located on chromosome 2
  Distance between a terminus base of telomere on chromosomal short arm and 5'-terminus of this base sequence : 172694811
  Distance between 3'-terminus of neighbour sequence of sequence listing upward to telomere on chrosomal short arm and 5'-terminus of this base sequence : 185802
taatgaactgtgagcgatctagagaggaactattacataccagtcatagaaatggcaaaccagacaaaaatagatggtgtatgtgtgtgtgtatgtgcgtgtgtgtgtgtgtgtgtgtgtgtgtgtgtgtggtgtgtgtttggggagagatctttctccatcttccatgatacactgattgctgcctttattgaaaaaaacaacgaagagaattcaaggcaaccagggaaattagttcatttaggacccaaacataaatgagagccatcttttggcaaatattcagtatagctttcctgacata

SEQ ID NO: 3873 - DNA, 189 bp, Homo sapiens
  Z67704
  Located on chromosome 2
  Distance between a terminus base of telomere on chromosomal short arm and 5'-terminus of this base sequence : 172870608
  Distance between 3'-terminus of neighbour sequence of sequence listing upward to telomere on chrosomal short arm and 5'-terminus of this base sequence : 175493
gtttaccaacagggctccctgcaaaaccccgcctccattctttaattaaacaggacaacgtcacccacacagtcacagtcacacccatgtgagctcacacacacacacacacacacacacacatatcttggctttgccaaagtcctcttccacctttctcattagtaacggagctgaactcattatgca

SEQ ID NO: 3874 - DNA, 314 bp, Homo sapiens
  AC055875.2_105198
  Located on chromosome 2
  Distance between a terminus base of telomere on chromosomal short arm and 5'-terminus of this base sequence : 172894143
  Distance between 3'-terminus of neighbour sequence of sequence listing upward to telomere on chrosomal short arm and 5'-terminus of this base sequence : 23346
gatgaatttgtaagtcaatagacagttaatctattaagcaaagataataattcatatttgggaaacaattactgagcatctcccatctgccaggcatattttaagatattagtaaaacatatttcttgtttattgctgaataatactccattttgcatgtgtgtgtgtgtgtgtgtgtgtgtgtgtgtgtgtgtgtacaatgcattttcttacctcttctttatccattcagccattgatggacatttaggttgtttgtacaaacactttagttcacaaaatgctttcacatgtattatcacatttggctttca

SEQ ID NO: 3875 - DNA, 288 bp, Homo sapiens
  HUMUT433B
  Located on chromosome 2
  Distance between a terminus base of telomere on chromosomal short arm and 5'-terminus of this base sequence : 172927565
  Distance between 3'-terminus of neighbour sequence of sequence listing upward to telomere on chrosomal short arm and 5'-terminus of this base sequence : 33108
ggtgaaggctacagtgagccaagattgcaccactgtactgcagccctggtgacagagtaagactgtctcaaaaaaaagaaagaaagagagaaagagtgagaaagagagaatgaaagaaaagagagaaaaagaaagagagaaagagagaaaggaagaaaggaagaaaagaaagaagaaagaaagaaagaaagaaagaagaaagaaagaaagaaagaaagaaagaaagaaagaaagaaagaaagaaagaaagagagagagaaagagagttcctgttcccccattctgtgt

SEQ ID NO: 3876 - DNA, 475 bp, Homo sapiens
  AC055875.2_61235
  Located on chromosome 2
  Distance between a terminus base of telomere on chromosomal short arm and 5'-terminus of this base sequence : 172935548
  Distance between 3'-terminus of neighbour sequence of sequence listing upward to telomere on chrosomal short arm and 5'-terminus of this base sequence : 7695
agataatcatgcttatttcacaaggttgttgtaaaaatgacataagcaaatatacggaaaatactccaaacatagtacttagtgtataaatatgtgcacaataaacattagttattttctatccttcaactgaaccaactggaagagggactaaaaataatattgtgattaatgaggcatgcacgcacgcacgcacacacacacacacacacacacacacatacacacacagaggcagctctggaaatagtccatgtggctctggtagcacggttatctagctgggtagtttcattgttgttgttttaggtagcagattactatgatagccctcttttcctattctataggtcttgataagaatcacccatgctaggcgattcctggacagttaacacagatggtaacccaaaccaacatgctcctaaaacttcatcacagtctgaaggttgtgaagacgtttagatggtagtta

SEQ ID NO: 3877 - DNA, 101 bp, Homo sapiens
  DID22N_0017521
  Located on chromosome 2
  Distance between a terminus base of telomere on chromosomal short arm and 5'-terminus of this base sequence : 173115607
  Distance between 3'-terminus of neighbour sequence of sequence listing upward to telomere on chrosomal short arm and 5'-terminus of this base sequence : 179584
ggctgaatcaagtttgccaggtacacacacacacacacacacacacacacacgaaaaaaaagcccacaaaaaagccaatctcagtgtttcagagcagtgta

SEQ ID NO: 3878 - DNA, 323 bp, Homo sapiens
  AC018890.9_93516
  Located on chromosome 2
  Distance between a terminus base of telomere on chromosomal short arm and 5'-terminus of this base sequence : 173163042
  Distance between 3'-terminus of neighbour sequence of sequence listing upward to telomere on chrosomal short arm and 5'-terminus of this base sequence : 47334
agcttcagttttacttccagagtggaagcttacccactttcagtgggatcggagtcctcgggatcagagcatactgtggactaggcagcttttcacgggctatctgtgtgtgtgtgtgtgtgtgtgtgtgtgtgtgtgtgtgtgtgtgtgtgtgtgtgtgtgtgtgtgtgttgctttctagatgagtggcaatcagacttaactggagaggaaatgtctgccccatgagacaaggacatgtgagatccctcatacaaattttcatgatcagcactgcgtccataagagacctagaatttttcatgctttctaacctaatgctt

SEQ ID NO: 3879 - DNA, 130 bp, Homo sapiens
  Z67465
  Located on chromosome 2
  Distance between a terminus base of telomere on chromosomal short arm and 5'-terminus of this base sequence : 173345888
  Distance between 3'-terminus of neighbour sequence of sequence listing upward to telomere on chrosomal short arm and 5'-terminus of this base sequence : 182523
cattggcagacttggtgtgtgcggggtgtgtgtgtgtggtgtgtctgtgtgtgtgtgtgtgtgtgtgtgtgtgtgagagagagagagagagagagagagcgcgagcgcaagagcaagagtgcgaggtcgt

SEQ ID NO: 3880 - DNA, 365 bp, Homo sapiens
  chr2.fa.O7frz.182926028
  Located on chromosome 2
  Distance between a terminus base of telomere on chromosomal short arm and 5'-terminus of this base sequence : 173664434
  Distance between 3'-terminus of neighbour sequence of sequence listing upward to telomere on chrosomal short arm and 5'-terminus of this base sequence : 318416
tcttgcttattgctgattgtacacacaacacttgcccatcaagatcatttttgaaagatgattacttcagtgtgcccaggcctgcaggacataagtacgtgggcagtgatggtaagagctataattattcttaatgggaaaatatgcaggtaatgacttggatgatcatgtgtctgtaatgtataagttccaaagcccaatgaagtaattaagcaatctgcaaacatgcagggggaaaaagcctgaagtgaaaaagaaccagaaaagaagagctctttcatctatctatctatctatctatctatctatctatctatctatcatctatctatctatcatctatctatttatccatctaccgacct

SEQ ID NO: 3881 - DNA, 444 bp, Homo sapiens
  chr2.fa.O7frz.183167975
  Located on chromosome 2
  Distance between a terminus base of telomere on chromosomal short arm and 5'-terminus of this base sequence : 173927192
  Distance between 3'-terminus of neighbour sequence of sequence listing upward to telomere on chrosomal short arm and 5'-terminus of this base sequence : 262393
atgattcatttatactggagtgacagcataatacctaggtgtcagaatccattaaaactgttcaatgtcttctgtttatttttcgaaccaattgagacttaactgatggtgaaaaatatacagtcaagtgtgtttacttcacctttacaaagaatccgttatagtcccaattaatttgttattcctgtcacaacaggtactggaaatttcaaaactgtcattactgtttctgcctttctttcgaggccttgtgtttatttttagcccattcagagatgtctgtctgttgtgagctaaggatttctctgtgtgtgtgtgtgtgtgtgtgcgtgtgtgtatgagagagagagagaaagagagagagagaagaatgataggatataagataggtaaggctgcatgttattttcatttggttaaaatcaccgagtatgtactcagaac

SEQ ID NO: 3882 - DNA, 437 bp, Homo sapiens
  AC010894.6_132657
  Located on chromosome 2
  Distance between a terminus base of telomere on chromosomal short arm and 5'-terminus of this base sequence : 174028535
  Distance between 3'-terminus of neighbour sequence of sequence listing upward to telomere on chrosomal short arm and 5'-terminus of this base sequence : 100899
taaaccatgatgttgacctaatagcattctagtaagacaaacgatgccagccatttcattcacagaatgaactaggaagtccagaatttctaaatgttggggtggtgtgtgtgtgtgtgtgtgtgtgtgtgtgtgtaagcaacaaagaagaaacagtaattaaatttttaaagtcatttatgcaaattatttcactctgttctctcaacccataaagccagttccttacgaaagggttattgctagatccctccccttacttcagctattttcacctaaaatttcattatttttgaatgattcattcacttattaaataaacctttggcagtcacttacatactctagggttctggctgatttttaaattttttaacgtatgacaatccagaaatatcttgctgagaaatcagttgatggatagtttattcaaaggc

SEQ ID NO: 3883 - DNA, 269 bp, Homo sapiens
  AC018470.8_116877
  Located on chromosome 2
  Distance between a terminus base of telomere on chromosomal short arm and 5'-terminus of this base sequence : 174165083
  Distance between 3'-terminus of neighbour sequence of sequence listing upward to telomere on chrosomal short arm and 5'-terminus of this base sequence : 136111
aaccgaagctcactaatttctctgtttggtcatttgtttgtgtttttgttgttgttgttgttgttatttttatttttatttttttgagatggagtctcgctctgttgcccaggctggagatcattgtgtaatgatcaaatcagggtaattagcatatctatcacttcaaaatgtataatttctttgttgtaggaacatacaaaatcctctcttctattttgagatgtacagtatctttgttgactatagccaccatactgtatgatagg

SEQ ID NO: 3884 - DNA, 375 bp, Homo sapiens
  AC016774.3_4702
  Located on chromosome 2
  Distance between a terminus base of telomere on chromosomal short arm and 5'-terminus of this base sequence : 174451472
  Distance between 3'-terminus of neighbour sequence of sequence listing upward to telomere on chrosomal short arm and 5'-terminus of this base sequence : 286120
ttctgttgatttatctttgacatattcttttcctcagtcatcttaatttggctgttatgtccatatatctagatagatagatagatagatagatagatagatagatagatagatagatatacatattgtgtttatcagttctaaatttgtctcccttcctccctgccctcctttcttcttctcttcttccttctctcccaccatttctatttctctgctgggagtgcctgtctcccagttcattgtgtgcataatttacttttatttattgaaggtagttttaatagacacttaaaatttttttcagctactttcagcatctggataatctcaaattcaatctcacttgttttctgatagcattatgcttgattt

SEQ ID NO: 3885 - DNA, 301 bp, Homo sapiens
  chr2.fa.O7frz.181519693
  Located on chromosome 2
  Distance between a terminus base of telomere on chromosomal short arm and 5'-terminus of this base sequence : 174542915
  Distance between 3'-terminus of neighbour sequence of sequence listing upward to telomere on chrosomal short arm and 5'-terminus of this base sequence : 91068
aatgtttacttgcagattatcaagtaggttttagatttgagagcaaaattgtgtatatgtgtgtgtatgtatgtatgtatgtatgtatgtatgtatgtatgtatgtatatgtatttctaacaccagtgcagcataactaatttaatgccagtgctgtgaactatatactgaatagctctgtgtgggctttgtagtctacagggatatcacattattagcaatcatatctgcttaggcaaagctggcttctacagatggctgctttcaagtgcaaatgaactggttagacgtgtcttgttta

SEQ ID NO: 3886 - DNA, 350 bp, Homo sapiens
  chr2.fa.O7frz.181842884
  Located on chromosome 2
  Distance between a terminus base of telomere on chromosomal short arm and 5'-terminus of this base sequence : 174556226
  Distance between 3'-terminus of neighbour sequence of sequence listing upward to telomere on chrosomal short arm and 5'-terminus of this base sequence : 13010
tttgaaagcaagttcagattactcttttgagaagttttgccagaaaggggacaagagaaatggaaatgggggagatgggaagcaaagaggtttttttgttggttggttggttggttggttggttggttggttggctggctgtagattttttagcaacggagcgtgccggggcatgtctggatgttgaggggaatgttcccgagaggaggagagctggaggctgatgaagcaagagggagaggggtgacgaaagagacccagtccttaagaagctacaggggatgagaactggagcataggtggagggactgacagttggtagaagcaggaatgcttccagtaaataggag

SEQ ID NO: 3887 - DNA, 340 bp, Homo sapiens
  chr2.fa.O7frz.183497067
  Located on chromosome 2
  Distance between a terminus base of telomere on chromosomal short arm and 5'-terminus of this base sequence : 174739818
  Distance between 3'-terminus of neighbour sequence of sequence listing upward to telomere on chrosomal short arm and 5'-terminus of this base sequence : 183242
cctatcaatggtagactggataaataaataaataaataaataaataaataaataaataaataaaatatggtacatatactatgcagccataaaaaggataaaatcatgtcctttgcaggaacatggatggaactagaggccattattcctaacaaactaacacaggaacagaaaacaaaacacaacatgttctcatttacatgtgggagctaaatgatgagaacagatggacacaaaaagaggtacaacatacacttgtgtctacctgagggtggagagtgggaggagggagaagagcagaaaaaataactattgggtactaggcttagtacctgagtca

SEQ ID NO: 3888 - DNA, 408 bp, Homo sapiens
  AC016761.8_58078
  Located on chromosome 2
  Distance between a terminus base of telomere on chromosomal short arm and 5'-terminus of this base sequence : 174761830
  Distance between 3'-terminus of neighbour sequence of sequence listing upward to telomere on chrosomal short arm and 5'-terminus of this base sequence : 21672
gcctaatcctagaaatctgttattatctcatttttaatctcaaatatgaagtttagttttaggaggatctttgcctaacagaaggaacaattgagatgaaaatctctgattcctatgaaatacactgctcttggaaaactttgcatggatttctgatatacacagagatttctatgaagtatgaccacacacacacacacacacacacttcagatcccaagacttcaagagacctcagagatagagctacctagcccaacaccttccttggaaaaagtcaagagccaaaaaggccaaatgacttgccaaatatcatacttcctgcccaagattgcaggcaacggcagtaaaaggaatcacaatgacagccattattaatttagttcgtactaagtgctttgcattcat

SEQ ID NO: 3889 - DNA, 422 bp, Homo sapiens
  chr2.fa.O7frz.183685698
  Located on chromosome 2
  Distance between a terminus base of telomere on chromosomal short arm and 5'-terminus of this base sequence : 175013701
  Distance between 3'-terminus of neighbour sequence of sequence listing upward to telomere on chrosomal short arm and 5'-terminus of this base sequence : 251463
tcaagaacatcgtgttctaaagattctgaaaagataaagattcaaaactttaggaatacctgaacgttaaaactgctaaataaggcaagcaaaaaagataaacacacacacacacacacacacacacacacacacacacacacaaagaaaccatacaattgtctaacattatccttaaaatcttttacaataagtacataactctctttacagttagtatgatagaagaaaaaaaaagtaattcagaggaaaaaaacccataaatatactttttctaatgtcccatattttcatacaaaataagttactaaagacacatctgaaagttgaagtccaaaaatcatagtcccaacagaattatgtgctataatacaatagtccagcaaacaatgcaaatgtattaatgtccagattacatttcc

SEQ ID NO: 3890 - DNA, 379 bp, Homo sapiens
  AC016915.4_36775
  Located on chromosome 2
  Distance between a terminus base of telomere on chromosomal short arm and 5'-terminus of this base sequence : 175132362
  Distance between 3'-terminus of neighbour sequence of sequence listing upward to telomere on chrosomal short arm and 5'-terminus of this base sequence : 118239
tgaggtcaggagttcaagaacagcctgaccaacatggtgaaaccccgtctcaactaaaaatacaaaaattagccagccatggtggcaggcgcctgtaatcccagctactcgggaggctgaggcaggagaatcgcttgaacccgggaggcagaggcttcagtgagccgagatcaagccactgcactccagcctaggtgacagggagactccatctcaaaaaataaataaataaataaataaataaataaataaataaataaaataaaaagaactgtagataataaaactgaattaataatgagcaggaacaacactaaccttcagaagtgatctattaggtaatgcaatgagttaagggtgctatgtcaaagcctttaga

SEQ ID NO: 3891 - DNA, 428 bp, Homo sapiens
  AB032481.1_10363
  Located on chromosome 2
  Distance between a terminus base of telomere on chromosomal short arm and 5'-terminus of this base sequence : 175195539
  Distance between 3'-terminus of neighbour sequence of sequence listing upward to telomere on chrosomal short arm and 5'-terminus of this base sequence : 62798
atacaaccgacatttgcagaaactgtcctcatgaacgtgcccaataaccacaccataaaattgcaagcttgttaagatgccggtttgagaaactatgataatcaatcaaattaaccattgttgttaagtgcaaataatccttctttaataacaggtaagtgttatgtctatgtacataataaagaccaaacagcatggcattttttaaaaatttcctgcacccctgcaaacgcacacacacacacacacacacacacacacacaatcctcagctaggtgctccgaatatcccagcctaatttttcttgtgcttttgtttgtatcaggggatgtggctctaaatcagccggacatgtgcgtctaccgaagagggaggaagaagagagtgccttacaccaaactgcagcttaaagaactggagaacgagt

SEQ ID NO: 3892 - DNA, 101 bp, Homo sapiens
  DISD22_0002031
  Located on chromosome 2
  Distance between a terminus base of telomere on chromosomal short arm and 5'-terminus of this base sequence : 175379497
  Distance between 3'-terminus of neighbour sequence of sequence listing upward to telomere on chrosomal short arm and 5'-terminus of this base sequence : 183530
atgaaatgaagcacggtgggaaagaagagaaaatgagagagagagagagagagagagaagaaatgaatagaaagagaatcaaggaagcacctggtagttat

SEQ ID NO: 3893 - DNA, 331 bp, Homo sapiens
  AC068706.3_105873
  Located on chromosome 2
  Distance between a terminus base of telomere on chromosomal short arm and 5'-terminus of this base sequence : 175521321
  Distance between 3'-terminus of neighbour sequence of sequence listing upward to telomere on chrosomal short arm and 5'-terminus of this base sequence : 141723
ttataatgcactctgcttgaaccaaatgtctagattttggagagctcttaaaaacaaacaaacaaaaaaatgctatctcagtagtttagaaatgatgttttaggatctccctcttctctgctatgagtgtgtatgcatgtgtgtgcacgcatgtgtgcatatatatatatatatatatatatatatatataagaaaaatccaatttaagtgttcctaaaacttcagatctagagaagaactgccttgtaatgtcattttgcagggatgacagttccctggtctgtattaatggcaaatccctaaaactaattacacctagttgcaggtgta

SEQ ID NO: 3894 - DNA, 467 bp, Homo sapiens
  AC068706.3_17641
  Located on chromosome 2
  Distance between a terminus base of telomere on chromosomal short arm and 5'-terminus of this base sequence : 175537593
  Distance between 3'-terminus of neighbour sequence of sequence listing upward to telomere on chrosomal short arm and 5'-terminus of this base sequence : 15941
aaatagtaatgttggccagatatggtggctcacacctgtaattccagcacttagggagggcgaggtgggaggatcacttgagcccaggagtttgagaccagcctgggcagcatggcaaagccccatctctacaaaaaatacaaacattagccaggcgtggtggtgtctgcctgtggtcccggctactcaggaggctgaggtgggaaaatcgcttgagcctgggaggtggaggttacagtgagccatgactgcaccactgcactccagcctgggcgacagggcaagactctctctctctctctctctttctctctctctctctatctatcatctatctatctatctatctatctatctatctatctatctatctatcatcatctatctatataaaatgttacttaaacccttttggtctccataggctggtgaggccagtggtctgagataagtaatgtaacttgcaa

SEQ ID NO: 3895 - DNA, 463 bp, Homo sapiens
  AC017048.2_46518
  Located on chromosome 2
  Distance between a terminus base of telomere on chromosomal short arm and 5'-terminus of this base sequence : 175644241
  Distance between 3'-terminus of neighbour sequence of sequence listing upward to telomere on chrosomal short arm and 5'-terminus of this base sequence : 106181
gtgcactaaccatacaactgtacatactggccctgaaaagccactgaaaggaataggagaaatgttcaataataaggtagaagtagatgtgaagaagagagatagaggcttgtctttgctcacaggcctcctcagtgaatgttcacaatccagagggcactgtgtgtgtgtgtgtgtgtgtgtgtgtgtgtgtgtgtgtgtgtatacgagccacttgtttgttggttggcttatttttgaggtgagaaaatactataaattctggccatatatttactgccttctctattcggtgctgtgcctgtcaagttttcacttcctctgaattttaactccctgtctccctccctatgctattctcccctcctgcaacacaaatgcctttttaaatttttgctagtttaattagtacatgcattcattttgattgatgaattgatgtggcttatttgtatgaagactc

SEQ ID NO: 3896 - DNA, 456 bp, Homo sapiens
  chr2.fa.O7frz.184348956
  Located on chromosome 2
  Distance between a terminus base of telomere on chromosomal short arm and 5'-terminus of this base sequence : 175709616
  Distance between 3'-terminus of neighbour sequence of sequence listing upward to telomere on chrosomal short arm and 5'-terminus of this base sequence : 64912
gagttccagactccatctctataatttttttttttttttttttttttgtaattagccaggtgtggtggcgctcgcctgtagtcccagctactcagtaagctgaagcgtgaggatcatttgagcccaggagttcgaggctgcagtgagctgtgattgtgccactgtacctcagcctgggtgacagagaaagaccttgtccaaaaaaaaaaaaaaaaaaagacaaagagatgggaattttctttattaagaggcaatacatgagagaaaataagcatgggggaatagggtgtgtgtgtgtgtgtgtgtgcacatgaagggtgcaatttttggtaaaggggttcagaaaggtctctgtgaagaggtgatgtgtgtgagagtctgaaaggcaaagatggctgatggatcccagctacctagtattaatatgtaacttcatttccataccaagaaagtttc

SEQ ID NO: 3897 - DNA, 419 bp, Homo sapiens
  AC017048.2_139796
  Located on chromosome 2
  Distance between a terminus base of telomere on chromosomal short arm and 5'-terminus of this base sequence : 175807570
  Distance between 3'-terminus of neighbour sequence of sequence listing upward to telomere on chrosomal short arm and 5'-terminus of this base sequence : 97498
atttgtgacatcagtgaggaattactgacccctgctgaaccctccttattaacatttttcttgattgacataaaggaatgaaaccctggaagaggataatttctgcattctttgttttttcttttgtcatcatttgatttagagatattagacccctctgactaatccatgaattttaagttctttgaaaaagaacttaaattttctctacagcttagagaactaaagctctctttccttccgtttttccttccttccttccttccttccttccttccttccttcctttcttccttttttcttccctccctcccttctttccttccttccttccttccttccttccttccttccttccttccttccttccttccttccttccttcatggggtccacagtttagttggagaggcaagttt

SEQ ID NO: 3898 - DNA, 343 bp, Homo sapiens
  AC017048.2_155068
  Located on chromosome 2
  Distance between a terminus base of telomere on chromosomal short arm and 5'-terminus of this base sequence : 175822967
  Distance between 3'-terminus of neighbour sequence of sequence listing upward to telomere on chrosomal short arm and 5'-terminus of this base sequence : 14978
aagctttaaagccactgataagtcgttggcttaacgtgaatattaattatttaactaataaagtaaaaataagctagggatcaaaacagtggtttaaaagattatgctactattatttttatacaatctggggcagagttgatccttaaaccagaattccacctccaatgaatgtttactgttgtgtgattgtgggtgtgtgtgtgtgtgtgtgtgtgtgtgtgtgtgtaaacacaggcatgtatactgtagcttttctgttttccccagaaatgtaaccaaaaaatctagagagaaacaatcaaatatttataccagagctttggtgcaagtagctaagata

SEQ ID NO: 3899 - DNA, 396 bp, Homo sapiens
  chr2.fa.O7frz.184531100
  Located on chromosome 2
  Distance between a terminus base of telomere on chromosomal short arm and 5'-terminus of this base sequence : 176035802
  Distance between 3'-terminus of neighbour sequence of sequence listing upward to telomere on chrosomal short arm and 5'-terminus of this base sequence : 212492
gacaaagcaatcctttactttcatgttcctgtccttctttgtttccatgcggcattattaatttgtccactccattcattcattcattcattcattcattcctatctttagtaagttctaactgagtgattgggcccgtgcttatgattgaagctgggtatggagagacgcatagttggaccaagtggctgccccgacacagcccacagcttattaataccttcactctctcccattcactccacaaaccaatgcatccagatacatcttccaggcctttattacaggttcaccctctgttgcacaagagcatatactctcaatgctaaagggcaactaaatgacacagggcactaccctcattgctcagatgtgtaacaaatgcagagtagcatc

SEQ ID NO: 3900 - DNA, 384 bp, Homo sapiens
  AC012452.5_63178
  Located on chromosome 2
  Distance between a terminus base of telomere on chromosomal short arm and 5'-terminus of this base sequence : 176087285
  Distance between 3'-terminus of neighbour sequence of sequence listing upward to telomere on chrosomal short arm and 5'-terminus of this base sequence : 51087
gatagcattaggagaaatacctaatgtaggtgataggttgatgggtgcaacaaaccaccatggcacgtgtacacctgtgtaacaaaaccacacattctgcacatgtaccccagaacttaaagttaaataaataaataaataaataaacattctcagaatgggaagaacttagaggcgccctcttccatttcttgcttgctggaggagaagaaaaaatcaaacaaaacaaataaaacaattaaaacatcaactccaatagaaggtactaaaatcgatatgtaactccataaacacacacacacacacacacacacacacacacagaaaatgtgttggattggtagagcatgtgtgcatgaggcctgttatttgcattaagcaaag

SEQ ID NO: 3901 - DNA, 425 bp, Homo sapiens
  AC012452.5_168573
  Located on chromosome 2
  Distance between a terminus base of telomere on chromosomal short arm and 5'-terminus of this base sequence : 176161384
  Distance between 3'-terminus of neighbour sequence of sequence listing upward to telomere on chrosomal short arm and 5'-terminus of this base sequence : 73715
attaaggctttatcagcaagaggttggggaagatatcactgattttcacatgaagccaatgaaacacacagatatgaagccagtaaagggagatgccaaaattataactcatttttcccgatttattttatattactatattatttttctatctgctagagtatttgaacttattaataaaattaagatgcattactctaatataatatcatgttaatcaatgaaattttgcctatatcatgtataaaaaccaaatgttttcatatatgactaggaattacagcatcctgcaaaaatgaagagtacctcatattctcccttcctctctctctctctctctctctctctctcacacacacacacacacacacacacacacacacaccagccagctgttctgtctcggatgtctttgtgaaaggctg

SEQ ID NO: 3902 - DNA, 381 bp, Homo sapiens
  chr2.fa.O7frz.184873664
  Located on chromosome 2
  Distance between a terminus base of telomere on chromosomal short arm and 5'-terminus of this base sequence : 176347448
  Distance between 3'-terminus of neighbour sequence of sequence listing upward to telomere on chrosomal short arm and 5'-terminus of this base sequence : 185639
tcgtagcttaattatgctcctttagcctctaggctgtggcagaaggtcaaaccacagttaggcattgaagccattgctcccctagcacaatcagcaaaaccccagcatgaagcccaagcatctcaactctctcctgcctagaggtaaattccttctccaccaggcgctctctgaagattgtaaggaggctctctctctctctctctctctcactctctctctattttgttatttcatacctgttgctaaccatccattttaacctttctcttcactgtttttacccactgggattcctcagcaaacacaagttttatggatgttttgcaaagacaagatggtgttgagagaatgaaaaggtgatagcaatcatgtatctgc

SEQ ID NO: 3903 - DNA, 107 bp, Homo sapiens
  DISD22_0002038
  Located on chromosome 2
  Distance between a terminus base of telomere on chromosomal short arm and 5'-terminus of this base sequence : 176445742
  Distance between 3'-terminus of neighbour sequence of sequence listing upward to telomere on chrosomal short arm and 5'-terminus of this base sequence : 97913
gtccttcctagcctgcagccccaggctgccctcagtttacagtttgtttgtttgtttgtttgtttgtttgtttgtttgtttttgtgaaagcaaggagccaaatgatc

SEQ ID NO: 3904 - DNA, 443 bp, Homo sapiens
  chr2.fa.O7frz.185049012
  Located on chromosome 2
  Distance between a terminus base of telomere on chromosomal short arm and 5'-terminus of this base sequence : 176699496
  Distance between 3'-terminus of neighbour sequence of sequence listing upward to telomere on chrosomal short arm and 5'-terminus of this base sequence : 253647
attacattatcaagcgcaaacctggctcaaaattagcgtgggcccctaaaaactgccaaaacaggcatgatggctcacacctgttatcccagcactttgggggaccaaggtaggaggaccacttgagcccaggagttttgatatcagcctggccaacatggaagacgcagtctctacaaaagagaaaaaaaaaaatagccaggcgtggtggcgcgtacctgtggccccggctactcagaaggttgaggcatgaggatcctggagcccaggaggttgaggctgcagtgaaccatgtttctgccactatactacagcctaggccacagcaatacccggtctccataaataaataaataaataaataaataaataaggcattttcttcactccggatctggtagaagttctctgcagctctgatgtctgctatgtttccaagtaaa

SEQ ID NO: 3905 - DNA, 422 bp, Homo sapiens
  AC019080.4_118635
  Located on chromosome 2
  Distance between a terminus base of telomere on chromosomal short arm and 5'-terminus of this base sequence : 176817266
  Distance between 3'-terminus of neighbour sequence of sequence listing upward to telomere on chrosomal short arm and 5'-terminus of this base sequence : 117327
gagctagatgtacaattaccaaacaagagtctttagttctagggtagaatgaaggaatactggcttgtaaagagttcttcctaatatattacacttggtttcttgttgtgtgtgtgtgtgtgtgtgtgtgtgtgtgtgtgtgtagtactttacaactatcttcaactttaaaaaaatttttaatatttaatttcccatttatcactttagatacccttacactttagcataaggctaaagccaaaagctttgcttaaaccaataaacaattattgtcataggctgagaagaggaacgtgaaatagagtgtaaagattgattcgtttttctttaaccatgttaaatacttgtaatcatttgaactgtagctgaagcagacttacctgtttttcctccttatgtgagtagcctgttatcatgtc

SEQ ID NO: 3906 - DNA, 377 bp, Homo sapiens
  chr2.fa.O7frz.185240736
  Located on chromosome 2
  Distance between a terminus base of telomere on chromosomal short arm and 5'-terminus of this base sequence : 176889327
  Distance between 3'-terminus of neighbour sequence of sequence listing upward to telomere on chrosomal short arm and 5'-terminus of this base sequence : 71639
cttccatacttcaagaatctgtatgaatggtgtattcctggctgaatcaagtttataattttattctgttcaatatcctagtataatgacttctttggaaatagtttcccgacaagttattaagtcactgaggtctttatttaattttaatgtgaatttcctactggcgatgaagtccaagtttttctttgcaggaggcctagttttgagacaatgaagaaatttgaggcaatgtggtattccatagagtggatgtggctgtctcattcttgcaatacacacacacacacacacacaactggaaatctgttgtagttgtctttaagtctggctttgatctgaatcggaattctatgtgttgcttaataggatgctta

SEQ ID NO: 3907 - DNA, 370 bp, Homo sapiens
  AC016762.2_2641
  Located on chromosome 2
  Distance between a terminus base of telomere on chromosomal short arm and 5'-terminus of this base sequence : 177031262
  Distance between 3'-terminus of neighbour sequence of sequence listing upward to telomere on chrosomal short arm and 5'-terminus of this base sequence : 141558
ctgacaggagtcagacagtaacagagagaagtggacatctagggcagtgggaaatgaagccaaggaggtcagggagaaccctgcagagctgctcgctgccaacctccttccctgccctgtcatattgattcagcttcaggtgccaagagctgagcaagatgcagaggagacagagagtttacatttgagtggtgggaaacacacacacacacacacacacacacacacacacacatttccacacaaaaccacctaacatgcatccatgcaagtgtgtggaggctgagtcagtacctcaagagttctgaggaggaaggcaagaaagatcgctgtgggctgaggttgggataaaggtcttcatagacagagg

SEQ ID NO: 3908 - DNA, 233 bp, Homo sapiens
  D2S2173
  Located on chromosome 2
  Distance between a terminus base of telomere on chromosomal short arm and 5'-terminus of this base sequence : 177031427
  Distance between 3'-terminus of neighbour sequence of sequence listing upward to telomere on chrosomal short arm and 5'-terminus of this base sequence : -205
ggagacagagagtttacatttgagtggtgggaaacacacacacacacacacacacacacacacacacacatttccacacaaaaccacctaacatgcatccatgcaagtgtgtggaggctgagtcagtacctcaagagttctgaggaggaaggcaagaaagatcgctgtgggctgaggttgggataaaggtcttcatagacagaggccttgactgagattcaggaaagtgtggc

SEQ ID NO: 3909 - DNA, 448 bp, Homo sapiens
  AC012499.6_105210
  Located on chromosome 2
  Distance between a terminus base of telomere on chromosomal short arm and 5'-terminus of this base sequence : 177209708
  Distance between 3'-terminus of neighbour sequence of sequence listing upward to telomere on chrosomal short arm and 5'-terminus of this base sequence : 178048
gacaatgaattgccatgagatccttttgtaaagccagagttgaaactccaaatcatatgactatcccgttaagttggagcacgtgcacacacacacacacacacacacacacacgcacacacaaatggaaacagtatcaggagctaattcagaatagctaaaatttctgaaaaatctttaaaatttaccttgagagttttatgttaaaatcatcatatttcagatgtgcagattaccatccatgatgttcccaatatcaagtatcactataggaaatattataaaaaatgcaagcccagtctcacattcttcacttcatattcccccaaatagtctctagttcataagtgctcatgccttaaacataagactttatcacctgacaagtgctttatcatgaaactgatgtttgcaatctcatatccttgttatctttcgtacaaggtac

SEQ ID NO: 3910 - DNA, 88 bp, Homo sapiens
  D2S300
  Located on chromosome 2
  Distance between a terminus base of telomere on chromosomal short arm and 5'-terminus of this base sequence : 177209765
  Distance between 3'-terminus of neighbour sequence of sequence listing upward to telomere on chrosomal short arm and 5'-terminus of this base sequence : -391
tgactatcccgttaagttggagcacgtgcacacacacacacacacacacacacacacgcacacacaaatggaaacagtatcaggagct

SEQ ID NO: 3911 - DNA, 234 bp, Homo sapiens
  AC012499.6_19298
  Located on chromosome 2
  Distance between a terminus base of telomere on chromosomal short arm and 5'-terminus of this base sequence : 177270379
  Distance between 3'-terminus of neighbour sequence of sequence listing upward to telomere on chrosomal short arm and 5'-terminus of this base sequence : 60526
tagtaagaaagtctgcactaggagttaggaagcctgaattttgttcctgaccttgctattaactttgtggccttcttgaagtcatttctctttctctctttctctctttctctctctctctctctctctctctctgtctctgtctctctctggctttttttttcactctctgcctctatttccacagggtgagataaaagagttctattggttgataactcagattctctacga

SEQ ID NO: 3912 - DNA, 478 bp, Homo sapiens
  AC012499.6_55333
  Located on chromosome 2
  Distance between a terminus base of telomere on chromosomal short arm and 5'-terminus of this base sequence : 177306400
  Distance between 3'-terminus of neighbour sequence of sequence listing upward to telomere on chrosomal short arm and 5'-terminus of this base sequence : 35787
gataacacttgcagctaacaagaagctgagcaaaaagcttaatgagataagcttgggaatgagatgctcccagaaggctttgaaaagcttgtacatattcatagacatctagaacgtatgcaacacacacacacacacacacacacacacacacacacacacacacacactactgtaagaatgtctgggaaagaactgagaaggctctcacctctagcagattttgaagctctgtgttaagtggaaaatgaaacctaagtaaaatccctgtcagaggattgaaggcatccctcatatgcacatagagctcctcagcaaaggctggaagacttattggttcaggcttttaaggaaatctctgtcccattagctgacaaccaagctaactgagcagtaccttcagttgccaaaccctcccaaaaatacagacttcaaagaattagttctggcaagtcactgaacagcaaatagcagtaac

SEQ ID NO: 3913 - DNA, 331 bp, Homo sapiens
  chr2.fa.O7frz.186113565
  Located on chromosome 2
  Distance between a terminus base of telomere on chromosomal short arm and 5'-terminus of this base sequence : 177451845
  Distance between 3'-terminus of neighbour sequence of sequence listing upward to telomere on chrosomal short arm and 5'-terminus of this base sequence : 144967
cctgatgtctataatttgctttacattccttagcaaagacaatgtgaaagtgtgtgtgtgtgtgtgtgtgtgtgtgtgtgtgtgtagtaggtttaatatgccatcaaggagcagacagttgccctagtgagaatttatactccagggatattcagaaagctgcactcaaaatgtggctattacaagtgctccagagatctttatctgccttcaatagcatggggctttgcaatgttagaaatggatttcactggtgaaatcagtagcttgttaatcggcacaatggattttagatatcaactctgattactgcaattagtcctattcaaga

SEQ ID NO: 3914 - DNA, 438 bp, Homo sapiens
  chr2.fa.O7frz.185993449
  Located on chromosome 2
  Distance between a terminus base of telomere on chromosomal short arm and 5'-terminus of this base sequence : 177571684
  Distance between 3'-terminus of neighbour sequence of sequence listing upward to telomere on chrosomal short arm and 5'-terminus of this base sequence : 119508
aaatacagtgcctttattcagtacaatggactctgttttctagtatttaaaatgttaagcgaattgttggctgtgtagaaatctaaagatttacttttttttatattgtcggagaacaacaatctgaattttcaagttttgacaagaatgatagccgaggccaggaagcaatctccaaacgcttgtcagttgtatcaagagttcctttcactgaagaacagcttttcagcatttttgatatagtaccaggattggaatattgtgaagttcaacgagatccttattcaaattatggtaaaataatgttcacattaaaaaatatatatatatgtatatatacacacacacacacacacacacacacacacacacacacacagagttttgttaaaatggcttttctctagtggcacttttatgtcaagtactgctcatgtg

SEQ ID NO: 3915 - DNA, 316 bp, Homo sapiens
  AC011743.4_103789
  Located on chromosome 2
  Distance between a terminus base of telomere on chromosomal short arm and 5'-terminus of this base sequence : 177742236
  Distance between 3'-terminus of neighbour sequence of sequence listing upward to telomere on chrosomal short arm and 5'-terminus of this base sequence : 170114
cttctttggtttgtcaagtgaccaagtgcattgtttcctggacacattttgttatatctgacccgtggagaatgttagtgttcatagaaaatataggaacaggtagtctcttccttccttccttccttccttccttccttccttccttctttcctccctccctccctccctccttcctttctttccttccttcctccctttttcctttcctccttccctgttttccttcctgcctgccatccatccatccatccatccatccatccatccattcatccttgatgtctttttcctacaaccagttaattccttgaac

SEQ ID NO: 3916 - DNA, 223 bp, Homo sapiens
  AC010680.8_12114
  Located on chromosome 2
  Distance between a terminus base of telomere on chromosomal short arm and 5'-terminus of this base sequence : 178006999
  Distance between 3'-terminus of neighbour sequence of sequence listing upward to telomere on chrosomal short arm and 5'-terminus of this base sequence : 264447
actcaggtgactgaggcacgagaatcgtttgagcccaggaggcggaagttgcagtgaaccaagaccgtgccactgcactacagcctgggcgacagagtgagactctgtctcaaaacaaacaaacaaacaaacaaacaaaaaaaaaaaaaccaaaaaatgaagtctctgtttagtctgtggcttatttaagagcaatattctctaggaactcaaccatggttta

SEQ ID NO: 3917 - DNA, 166 bp, Homo sapiens
  D2S385
  Located on chromosome 2
  Distance between a terminus base of telomere on chromosomal short arm and 5'-terminus of this base sequence : 178211454
  Distance between 3'-terminus of neighbour sequence of sequence listing upward to telomere on chrosomal short arm and 5'-terminus of this base sequence : 204232
tcaataacacgccaaaagacagtgccatgtgatataacatgaaacaccacccctatttagtttgtgtgaaggggtgtgtgtgtgtgtgtgtgtgtgtgtgtgtgtgtgtgagatcatcaatggtacatcctcttacaaggttctctgcttatttctactgacagct

SEQ ID NO: 3918 - DNA, 234 bp, Homo sapiens
  chr2.fa.O7frz.186733306
  Located on chromosome 2
  Distance between a terminus base of telomere on chromosomal short arm and 5'-terminus of this base sequence : 178344386
  Distance between 3'-terminus of neighbour sequence of sequence listing upward to telomere on chrosomal short arm and 5'-terminus of this base sequence : 132766
gaagtgaaatgcatatgtttctacaataaatttgattcttatttaagctatatactttgaaaatttctcccaccaaacatttctctctctctcacacacacacacacacacacacgcacacacacacacacacacacacacaatgttttatgtatagataacaaagtagaaacagaaagcagtaagtgtggctgaagctacagggcacctgggttcttgttcagatgcatgtag

SEQ ID NO: 3919 - DNA, 313 bp, Homo sapiens
  AC016755.2_15077
  Located on chromosome 2
  Distance between a terminus base of telomere on chromosomal short arm and 5'-terminus of this base sequence : 178522420
  Distance between 3'-terminus of neighbour sequence of sequence listing upward to telomere on chrosomal short arm and 5'-terminus of this base sequence : 177800
tcacttgaatctaggagttggagacttcagtgagctgagatctcgccactgcactccagcctgggcaacagaatgagacactgtctcaaaaaaaaaaaaaaaaaaaatctatctatctatctatctatctatctatctatctatctatataaattatatagtttttcagatctgcatcttcattccaagcaaaaacacctcacaccagcattcacatagctatcacttgctatgggaatcttttctgttattacatcactcacctcggtcatagaacccacatgaaaggcaataattactgagactgtccgga

SEQ ID NO: 3920 - DNA, 477 bp, Homo sapiens
  chr2.fa.O7frz.187035397
  Located on chromosome 2
  Distance between a terminus base of telomere on chromosomal short arm and 5'-terminus of this base sequence : 178704335
  Distance between 3'-terminus of neighbour sequence of sequence listing upward to telomere on chrosomal short arm and 5'-terminus of this base sequence : 181602
tctcagtaaactatcgcaagaacaaaaaaccaaacaccgcatattctcactcataggtgggaactgaacaatgagaacacatggacacaggaaggggaacatcacactctggggactgttgtggggtgggggtaggggggagggatagcattgggcaacatacctaatgctagatgatgagttagtgggtgcagcgcaccagcatggcacatgtatacatatgtaactaacctgcacattgtgcacatgtaccctaaaacttaaagtataataataataataataataataataataataataataaagaaagaggaatgcttaggacaagtcacaaagtccaagcatgtcaaaaatagtctgtgtaagtcataagaaggtttgtaaagggaaatttaggaaaggaattttgtatgtgattaagttggttataaatgaaagggaattatttaggatagtctttctaacattgcctct

SEQ ID NO: 3921 - DNA, 318 bp, Homo sapiens
  chr2.fa.O7frz.187709242
  Located on chromosome 2
  Distance between a terminus base of telomere on chromosomal short arm and 5'-terminus of this base sequence : 178973243
  Distance between 3'-terminus of neighbour sequence of sequence listing upward to telomere on chrosomal short arm and 5'-terminus of this base sequence : 268431
tcactgtttgtctcctgtaaagttttgattcatgggaaaaaggatttgtgaggctagtgttagcctgtagcaaatctgatgtgctttaccgtatgaatttatctttctgctttgttctgtcataaaaaaggtaccctagaataaaatgtggatctaggacccctgtaagcctgctgttcaagccagcccagcaagctggtcagttacaaactttgctgtatgtccctgaaacaaacaaacaaacaaacaaactggatgaggtttccctctcctcttgttttatgtccttgagagcttgacttgtaaccatatggtagt

SEQ ID NO: 3922 - DNA, 397 bp, Homo sapiens
  chr2.fa.O7frz.187989050
  Located on chromosome 2
  Distance between a terminus base of telomere on chromosomal short arm and 5'-terminus of this base sequence : 179093615
  Distance between 3'-terminus of neighbour sequence of sequence listing upward to telomere on chrosomal short arm and 5'-terminus of this base sequence : 120054
taccaacagtcctagaaagttaaggtttaatgggatgtttgggattttctaattattcactacctgttacaaagataaagtatcttagtcccagagtggttcatgattcatttacacacacacacacacacacacaattcaaacccctagaaagtttctttgtaataatagaaaattattttatgttatttttaaacttcttttaattgtatatttcctattattttcatatgattacaaacgttccctctgttctttctatattatctgtatagtgtggtttcaaaactttttttttcagctttccagtagttcttagattaaggaaaaatgggaatatttatattagaacatgtcttactttgaatagaatatataccttattgaccaaggaaat

SEQ ID NO: 3923 - DNA, 461 bp, Homo sapiens
  AC062033.1_108132
  Located on chromosome 2
  Distance between a terminus base of telomere on chromosomal short arm and 5'-terminus of this base sequence : 179111299
  Distance between 3'-terminus of neighbour sequence of sequence listing upward to telomere on chrosomal short arm and 5'-terminus of this base sequence : 17287
catacagattctgtttcaggacatctggaaatggacctgagactctgcattttaacaagcccctaagtgatgactcactgttggttttttacatagcaaagttctcaaagatgagaataagacagacctcatcaccattacaatgtaagttcctgaagggccaagactgtgtgtgtgtgtgtgtgtgtgtgtgtgtgtgtgtgtgtgtgtgtgtgtgtgtatttaatttcaaatgacctggctttattttctttaaaaaaaatttttatgagtacaaagtaggtgtatatatttatggggtacatgagatattttgatatagaaatataatgcctaataataatattaaggtaaatgggatatccatcaccttgagcatttattctttctttgtgttacaaatatcttattatactctttataagagtatgatattattgtaaactgtaatcattcggttg

SEQ ID NO: 3924 - DNA, 423 bp, Homo sapiens
  AC062033.1_189070
  Located on chromosome 2
  Distance between a terminus base of telomere on chromosomal short arm and 5'-terminus of this base sequence : 179192183
  Distance between 3'-terminus of neighbour sequence of sequence listing upward to telomere on chrosomal short arm and 5'-terminus of this base sequence : 80423
gtaagcttattggtctacaggaccatggcagtgaagctctatgcaatggatattttccatttgcccttctagatcgaatattccccattcctcaccctgcactgtgcccaggagactgactacatcagtgcctcctttctgctctggtttctcattgagttccattaatgttagccaccagcaaaagacaagactacatgaagaagagcgtgagggcaggggcatgtgtgtgtgtgtgtgtgtgtgtgtgtgtgtgtgtgtgtgtgtttatttgtttttatcccagactttggttctacactttcctgatgtcaatgaattagctgtatcctttcctggaagacagcagctccttacctgttggttttctctctcctatagctaaagctctctttgtcttctagtaacgtcagagtctaggaa

SEQ ID NO: 3925 - DNA, 344 bp, Homo sapiens
  AC023761.3_88544
  Located on chromosome 2
  Distance between a terminus base of telomere on chromosomal short arm and 5'-terminus of this base sequence : 179268500
  Distance between 3'-terminus of neighbour sequence of sequence listing upward to telomere on chrosomal short arm and 5'-terminus of this base sequence : 75894
gcaaactaagttacctcagctctttttgcttcccctttgagtctctctttcaccgcccagagtattcataaaacatttggctagggagacactgctgggaaaaggattttgctgctacttttcacaagtcccttgctcactttggtacattgatcacacacacacacacacacacacacacacacacacagcagactggtttcaggtacactctaagaatcttcctgttgttctaaagctcagatctaaaagttctgtaaataccctgaatactaaatttggcagaagaacttccagtggttaggggtcagccaccttttattactagaaacaagtctcaacca

SEQ ID NO: 3926 - DNA, 297 bp, Homo sapiens
  AC023761.3_161334
  Located on chromosome 2
  Distance between a terminus base of telomere on chromosomal short arm and 5'-terminus of this base sequence : 179388578
  Distance between 3'-terminus of neighbour sequence of sequence listing upward to telomere on chrosomal short arm and 5'-terminus of this base sequence : 119734
tgctccagtggacatgtataccttcagataatttttttgaacaaaaaacttgggagatcacctggtctaacattctagcttttagcaaaataataataataataataataataataataataataataataactaagccacctatataagataggtatctagatcaacactaccccctgcaaaaaataatgaatatcatctaattttaaattttctagtagccacatttttaaagttaaaaaaagtgaaattaatgctagaatatattttatttagtcaaacatagccaaatcatta

SEQ ID NO: 3927 - DNA, 313 bp, Homo sapiens
  AC068194.3_27965
  Located on chromosome 2
  Distance between a terminus base of telomere on chromosomal short arm and 5'-terminus of this base sequence : 179666884
  Distance between 3'-terminus of neighbour sequence of sequence listing upward to telomere on chrosomal short arm and 5'-terminus of this base sequence : 278009
tgtattggcatttgagttaaactgtgcctatatcccatacatttttatatatcatgctttcattgtcattaatttataattttttcacttaaaacaatttctaaatatttttaattgcagttgatttcatttctccccaggattactgaagaagagggctgtgtgtgtgtgtgtgtgtgtgtgtgtgtgtatgttcaattccagttttgttacattgtgatcggagagtatagtcagataaatttctgctttggggggagtcctggggttctcatgttctaacacttaatagcactatgtttgagtcagagta

SEQ ID NO: 3928 - DNA, 276 bp, Homo sapiens
  chr2.fa.O7frz.188449444
  Located on chromosome 2
  Distance between a terminus base of telomere on chromosomal short arm and 5'-terminus of this base sequence : 179708819
  Distance between 3'-terminus of neighbour sequence of sequence listing upward to telomere on chrosomal short arm and 5'-terminus of this base sequence : 41622
gataccaacattgctaaactttaccttttctcacttgcttaaaagagtaccatatttgattttcaaagaccttgtgaatagccccttaaaatgtttcatttttttaagtgggcaattgaatactgtgtgtgtgtgtgtgtgtgtgtgtgtgtgtgtgtgtgtgtgtgtgtgttttcctccttaggataatattatctaaattctagtaagtttatattctttaaacacaaaattgttttcataggtcaaaatctcagtatctgataggcaagtaga

SEQ ID NO: 3929 - DNA, 451 bp, Homo sapiens
  chr2.fa.O7frz.188787822
  Located on chromosome 2
  Distance between a terminus base of telomere on chromosomal short arm and 5'-terminus of this base sequence : 179975186
  Distance between 3'-terminus of neighbour sequence of sequence listing upward to telomere on chrosomal short arm and 5'-terminus of this base sequence : 266091
cttcaatgacatcaactttcagggagtccctgtattgagcctgcagacacctttccttccttccttccttccttccctccctccctccctcccttccttcctttccttccttcctctcttccttccttcttttcttcctctcaccttccctgcctccttctttcccttcctccctttctccttgccttcctccctccctccctccctacttaccttcctttttctttttttcatgactatatgtattgagtatctactatgtcctgggcataatcctaaattcttagttttctcccattcttagttctcctaaattcttagttctctcccattctataaaagcaatacaacatgcacacacactcacagacacacacacagacacacacacacacacacacacacatctcttctctatctcatacttcatatcagttgtcacctatccttc

SEQ ID NO: 3930 - DNA, 448 bp, Homo sapiens
  chr2.fa.O7frz.188683328
  Located on chromosome 2
  Distance between a terminus base of telomere on chromosomal short arm and 5'-terminus of this base sequence : 180046107
  Distance between 3'-terminus of neighbour sequence of sequence listing upward to telomere on chrosomal short arm and 5'-terminus of this base sequence : 70470
ctgatacattctaggaagtacgagttctctaatcttagaattcttattaataacgaccctatagctataaagaacaaggatctacaggttttaaggtagtttgttttattttgttttgccatttgtcttcacatgtctgactctgacatcctccttttcttcctacatctcatttctgtttatatccatccttaggcgctctctctctctctctctctctctctctctctctctctctctgctatctactgtttatccctaaaatccacatgttgaaaccgaatccccagtgtgatggtattaggcagtcaggcctttgggagatgattatgtcatgaagacagaggcctcatgaatgaaactagcacccttctacgagagaccccagatttttccctcactccttctaccatgtgagaacacagtgataagatagccatctatgaac

SEQ ID NO: 3931 - DNA, 129 bp, Homo sapiens
  D2S2261
  Located on chromosome 2
  Distance between a terminus base of telomere on chromosomal short arm and 5'-terminus of this base sequence : 180134974
  Distance between 3'-terminus of neighbour sequence of sequence listing upward to telomere on chrosomal short arm and 5'-terminus of this base sequence : 88419
gtgcaggataagaccacaaatgacagaggggcttggttgttttttttttttttttttttttttttttttttttttgtgtgtgtgtgtgtgtgtgtgtgtgtgtttgatacaaaggtcctctcaaatatg

SEQ ID NO: 3932 - DNA, 241 bp, Homo sapiens
  D2S384
  Located on chromosome 2
  Distance between a terminus base of telomere on chromosomal short arm and 5'-terminus of this base sequence : 180140646
  Distance between 3'-terminus of neighbour sequence of sequence listing upward to telomere on chrosomal short arm and 5'-terminus of this base sequence : 5543
catccgaaagtacaaaactcactggtaatagtgaaaaaaaataactatgactactttttaagacatagtacaataagacataaagacaaacaatagaaagttaaaaaattggaggacaaagtaaaagtgtatagtttagattagttttctgtgtgtgtgtgtgtgtgtgtgtgtgtgtgtgtgtgttgagacagagtctcactctgcctcccaggctggagttcagtggtgcaatctcagc

SEQ ID NO: 3933 - DNA, 317 bp, Homo sapiens
  AC009478.3_139160
  Located on chromosome 2
  Distance between a terminus base of telomere on chromosomal short arm and 5'-terminus of this base sequence : 180177446
  Distance between 3'-terminus of neighbour sequence of sequence listing upward to telomere on chrosomal short arm and 5'-terminus of this base sequence : 36559
ttaggtactagaccaactgtgaagaaaatgataagagtctataaaattaggcctgccagcattaaggaattaaggattgacaaactccgggtgggagaggaaagagacagagagagagagagagagagagagagagagagatagagagagagagaaacaaagaggagagagagggagggaatgtgggattaggaggagagaatggtactcaaatgtcaagaaggagggatttctttagagacaattgcatagtattttgtatcttctttttctgccaaacaatcaaatgtcccctagagcttaaggtgctagaatct

SEQ ID NO: 3934 - DNA, 366 bp, Homo sapiens
  chr2.fa.O7frz.189264343
  Located on chromosome 2
  Distance between a terminus base of telomere on chromosomal short arm and 5'-terminus of this base sequence : 180392579
  Distance between 3'-terminus of neighbour sequence of sequence listing upward to telomere on chrosomal short arm and 5'-terminus of this base sequence : 214816
tctaacatcttgcatttacagttatttaaaggcagtttttaagacttaaattatggtgtagtttttgccaactactctaatccattactaactaactgtataatagctatattaaaacttagagcaaaagaaaaatggaaaacaatgtttgagaaaaatgcaaaaccaaaccaaaaaacaccctagagaagcagaacaatataaaattaaacacacacacacacacacacacacacacacacacacacacactagagttcataagagatattgtggtaaagaaaagttatgatgctagaattgaggcaaatagtatccatggagatgcgcattagccaaattgaatcagccttaaatttggatagt

SEQ ID NO: 3935 - DNA, 448 bp, Homo sapiens
  chr2.fa.O7frz.189153279
  Located on chromosome 2
  Distance between a terminus base of telomere on chromosomal short arm and 5'-terminus of this base sequence : 180403022
  Distance between 3'-terminus of neighbour sequence of sequence listing upward to telomere on chrosomal short arm and 5'-terminus of this base sequence : 10077
aggcagtcttagaactcagatagtaactcttctctgagtctctagtctgccagtagaccctgcagattttggacttaccagccatatcatgtaagtcaatatcttaaaataaatctctctttctgtacacacacacacacacacacacacacacacacacacacaccctattggttctgtttctctggagaactctaatatagtagtgtttaaggacatacagagaaggggcttgaaggctgggagggatgagtctgaactaagaaatctgggatatactctaaagtccttcgagaatggaaatatctactggttagatattttctgtgattggagtacagaaaattgcataataaggctcataatatgaggtacatttgtggaaaatttgagttttaatagtaatttgagagatgacatactggtagctattttacattagtgcagc

SEQ ID NO: 3936 - DNA, 303 bp, Homo sapiens
  AC013473.5_43341
  Located on chromosome 2
  Distance between a terminus base of telomere on chromosomal short arm and 5'-terminus of this base sequence : 180624382
  Distance between 3'-terminus of neighbour sequence of sequence listing upward to telomere on chrosomal short arm and 5'-terminus of this base sequence : 220912
acagaagtcgtttatcaggtctagatgccttttggcagagtctttagtgtttactaggtatagaatcataccatcagcgaaggaagataatttgactccttttcttattttgatgccttttatttctttctgttgcccgattgctctggctaggacttccagtactgtgtagaaaacgggtggtgagagtaggtatccttgtcttcttcctggttttcttatttttatttatttatttatttatttatttatttatttatttatttatttatttgagacggagtctcaatctgtcaccaggct

SEQ ID NO: 3937 - DNA, 248 bp, Homo sapiens
  D2S2310
  Located on chromosome 2
  Distance between a terminus base of telomere on chromosomal short arm and 5'-terminus of this base sequence : 180642037
  Distance between 3'-terminus of neighbour sequence of sequence listing upward to telomere on chrosomal short arm and 5'-terminus of this base sequence : 17352
gcatctaaactgtgaaatgagcttattgatgtttcccaaaataagccattttagagctttgactttaattcaagttctaattcaatgttagactgctttaatagctagagaaccattttcagtttatgaaagaaatgccagtccaagaggaaaataggtaggacatctattgtgtgtgtgtgtgtgtgtgtgtgtgtgtgtgtgtatgtgtgtgtatgttttaaggaatagtgcgtctactcaagtcg

SEQ ID NO: 3938 - DNA, 228 bp, Homo sapiens
  AC013473.4_109890
  Located on chromosome 2
  Distance between a terminus base of telomere on chromosomal short arm and 5'-terminus of this base sequence : 180642087
  Distance between 3'-terminus of neighbour sequence of sequence listing upward to telomere on chrosomal short arm and 5'-terminus of this base sequence : -198
ttagagctttgactttaattcaagttctaattcaatgttagactgctttaatagctagagaaccattttcagtttatgaaagaaatgccagtccaagaggaaaataggtaggacatctattgtgtgtgtgtgtgtgtgtgtgtgtgtgtgtgtgtatgtgtgtgtatgttttaaggaatagtgcgtctactcaagtcgagggttgaataattctcaaggagcacttct

SEQ ID NO: 3939 - DNA, 316 bp, Homo sapiens
  AC013473.5_129182
  Located on chromosome 2
  Distance between a terminus base of telomere on chromosomal short arm and 5'-terminus of this base sequence : 180699884
  Distance between 3'-terminus of neighbour sequence of sequence listing upward to telomere on chrosomal short arm and 5'-terminus of this base sequence : 57569
catagttgcaatcatgtcaaacaaagaccttcccccatggatttgcattccatggtcaagaactgacaaaatggaatataaaccacagacaattggtttggtttggaggatggggagagggagaggtgagcagaagggatactattgttaaaaaaaaaaatggacttcttttcttaagggagtgggtgtctcactattagatgttctcatactactaggtggggataataattcgttattattattattattattattattattatattttgatattttgaaaaggtatttggtaagcaaccttaattcctgaaat

SEQ ID NO: 3940 - DNA, 311 bp, Homo sapiens
  chr2.fa.O7frz.189570141
  Located on chromosome 2
  Distance between a terminus base of telomere on chromosomal short arm and 5'-terminus of this base sequence : 180800685
  Distance between 3'-terminus of neighbour sequence of sequence listing upward to telomere on chrosomal short arm and 5'-terminus of this base sequence : 100485
taaattcagtggtagcttgaagctataaaatagggattgaggctacagtctagaaataaaacactaaaaacaatacattggtaataaagataatttaggattcttaggtttgtgggctatgcactattttgtatgaagaagtttcaagagtgtgtgtaaatatatataagccatcttctgtagaagagtgtgtgtgtgtgtgtgtgtgtgtgtgtgtgtgtgtgaatcttctgtataaaatagcttcagttgtcctgtttcaaatgtgggtgactctaatgtttcaaaaatgcttagctcagtactgacac

SEQ ID NO: 3941 - DNA, 431 bp, Homo sapiens
  chr2.fa.O7frz.189751080
  Located on chromosome 2
  Distance between a terminus base of telomere on chromosomal short arm and 5'-terminus of this base sequence : 180981442
  Distance between 3'-terminus of neighbour sequence of sequence listing upward to telomere on chrosomal short arm and 5'-terminus of this base sequence : 180446
atttcagttcaaacaatgtatcacaatgaccatgaaaaatacaatgatttctatagacaagacttcaactttactagtaaccaactaatctacacataataaaaatattttttgtacacacaaaatatgttaatatatgtgtgtatatatgtatatatgtgtatgcatatatatatatatatatatatatatatatatatatatatatacatatatatacacatatttttttccctgagatggggtcttgctatgttgcccaggctggcctcgaactcctgggctcaagcaatcctcccatctcagcctcccaaagtactaggattacaggtatgagctaccgtggccagcccacgaaatatgttaaaggactctgccactttgaaatctctaaactcagttgctttatctttaaataggcagctcaaatt

SEQ ID NO: 3942 - DNA, 471 bp, Homo sapiens
  AC009962.8_131079
  Located on chromosome 2
  Distance between a terminus base of telomere on chromosomal short arm and 5'-terminus of this base sequence : 181194642
  Distance between 3'-terminus of neighbour sequence of sequence listing upward to telomere on chrosomal short arm and 5'-terminus of this base sequence : 212769
aattagatgaggagtcaatcctaccaaaagctatgagaatactataaaatgagagctgaaaagtatccactggatttggtgttttagaggtcattgatgattattgcctcagtaggtttggaatagcttacttggaaaataggaatagggctgaccaagaacatataaaaacatggctgtctggtattaatggttcaaaacacacacacacacacacacacacacacacacacacacacacaatctctctctatagatatagatatagatatatatacaccaaacttttatccagagtttcatctctgagtggtatttctgaatgcttggggctacatctccatctgcatgtattatatgcacatcacatctagtatgtccagtgatgtactaatttcccttcttctaccttattctccttactctcaaccaaattaaccccaaatactcaatccttgtaaattgtctatc

SEQ ID NO: 3943 - DNA, 337 bp, Homo sapiens
  chr2.fa.O7frz.190061950
  Located on chromosome 2
  Distance between a terminus base of telomere on chromosomal short arm and 5'-terminus of this base sequence : 181269169
  Distance between 3'-terminus of neighbour sequence of sequence listing upward to telomere on chrosomal short arm and 5'-terminus of this base sequence : 74056
gtgatctacagctgtggtttacaaactgaattcaggtggccaggcagggacccctccccccgcgccccactacccgctaaccgcctcccgccacacacacacacacacacacacacacacacaccccgcgcgcgcgcacacacacacaccccaccccaccaccccgacctccacatacattcccccgaccccctccagcagtgaagtctaagagcaccgcgaagtaatttaaattttcgagggaaagcacagcgccatctgtcggacatcatgccaattactcttgttaagttcctacctgacggttactttatactttgaactgctaggtactcct

SEQ ID NO: 3944 - DNA, 448 bp, Homo sapiens
  AC009962.8_36585
  Located on chromosome 2
  Distance between a terminus base of telomere on chromosomal short arm and 5'-terminus of this base sequence : 181318414
  Distance between 3'-terminus of neighbour sequence of sequence listing upward to telomere on chrosomal short arm and 5'-terminus of this base sequence : 48908
ttagaatgccttcaccagtaccctattttactaaatacttgcattttttaagatactcagattccattttatttcatttttggacatggacatacaagaaatatgttttcttgcagctcagagctgaaaaaatatcactaagtagagtacagttaggtagcagtttatatctctgaatttcctacattctaccaaaagaggacataaatcagtcttgtagcatctccaagctaataaactcaatagtcagcctctatgatttttgctggatgtgtgtgtgtgtgtgtgtgtagtgtgtgtgtatgtaaaatggacactaccatttggactttgcacaaatttaattattaaaaaaaaggaatgctcaatagcctcccaagctcccactaaaaccatccccttttcattaactttgaaatagattgtttcataaacaaatcaggtacac

SEQ ID NO: 3945 - DNA, 270 bp, Homo sapiens
  Z66918
  Located on chromosome 2
  Distance between a terminus base of telomere on chromosomal short arm and 5'-terminus of this base sequence : 181381810
  Distance between 3'-terminus of neighbour sequence of sequence listing upward to telomere on chrosomal short arm and 5'-terminus of this base sequence : 62948
tggtggtcagccctgtaatttacagaacagccaattaaattattgttggactgcttgaatcatgttttcagaaaagtggatttggatgttaggacaggaaatggctgactcatttctatcccaattttgtgtgtgtgtctgtgtgtgtgtgtgtttgtgtgtgtgtgtgtgtgtgtgtgtgttttactggaatgcaaatgccttctactgaagaaagcaaagtaagtgctattgatttaaacggaaattggaacattaaacaaagcagct

SEQ ID NO: 3946 - DNA, 426 bp, Homo sapiens
  AC011291.6_75420
  Located on chromosome 2
  Distance between a terminus base of telomere on chromosomal short arm and 5'-terminus of this base sequence : 181456871
  Distance between 3'-terminus of neighbour sequence of sequence listing upward to telomere on chrosomal short arm and 5'-terminus of this base sequence : 74791
aatgcttgtacagtgaaaagttacaacatctaattgtgcttgatctttcttgtcagctaacaatgcataaaggtagtttttcagctttaagcaaaggaaagactttgcacatgctcaggcaaaacatgacaaggaagcagggcctctgagggctgcagtttgtttctgtgtagtaaaatataaaagtcacatcaaataatgttatctgtacagaaaagtgtgggttttcattttcatagacatttttgaacacacacacacacacacacacacacacacacacattcttgtctcttatctcttggctggtaatatattttgttacattctgatgggataaacatcccgctggcaaatttcattttccattctagtgtctgtctccagcaatggttgacggtcttgttatcatgaactgtagatagc

SEQ ID NO: 3947 - DNA, 236 bp, Homo sapiens
  D2S364
  Located on chromosome 2
  Distance between a terminus base of telomere on chromosomal short arm and 5'-terminus of this base sequence : 181484803
  Distance between 3'-terminus of neighbour sequence of sequence listing upward to telomere on chrosomal short arm and 5'-terminus of this base sequence : 27506
gctaataatctctatgggaatgcaggcatgctccctctaccttccttcttacttttgttgtccatgcaaatacagtggacaggagacacacacacacacacacacacacacacacgcacacacacacacacactctccctctctctctttctctttcatacacacacacacacacacacactcacacacacaatattacttaaaatatccttaagttatgctgctgtcagaatcct

SEQ ID NO: 3948 - DNA, 281 bp, Homo sapiens
  AC011291.6_139525
  Located on chromosome 2
  Distance between a terminus base of telomere on chromosomal short arm and 5'-terminus of this base sequence : 181498921
  Distance between 3'-terminus of neighbour sequence of sequence listing upward to telomere on chrosomal short arm and 5'-terminus of this base sequence : 13882
ttgaagataaatcattagaaagcagccaatcaaaaatgaatgaagaaggaaggaaggaacaaaagaaggaaggaaaggaagagaagaaagaaagaaagaaagaaagaaagaaagaaagaaagaaagaaagaacaattaaagaaattgacagagatccagagcatccaggacaatttccagaatcctaagttatgcataacacaatcctcagaaggagagaacagagagaaagaggcagaagaaaaatattgaacaaaatgacagaaagctttctaaatttg

SEQ ID NO: 3949 - DNA, 444 bp, Homo sapiens
  AC011291.6_51839
  Located on chromosome 2
  Distance between a terminus base of telomere on chromosomal short arm and 5'-terminus of this base sequence : 181534615
  Distance between 3'-terminus of neighbour sequence of sequence listing upward to telomere on chrosomal short arm and 5'-terminus of this base sequence : 35413
tcctggtagatacttaatgctgtcaagtgtaaaactgcctcactccagacttactgtttcaggcttttcagtgggtaaagtcctagttataacctagcactggccctgccactgaatatttatgatagagtagacaaggacaaaataaaaaatgaaaagttcccactaaaacaacaccaccaccaccacacatggatagctatgtgagatgatggatatattaatttgcttctgtataataatcattttactatctgtatcttatcatgttatataccataaatgtacacaataaaaactatttaataacaacagagaaaacaaaaactaaagaaatctggcattttatacaagcagcctgtttaagatctgtgtctgatagtctgccagataaaccaagctttattattcatccaacatatgataaatgacctaccaggcact

SEQ ID NO: 3950 - DNA, 276 bp, Homo sapiens
  AC011291.6_109247
  Located on chromosome 2
  Distance between a terminus base of telomere on chromosomal short arm and 5'-terminus of this base sequence : 181548614
  Distance between 3'-terminus of neighbour sequence of sequence listing upward to telomere on chrosomal short arm and 5'-terminus of this base sequence : 13555
caatatcctttaaattcttggttaatgtagaaaaaccaatatgcagatgttttaggagacaatgttaaattaaattaggcaatcgaaacaagtttagaaggatgagcctacaaaatgcctctgtagaaataacatttagaaacaaggcacatgaacaccacacacacacacacacacacacacacacacacacacacaatgaggcaagtatgtgagccaataactttactcacttcagagtttcaactctgattatttctaacatatgtagcgctg

SEQ ID NO: 3951 - DNA, 306 bp, Homo sapiens
  chr2.fa.O7frz.190168316
  Located on chromosome 2
  Distance between a terminus base of telomere on chromosomal short arm and 5'-terminus of this base sequence : 181699359
  Distance between 3'-terminus of neighbour sequence of sequence listing upward to telomere on chrosomal short arm and 5'-terminus of this base sequence : 150469
ttaagtaggcttagtgaacttcaggatatatgaaaaatgattcaacaaaatgagaaaaataataaattaccaaaaagcaaaatttaataaagagaaaataataataataataataataataataataaaatagaaatccaggagctgaaaaatacaacaaacaaaattaaaaattaaaaatgctatagagagtaaattaatgaagtagatacaaataacttgaactccaagacaggttatttgaaaatatgtagtcagaagagggaaaaaaataataaaaagaaatcaggttagcttacaggattt

SEQ ID NO: 3952 - DNA, 282 bp, Homo sapiens
  chr2.fa.O7frz.190637933
  Located on chromosome 2
  Distance between a terminus base of telomere on chromosomal short arm and 5'-terminus of this base sequence : 181831612
  Distance between 3'-terminus of neighbour sequence of sequence listing upward to telomere on chrosomal short arm and 5'-terminus of this base sequence : 131947
gcaccagagtgagatcctatctgaaaaagaaagaaagagagaaagagagaaagaagggaaggagggaaggagggaagggaggaagggaggaaggaaggaaggaaggaaggaaggaaggaaggaaggaaaaagagagaaagaaagaaaaagaaagaaagaaagaaagaaaaagaaagaaagagagaaaggaaggaaggaaaggaagggaaggaaggaagggagggagggagggagggagggagggagggaggaagatgaatctttgtgattacattaggctca

SEQ ID NO: 3953 - DNA, 351 bp, Homo sapiens
  chr2.fa.O7frz.191060686
  Located on chromosome 2
  Distance between a terminus base of telomere on chromosomal short arm and 5'-terminus of this base sequence : 181950574
  Distance between 3'-terminus of neighbour sequence of sequence listing upward to telomere on chrosomal short arm and 5'-terminus of this base sequence : 118680
tgtcaccagtctagcttatcaccagctgttcccacatcttcggttggccaacttttcattttaatcatttatggatcactttgttttaagagtatctatctctctctctctctctctctctctccacatatgtggaacttctttttaacttcaaagagtgtccttcatatgggaggtgagtttttttggttttctttttccagctttattgaggtataattaacaaataaaaattgtacatatttaaggtataaggaggtaaattttgattaatgttttctgaggtctgctgccactgaattctcccactgctctgagtccttatttttctttacttccgtcaataaagct

SEQ ID NO: 3954 - DNA, 439 bp, Homo sapiens
  AC018936.3_134506
  Located on chromosome 2
  Distance between a terminus base of telomere on chromosomal short arm and 5'-terminus of this base sequence : 182108586
  Distance between 3'-terminus of neighbour sequence of sequence listing upward to telomere on chrosomal short arm and 5'-terminus of this base sequence : 157661
tacagaaatagcttgattggttacagataggcatttgccttatttggacatggtctgctccaaataaggcaagttggcagcatgcaattggctgtgacctatctgttacaaaaatatatctatataatcctaaattaggtttcagtttatttaagtactaaattaggttgcaatttattacatgggaactcaaagtctggagacagcctcaggccaaggtcctcttgcttatttaatttagcaatcctaaaattttccagagaggaaacacatcacacacacacacacacacacacacacacacacacacacacacactacctacaaaaaaataacaattagaaagtaattggagcttgaagtattctagaagactttggagcaaagccttccaaattctgagaggaaaatatttttaacctaggattctattcatacc

SEQ ID NO: 3955 - DNA, 156 bp, Homo sapiens
  D2S350
  Located on chromosome 2
  Distance between a terminus base of telomere on chromosomal short arm and 5'-terminus of this base sequence : 182255532
  Distance between 3'-terminus of neighbour sequence of sequence listing upward to telomere on chrosomal short arm and 5'-terminus of this base sequence : 146507
tccaagcaactcctcatactacacaaaatatacactgctccaagaaagttttagaatttagattggggtgtgtgtgtgtgtgtgtgtgtgtgtgttgcctatgccaaaaacccaagtataaagaatacacaccactagtaatttcgctgtgacaca

SEQ ID NO: 3956 - DNA, 332 bp, Homo sapiens
  chr2.fa.O7frz.191465002
  Located on chromosome 2
  Distance between a terminus base of telomere on chromosomal short arm and 5'-terminus of this base sequence : 182332502
  Distance between 3'-terminus of neighbour sequence of sequence listing upward to telomere on chrosomal short arm and 5'-terminus of this base sequence : 76814
attatgaggtcaggagatcaagaccatcctggccaacatggtgaaaccctgtctttactaataatacaacacattagccgggtgtggtggtgcacacctgtagtcccagctactcaggaggctgaggcaggggaatcacttgaacctgggaggcagagattgcagtgagctgagatagcgccactgcactccagcctggagacagagcaagactccgtctcaaaataattaataataataataataataataataataaaataaaattttttaaaaaaagggcctatcttctccctatccctctaaatcttggaacatagataatttaatgg

SEQ ID NO: 3957 - DNA, 308 bp, Homo sapiens
  chr2.fa.O7frz.191555507
  Located on chromosome 2
  Distance between a terminus base of telomere on chromosomal short arm and 5'-terminus of this base sequence : 182423208
  Distance between 3'-terminus of neighbour sequence of sequence listing upward to telomere on chrosomal short arm and 5'-terminus of this base sequence : 90374
tacatctagtggaattcaccagttttgaattaacagaatgaacatttacaaacacacacacacacacacacacacacacacacacacacacacacaatgtcacagggttgatactttctggtccacaaagtattgaatattaatagaaacagtatgacagtccttgttacatttttgaatagatttttaggtccaaaaaaaactttaaaatgcctttttttaaaaaaaatgcttttttatttccataggtttttggggaacaggtggtatttggttacatgagtaagttctttacatgattcgtgaga

SEQ ID NO: 3958 - DNA, 405 bp, Homo sapiens
  chr2.fa.O7frz.191665444
  Located on chromosome 2
  Distance between a terminus base of telomere on chromosomal short arm and 5'-terminus of this base sequence : 182471931
  Distance between 3'-terminus of neighbour sequence of sequence listing upward to telomere on chrosomal short arm and 5'-terminus of this base sequence : 48415
aaatgtacaacgtgaggactatagttaataatattgtattatatactggtaatttgccaaaagaataaattttagatactcttaccatcaaaaaaaaaaaaagagaaaagaaaggtaactgagattataatttgctaaactgtaataatccatttactatgtgcgtgttcattatatatatatatatatatacacacacatatacataaacatgttgtagccctaaaatctatgcaataaaatttaaaaaataaaaacacccaagatgtcttttcctcctaattaaatttatatttgctataaatttaagtttattgtcccattccaagtgctagtgaaggatttcaaagaagtcctttgttcgatgttattagcgatatcctactgtatctataccaaggcatg

SEQ ID NO: 3959 - DNA, 292 bp, Homo sapiens
  AC021851.3_169328
  Located on chromosome 2
  Distance between a terminus base of telomere on chromosomal short arm and 5'-terminus of this base sequence : 182483029
  Distance between 3'-terminus of neighbour sequence of sequence listing upward to telomere on chrosomal short arm and 5'-terminus of this base sequence : 10693
tcacgatatctgtagacaggatcaaacaacttttgaagggtatttgatttccccctatttacagatttaagaaactgaaactcaaaagagacaaattgccacattcatcctgccacagggtgtgtgtgtgtgtgtgtgtgtgtgtgtgtgtgtgtgtgtgtgtgtgtgtgttttctgactctaaacgtagagcagtttctactatgccccagccacttggatgtagtatgtgtacaaaagtgacaacacgatatagtgattcttcaaagtaggtttattgttctaattgaca

SEQ ID NO: 3960 - DNA, 464 bp, Homo sapiens
  AC021851.3_108017
  Located on chromosome 2
  Distance between a terminus base of telomere on chromosomal short arm and 5'-terminus of this base sequence : 182544280
  Distance between 3'-terminus of neighbour sequence of sequence listing upward to telomere on chrosomal short arm and 5'-terminus of this base sequence : 60959
tagttcctgacaaccactgatctgctttctattactaaagctttgtttttttctaggatttcatagaaatgaagtcatacagtatgtagtcttttttgactggctttattcacttagtataatcctttgagtttcatccacattgttgtactgcattagccgttctttctttctttctttctttctttctttctttctttctttctttctttctttctttctttcttttttttttttgagacagagtcttactctgttgcctaagctggagtgcagtggcacaatcttggctcactatagcctctgcctcctgggctcaagccatcctcctacgtcagcatcccaagaagctgggactacaggtatcacaccccactaatttttgtattttttgtagagacagggtttcaccatattgcacaggctggtcttgaactcccagactcaagctattgactcacctt

SEQ ID NO: 3961 - DNA, 156 bp, Homo sapiens
  D2S2273
  Located on chromosome 2
  Distance between a terminus base of telomere on chromosomal short arm and 5'-terminus of this base sequence : 182548888
  Distance between 3'-terminus of neighbour sequence of sequence listing upward to telomere on chrosomal short arm and 5'-terminus of this base sequence : 4144
agataatacttgggtcatggccatgtgtgtgtgagtgtgtgtgtgtgtgtgtgtgtgtgtgtgtgtgtggtttcaatatacaggtgcagaaaaaatcctgagagagatggaaatggttgttctacaggctgtaaacgatgggaagtccagtgacct

SEQ ID NO: 3962 - DNA, 237 bp, Homo sapiens
  D2S2281
  Located on chromosome 2
  Distance between a terminus base of telomere on chromosomal short arm and 5'-terminus of this base sequence : 182587360
  Distance between 3'-terminus of neighbour sequence of sequence listing upward to telomere on chrosomal short arm and 5'-terminus of this base sequence : 38316
ttattagcagtataaaggcagcaaatttatagttagttaatagttatttgcatttataaatctatttaaatgaatgtttaaaaaagttctaccagcttgtaatcatccttgtggaatcaagcaactcttattatacacacatacaaacatacacacacacacacacacacacacacacacacacacacacacacacacacacacacacatacacatggcccagagtgcctcctaatc

SEQ ID NO: 3963 - DNA, 472 bp, Homo sapiens
  AC021851.3_2454
  Located on chromosome 2
  Distance between a terminus base of telomere on chromosomal short arm and 5'-terminus of this base sequence : 182649802
  Distance between 3'-terminus of neighbour sequence of sequence listing upward to telomere on chrosomal short arm and 5'-terminus of this base sequence : 62205
ctcttaagcctctttaggttaaatggactgttttacgttatagattaaaacgaaggagggttcttcccatacctctaataaaaaagataaatagaatcattagaagttagtcatacacaataactaatttagtaaccactaggtatagatgtctatgagttgtgatgggaattaggatggatacaaagaatgtgttccttgctgtaagattctaactatttagaaagaaagacaaattacacacacacacacacacacacacacacacccccacacaccccatactgttcttgaatacatacaaatgccaaagaggtggctgagacagtagaaccacagaagcatatgtggcatctgtagattatatatatttaggttatttatttgccccttaaactttgttccaccccctaaaaatgaagggaggtgtacctaacattaggtgttgtgacttgactttacaaatggaacc

SEQ ID NO: 3964 - DNA, 436 bp, Homo sapiens
  chr2.fa.O7frz.191888749
  Located on chromosome 2
  Distance between a terminus base of telomere on chromosomal short arm and 5'-terminus of this base sequence : 182695658
  Distance between 3'-terminus of neighbour sequence of sequence listing upward to telomere on chrosomal short arm and 5'-terminus of this base sequence : 45384
atacttctacagcctggaagattctagaatagcatctctcatatattttcgactgaggataagacatgcattttctctattgacccattttgtgtgtgtgtgtgtgtgtgtgtctgtgtgtgtgtagctaaaacaaaagtttcacaaacaacgctttccattgctatgtaaaatgcactctgttttttctatccttttgaattttaaaaattgacccacttaattgattttgttgataagtcaaaagtatcattgaaaagatactgttctaggaaatgggccttacagaacaataaagttcataagagcattctgtgttttgaaaaacaaaggggagaggttaagaaagaacagcaagaaatgcaaagcagagagtaatttcaccaatgtggtcattacaaaagtcacctttgtctttccagttacagtagacatg

SEQ ID NO: 3965 - DNA, 157 bp, Homo sapiens
  DISD22_0002045
  Located on chromosome 2
  Distance between a terminus base of telomere on chromosomal short arm and 5'-terminus of this base sequence : 182919153
  Distance between 3'-terminus of neighbour sequence of sequence listing upward to telomere on chrosomal short arm and 5'-terminus of this base sequence : 223059
ttgtcacagatacacagctttcactaaactcacaagtataaagtacgtgtatatatatgtgtatgtgtgtatatatatatatatatatatatatatatatatatatatatatacacatacatacccacagtcactccccttctgatgctatgacatt

SEQ ID NO: 3966 - DNA, 447 bp, Homo sapiens
  chr2.fa.O7frz.192279227
  Located on chromosome 2
  Distance between a terminus base of telomere on chromosomal short arm and 5'-terminus of this base sequence : 183124252
  Distance between 3'-terminus of neighbour sequence of sequence listing upward to telomere on chrosomal short arm and 5'-terminus of this base sequence : 204942
tgtgactaggttatttccaataacctgctttttaagcttgttcattcttttttctatttgaccaagtctgctgttaaaactttctgtttagttttaaagatttggtaattgtgtttcccacctccagaatttctgtttggctctttgtgtgttttctgtcacttattttttgaaattttcattttgttcacatagtattttccaattccttttatcacctgtttctgtttgttatttaattaattatttgtttatttatagctcactgattttccttaagacaaatcactatttttttacaattggttacgagtgctttattttgttactttggtggtctcgtgtgtgtgtgtgtgtgtgtatgtgtgtgtgtgtgtgtgagattcctatagctttttgctggcatatatgcatttgaagtaggtaccttgttctgtctttacagac

SEQ ID NO: 3967 - DNA, 433 bp, Homo sapiens
  chr2.fa.O7frz.192379443
  Located on chromosome 2
  Distance between a terminus base of telomere on chromosomal short arm and 5'-terminus of this base sequence : 183198698
  Distance between 3'-terminus of neighbour sequence of sequence listing upward to telomere on chrosomal short arm and 5'-terminus of this base sequence : 73999
ttagcttccacttatgagtgagaacatatggtgtttggttttccattcctgaattacttcatttgaataatggtctctaataccatttgggttgctgtgaatgcctttatttagttcctttttatggctgagtagtatttcatggtgtgtgtgtgtgtgtgtgtgtgtgtgtgtgtgtgtgtgcatatcacaatttctttatccattcattgattgatgggcatttgggctggttcgatatttttgcaactgcaaatcgtgctgctgtaaacatgcctgtggaagtatctttttttgtatgacttcttatcctctgggtagatacccagtaatgggattactggatcaaatagtagttctacttttagttctttaaggaatctccacactgtttttcctagtggttgtactagtttacattatcaccagcagt

SEQ ID NO: 3968 - DNA, 404 bp, Homo sapiens
  chr2.fa.O7frz.192635301
  Located on chromosome 2
  Distance between a terminus base of telomere on chromosomal short arm and 5'-terminus of this base sequence : 183466524
  Distance between 3'-terminus of neighbour sequence of sequence listing upward to telomere on chrosomal short arm and 5'-terminus of this base sequence : 267393
gtgctccttgtcatctgaccttcacctggtgctgttccatggcaaaatatggaacgccaaagtgtggtactttcccctctgcttcttgcctgccctgttgtcataagaaaataacagccttttcagtttggcttgtcttaattgattacctcaacacctgccagcttaactatgtgtgtgtgtgtttgtgcgtgtgtgtgtgtgtgtgtatgtgtgtatgtgcatgtgtatatgcataggtatatgcatggttgtaaggatttattttcaataaagtggtaaaactatatcaaaataaattacacatgaataggaagaaaatcaataataaatgagagaattaatcccaaacaattcagcaagtacattaaatgtaaatagactattcagtctaagcaatacca

SEQ ID NO: 3969 - DNA, 194 bp, Homo sapiens
  D2S1383
  Located on chromosome 2
  Distance between a terminus base of telomere on chromosomal short arm and 5'-terminus of this base sequence : 183628650
  Distance between 3'-terminus of neighbour sequence of sequence listing upward to telomere on chrosomal short arm and 5'-terminus of this base sequence : 161722
agacagttgtaggtgtgcagctttatttctgagttctctaacttgttccattggcatctatctatctatctatctatctatctatctatctatctaatctatctatagatagatagatatatcagtaccatgctgttttagttaactgtagccttatagtatagtttgaagtcaaataatgtgatgcctccagc

SEQ ID NO: 3970 - DNA, 252 bp, Homo sapiens
  chr2.fa.O7frz.192914983
  Located on chromosome 2
  Distance between a terminus base of telomere on chromosomal short arm and 5'-terminus of this base sequence : 183714989
  Distance between 3'-terminus of neighbour sequence of sequence listing upward to telomere on chrosomal short arm and 5'-terminus of this base sequence : 86145
ccttgactgctacattaagaatagggttcgtgtgtgtgtgtgtgtgtgtgtgtgtgtgtgtgtgtgtgttttctttcttgatatttcttcagagcctataatagggcttcgcatatgacaagcactgaataaatattgaatgtctgaattacctctagatggatagtgtaacattctaaagggacagaattatgtcattcacatttaatgaacatatggtaatataatgtcattgaaatggtgaatagtaat

SEQ ID NO: 3971 - DNA, 446 bp, Homo sapiens
  chr2.fa.O7frz.193012924
  Located on chromosome 2
  Distance between a terminus base of telomere on chromosomal short arm and 5'-terminus of this base sequence : 183843015
  Distance between 3'-terminus of neighbour sequence of sequence listing upward to telomere on chrosomal short arm and 5'-terminus of this base sequence : 127774
acaagtatttaaggtgatttcctccttggcaaatctctttctagttggcatgaaggactttatagtttattgaaaatgccaaacatttaaaatttgaacattgaagataaaaaaattcaagactcttcttgggttttcactaagtggatctctaaggtgtatttctcatgaatatcactactaccataatggaagttatagagataagttagatgaaataataaaataaaaataacatgaatattggcataacaatattacatgcataaatacttccacaggcacatgaacacacacacacacacacacacacacacacacacacacacatgcgccaaagataagctgaagtagtttcataaaagaaagtatttggttgtataataactactaaagtatctctaggaagtatgagcttagaaaagtcagatagacttccttggaag

SEQ ID NO: 3972 - DNA, 470 bp, Homo sapiens
  chr2.fa.O7frz.193333090
  Located on chromosome 2
  Distance between a terminus base of telomere on chromosomal short arm and 5'-terminus of this base sequence : 184154178
  Distance between 3'-terminus of neighbour sequence of sequence listing upward to telomere on chrosomal short arm and 5'-terminus of this base sequence : 310717
gtttcagttactgatggtcaaccatccaaaaaataggtgaatgcagtacaatcggatattctgagagatagagagagagagagagagagagagagagagagaaagagaccgcattcacataacttttatattcagtatattatcagtactatttgtgatttcaagcatccactgtagatcttggaaaatatcctccacagataagcaggtgactactgtattttcaatcataaatttgataaggtttaataaccaaaattgataagaaattcaaatgactaaagactaagaaaacaaataacctgattaaaaatgggcaaaggacctgaatagacatttttcagaagaagacatacgaatgccccaaagatatatgaaacaaaatgctcagtatcactaatcatcagagaaatgcaaagtaaaaccacgatgagataccacctcaaacctgttaggatgtctgttagcaa

SEQ ID NO: 3973 - DNA, 289 bp, Homo sapiens
  G10074
  Located on chromosome 2
  Distance between a terminus base of telomere on chromosomal short arm and 5'-terminus of this base sequence : 184486597
  Distance between 3'-terminus of neighbour sequence of sequence listing upward to telomere on chrosomal short arm and 5'-terminus of this base sequence : 331949
aatgctaaattttctggcctgatttaatgtagaaaaataaaatcttgtaaatgactataatacttgccaatgtcatatctatctatctatctatctatctatcatctatatatatatacatatatatatatatatatatatatatatatatatatatatatatatatatatgggtctctgatgttattatctggtgcccatttttctggtttaaattttggctgggctaggtggctcacacctgtaatcccagcactttgggaggccgaggagggcggatcacgagatc

SEQ ID NO: 3974 - DNA, 255 bp, Homo sapiens
  D2S1330
  Located on chromosome 2
  Distance between a terminus base of telomere on chromosomal short arm and 5'-terminus of this base sequence : 184532184
  Distance between 3'-terminus of neighbour sequence of sequence listing upward to telomere on chrosomal short arm and 5'-terminus of this base sequence : 45298
gaataatttgtactgagctcttttgagatatattctattctgtgcaaacatattagtattacagttctccaggagaacagaataaataagatgtctatctatctatctatctatctatctatctatctatctatctacctacctgcctgtctatctatgatctatctatctgtatctatctatctatcttctgagagagaaagagagaatgaggtttatgttaaagaagtagttcacagtaattgtggaggctgg

SEQ ID NO: 3975 - DNA, 177 bp, Homo sapiens
  D2S1361
  Located on chromosome 2
  Distance between a terminus base of telomere on chromosomal short arm and 5'-terminus of this base sequence : 184672579
  Distance between 3'-terminus of neighbour sequence of sequence listing upward to telomere on chrosomal short arm and 5'-terminus of this base sequence : 140140
tcaaattcaagttaacattcatcatgttatatataacatgctagatagatagatagattagatagatagatagatagatagatagatagatagatagatagatgatagatagatagatagatagtagatagatagatagtggagcagaatacaaagacatccaagaacggcttctta

SEQ ID NO: 3976 - DNA, 389 bp, Homo sapiens
  chr2.fa.O7frz.193963268
  Located on chromosome 2
  Distance between a terminus base of telomere on chromosomal short arm and 5'-terminus of this base sequence : 184802035
  Distance between 3'-terminus of neighbour sequence of sequence listing upward to telomere on chrosomal short arm and 5'-terminus of this base sequence : 129279
agtaatacgtagcagaataaccattgaaaatgggtttatgtacataaaactcctgactatatccacactctagtatttataatgaaaatgacctttaaaatgcatttatttatctagatcaattaacacatttgtaaactagtagtttacatgtgtttacttgaaatgattgcagtgaaaatttaataaagtatgtatacaagaataactctccccaaatcttaaagtgctatacaattccaagttttattctgtgatatatatatatatatatatatatatatatatatatatatatatatatatatctttgaagctacaaagccagaagacagatttctataattcatatacgaattctatcttttctaacaaaccgaacttggata

SEQ ID NO: 3977 - DNA, 378 bp, Homo sapiens
  AC007966.3_108029
  Located on chromosome 2
  Distance between a terminus base of telomere on chromosomal short arm and 5'-terminus of this base sequence : 184962214
  Distance between 3'-terminus of neighbour sequence of sequence listing upward to telomere on chrosomal short arm and 5'-terminus of this base sequence : 159790
tgaagctacataagtaggtaaggtctctctaagaagaatacaaaaaaaaaaaaagaaaacaaatttataggagtggtccatgtatgacagaaaaggataaaatacatatatagtctctgtatatatagactatgtatgtatatatatatatatatatatatatatatatatatggccaaatttggcagccatttttatttggcaaattgtctattcacatagattaacttatataccttattaaaatccctccttaattctttatacatttttaaaattttatctaattgttcctttttctcatttttattttcctaagttaatcaagtagctaattaactttttctctcttttgttaaaatgaacttctgtttcatg

SEQ ID NO: 3978 - DNA, 365 bp, Homo sapiens
  AC007966.3_70889
  Located on chromosome 2
  Distance between a terminus base of telomere on chromosomal short arm and 5'-terminus of this base sequence : 184999286
  Distance between 3'-terminus of neighbour sequence of sequence listing upward to telomere on chrosomal short arm and 5'-terminus of this base sequence : 36694
gctgtcataaactatttgaggtccctcatgcagcagagggtgcaagagaaaggagagccagcagaagtaaatgaagaaaacagaattcatttaactggaagaaaaaaaacttttgctcaaaaaaagacaaggtcctaggagagaaaaaacaacaaacaacaacaaaaacatgaaggccttttaaatacaaacacacacaggcatacatacaaacacacacacacacacacacacacacacatcttggatgttagcttttaattaagctgacttttaaccattgatctcctttaacaaaaaatcttttaaaatttcattaccatatttaagctaggaaaaattgctgctacttcagaagtgtcaag

SEQ ID NO: 3979 - DNA, 215 bp, Homo sapiens
  AC008174.2_101885
  Located on chromosome 2
  Distance between a terminus base of telomere on chromosomal short arm and 5'-terminus of this base sequence : 185071852
  Distance between 3'-terminus of neighbour sequence of sequence listing upward to telomere on chrosomal short arm and 5'-terminus of this base sequence : 72201
gtaatattaacattgccacttcagctttactttgattactgttagcacggcatattattttcttgtgttttacttttaagaccaaatttgggtctttatttttctgtgtgtgtgtgtgtgtgtgtgtgtgtgtgtgtgtgtggttactactcatatagatgggctttggtttcatatcaaatctgacaaccgcctgtaattgaggtgtttgtagc

SEQ ID NO: 3980 - DNA, 324 bp, Homo sapiens
  AC008174.2_36504
  Located on chromosome 2
  Distance between a terminus base of telomere on chromosomal short arm and 5'-terminus of this base sequence : 185137269
  Distance between 3'-terminus of neighbour sequence of sequence listing upward to telomere on chrosomal short arm and 5'-terminus of this base sequence : 65202
gagctcaggagttcaaagttacagtgagctatgattttgccactgcactttagcctaggtaacagagcgaaactctgagacagagagagagagagagagagagagaagacgaaagaaagagaaagaaaagagagagaaagaaaaaagagtaaatgagaaagagagagaagagagagaaacaaaaggaagaaggaaagaaaaaaagaaaaggaagggaagaaggggagggagagaggggtgaagaaagggaaggagcaagggagacagaaagggaaaaaacacattcaaaatagttaaaaaaaatctgtgaagtttaacttgctc

SEQ ID NO: 3981 - DNA, 379 bp, Homo sapiens
  chr2.fa.O7frz.194382166
  Located on chromosome 2
  Distance between a terminus base of telomere on chromosomal short arm and 5'-terminus of this base sequence : 185211371
  Distance between 3'-terminus of neighbour sequence of sequence listing upward to telomere on chrosomal short arm and 5'-terminus of this base sequence : 73778
ctggttatgagtaacagaaatcacattttatttggcaccgaaagataatggtagaattttaaaatatattgactttcatttacccacttaagagaatctttcccttaggattttgtaatctacccaacgtcagcacaaactatatatactatatatatatatatatatatagagagagagagagagagagagagagaatattttatatattcatcattcactatgtctgagttttaacaaagaaaattatttcctacaaaactaatttggtcccaatcatttaaaaaattactttaaataattcaatgatcactgcagttattgatgtctctacaaccaccattggctgaaacctgtacttcctcaggttcagtacata

SEQ ID NO: 3982 - DNA, 356 bp, Homo sapiens
  chr2.fa.O7frz.194503592
  Located on chromosome 2
  Distance between a terminus base of telomere on chromosomal short arm and 5'-terminus of this base sequence : 185263919
  Distance between 3'-terminus of neighbour sequence of sequence listing upward to telomere on chrosomal short arm and 5'-terminus of this base sequence : 52169
ttactcaagatgtttcttaggactgtcaggttttacatggtgttataaagatgaagttacacacttcactattaaaaaattcctgttcaaaagaaaacaaaataataaagtacagaaatcaaactaactcttccacaagactaataagtacctgtaactgtgaaaacagagagagggagggagggagagagagagagagagagagagagagaaagagagaaacagagagaaacagagacagttacagaaatgatcaaagaattatagatacagtgaaaacatagtaaagatgcaacaactaccaaatatagtcatgtagtctaacaaagttcttcttgttaatcattgtagcaagg

SEQ ID NO: 3983 - DNA, 451 bp, Homo sapiens
  M2_185268627
  Located on chromosome 2
  Distance between a terminus base of telomere on chromosomal short arm and 5'-terminus of this base sequence : 185268481
  Distance between 3'-terminus of neighbour sequence of sequence listing upward to telomere on chrosomal short arm and 5'-terminus of this base sequence : 4206
agctttgaatcaccaggactattttgttgtaccattagtcacccctatttatgttagctccaggcagtggtatgctggtaaatgcttcataataagccctctgaaatagtgtgtgtgtatgtgtgtgtgtgtgtgtgtgtgtgtgtatatatatatatatatatatatatacatctatatatacatatacatatatacatacttatatatatacacatatgtgtgtatatatatctgatatataatctctctgaaatagtgtatatactttattatatatacacatatgtgtgtgtatatatatctgatatatagatatcagagtttataaaaattttactaataagaaagagatgcaatacacaatttaaaaataattataaaaacacaatactttttaagttccacatacttaattgattttcatagaatgcttttgtcaattattgcc

SEQ ID NO: 3984 - DNA, 460 bp, Homo sapiens
  AC068824.2_26591
  Located on chromosome 2
  Distance between a terminus base of telomere on chromosomal short arm and 5'-terminus of this base sequence : 185492948
  Distance between 3'-terminus of neighbour sequence of sequence listing upward to telomere on chrosomal short arm and 5'-terminus of this base sequence : 224016
gtcaggactatttgatagagcaccttttgagaaaatataacaaagatgtctttttttatactttattatatactctttttttagtaagttccaaattataatactcataaagttaagagttttaaacaacgtgggaagactatagaaggagacatttgcagttaaaactggcattttgatactcttctaatttttgcaaagttgttatagctggggccaatctaactgcaggcattaatgacacaaaaatgaaactggaaatgtgataaacttcaaacttctttagtttcttcttcacttttactcttcctccattgtgtgtgtgtgtgtgtgtgtgtgtgtgtgtgtgtgtgtgtacatatgagtttagaatatatgtgtatatatatgaatttataaaaccatatgtaaaatttaaaaagctttaaagagaatatatcttgccaatagtatacatcaa

SEQ ID NO: 3985 - DNA, 305 bp, Homo sapiens
  AC017071.6_132542
  Located on chromosome 2
  Distance between a terminus base of telomere on chromosomal short arm and 5'-terminus of this base sequence : 185721087
  Distance between 3'-terminus of neighbour sequence of sequence listing upward to telomere on chrosomal short arm and 5'-terminus of this base sequence : 227679
agtgcaatttaatccattagtaaccttgctcccaagttatactctatattggaacaatcaagagctcaggtgtaattacaatcacatcgggctccaaatcccagcccagtttaatgaataagaccactaccacaaccaccacgaccacacacacacacacacacacacacacacacaccctcctcgccatttgggactggtattcactcagtgatttctgcagcccgagaagaaaaaaaatactgctccttcatttctgggaggccttacattattgttatttctcactgttacgtttctgctac

SEQ ID NO: 3986 - DNA, 426 bp, Homo sapiens
  AC018867.2_148707
  Located on chromosome 2
  Distance between a terminus base of telomere on chromosomal short arm and 5'-terminus of this base sequence : 185915720
  Distance between 3'-terminus of neighbour sequence of sequence listing upward to telomere on chrosomal short arm and 5'-terminus of this base sequence : 194328
tttctaccttcattaaagctgtagtcttaaaaagaaagagaatacatttttctttataacgcacttatatagtgcttagtgcatggtaattgttatatagatattagtaataataataataataatgtttcctattttacttgccggttcagcctctctgcttatttctcttaaactcatgcctgggttggaccctggtttttgccccttggcactttcttgtatcccccaaattccatgtttttcagacagctggccaattttcgtcgttctgtctctctgtgttctctctccctgtcaaacacacacacacacacacacacacacacacacacacacacacacacctgccttcaggatcagagctcaggttcagtgcctcagatttaaatagatacttctcaacatttaaattggtgagttcac

SEQ ID NO: 3987 - DNA, 326 bp, Homo sapiens
  AC017026.5_11120
  Located on chromosome 2
  Distance between a terminus base of telomere on chromosomal short arm and 5'-terminus of this base sequence : 185915788
  Distance between 3'-terminus of neighbour sequence of sequence listing upward to telomere on chrosomal short arm and 5'-terminus of this base sequence : -358
atagtgcttagtgcatggtaattgttatatagatattagtaataataataataataatgtttcctattttacttgccggttcagcctctctgcttatttctcttaaactcatgcctgggttggaccctggtttttgccccttggcactttcttgtatcccccaaattccatgtttttcagacagctggccaattttcgtcgttctgtctctctgtgttctctctccctgtcaaacacacacacacacacacacacacacacacacacacacacacacacctgccttcaggatcagagctcaggttcagtgcctcagatttaaatag

SEQ ID NO: 3988 - DNA, 386 bp, Homo sapiens
  AC018867.2_156371
  Located on chromosome 2
  Distance between a terminus base of telomere on chromosomal short arm and 5'-terminus of this base sequence : 185923374
  Distance between 3'-terminus of neighbour sequence of sequence listing upward to telomere on chrosomal short arm and 5'-terminus of this base sequence : 7260
cactagcttcctactgatcaaaatctaggctgggggtagtggctcacgcctgtaatcccaccactttgggaggctgaggtgggagactactcgagcccaggatttcaagaccagtctgggcaacatggatctcatctctacaaaactttaaaaaaattaaccaggcttggtggcacatacctgtggtcccagctactccagaggctgaggtgggaggaatgcttgagccaggaggtcgaagctgcagtgagctgtatttgtaccactgcactccagcctgggcaacagagtgagaccctgtctcaaaaaataaaaataaataaataaataaataaataaataaataaataataaaataaaacctgaactaatgaattccataggaa

SEQ ID NO: 3989 - DNA, 397 bp, Homo sapiens
  AC017101.8_55453
  Located on chromosome 2
  Distance between a terminus base of telomere on chromosomal short arm and 5'-terminus of this base sequence : 186053136
  Distance between 3'-terminus of neighbour sequence of sequence listing upward to telomere on chrosomal short arm and 5'-terminus of this base sequence : 129376
gtaaaggagtagacttctaggcagggaaaatcacatatttaaaggtctaggggcaactcaaatctagttcaaaggaatagaagaaactcccgtgtgtgtgtgtgtgtgtgtgtgtgtgtgtgtgtgtgtatgcaggaaaatttttaaaatgaacctgaacctaggtagtcaggggacatattgcaaacggctttgtaaatcatgttaggaattttggatttgtgctaagagtaatgaggaggtaccagtaggttttaagtggggaagaattatatgtgtatagtattgtgctttgctttctgatggctcttggggcatttttctaaaaatgatgaatttctaaccttaacgattacattgtgtttagcataaactttatcatggactatgtacctga

SEQ ID NO: 3990 - DNA, 454 bp, Homo sapiens
  AC017026.6_146393
  Located on chromosome 2
  Distance between a terminus base of telomere on chromosomal short arm and 5'-terminus of this base sequence : 186056238
  Distance between 3'-terminus of neighbour sequence of sequence listing upward to telomere on chrosomal short arm and 5'-terminus of this base sequence : 2705
aatgtgaagtacttgagcacacagtaagtactatagaaatgcttgttattattatttttttaatgacctggtctccactctccttttcaatctaaaacactgtcattcctccattagaataattgctcacacttttgcaagcccactgtgcttacacacatctgggcttcacacacacacacacacacacacacacacacacacacacactcttccacgttcctgatttctcctgtgtggaagtcttactcttttttatattctacctctcctggtgtttcatagcccctacatacacaagatattttcttccaattctgagacctctggacttgtattgcttttctgtttgtagccaccacattgggttctaatttgttcctgtgttcctctcccctaatagatgttgagctcctggaatgcagggattgtattttacttattccaagcacct

SEQ ID NO: 3991 - DNA, 454 bp, Homo sapiens; identical to SEQ ID NO: 3990
  AC017101.8_484
  Located on chromosome 2
  Distance between a terminus base of telomere on chromosomal short arm and 5'-terminus of this base sequence : 186056238
  Distance between 3'-terminus of neighbour sequence of sequence listing upward to telomere on chrosomal short arm and 5'-terminus of this base sequence : -454

SEQ ID NO: 3992 - DNA, 392 bp, Homo sapiens
  chr2.fa.O7frz.195254170
  Located on chromosome 2
  Distance between a terminus base of telomere on chromosomal short arm and 5'-terminus of this base sequence : 186175860
  Distance between 3'-terminus of neighbour sequence of sequence listing upward to telomere on chrosomal short arm and 5'-terminus of this base sequence : 119168
ctggttaatcaggtactgtcagttttatattatcctttaaaatgatgaagatatttggatagctagagaataaatgtagatatgatgaatttcagattttatatatacatatacacacatatatacacacatattcatatatacacctatgtagaaatacacacatatatacacatacacacacacacacacacacacacacacacacacacacacacattttaatttgtagagatgtgatcttgctgtgtttcctaggatggtctcaaactcctggcttcaaaggacctacctgcttcagattcccaaagtgttgggattagaggcgtaagttaccatacccggccaagatttaattttaaaacatgttaaacatcagataaaagaccact

SEQ ID NO: 3993 - DNA, 377 bp, Homo sapiens
  HUMUT866
  Located on chromosome 2
  Distance between a terminus base of telomere on chromosomal short arm and 5'-terminus of this base sequence : 186245050
  Distance between 3'-terminus of neighbour sequence of sequence listing upward to telomere on chrosomal short arm and 5'-terminus of this base sequence : 68798
gctgttgggtggaatatgtgtatatatatatatatgtgtgtgtgtgtgtgtgtgtgtgtgtgtatgtatatatatgtgtgtgtacatatataaatttagtgtattcgcttgaggatttttacatctatgtcgaaagtagtatattgaagtctgctattattattttgttgcctattttgcccttcaattctgtcaatgattgcttcacatatttaagtgctgtgatgttgagtgcagatagatgatagatagatagatagatagatagatagatagatagatagatagatagatagttatatcttcctgttacaatagtaacaagttgaacctgttcttaacttgttattattatatccttctttgtctctttgtga

SEQ ID NO: 3994 - DNA, 343 bp, Homo sapiens
  chr5.fa.O7frz.117490810
  Located on chromosome 2
  Distance between a terminus base of telomere on chromosomal short arm and 5'-terminus of this base sequence : 186437035
  Distance between 3'-terminus of neighbour sequence of sequence listing upward to telomere on chrosomal short arm and 5'-terminus of this base sequence : 191608
gctttgttactcctgtatcactagaacattttcatgtaaattatatttaaacttcctgtgaagacaatgaatgtttatggaaggcaagtagttcatttactgtttgtcttatcattgttattcaactatgaatattgtgcaataaaaatatttaccagttgtatttaaatgacaaaaagatatgattattttaccactgataatggggactgattacattaaggaagccaagtgtgtgtgtgtgtgtgtgtgtgtgtgtgtgtgtgtgcatctcaagatatgccttatatacaaataaaacagataatcacaataatatttgtcatttggtacttcagacttg

SEQ ID NO: 3995 - DNA, 339 bp, Homo sapiens
  AC046198.3_158342
  Located on chromosome 2
  Distance between a terminus base of telomere on chromosomal short arm and 5'-terminus of this base sequence : 186640224
  Distance between 3'-terminus of neighbour sequence of sequence listing upward to telomere on chrosomal short arm and 5'-terminus of this base sequence : 202846
aagaatgtccttggtattttgataaggattatactgaaactgtagattactttgggtagtatggacattttgatgatattgaatcttccaatccatgaacatggaatatcttttaccttttggtgtccacttcagtttctttcatcagtattttatagtttttatcatagagatctttcacttctttgattaggttaatccttaggttttttattttatttgtggctactgtaaatgggattcctcttatttatttatttatttattttttaccattagtatatagaaatgctatgatttttatatgttgattttgtgtcctgcaactttactgaactg

SEQ ID NO: 3996 - DNA, 275 bp, Homo sapiens
  D2S152
  Located on chromosome 2
  Distance between a terminus base of telomere on chromosomal short arm and 5'-terminus of this base sequence : 186724782
  Distance between 3'-terminus of neighbour sequence of sequence listing upward to telomere on chrosomal short arm and 5'-terminus of this base sequence : 84219
agctgctggtatatattatcttccaaaaatgtcattattgtgagtataaccccacacacacacacacacacacacacacacacacacacacacacgacatcttattctcttattatgggataaaaggatataccatatttctctttttaagacccaaacaatatcattatgggcaaagttttgaaataatagaatgaaattcccttgaaatttactgaatgtttaataccaagacaaaacaagttcttaagaagatgcattaaataatttcatta

SEQ ID NO: 3997 - DNA, 327 bp, Homo sapiens
  AC046198.3_88058
  Located on chromosome 2
  Distance between a terminus base of telomere on chromosomal short arm and 5'-terminus of this base sequence : 186806410
  Distance between 3'-terminus of neighbour sequence of sequence listing upward to telomere on chrosomal short arm and 5'-terminus of this base sequence : 81353
caccttgactgagttctgttagaacttgccaaacaagctacttgtgatttgaaggaaatctgaatatagtattctgctcaaagaatcaaaggagttaggcgtgtgtgtgtgtgtgtgtgtgtgtgtgtgtgtgtgtgtgttgaattatagcttacaaagtatccaggaaaaaaaatctaacaaatctgtgttcatagcacaacacagaaaaaaaaattaactgtattcatcataactggttttgtgatttggctcttcttaatttggagctctgctaattgggtgctgttcctccatcagttcctaagtgcagttcctaatcagtta

SEQ ID NO: 3998 - DNA, 450 bp, Homo sapiens
  chr2.fa.O7frz.195973929
  Located on chromosome 2
  Distance between a terminus base of telomere on chromosomal short arm and 5'-terminus of this base sequence : 186816863
  Distance between 3'-terminus of neighbour sequence of sequence listing upward to telomere on chrosomal short arm and 5'-terminus of this base sequence : 10126
ggcctattgaattcaaatctaagttgatttgaatccaaaccctgtattctttatcatcatatttgatttggtatttgatttttctcccattatagtcataaaatagtcttcatgtgcatctgccagtttattaacaaccagtggagatgagagaaactgtggaatgcagtggttttaaatattttctccctaattaaatgactctgtatgtgtgtgtgtgtgtgtgtgtgtgtgtgtgtgtgtgtgtagcttgtgaagaaagaaaatagttaataaagaatatgtaaagagataaataaagtttcctaacatatacagtcattagctttagaattttaaatactttctcattgaacagtggcagaaactttcaataaaaaatggtaattgtttatttcgtcgtctctggagtaacaatttcttggcaagatggatcatttaggtagctca

SEQ ID NO: 3999 - DNA, 432 bp, Homo sapiens
  chr2.fa.O7frz.196172996
  Located on chromosome 2
  Distance between a terminus base of telomere on chromosomal short arm and 5'-terminus of this base sequence : 187130976
  Distance between 3'-terminus of neighbour sequence of sequence listing upward to telomere on chrosomal short arm and 5'-terminus of this base sequence : 313663
atcctgaggatctaatgaacagcatgggtggtgatagatgtgttaattaatttgattgtggtaatcattacacaatgtgtgtgtgtgtgtgtgtgtgtgtatatatatatatatatatatatatatatcttcacatgatatccttgaatatattgtctttataggtcaccaaaatattgtaaaattaaaaatacaagaaaaataaaaatgtaaaagactaatttattcaggttaacataatgccagaagtaatgttaacatatcatacaaaatgcatataataagtgtctatacatttatgaaaggggaagatggtaaaaaaatgatttgaatatttttagcaatcagaattaaaaatgcagcatggcccaaataccagatttacggtgttcatgagttgtagacaaactgtggctcaaagtatttcaaata

SEQ ID NO: 4000 - DNA, 242 bp, Homo sapiens
  Z67685
  Located on chromosome 2
  Distance between a terminus base of telomere on chromosomal short arm and 5'-terminus of this base sequence : 187238302
  Distance between 3'-terminus of neighbour sequence of sequence listing upward to telomere on chrosomal short arm and 5'-terminus of this base sequence : 106894
gggtcaaacttggaaatctgttcttttttctcatgtgaataaatctagtttaaatgtgtgtgtgtgtgtgtgtgtgtgtctttattcactttttacattcatattaatttcaatttattgaaataaagatattagcaggatatttgtattatcttttcatactacagtttttctgcttaacacaccaataaaatagatgttgctcactgacagtgtaccatagccacttagagtgtgcaaaa

SEQ ID NO: 4001 - DNA, 430 bp, Homo sapiens
  chr2.fa.O7frz.196464091
  Located on chromosome 2
  Distance between a terminus base of telomere on chromosomal short arm and 5'-terminus of this base sequence : 187351690
  Distance between 3'-terminus of neighbour sequence of sequence listing upward to telomere on chrosomal short arm and 5'-terminus of this base sequence : 113146
cactttagaattctgcctgagaagctttaaaagaaagaacagagatgggaggcatagagggagggagggagggaggaagaagagagggagggagagagggagggagggagggagggagggagagagggagagagggagggagggaggcaggaagggaggaagggaggaaggaaggagagaaggaaggagggaaggcgggaaggcaggcaggcaggcaggcaggcaggcaggcatagggcctatcattttctaagattatgctttagatggtttggaaaatgtccaggctttggtgttaattttagagagatatttagggcattctaatatacagccagtgatgagaaccactgtcctaaatcaataattctcaagcttaatgtgcatatgaatcccaggggaaagttattaagatgcaggttctaagtca

SEQ ID NO: 4002 - DNA, 295 bp, Homo sapiens
  AC064864.2_35614
  Located on chromosome 2
  Distance between a terminus base of telomere on chromosomal short arm and 5'-terminus of this base sequence : 187361481
  Distance between 3'-terminus of neighbour sequence of sequence listing upward to telomere on chrosomal short arm and 5'-terminus of this base sequence : 9361
atgcatacgtttattgcagtagaattcaaaactctaaagataacaatctaagtgcccctcaagcaatgagtggataaagaagatgtgatatatacatacatacatacatacatacatatatatatatatatatatacacacacaccatggagtactgtgcagccataagaaaagaataaaataatttctttagctataaattgtgatggaactggaggccatgattttaagtgaagtaactcgggaatagaaaaccaaataccaaatgttctaacttataagcaggagttaagct

SEQ ID NO: 4003 - DNA, 204 bp, Homo sapiens
  chr2.fa.O7frz.196657650
  Located on chromosome 2
  Distance between a terminus base of telomere on chromosomal short arm and 5'-terminus of this base sequence : 187511518
  Distance between 3'-terminus of neighbour sequence of sequence listing upward to telomere on chrosomal short arm and 5'-terminus of this base sequence : 149742
tctactccttctagtccaggatcagtatttttaccatgacattcttgtatccacctcccaggtatttttgaaaatgtaatacaatattttagtgacttctgactttagtaataatgatgatgatgatgatgatgatgatgatgataataacataatgtctccaaagcagacatccaagaaagctcatgttggtatgactgaaac

SEQ ID NO: 4004 - DNA, 200 bp, Homo sapiens
  DISD22_0002049
  Located on chromosome 2
  Distance between a terminus base of telomere on chromosomal short arm and 5'-terminus of this base sequence : 187659473
  Distance between 3'-terminus of neighbour sequence of sequence listing upward to telomere on chrosomal short arm and 5'-terminus of this base sequence : 147751
ggattcataagtgaccacagctataatagttctaaatgactacatttaatgagcacatacaaaactgaaaaaaaaaataggaaaacagtgatagtaaaagcaaacttccctttccctaactttgtacacacatacacacacacacacacacacacacacacacacacacacatatcttcagatatctccttaatggcaca

SEQ ID NO: 4005 - DNA, 278 bp, Homo sapiens
  AC027781.2_28577
  Located on chromosome 2
  Distance between a terminus base of telomere on chromosomal short arm and 5'-terminus of this base sequence : 187835720
  Distance between 3'-terminus of neighbour sequence of sequence listing upward to telomere on chrosomal short arm and 5'-terminus of this base sequence : 176047
ggtctagctaatgatttgctgatttaaaaaaatctttttagtgaattaatttttcattttgttgatcctgtgtgtgtatgtgtgtgtgtgtgtgtgtgtgtgtgtgtgttttaagtcactattttgtttatttctgttttgatcttttattattattattatttctactactttgaggtttggtttgctcttgcttttctggttccttgaggtataacattaggttgtttatttgaaatctttttacttttttgatgtaggcattgtctgctttaaac

SEQ ID NO: 4006 - DNA, 296 bp, Homo sapiens
  chr2.fa.O7frz.196970788
  Located on chromosome 2
  Distance between a terminus base of telomere on chromosomal short arm and 5'-terminus of this base sequence : 187948364
  Distance between 3'-terminus of neighbour sequence of sequence listing upward to telomere on chrosomal short arm and 5'-terminus of this base sequence : 112366
aggactgttctagaagacgaaggtatgaattaccgttctttctgcttacacacacacacaaacatatatgtgtgtgtaaatatacatggagaaacacatcccaaaaggttgagtctccataaatttgtatttatgtgtgtgtgtataaatattcatgcatatatccatatattatattctacatgtctatattatacatatgatatatatacaatgtatataacccatgtttaaaaaatttacacacacacacacacacacacactcctctagagactcaaactttctggttcatt

SEQ ID NO: 4007 - DNA, 467 bp, Homo sapiens
  chr2.fa.O7frz.197047797
  Located on chromosome 2
  Distance between a terminus base of telomere on chromosomal short arm and 5'-terminus of this base sequence : 188025487
  Distance between 3'-terminus of neighbour sequence of sequence listing upward to telomere on chrosomal short arm and 5'-terminus of this base sequence : 76827
agtacagctaactgcttgagttcagccttgtgataccctgagaaaaagactgagataagtcatgcctaaatttctgacccacagaaattatggacgtgtgtgtgtgtgtgtgtgtgtgtgtgttttaagagactactttgtggaaatttgtcacacaaaaataggaaactattatagactcgaaatactttttatcactaagaggaaccaagaacccttgaataattgactggtttcagatctgcctatagaaatatactagaaatatactagataatgctaaacatgttttcataccagaaagcaaataatcttaaaaactatggtggttttgttaaaacagcacataggaatcaacttgaagaccgtctataggttagatatgagaaaatttgatatcaagaaaaatagtgaacagcaaaacactgaaatgtattagataggttacattctaggtattccagtga

SEQ ID NO: 4008 - DNA, 250 bp, Homo sapiens
  chr2.fa.O7frz.197184084
  Located on chromosome 2
  Distance between a terminus base of telomere on chromosomal short arm and 5'-terminus of this base sequence : 188119334
  Distance between 3'-terminus of neighbour sequence of sequence listing upward to telomere on chrosomal short arm and 5'-terminus of this base sequence : 93380
aactttatgtcaggacctgttcatatatatatatatatattatatatatgaaaatatatatatatacacacaaacacatatatatacatatatatacatatatacatgtatatatatatacatgtatatatgtatatatatgtgtgtatatatatatgaacttagttttcacaataatcttttgatatagatgttattgctattctccattttacaaatgaggaatttgaggcaaagtgattaaatgact

SEQ ID NO: 4009 - DNA, 465 bp, Homo sapiens
  AC066694.2_218537
  Located on chromosome 2
  Distance between a terminus base of telomere on chromosomal short arm and 5'-terminus of this base sequence : 188154449
  Distance between 3'-terminus of neighbour sequence of sequence listing upward to telomere on chrosomal short arm and 5'-terminus of this base sequence : 34865
gagctcaggagttggagaccagcctgggcaacatggcaaaaccctatttctaccaaaaatacaaaaaatagccaggcattgtgatgggcacttgcagtcccagctgctcaggaggctgaagtgggaggattgctggagcccaggaggtggaggttgcagggagctgagattgcaccactccactccacccttggcaacagagtgagactctgtcaaaagagagagagagagaaagagagaaagagggagagagagagagagagagaaagaaagaaagaaagaaaagaaagaaagaaagaaagaaaaagaggaaagaaagaaaaaagaaagaaaggaagaaagagaaggaaagagaaaagaaagaaaagaagtggtgagagtatctttgtcttctgatcttagagaaaaagctttcagcttttcaccattgagaatgatgttagctacagatttgtcatgtatggc

SEQ ID NO: 4010 - DNA, 331 bp, Homo sapiens
  AC066694.2_210890
  Located on chromosome 2
  Distance between a terminus base of telomere on chromosomal short arm and 5'-terminus of this base sequence : 188172328
  Distance between 3'-terminus of neighbour sequence of sequence listing upward to telomere on chrosomal short arm and 5'-terminus of this base sequence : 17414
  misc_feature (1)...(331): n = A,T,G or C
catatcattgtcattaaaggaaagtttatatttgttctatctatctatctatctatctatctatctatctatctatctatctatcatctatctatagatagaacaaatatatatatatatatatatatatatatatatatatatatatatttataatttttttctatatatttttgaaaataaaatattttctacactgtagaatgngttnnananagtgtattacatatatatatatatatnanananatatnananatatntnantnanacanatnaaacgggagcaccagcagggccagcagggctaagatgaaaacattcaattgag

SEQ ID NO: 4011 - DNA, 205 bp, Homo sapiens
  chr2.fa.O7frz.197491526
  Located on chromosome 2
  Distance between a terminus base of telomere on chromosomal short arm and 5'-terminus of this base sequence : 188455484
  Distance between 3'-terminus of neighbour sequence of sequence listing upward to telomere on chrosomal short arm and 5'-terminus of this base sequence : 282825
gtttacctgatggaggatttactgaagggagaagtaagatagaaatattggaggatttttgttaatacacacacacacacacacacacacacacacacacacacacacacacattattatatacagggaaaggaaacctcaaatacattttagaaggaggtatgttagacataacaaatatgtgaatggtacaatatctcaagac

SEQ ID NO: 4012 - DNA, 155 bp, Homo sapiens
  D2S426
  Located on chromosome 2
  Distance between a terminus base of telomere on chromosomal short arm and 5'-terminus of this base sequence : 188594320
  Distance between 3'-terminus of neighbour sequence of sequence listing upward to telomere on chrosomal short arm and 5'-terminus of this base sequence : 138631
caccactcactcactgatgcacccagaacacctccaatgggtaagctccactcatggtaagtgccccatccacaggtgtagtattttttatctatctatctatctatctatctatctatctatctatcatttatttattttgaggcagggtctca

SEQ ID NO: 4013 - DNA, 404 bp, Homo sapiens
  AC013439.10_123350
  Located on chromosome 2
  Distance between a terminus base of telomere on chromosomal short arm and 5'-terminus of this base sequence : 188641243
  Distance between 3'-terminus of neighbour sequence of sequence listing upward to telomere on chrosomal short arm and 5'-terminus of this base sequence : 46768
cgtaaggctgtgacttcagctcccaccccatctccaactcctccaacccttctgctgtaccctggagagtgctcagtgcatcatcactacccaacatcctcaaaatgtccatgaatgttcctgtctcttagggctccaactaaaagccgcctcttccctgagttccctgcttcctctccagccctctcaggttgtgactgttacaggtctctaggcctggaggtgggaaatgtgtcctccttgctcctcctctaaatcgttttccatctctcctcctaacccctaaacacacacacacacacacacacacacacacacacacacacacacacacagcttcgaatctcacgtcatcagacaacactatccattatcttccctataggagtcatttactcatctgc

SEQ ID NO: 4014 - DNA, 428 bp, Homo sapiens
  AC012488.6_3836
  Located on chromosome 2
  Distance between a terminus base of telomere on chromosomal short arm and 5'-terminus of this base sequence : 188688929
  Distance between 3'-terminus of neighbour sequence of sequence listing upward to telomere on chrosomal short arm and 5'-terminus of this base sequence : 47282
aatggctcttgagaagtttaagttcaacatctactttaaattacagacatcctattgaaagataaatatcctcccaggtcttcattttgtttgaacatttcaaatagatttgaccttgcgaagtttcttatgaatgctggctctcattgggggtgctctcttgcttcctctctctcatacacacacacacacacacacacacacacacacacatatacacagtagtctacagtttctagttggaaaaattaaatacagaattcagaagattccaaaagaaatatactcctaaggcaaatccatagagacagagagcatattggttgttttcagagcctgggaggagggaagaataggtagtgactgctttatgggtgtgtagtttccctttggggtgatgaaaatggtctgaatctagatagtggcaa

SEQ ID NO: 4015 - DNA, 428 bp, Homo sapiens; identical to SEQ ID NO: 4014
  AC013439.10_10852
  Located on chromosome 2
  Distance between a terminus base of telomere on chromosomal short arm and 5'-terminus of this base sequence : 188688929
  Distance between 3'-terminus of neighbour sequence of sequence listing upward to telomere on chrosomal short arm and 5'-terminus of this base sequence : -428

SEQ ID NO: 4016 - DNA, 243 bp, Homo sapiens
  AC012488.6_102140
  Located on chromosome 2
  Distance between a terminus base of telomere on chromosomal short arm and 5'-terminus of this base sequence : 188770802
  Distance between 3'-terminus of neighbour sequence of sequence listing upward to telomere on chrosomal short arm and 5'-terminus of this base sequence : 81445
gtgcctaaattatactcatctgagtgttaaaatatatatctaaagattaatgcagcagtttgattttcttcaaattaggcttccgaagatgagtcaacagttatatatatatgtgtatatatatatatatatatatatatatatatatatatatatatatatattataaatgttttagaaagcaatagttattaacatgtgctttagaattttaaacaggtctaagtatgacaaaccattacc

SEQ ID NO: 4017 - DNA, 313 bp, Homo sapiens
  chr2.fa.O7frz.197928313
  Located on chromosome 2
  Distance between a terminus base of telomere on chromosomal short arm and 5'-terminus of this base sequence : 188830348
  Distance between 3'-terminus of neighbour sequence of sequence listing upward to telomere on chrosomal short arm and 5'-terminus of this base sequence : 59303
gtgagcttgtatgtcataatgatatgggtagaacaattctgaacccatatgataagtaccataggactaaagaaatgaataaatgtgttgatattattgggttcttactgtgcaaagaaatgtgcagaatgtaggaaaacaataaaccctgtggggttggattggaactggaaatgtatgtgtgtatgtatgagtgtgtgtgtatacacatacatatatatgtatacatattttatatatatggatttatacacacacacacacacacacacacacacacacacacatatatatgatccagaagcaatgatat

SEQ ID NO: 4018 - DNA, 310 bp, Homo sapiens
  chr2.fa.O7frz.198231671
  Located on chromosome 2
  Distance between a terminus base of telomere on chromosomal short arm and 5'-terminus of this base sequence : 189274976
  Distance between 3'-terminus of neighbour sequence of sequence listing upward to telomere on chrosomal short arm and 5'-terminus of this base sequence : 444315
gagctttatgatcatgagttaaagatgaaaataaaaagtttaaaatcccagcttatgcacagttttttattgtaagctcattctacatgtattcactgagcacctcctttgtgctagatactttatgagtttcttggctatgtcagtgaataaaagatgtgcacgtgcacacacacacacacacacacacacacacacacacacacacccacctggtctcctgaaatttacattatggggtgtaagtaagcaaagtgtgatatgtgctttggaaaaatgagtaagtaaagcagagttagaggttaggaag

SEQ ID NO: 4019 - DNA, 360 bp, Homo sapiens
  AC073120.2_133939
  Located on chromosome 2
  Distance between a terminus base of telomere on chromosomal short arm and 5'-terminus of this base sequence : 189357727
  Distance between 3'-terminus of neighbour sequence of sequence listing upward to telomere on chrosomal short arm and 5'-terminus of this base sequence : 82441
tattacagaaagttccagtttgacacatatgaatttatttcagaaagtctgctatctcacaggaattctaacactaggatactttgataataactgaaaggaatttattcaaactgtactaaaatatgctacaagagtgacctacttttgaaagtaaagaactgtttcctatgtttcttaaagtagaagagaacttatttgtatcaaattagtagtttatcctcttttgttaaacacacacacacacaagtagcccaaatagaaccattttaagaactgaagaggccatgtaatctactttattgattacaaagcctaattgattgtgtaaattatgtcttaaatttctagaggccaaac

SEQ ID NO: 4020 - DNA, 330 bp, Homo sapiens
  chr2.fa.O7frz.198417182
  Located on chromosome 2
  Distance between a terminus base of telomere on chromosomal short arm and 5'-terminus of this base sequence : 189458650
  Distance between 3'-terminus of neighbour sequence of sequence listing upward to telomere on chrosomal short arm and 5'-terminus of this base sequence : 100563
catgtcaagtatcagtttaccatatttttatgggtgtatctctggacttgtttctgtttcataggtttgtggctagccttttgtcaatatagcactaattactgtagctttatagtcattcttaacattagataataggagtactccaaattattgttctttctcaaaattgttttggccattctagtttgtgtttccatgtataattcagaatctgtgtgtgtgtgtgtgtgtgtgtgtgtgtgtgtgtgtgtatctatatatctatatatataaaacaaatcctgctgggattttgactggacttttagaatccatttgtcaatgtct

SEQ ID NO: 4021 - DNA, 431 bp, Homo sapiens
  AC037444.2_30539
  Located on chromosome 2
  Distance between a terminus base of telomere on chromosomal short arm and 5'-terminus of this base sequence : 189460649
  Distance between 3'-terminus of neighbour sequence of sequence listing upward to telomere on chrosomal short arm and 5'-terminus of this base sequence : 1669
tgaatatcaactcaagttggagcataatgttgttcagaacacgtattttttctttgactattctagtaatgttttaagtctccagctatgcttgtgggtttgtcagttttaagttgtgtatcttttatagatagcatatagtgggtgtattttttaaaaaaataatagactgtttttcagagcagttttaagttaacagaaaaatggagcaggaagtagtgttcccacgtatcctgtgtatacacacacacacacacacacacacacacacacacacacacacgcagcatctcccactagacacatcgcaatcacctgaaatccacgttattttagggttcattcctggtgttgtacaacctatggtttttgacaaatgtatgacagaaatccattattagtatcatatagaatagtttcattgccttaaa

SEQ ID NO: 4022 - DNA, 425 bp, Homo sapiens
  chr2.fa.O7frz.198525313
  Located on chromosome 2
  Distance between a terminus base of telomere on chromosomal short arm and 5'-terminus of this base sequence : 189560063
  Distance between 3'-terminus of neighbour sequence of sequence listing upward to telomere on chrosomal short arm and 5'-terminus of this base sequence : 98983
ttacgtaagtttggtgaacaagcccaaagactgttgtcttaatacaacaaacaaacaaacatataaaattaaaacacaaagaaaaaaaccatccctgaaccctaccaaatccacaagaaacaagatacaaaatgtaaaaagttttcaatatactgtacatataatatggacaattatagtgattataataaatacatgacactgatgctgagaacagacatttcttctcttttgtctttaacatttaaatgtgtatagacagactgacctgaacaattatgaaaaataaagagagtttctctttttatctcagcatgtttaaacacgtaaaatatacttacaatatatattttgtaatatatattttgtgtgtatatatatatatatatatatatatatatatagcaacaggataaatgctataa

SEQ ID NO: 4023 - DNA, 234 bp, Homo sapiens
  D2S2262
  Located on chromosome 2
  Distance between a terminus base of telomere on chromosomal short arm and 5'-terminus of this base sequence : 189684215
  Distance between 3'-terminus of neighbour sequence of sequence listing upward to telomere on chrosomal short arm and 5'-terminus of this base sequence : 123727
aagcccctcgttttcttgacaacccctgtctgaagtatggacaccctacttggaactccagaagcatgcctattgtccctaatatcttttagttaataaattatatagggctatgtggcttttcttccattattattctgacttttcatttaaccctttagtggtgtgtgtgtgtgtgtgtgtgtgtgtgtgtgtgtgtatgtgagagagagagagatgtggtttatcattgct

SEQ ID NO: 4024 - DNA, 168 bp, Homo sapiens
  Z66655
  Located on chromosome 2
  Distance between a terminus base of telomere on chromosomal short arm and 5'-terminus of this base sequence : 189695554
  Distance between 3'-terminus of neighbour sequence of sequence listing upward to telomere on chrosomal short arm and 5'-terminus of this base sequence : 11105
ttgggttacctgatattttcctactgatttttttctattgattttaaagaataaatttttatatatctgtataattcttttgttacgtgtgtgtgtgtgtgtgtgtgtatacatatatcaccaaaatatcttctctcactctttgacttgccatttcaatctttaatg

SEQ ID NO: 4025 - DNA, 179 bp, Homo sapiens
  D2S118
  Located on chromosome 2
  Distance between a terminus base of telomere on chromosomal short arm and 5'-terminus of this base sequence : 190008957
  Distance between 3'-terminus of neighbour sequence of sequence listing upward to telomere on chrosomal short arm and 5'-terminus of this base sequence : 313235
agcttccacccactgcttggttccaaaatcacttctacatttttaggcatttgttatggcagcattccatttcagcacagggtccaatcagagaagaagaaatactacacacacacacacacacacacacacacacacacacacacacacacggggcagggagggtttcgattgtcctt

SEQ ID NO: 4026 - DNA, 193 bp, Homo sapiens
  DISO7_10000471
  Located on chromosome 2
  Distance between a terminus base of telomere on chromosomal short arm and 5'-terminus of this base sequence : 190034674
  Distance between 3'-terminus of neighbour sequence of sequence listing upward to telomere on chrosomal short arm and 5'-terminus of this base sequence : 25538
ctatgtctggaatattcccattctggtttttcaaaggatgattttacacacacacacacacacacacacacacacatatcaggaatatatatgtgtgtgtgtgtgtgtgtgtgtgtgtgtgtgtgtgtggggtttgtgtgtgtgtgtgcatgattttttacctaattatttttctctgggcattctgaatctg

SEQ ID NO: 4027 - DNA, 213 bp, Homo sapiens
  D2S389
  Located on chromosome 2
  Distance between a terminus base of telomere on chromosomal short arm and 5'-terminus of this base sequence : 190047129
  Distance between 3'-terminus of neighbour sequence of sequence listing upward to telomere on chrosomal short arm and 5'-terminus of this base sequence : 12262
gctgagttaacagttatcaacaattataacagatatatatcaatgagggtatcatatatagaagtctctataggtgtgtgtgtgtgtgtgtgtgtgtgtgtgtgtgtgtgtgtgtgtgtctgtgtagcaggtaagatggctgagtgttttgggaatgaattaatccactagagttttccatggtgagaacagatgatcttccactaggcttta

SEQ ID NO: 4028 - DNA, 130 bp, Homo sapiens
  G08182
  Located on chromosome 2
  Distance between a terminus base of telomere on chromosomal short arm and 5'-terminus of this base sequence : 190102308
  Distance between 3'-terminus of neighbour sequence of sequence listing upward to telomere on chrosomal short arm and 5'-terminus of this base sequence : 54966
tgacaccaaatccaacctctggagaaatgtgagtagctgagatgatagatgatagatagatagatagatagatagatagatagatagatagatagatagtgatagaaatttcctgaatccttgggaatgt

SEQ ID NO: 4029 - DNA, 466 bp, Homo sapiens
  AC067945.1_38863
  Located on chromosome 2
  Distance between a terminus base of telomere on chromosomal short arm and 5'-terminus of this base sequence : 190221073
  Distance between 3'-terminus of neighbour sequence of sequence listing upward to telomere on chrosomal short arm and 5'-terminus of this base sequence : 118635
tcagctaatctggctaattagtaccagtggcttactggaattggacagtgccttctcactccctgtctaccctccattcccaatctttgatatgtgtgtgtgtgtgtgtgtgtgtgtgtgtgtgtgtgtgtgtgtgtgaagcagctggggggtttggtgtctggcagatcatcaggattagtaaggccatatactgctgtatacctaaggtcttttgtgtagagttgtaacttattttcttttttttttctcccattaatacctcaaataactgattttcaaagtggaaaaatgtctgtgcttcccccccttgttttgaagtctgacaagtactagtagactgtgaaatgtttaagaatgggagtcttagtaaaacatacaactttactatagggattagtttcttgcccttatgagacataaaccttggtacacagttgtgccataattcttaagttgcgaacaa

SEQ ID NO: 4030 - DNA, 387 bp, Homo sapiens
  chr2.fa.O7frz.198842774
  Located on chromosome 2
  Distance between a terminus base of telomere on chromosomal short arm and 5'-terminus of this base sequence : 190284610
  Distance between 3'-terminus of neighbour sequence of sequence listing upward to telomere on chrosomal short arm and 5'-terminus of this base sequence : 63071
ctatgtgacttgttctggataaaggaatatgaacagttgtgatgtatataccatctgtcctgaaactgcgtgttctttgtaatcaacttgttcttgtgtgctccttccctctgctaggagacagcatgcctcaggttcccacgctaaatcaaaattctaaataatctaaatattctaacggactgctgctggtctgaaaccaactggatactatgtatgtatgtatatatgtatgtatgtatgtattgatgacagagtctcgctctgtcgcccaggctggagtgcattggtgcaatctcggctcactgcaaccaccgcctcctgagttcaagcgattctcattctttagcctcccaagtagctgggattataggcctacatcaccaa

SEQ ID NO: 4031 - DNA, 406 bp, Homo sapiens
  AC019243.2_142191
  Located on chromosome 2
  Distance between a terminus base of telomere on chromosomal short arm and 5'-terminus of this base sequence : 190449019
  Distance between 3'-terminus of neighbour sequence of sequence listing upward to telomere on chrosomal short arm and 5'-terminus of this base sequence : 164022
tagatgagacatatggctcaagaggcagggcagcttgtattgcaacttggtctttctgcaactccctgtcttcctctggaccacatttgaagctggctctggtctacacgtgtgtgtgtgtgtgtgtgtgtgtgtgtgtgtgtgtgtgtgtgtatagagagagagaaagagtgagaatccaacatttagttggctgtctctccaactcactcctagtaatgttataattcattatccatcactacagtctctgtgactcaaagcacgcccctggcaagattgttctgagatgttaccatgatcattggcctggaggcaatgagatgtggtggtaggcagattgtgaagagaacaagtactgtcttatagtacatcgagtgatataactgcatagtctcctactgag

SEQ ID NO: 4032 - DNA, 477 bp, Homo sapiens
  chr2.fa.O7frz.199417732
  Located on chromosome 2
  Distance between a terminus base of telomere on chromosomal short arm and 5'-terminus of this base sequence : 190453249
  Distance between 3'-terminus of neighbour sequence of sequence listing upward to telomere on chrosomal short arm and 5'-terminus of this base sequence : 3824
tttcagatctaccatttaatacctcttttatgatgaagacaaaaatctttttaaaagaaaagaaaacaaaaggtttcttttggcatgccatgaacacacagcctgagagtaaacattccagtagctagaatgggccaggcatggtggctcacgcctgtaatctcagaattttgggatgcccgaggtgggcagatcacttgaggtcaggagtttgagaccagcctggccaatatggtaaaacctcgtttctactaaaaatacaaaaaattagccaggcgtggtggtgcacacatgtaatcccagatactcgggaggctgaggcaggagaatagcttgaacccggaagccagaggttgcagtgaccccagatctcacaccactgcactccaccctgggcaagagagtgagactctgtcacaaaacaaaacaaaacaaaacaaaaaacaacacaaatcctgaatagctagaatggtcaga

SEQ ID NO: 4033 - DNA, 434 bp, Homo sapiens
  AC068056.4_175678
  Located on chromosome 2
  Distance between a terminus base of telomere on chromosomal short arm and 5'-terminus of this base sequence : 190636108
  Distance between 3'-terminus of neighbour sequence of sequence listing upward to telomere on chrosomal short arm and 5'-terminus of this base sequence : 182382
catgattacagtcatcacttagaagacaatggggcaaaagactgctcaaaaaattaaaaaacaatgaaatccacaagcccagactccagccaatccaaaagatttaaaatgagacatgtaaggtatatgtgtgtgtgtgtgtgtgtgtgtgtgtgtatttatatgtacatatgtatatgtgtgtatatgtgtgtgtgtatatatacacacacacatatataaattgtaaactaaattgaaacaaaaaacattaagaaaattttaactctggtttcaatttaaatcaagagagagaaggtgttggaaaaaatgatcaaattaaagcaattgggaaatatttgctaggattacagaattccaaaatgagcacgaagccctgattcagggcctaattgctcctgatggctgcactagaccatcactaaattctcctt

SEQ ID NO: 4034 - DNA, 205 bp, Homo sapiens
  D2S2246
  Located on chromosome 2
  Distance between a terminus base of telomere on chromosomal short arm and 5'-terminus of this base sequence : 190640355
  Distance between 3'-terminus of neighbour sequence of sequence listing upward to telomere on chrosomal short arm and 5'-terminus of this base sequence : 3813
agctcctcgcccagaaattactgaatacacacacacacacacacacacacacaagtacaaaaatgttcctaaaacagactaaatggtatgcatgtatttttaggttttggtttatgctccccttagatgctgtcacagaggatctagttgaacaataaaaatattagaaatgcagttatttttactgagttgattggagcaagca

SEQ ID NO: 4035 - DNA, 243 bp, Homo sapiens
  AC068056.4_131637
  Located on chromosome 2
  Distance between a terminus base of telomere on chromosomal short arm and 5'-terminus of this base sequence : 190682432
  Distance between 3'-terminus of neighbour sequence of sequence listing upward to telomere on chrosomal short arm and 5'-terminus of this base sequence : 41872
agaaacttccatgtgttctatcagctgctctctggtgcctctgaagagctcctcagtaagtctctgtttctatgtggtgttgttgttgttgttgttgttgttgttgttgttgttggagctgggagtctcactgtgttgcccaggccggtctctaattcctgagctcaagcgattctcctgccttggcttcccagagtgctaggattacaggcatgagcactgtgcctgaattgtttctatgtt

SEQ ID NO: 4036 - DNA, 241 bp, Homo sapiens
  DISD22_0002061
  Located on chromosome 2
  Distance between a terminus base of telomere on chromosomal short arm and 5'-terminus of this base sequence : 190938825
  Distance between 3'-terminus of neighbour sequence of sequence listing upward to telomere on chrosomal short arm and 5'-terminus of this base sequence : 256150
ttaagccatgtgggtgtgtattcatctgatttgtcaaaatgtctcaaaaaataaatgataagtctttatcaacaagctttatttagcacacacacacatatatgtgtgtatatatgtatatacatatgtatacacacacacatatatatgtgtatatgtgtgtgtgtgtgtgtgtgtgtgtgtgtgtgtgtgtatacatatgtattggactaaggataaaagttcttcaactgtgattggc

SEQ ID NO: 4037 - DNA, 295 bp, Homo sapiens
  chr2.fa.O7frz.199973370
  Located on chromosome 2
  Distance between a terminus base of telomere on chromosomal short arm and 5'-terminus of this base sequence : 191177396
  Distance between 3'-terminus of neighbour sequence of sequence listing upward to telomere on chrosomal short arm and 5'-terminus of this base sequence : 238330
agaacatttgtagatctaaagcacgacttattaaataaaaacatttagtatctgaattaggtaatacctgaaaaacataaggcttcatcatatttttaaattataaagtggttattgatcactgcatgaccagggttatctataaatatctgcatgcatctcccttccttttttcctccctctctgcctccctcccttccttcctccccgcttttctatctatctatctatctatctatctatctatctatctatctatctatctatctatctgtccatctactgtctccaaatt

SEQ ID NO: 4038 - DNA, 126 bp, Homo sapiens
  D2S315
  Located on chromosome 2
  Distance between a terminus base of telomere on chromosomal short arm and 5'-terminus of this base sequence : 191487470
  Distance between 3'-terminus of neighbour sequence of sequence listing upward to telomere on chrosomal short arm and 5'-terminus of this base sequence : 309779
ggtaaaagcacccattgacaatatagaaatcaattgcacatgcctgcgcatgcacacacacacacacacacacacacacacactcacacacgaagaatgtattatgtgttagtgagacgaccacgt

SEQ ID NO: 4039 - DNA, 125 bp, Homo sapiens
  DISO7_10009188
  Located on chromosome 2
  Distance between a terminus base of telomere on chromosomal short arm and 5'-terminus of this base sequence : 191557744
  Distance between 3'-terminus of neighbour sequence of sequence listing upward to telomere on chrosomal short arm and 5'-terminus of this base sequence : 70148
actgaagttcctttaactcaacccaggcagcctggccacacacacacacacacacacacacacacacacacacacacacaaaatcaaactcagatactttctctactactttcagtggatctgaa

SEQ ID NO: 4040 - DNA, 120 bp, Homo sapiens
  D2S2167
  Located on chromosome 2
  Distance between a terminus base of telomere on chromosomal short arm and 5'-terminus of this base sequence : 191557757
  Distance between 3'-terminus of neighbour sequence of sequence listing upward to telomere on chrosomal short arm and 5'-terminus of this base sequence : -112
taactcaacccaggcagcctggccacacacacacacacacacacacacacacacacacacacacacaaaatcaaactcagatactttctctactactttcagtggatctgaaaccataat

SEQ ID NO: 4041 - DNA, 398 bp, Homo sapiens
  HUMUT5048
  Located on chromosome 2
  Distance between a terminus base of telomere on chromosomal short arm and 5'-terminus of this base sequence : 191750597
  Distance between 3'-terminus of neighbour sequence of sequence listing upward to telomere on chrosomal short arm and 5'-terminus of this base sequence : 192720
aagtcggaatatatttccaggcaagtgaattcattatattatcaaaggccaacaaataagtatgctaagaaagcttaattgaagtcacccaacacatgaaaataaaaacacaattaagatacagatagtgcagaaaaactcatgatgaaaaattgtggtggtgaatgctataaaacatagggattttccagggcccaatgctaaatactgttagtttacatagtcaaaattgttaacaaaataattttggtggtagtatattttctaacactatatttctacctatctatcatctatctatctatctatctatctatctatctatctatctatctatctatctatctcaatcatctatcatttatctacttatcatctctctcaaactgaaaacgatg

SEQ ID NO: 4042 - DNA, 244 bp, Homo sapiens
  DISO7_10525127
  Located on chromosome 2
  Distance between a terminus base of telomere on chromosomal short arm and 5'-terminus of this base sequence : 192005974
  Distance between 3'-terminus of neighbour sequence of sequence listing upward to telomere on chrosomal short arm and 5'-terminus of this base sequence : 254979
attatgctgcccttgtgcatcagtgtgtgtgtgtgtgtgtgtgtgttctgtatattttatatatcatttttctaaaattttgcattatttctaaaatttctataatgtctgcattgtttctttagtcttcagtaccatagatatacagaatagatattacacattttcttttgtataaaaaaaactcaaaggaagctattttgagaagattaattttaagtaacatacggattcaggaattata

SEQ ID NO: 4043 - DNA, 171 bp, Homo sapiens
  DISD22_0002067
  Located on chromosome 2
  Distance between a terminus base of telomere on chromosomal short arm and 5'-terminus of this base sequence : 192177888
  Distance between 3'-terminus of neighbour sequence of sequence listing upward to telomere on chrosomal short arm and 5'-terminus of this base sequence : 171670
tgcatgacttctaatgagaagacttttgtaatttgtatgcctttttcactcatgtaatgaatattggtgtgtgtgtgtgtgtgtgtgtgtgtgtgtgtgtgtgtgtttacaacatatatgtatacattaaaaattatcaaattttatactggactaggtgcaagttactta

SEQ ID NO: 4044 - DNA, 231 bp, Homo sapiens
  DISO7_10535105
  Located on chromosome 2
  Distance between a terminus base of telomere on chromosomal short arm and 5'-terminus of this base sequence : 192385088
  Distance between 3'-terminus of neighbour sequence of sequence listing upward to telomere on chrosomal short arm and 5'-terminus of this base sequence : 207029
ccttaatcctggatgaaatagctaattattttaacttctttagttaccttgcaattttttatttgggattttttcagatagttatgtgtgtgtgtgtgtgtgtgtgtgtgtgtgtgtgtgtaggagtaactttataaactttattttaatataatttgcccatttatttgtttaactgtgatagaataactataacgtattttatacataatcatctctatgcttaccagt

SEQ ID NO: 4045 - DNA, 413 bp, Homo sapiens
  AC013475.11_153154
  Located on chromosome 2
  Distance between a terminus base of telomere on chromosomal short arm and 5'-terminus of this base sequence : 192464114
  Distance between 3'-terminus of neighbour sequence of sequence listing upward to telomere on chrosomal short arm and 5'-terminus of this base sequence : 78795
aagaaagtaattccaccttcagaatcttaggattttaccaaatgatctttgctttacaaggcatttacattcttactggatacatggacattccccagccttgattgagatcctagtattattctacctgttcctttccaaggtttccttctgtaggctagggtaatttccattcatatatgcacaaatcaatgccgaggagactgctctgcagatctctggaaacttttttctaggcatctttcttcccttacttcaatgctaggtctactgaacatgaatatatatatatatatatatacacacacacacacacatatatatgtatacatattcacattttctattgtaatttctctttatgtctctcacatcttctcaccaagtagttatagttggtatgctgttgtcac

SEQ ID NO: 4046 - DNA, 206 bp, Homo sapiens
  Z66613
  Located on chromosome 2
  Distance between a terminus base of telomere on chromosomal short arm and 5'-terminus of this base sequence : 192565649
  Distance between 3'-terminus of neighbour sequence of sequence listing upward to telomere on chrosomal short arm and 5'-terminus of this base sequence : 101122
tgtgcataagtgtgtttggcaggggtggggcaagggggtgtgtgtgtatgtttgtgtgtgtgtgtgtgtgtgtggaaaacaggcactttatttctaaataaatgctggaaaaatacattatataacatactgaagaaaaatagttatataattacctaagatattggtttctgtttatattatttgtgatttgaagagaatttgcg

SEQ ID NO: 4047 - DNA, 130 bp, Homo sapiens
  DISO7_10535115
  Located on chromosome 2
  Distance between a terminus base of telomere on chromosomal short arm and 5'-terminus of this base sequence : 192730705
  Distance between 3'-terminus of neighbour sequence of sequence listing upward to telomere on chrosomal short arm and 5'-terminus of this base sequence : 164850
atatcaaggataaatccaattatcccaaagcatttgtcactctacattactttaaacacaatatgtgtgtgtgtgtgtgtgtgtgtgtgtgtgtgtgtgtatgtgtgggtaagtgctctagattcaatgg

SEQ ID NO: 4048 - DNA, 102 bp, Homo sapiens
  DISO7_10535119
  Located on chromosome 2
  Distance between a terminus base of telomere on chromosomal short arm and 5'-terminus of this base sequence : 192846269
  Distance between 3'-terminus of neighbour sequence of sequence listing upward to telomere on chrosomal short arm and 5'-terminus of this base sequence : 115434
caggcactaatgtctcagttaaacatctgtgtgtgtgtgtgtgtgtgtgtgtgagtgtgtgtgtattcttttcctgatttttaagcctggtcttcttcctca

SEQ ID NO: 4049 - DNA, 162 bp, Homo sapiens
  DISO7_10535127
  Located on chromosome 2
  Distance between a terminus base of telomere on chromosomal short arm and 5'-terminus of this base sequence : 193094618
  Distance between 3'-terminus of neighbour sequence of sequence listing upward to telomere on chrosomal short arm and 5'-terminus of this base sequence : 248247
aacaagatctgcctttacagctataaatataactaaaaatgccttacccctatctatttctctctctctctctctctctctctctctctctatgtatctatcgatcatctaacatatctaacttgaaaggtaatatttggaaagaatggctacctaaagcca

SEQ ID NO: 4050 - DNA, 263 bp, Homo sapiens
  DISO7_10535125
  Located on chromosome 2
  Distance between a terminus base of telomere on chromosomal short arm and 5'-terminus of this base sequence : 193149085
  Distance between 3'-terminus of neighbour sequence of sequence listing upward to telomere on chrosomal short arm and 5'-terminus of this base sequence : 54305
cctcccacttacatagttaactaggaagttgtttctatagtaatcttacagtatgtatatatatatatatatatatatatatatatatatatatatcctacacatatacatatttaatgcatctgcaccattttgtttaattaaaatggaaatgctattctttacctttcttttttctttataaagtaatctattttggtggtctcataaaataagcacaatatagacatcttttaaaatgctcatatggcatgttaatgtaa

SEQ ID NO: 4051 - DNA, 241 bp, Homo sapiens
  DISD22_0002079
  Located on chromosome 2
  Distance between a terminus base of telomere on chromosomal short arm and 5'-terminus of this base sequence : 193274220
  Distance between 3'-terminus of neighbour sequence of sequence listing upward to telomere on chrosomal short arm and 5'-terminus of this base sequence : 124872
acagattctcattgttcttaacaagatttagtagatttttctaaataaataagtctttctttcatgaataatcttaggaaaatttccagagactttagaggggtgtgtgtgtgtgtgtgtgtgtgtgtgtgtgtgtgtgacagagagagagagagagagagagagaaagagatttctattttcatcagttatgtttgcttttccagggagaagatccaggggcaccttacatcactattag

SEQ ID NO: 4052 - DNA, 301 bp, Homo sapiens
  D2S425
  Located on chromosome 2
  Distance between a terminus base of telomere on chromosomal short arm and 5'-terminus of this base sequence : 193463814
  Distance between 3'-terminus of neighbour sequence of sequence listing upward to telomere on chrosomal short arm and 5'-terminus of this base sequence : 189353
catttgggcttttttcttccctgatgtttttcaacaagagaataatatacttatttttaatgaaaacaagaaagttatgatttttcaaaattaaagaacaaagcctataacagatggactacctggtggagagtagcagcgctgtgtcgtatattaaaacactaaggatgaagatagaatgagaagaagtagcagtgatctcagaagcctagaggggcaatgctctatctatctatctatctatctatctatctatctatctatctatcatctatctatcatctatctcagaacacaaacc

SEQ ID NO: 4053 - DNA, 166 bp, Homo sapiens
  D2S1347
  Located on chromosome 2
  Distance between a terminus base of telomere on chromosomal short arm and 5'-terminus of this base sequence : 193466025
  Distance between 3'-terminus of neighbour sequence of sequence listing upward to telomere on chrosomal short arm and 5'-terminus of this base sequence : 1910
agaggatacccgtgatctccacaatattattattattattattattattattttattattatttgagacaaggtctcaccctgtaactcaggctggtgtgtcacccaggcacaatcacagctcactgcagccttgacctcccaggctcaggcaatctttccaagtc

SEQ ID NO: 4054 - DNA, 447 bp, Homo sapiens
  AC013456.4_134666
  Located on chromosome 2
  Distance between a terminus base of telomere on chromosomal short arm and 5'-terminus of this base sequence : 193786608
  Distance between 3'-terminus of neighbour sequence of sequence listing upward to telomere on chrosomal short arm and 5'-terminus of this base sequence : 320417
ctggcatagcaatgtatacaacatcatatatccgtatccaaaaaccaacacagtttgaccaccagaaagcttgcaaaacaggcatgggtttaatgtttctcaatgtccttcactgcgtctctctctctctctctctctctctctctctctctctctctctctctctcgtttgctctctttcccctcccacacagacatagacagacagacagacagacacacacacacagatacacagtcttctatgtacagaatataattttgaaaaaccaaccaataatgtaaaactgaatgccttttctcctacagtatagatgaatcacaataattaatgttattattttaaattaaaattaactacactgtaaatatgtattaattattgcttaatgcagacaggattggtggtaacattttctatctctcatagccttgtaaaataggaat

SEQ ID NO: 4055 - DNA, 402 bp, Homo sapiens
  AC013456.4_102810
  Located on chromosome 2
  Distance between a terminus base of telomere on chromosomal short arm and 5'-terminus of this base sequence : 193824765
  Distance between 3'-terminus of neighbour sequence of sequence listing upward to telomere on chrosomal short arm and 5'-terminus of this base sequence : 37710
cagaaaggtgtagtttagattcagatcttgtgaatttcagtgaactgttctcccattcttctctattcaagctggtttgcaaagaaactgaaaaataagtagaaggatcataaatatataatagatggatagaagacagataaagatagatgataggcagacaaatgagagagagagagagagagagagagagagagagagagagagagagaaaggatagttaaaaagagcttggaccctagagtcagactccctaagcgtgcattccggtttcatgacttactagttgtgcagcctttgacaaagacttaacaatttagaaacctatgtttttaaaaacatataattgggataatataataaacctacttcattagggttgtcctaaagattaaactcaca

SEQ ID NO: 4056 - DNA, 181 bp, Homo sapiens
  Z16508.1_109
  Located on chromosome 2
  Distance between a terminus base of telomere on chromosomal short arm and 5'-terminus of this base sequence : 193852656
  Distance between 3'-terminus of neighbour sequence of sequence listing upward to telomere on chrosomal short arm and 5'-terminus of this base sequence : 27489
atttaaaccttgaaacctgttattttttctccagaaaatgacaaactttagagagaattggaaacttaagtaatcagagatttcttcctaaaatatggcttaattattgactttgttagagaagtgtgtgtgtgtgtgtgtgtgtgtgtgtgtgtgtgtgtgtgtctacagtaagcaaagc

SEQ ID NO: 4057 - DNA, 198 bp, Homo sapiens
  D2S117
  Located on chromosome 2
  Distance between a terminus base of telomere on chromosomal short arm and 5'-terminus of this base sequence : 193852687
  Distance between 3'-terminus of neighbour sequence of sequence listing upward to telomere on chrosomal short arm and 5'-terminus of this base sequence : -150
cagaaaatgacaaactttagagagaattggaaacttaagtaatcagagatttcttcctaaaatatggcttaattattgactttgttagagaagtgtgtgtgtgtgtgtgtgtgtgtgtgtgtgtgtgtgtgtgtctacagtaagcaaagcagaattctagatattggagatccaagtggattgaatatacctgatctc

SEQ ID NO: 4058 - DNA, 241 bp, Homo sapiens
  D2S342
  Located on chromosome 2
  Distance between a terminus base of telomere on chromosomal short arm and 5'-terminus of this base sequence : 194118024
  Distance between 3'-terminus of neighbour sequence of sequence listing upward to telomere on chrosomal short arm and 5'-terminus of this base sequence : 265139
ctgagagtctgcactggatataattctgctatgtccttctgatcatttttccttttgtgtcatgttgtgcaacgtctattcccctctattagccttcaagggtcttgaaaaccaatcttacatctgattcacctctctctgcaccacccccctccatacacacacacacacacacacacacacacacacacacacacacacagtatctggaatataccaattgttgaatggttttgttgag

SEQ ID NO: 4059 - DNA, 124 bp, Homo sapiens
  DISO7_10545106
  Located on chromosome 2
  Distance between a terminus base of telomere on chromosomal short arm and 5'-terminus of this base sequence : 194371022
  Distance between 3'-terminus of neighbour sequence of sequence listing upward to telomere on chrosomal short arm and 5'-terminus of this base sequence : 252757
taccagctgagggtctggggtgtgtacgtgtgtgtgtgtgtgtgtctgtgtgtctgtgtgtctgtgtgtgtgtgtgaactagaatctaagagagacatagaaaaactgtcaagcaccactcaag

SEQ ID NO: 4060 - DNA, 421 bp, Homo sapiens
  AC073066.2_108121
  Located on chromosome 2
  Distance between a terminus base of telomere on chromosomal short arm and 5'-terminus of this base sequence : 194557003
  Distance between 3'-terminus of neighbour sequence of sequence listing upward to telomere on chrosomal short arm and 5'-terminus of this base sequence : 185857
gtgttctacctattctagttgcaatttctgggattgataccaaatgaagaaaatgtttctacacaaagatatttatacacagctttatttaaaatagtaaaattgggggaatatctttaactacctagttaaaggtagtgtggcacagctataaaacagaccatattgtcttttaaaattctgtttaattccttttacttcatgcaaattaatcatcttattttagtgtgatagcatgaaagatactaggacagctaggaaggaacacacacacacacacacacacacacacacacacacactccatcttctcccttaagacctaaattcaggattggagtaggagatcaagttttctgttgagaaccagcagcaaaatgaacaagattatttctctctgtgtgagtctgtgctacatctt

SEQ ID NO: 4061 - DNA, 159 bp, Homo sapiens
  DISD22_0002096
  Located on chromosome 2
  Distance between a terminus base of telomere on chromosomal short arm and 5'-terminus of this base sequence : 194744481
  Distance between 3'-terminus of neighbour sequence of sequence listing upward to telomere on chrosomal short arm and 5'-terminus of this base sequence : 187057
tgaatcattctgtgcaatactgaatatacactatgtcatgcaaaattacagaactctgtgtgtgtgtgtgtgtgtgtgtgtgtgtatgtgtgtgtgagatagagagacagagagaaagagagagagactaatcaataagcctgtttggctaccatgtag

SEQ ID NO: 4062 - DNA, 197 bp, Homo sapiens
  AC013274.3_103707
  Located on chromosome 2
  Distance between a terminus base of telomere on chromosomal short arm and 5'-terminus of this base sequence : 194954551
  Distance between 3'-terminus of neighbour sequence of sequence listing upward to telomere on chrosomal short arm and 5'-terminus of this base sequence : 209911
actcatccataagtcagacttcagatgtgacttcctttgggaagcctgagtgtatccccaaattttggcctttgctaccgttgcaagctatacctatatctaacatagcacttgccatgcgatactgtaattatctctttaattaccatccaccaccaccaccaccaccaccaccacgagactacaggcaacttaag

SEQ ID NO: 4063 - DNA, 470 bp, Homo sapiens
  AC013274.2_60443
  Located on chromosome 2
  Distance between a terminus base of telomere on chromosomal short arm and 5'-terminus of this base sequence : 195088755
  Distance between 3'-terminus of neighbour sequence of sequence listing upward to telomere on chrosomal short arm and 5'-terminus of this base sequence : 134007
tctactttgaaagttatccacaacatatgtaggtaaaaaaaagtaagctgaagataaatatgtacactataataatgtttttgagaaaaaattatgtgtgtattgtgtttatatatgtgtatctatatatgcacaggaaaatgtccaggcacatatgccccaggatgtgaaaatggttgccttggggatcagttagggtcagaatgaggggtgagaggtgggtcttatacacacacacacacacacacacacacacacacacacacacagacacacccctaccaaaacaagaatgacaacgcaattgcccatctgtcaagtagataatatatatccacctaaattttcttcttttacacttttaattttttctatttagtctttttggatccaacagaaattatatatgaagaatctactttagcaaataaccaattattctaacttcatttatcgaatacctcttccat

SEQ ID NO: 4064 - DNA, 441 bp, Homo sapiens
  AC068528.2_176139
  Located on chromosome 2
  Distance between a terminus base of telomere on chromosomal short arm and 5'-terminus of this base sequence : 195351715
  Distance between 3'-terminus of neighbour sequence of sequence listing upward to telomere on chrosomal short arm and 5'-terminus of this base sequence : 262490
gaatgtttaccaatttgttcagattttcacccatccagggacttaaaagattttacaataataaataaataaataaataaataaataaataactttaaaggaggaaaaagaattatgcaaatcaaagtgaataccctgaagcgtaacccctgctggcctctgggtcacaaagcagtgaatatattactctccaaggctttgcaatattaactatggtgtacagctcctgttttcttctactccactttttttaaaaaaaattccttaaggcaaacacacacacacacacacacacacacacacacacagaggaaaataaagtaggaacgcaagggcatttgcaaattcaaattcaatttcttgcactttttattccctggggaacattgaggaatgtgggaggttgttgactaatcttgctatttgacatcagccacatag

SEQ ID NO: 4065 - DNA, 138 bp, Homo sapiens
  D2S2336
  Located on chromosome 2
  Distance between a terminus base of telomere on chromosomal short arm and 5'-terminus of this base sequence : 195355346
  Distance between 3'-terminus of neighbour sequence of sequence listing upward to telomere on chrosomal short arm and 5'-terminus of this base sequence : 3190
ggaatatccgtatcccataccctgcctcatcacccctgcacatgcattcatgtgtgcatgcgtgcacacacacacacacacacacacacacacacacacaccagtctaggactgcatgttcctccagcatgaattact

SEQ ID NO: 4066 - DNA, 379 bp, Homo sapiens
  AC068528.2_156819
  Located on chromosome 2
  Distance between a terminus base of telomere on chromosomal short arm and 5'-terminus of this base sequence : 195370988
  Distance between 3'-terminus of neighbour sequence of sequence listing upward to telomere on chrosomal short arm and 5'-terminus of this base sequence : 15504
acagaacttcgaaataaagctttatgtataggttagtcactcttccaacaaaattattgagcacttcatacatagcaggctctgtgctaggtcctgtcaaaggagggactcttaagacctttgagagtttctgagtttagtactgaaacatagccaatccgtggaagaagttctatttcttgtagtccttcacgtcagtaatataactcacaatatgtgcatttaccaccaaatttctttagccatgtgaaaataagtttaaaatgaataattattatcttgtcgtattaaattacctattatgtgaaacctataactttatttatttatttatttatttatttatttatttattgagataagatctcgctttattgcc

SEQ ID NO: 4067 - DNA, 355 bp, Homo sapiens
  AC068528.2_98421
  Located on chromosome 2
  Distance between a terminus base of telomere on chromosomal short arm and 5'-terminus of this base sequence : 195428649
  Distance between 3'-terminus of neighbour sequence of sequence listing upward to telomere on chrosomal short arm and 5'-terminus of this base sequence : 57282
aatttgaacatgcttaaggtgtagtcttctagctctcctcattgtaaaggaacattttccctttttaattaatctgtgtagtgatatttacagaccatgtgattattatcttttgttgttgttgttgttgttgttgttgttgttgttggagtcttgctctgtcaccaggctcgagtgcagtggcgcgatctcagcttactgcaacctctgcctcctgggttcaagcgattgccctgcctcagcctcctgagtagctgggattacaggcacgtgccaccatgcccagcaattttttgtatgttactagagatggggtttcaccatgttggccaatatgtcttgatctcctgacctc

SEQ ID NO: 4068 - DNA, 355 bp, Homo sapiens
  AC020571.5_138861
  Located on chromosome 2
  Distance between a terminus base of telomere on chromosomal short arm and 5'-terminus of this base sequence : 195544342
  Distance between 3'-terminus of neighbour sequence of sequence listing upward to telomere on chrosomal short arm and 5'-terminus of this base sequence : 115338
taatcagcctttctgaaattctacaaataaaccatggttaaccaaaataaaaagaaagcaaaataaatgtaccctttgttttatctgccatagaaaacgaacaacagccaggcacggtggctcatgcctgtaatcccagcattttgggaggctgaggcaggaggatcacttgaggccaggagtttgagaccagcctgggcaacatggtgaaactgtctctacaaaaataaataaataaataaataaataaataaattaggcaggcatggtggcatgcgcctgtagtcctagctactcaggaggctgaagaagggggactgcttgagctctggagttcaaagttgcagtgagctat

SEQ ID NO: 4069 - DNA, 106 bp, Homo sapiens
  D2S2387
  Located on chromosome 2
  Distance between a terminus base of telomere on chromosomal short arm and 5'-terminus of this base sequence : 195678423
  Distance between 3'-terminus of neighbour sequence of sequence listing upward to telomere on chrosomal short arm and 5'-terminus of this base sequence : 133726
ttggtcctacagcacgagtgtatgagtgtgtgtgtgtgtgtgtgtgtgtgtgtgtgtgtgtgtgtgcataacttatatttttagagggaggcatcttcacttctga

SEQ ID NO: 4070 - DNA, 114 bp, Homo sapiens
  Z67469
  Located on chromosome 2
  Distance between a terminus base of telomere on chromosomal short arm and 5'-terminus of this base sequence : 195821691
  Distance between 3'-terminus of neighbour sequence of sequence listing upward to telomere on chrosomal short arm and 5'-terminus of this base sequence : 143162
agtctctggatcttaactgtttctctctctccctctcactcactcacacacacacacacacacacacatacacacaccccaaggggatgaaaatatgtgacttcgcattactag

SEQ ID NO: 4071 - DNA, 125 bp, Homo sapiens
  DISD22_0002111
  Located on chromosome 2
  Distance between a terminus base of telomere on chromosomal short arm and 5'-terminus of this base sequence : 196112102
  Distance between 3'-terminus of neighbour sequence of sequence listing upward to telomere on chrosomal short arm and 5'-terminus of this base sequence : 290297
aaggactcagaacccttcccacaatcatcaacacacacacacacacacacacacacacacacacacacacacacactctctctctctctctctctcacctggaaaaacacctggactttgcacac

SEQ ID NO: 4072 - DNA, 242 bp, Homo sapiens
  DISD22_0002114
  Located on chromosome 2
  Distance between a terminus base of telomere on chromosomal short arm and 5'-terminus of this base sequence : 196191445
  Distance between 3'-terminus of neighbour sequence of sequence listing upward to telomere on chrosomal short arm and 5'-terminus of this base sequence : 79218
gctatatccaaattctgactgttcaaaacaagcagagcaaatccatttctagacgaatcaaaatctctctctctctctctctctcacacacacacacacacacacacacacacacacacacacacacacacaaagcaacctagcaacctaggggtgggagacttctttaaaagctgtttaaaattcatcaagggacttttctctcactgaaacattttatgtttaattcatcagctccttga

SEQ ID NO: 4073 - DNA, 171 bp, Homo sapiens
  D2S2327
  Located on chromosome 2
  Distance between a terminus base of telomere on chromosomal short arm and 5'-terminus of this base sequence : 196285798
  Distance between 3'-terminus of neighbour sequence of sequence listing upward to telomere on chrosomal short arm and 5'-terminus of this base sequence : 94111
caactgaatttttcagacttgtctctatccttgccttcgtctcccttctataatccatagttcatactgctaacacacacacacacagacacacacacacacacacacacacacacacacacacacaacaaagcttaagagagagacatcctttaaaatctggctctaatt

SEQ ID NO: 4074 - DNA, 203 bp, Homo sapiens
  Z67306
  Located on chromosome 2
  Distance between a terminus base of telomere on chromosomal short arm and 5'-terminus of this base sequence : 196524105
  Distance between 3'-terminus of neighbour sequence of sequence listing upward to telomere on chrosomal short arm and 5'-terminus of this base sequence : 238136
agggtccctgcctttatgacgcctgaaagaatcttgctttcttgactccaggcaggggacattctattacagtagactaatgctagattaaacacacccatcagcaaagagcaaacaaacacacacacacacacacacacatacacacacatacacacggtattagaaaaagttaaacagaaagaaactgtgcaatgaaagga

SEQ ID NO: 4075 - DNA, 462 bp, Homo sapiens
  AC010746.4_133933
  Located on chromosome 2
  Distance between a terminus base of telomere on chromosomal short arm and 5'-terminus of this base sequence : 196649600
  Distance between 3'-terminus of neighbour sequence of sequence listing upward to telomere on chrosomal short arm and 5'-terminus of this base sequence : 125292
gacattcatgttctatgaccaggtccaagttgcctcaccatgaaaatcaaacaatggaggccttttcccaattcttagaaggaaaaaaactacttaaatgtgacatatactctttttcccattaatttctccaaaccctagcacataccaccacatggtcaaacaagaactcacggcaacagagagtcaaacacacacacacacacacacacacacacacacacacacataatttgtgtgtttaaacaaaattctagaaatatgactcattaaaatttttacattattagagccaggcgtggtggctcatgcctataatcccaaaactctggaaggcctaggtgggtggatcacttgaggccaggagttcgagaccagcctggccaacatggtgaaaccccgtctctactaaaaatacaaaaattagccaggtgtggtggtgtgcacctgtaatcctagcta

SEQ ID NO: 4076 - DNA, 174 bp, Homo sapiens
  DISO7_10009279
  Located on chromosome 2
  Distance between a terminus base of telomere on chromosomal short arm and 5'-terminus of this base sequence : 196739290
  Distance between 3'-terminus of neighbour sequence of sequence listing upward to telomere on chrosomal short arm and 5'-terminus of this base sequence : 89228
cctgaccataacacctgtatgttattaaattatctctctctctctctctctctctctctctctctttctctttctctctctctctctctctctctctctctctctctctctctctctctctctctcctctctctctctctctctctctctctcatccttccggctaaatcagtt

SEQ ID NO: 4077 - DNA, 131 bp, Homo sapiens
  D2S374
  Located on chromosome 2
  Distance between a terminus base of telomere on chromosomal short arm and 5'-terminus of this base sequence : 196807906
  Distance between 3'-terminus of neighbour sequence of sequence listing upward to telomere on chrosomal short arm and 5'-terminus of this base sequence : 68442
agtgtgaaagtggggttggaggaagagtgcagcatgctgtgtgtgtgtgtgtgtgtgtgtgtgtgtgtgtgtgtgtgaacctcctttccctcccactaacgcagtgattctcaaactctaagggcatcccc

SEQ ID NO: 4078 - DNA, 363 bp, Homo sapiens
  M2_197088205
  Located on chromosome 2
  Distance between a terminus base of telomere on chromosomal short arm and 5'-terminus of this base sequence : 197087899
  Distance between 3'-terminus of neighbour sequence of sequence listing upward to telomere on chrosomal short arm and 5'-terminus of this base sequence : 279862
ctagtaggactgttaattcatggaccttttggctgggcgcagtgactcatgcctgtagtcccagcactttggaggcgggtggatcacctgagatcaggagtttgagaccagcctggtcaacatggtgaaacctcatctttactaaaaatacaaaaattagccaggcgtggtggcgagcacctgtaatcccagctactcaggaggctgagataggagaatcacttgaacttgggaggtggaggttgcagtgagccaagatcgtgccactgcactccagcctgggcaataagactgaaactctgtgtcaataaataaataaataaataaataaataaataaaactgatgggagttcaatgaagga

SEQ ID NO: 4079 - DNA, 441 bp, Homo sapiens
  AC011997.5_36206
  Located on chromosome 2
  Distance between a terminus base of telomere on chromosomal short arm and 5'-terminus of this base sequence : 197228033
  Distance between 3'-terminus of neighbour sequence of sequence listing upward to telomere on chrosomal short arm and 5'-terminus of this base sequence : 139771
atcatgaggtcaggagctcgagaccatcctggccaacacggtgaaaccccgtctctactaaaaatatgaaaatattagccagctgggcatggtggcacgtgcctgtagtcccagctactcaggaggctgaggcaggagaatcactcgaacctgggaggtggaggttgcagtgagccgagaccacaccattgcactctagcctgggcgatggagcaagactccgtctcaaaaaacaaaacaaaaaacaaacaaaaaaaccccaaaacacacacacacacacacacacacacacacacacacaaaccatagaagacaatataggcaatactattcattcaggacacaggcacgggcaaagacttcatgatgaaaacatcaaaagcaattgcaactaagcaaaaattgacaaatgggatttaattaactaaagagcttctgctc

SEQ ID NO: 4080 - DNA, 289 bp, Homo sapiens
  AC073058.1_147145
  Located on chromosome 2
  Distance between a terminus base of telomere on chromosomal short arm and 5'-terminus of this base sequence : 197252219
  Distance between 3'-terminus of neighbour sequence of sequence listing upward to telomere on chrosomal short arm and 5'-terminus of this base sequence : 23745
tcattcctcagctaatgtacatctgctacttacattaagtgcttgctgcctaccactgaatggtccctccacccatgcaagaataacttctcaacaaattaagaaatattacagtgtctcctccctccaaaatacacacacacacacacacacacacacaaggaaatcaaaaggtaggaggaaagaagagggcatgatggtctctgctggaaaatggaaccaaagtaaactggcgtacaaaacctagtcatccaatgaaaatagagttgctaattccatagacaatcta

SEQ ID NO: 4081 - DNA, 281 bp, Homo sapiens
  AC011997.5_84643
  Located on chromosome 2
  Distance between a terminus base of telomere on chromosomal short arm and 5'-terminus of this base sequence : 197252227
  Distance between 3'-terminus of neighbour sequence of sequence listing upward to telomere on chrosomal short arm and 5'-terminus of this base sequence : -281
cagctaatgtacatctgctacttacattaagtgcttgctgcctaccactgaatggtccctccacccatgcaagaataacttctcaacaaattaagaaatattacagtgtctcctccctccaaaatacacacacacacacacacacacacacaaggaaatcaaaaggtaggaggaaagaagagggcatgatggtctctgctggaaaatggaaccaaagtaaactggcgtacaaaacctagtcatccaatgaaaatagagttgctaattccatagacaatcta

SEQ ID NO: 4082 - DNA, 204 bp, Homo sapiens
  D2S2318
  Located on chromosome 2
  Distance between a terminus base of telomere on chromosomal short arm and 5'-terminus of this base sequence : 197323471
  Distance between 3'-terminus of neighbour sequence of sequence listing upward to telomere on chrosomal short arm and 5'-terminus of this base sequence : 70963
accactgactgttgaagcatgtatctgaaatttccttttaacacaagttttcagtgattctcttagaggttaaacacacagacacacagacacacagacacacacagacacacacacacacacacacacacacacacacacacacacacacacacgactgcagccaggaagcctggctcagtcaccaggtagtggtatgccctt

SEQ ID NO: 4083 - DNA, 274 bp, Homo sapiens
  AC011997.5_121930
  Located on chromosome 2
  Distance between a terminus base of telomere on chromosomal short arm and 5'-terminus of this base sequence : 197370586
  Distance between 3'-terminus of neighbour sequence of sequence listing upward to telomere on chrosomal short arm and 5'-terminus of this base sequence : 46911
gccaaacagtatagttgaacatttccataatgatacctttggggatagaagtatgactccttcttcttcttcttcttcttcttcttcttcttcttcttcttcttcttcttcttcttcttcttcttcttcttcttcttcttcttcttcttctccttctccttcttctttcttcttcctcttcttcctcttcttcttcctccttcttcctcttcctcttcttttttgtttaacttgttatatgttgtatctagttgtgctgaaatagaggatttaa

SEQ ID NO: 4084 - DNA, 165 bp, Homo sapiens
  DISD22_0002190
  Located on chromosome 2
  Distance between a terminus base of telomere on chromosomal short arm and 5'-terminus of this base sequence : 197553759
  Distance between 3'-terminus of neighbour sequence of sequence listing upward to telomere on chrosomal short arm and 5'-terminus of this base sequence : 182899
tccttgagaagaatggagctatgtgtgtgtgtgtgtgtgtgtgtgtgtgtgtgtgtgtgtgtgatatgagattgcttgtgcgcctgtgtgcatgtgtgtatgtgtatgtgttgaacgatactgtggaaagtttgggataagaaatgataactgggaagagccaga

SEQ ID NO: 4085 - DNA, 323 bp, Homo sapiens
  AC013478.4_27376
  Located on chromosome 2
  Distance between a terminus base of telomere on chromosomal short arm and 5'-terminus of this base sequence : 197626621
  Distance between 3'-terminus of neighbour sequence of sequence listing upward to telomere on chrosomal short arm and 5'-terminus of this base sequence : 72697
gacttgtcataggtaaatggtaagctctcaagctctcatattatactataagtactcttctgttatctgctttttaagtatgcacacacacacacacacacacacacacacacacacacacaatgcattttaagatttataggtctgcatcacccattatatgggctgtataggatcctgttacatgtaatgtaccataatttattttgccagtccttggaatggatgtttagtttattagtttatacttactttttaaaatatcagcagcatggcagtgaaccacctcttacttatatctttgctcatttactcaagtattt

SEQ ID NO: 4086 - DNA, 371 bp, Homo sapiens
  AC013478.4_130837
  Located on chromosome 2
  Distance between a terminus base of telomere on chromosomal short arm and 5'-terminus of this base sequence : 197661073
  Distance between 3'-terminus of neighbour sequence of sequence listing upward to telomere on chrosomal short arm and 5'-terminus of this base sequence : 34129
ggcttgatctctaggttcatactctaggagatggggagctgcatactggaattaacatggtttttgccttaataaggcaatgaggttttcggtgcaggcagggtacagcccatgtgtgagattaatttgcctggtgtgtgtgtgtgtgtgtgtgtgtgtgtgtgtgtgtgtttactcacatgaatacttacgttcaagtcaatatggctgttcttgtttgtggaaagaataatgacaaatgcttctggggaagattccaacacaaatgattttgaagagacaaagtacaaaatatctagggccattgaggatttttattttaagaacagttcctataaatacatttctttttgcaaataactttggaagtc

SEQ ID NO: 4087 - DNA, 387 bp, Homo sapiens
  AC020719.4_159991
  Located on chromosome 2
  Distance between a terminus base of telomere on chromosomal short arm and 5'-terminus of this base sequence : 197702595
  Distance between 3'-terminus of neighbour sequence of sequence listing upward to telomere on chrosomal short arm and 5'-terminus of this base sequence : 41151
tcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctg

SEQ ID NO: 4088 - DNA, 214 bp, Homo sapiens
  AC020719.4_13864
  Located on chromosome 2
  Distance between a terminus base of telomere on chromosomal short arm and 5'-terminus of this base sequence : 197848869
  Distance between 3'-terminus of neighbour sequence of sequence listing upward to telomere on chrosomal short arm and 5'-terminus of this base sequence : 145887
aatctcatactatgtacttggcttctcaactttatcatctatctcccctcctagtatataagcccagtagggcagggtgtgtgtgtgtgtgtgtgtgtgtgtgtgtatttcatttagggctgtatcctcagggcttagagcagtgtctggcacattgaaagttatcaatacatgccagttacatggatgggtggttatcagaatgttatctgtc

SEQ ID NO: 4089 - DNA, 427 bp, Homo sapiens
  AC019330.2_48304
  Located on chromosome 2
  Distance between a terminus base of telomere on chromosomal short arm and 5'-terminus of this base sequence : 198157474
  Distance between 3'-terminus of neighbour sequence of sequence listing upward to telomere on chrosomal short arm and 5'-terminus of this base sequence : 308391
agtccaaggaaataagcattacaaccagaaaatcctgacccttgaaaaacatgtaagtcccttgtaaaacattatctccaacacaatataatcatgcacatgctaagcttcaggacctaagcttgattgcagtagaaaaatcgatatatttctacataagcttgcaataatcagtggatctctctctctctctctctctctctctctctctctctctctctctctctctctctctctctcgtatgatacaaattattaaaattgccaaagactccctgaaagttgtttagcatcatggaatgtattaagatgattaatgacaaattattagacagtagggagcagattcttgaataatattccatagaaggaccttctcacaaaagtcaaggagattgtaccatgctgtttacctgatgtctgactg

SEQ ID NO: 4090 - DNA, 253 bp, Homo sapiens
  AC019330.2_162569
  Located on chromosome 2
  Distance between a terminus base of telomere on chromosomal short arm and 5'-terminus of this base sequence : 198271807
  Distance between 3'-terminus of neighbour sequence of sequence listing upward to telomere on chrosomal short arm and 5'-terminus of this base sequence : 113906
catacagtgcacctatctacaatggtctgtggacctgctattatttttatgagttaatcaacttgaaatttaagaatggattataaagccgtcattttatacaaccaaaagggagagagagagagagagagagagagagagagaggggtactgcacaaggaaacttaaaaatcccaccacaacagatggcttgtgccattttgaatttactctccctaaggagcaatcccttgtagaggctattaaagcttct

SEQ ID NO: 4091 - DNA, 180 bp, Homo sapiens
  DISD22_0002210
  Located on chromosome 2
  Distance between a terminus base of telomere on chromosomal short arm and 5'-terminus of this base sequence : 198333676
  Distance between 3'-terminus of neighbour sequence of sequence listing upward to telomere on chrosomal short arm and 5'-terminus of this base sequence : 61616
cctccactgttgttaacccctactaataccctacattatcaaatattcattttcataatattgttagaaagttattttattttacacctcaacacacacacacacacacacacacacacatcatattcatgggtaactttctaacagaataaaattacatttccacaaagcaatgacgtg

SEQ ID NO: 4092 - DNA, 225 bp, Homo sapiens
  DISD22_0002213
  Located on chromosome 2
  Distance between a terminus base of telomere on chromosomal short arm and 5'-terminus of this base sequence : 198407084
  Distance between 3'-terminus of neighbour sequence of sequence listing upward to telomere on chrosomal short arm and 5'-terminus of this base sequence : 73228
ctctgtagatgagacactgtctttcaaatgaaaatattttagcatctttaataacatgttttaaataaactcttgggtatagttttgtgtgtgtgtgtgtgtgtgtgtgtgtgcgcgcgcgcgtgtgtgtgtgtgtgtccactggccttttcaaagtctctcttttgttttgcaactttggctttatttataatttaaatctagacatttcttcttgtgaagtcc

SEQ ID NO: 4093 - DNA, 446 bp, Homo sapiens
  AC068121.5_46541
  Located on chromosome 2
  Distance between a terminus base of telomere on chromosomal short arm and 5'-terminus of this base sequence : 198485280
  Distance between 3'-terminus of neighbour sequence of sequence listing upward to telomere on chrosomal short arm and 5'-terminus of this base sequence : 77971
ccatccaaatcagttacatagtcctctgccactcttcactcttgaatatttttccagaaaaagaaaatgtcttccaatgttctagatgcctctgagcaagacagacctccccattaacaataagtgcagaaaccctgtaatttctgcaaaagggagattaccctccaggctacagatgggcttggggacctgactgagatggtttgcagcacagggcataccagatgttttcaagaaaagctgggaaagataattcagcattgatttagaagagcacctttcaaatgtgtccacctgtaatggtaatacatgtattttacataatgacccagtatataagaaatgtgtgtgtgtgtgtgtgtgtgtgtgtgtgtgtgtatgtgtacttgaaactaaatttacaagagaaagtttcacaatccattaataggtcatgaaatcaattc

SEQ ID NO: 4094 - DNA, 439 bp, Homo sapiens
  AC073417.3_173221
  Located on chromosome 2
  Distance between a terminus base of telomere on chromosomal short arm and 5'-terminus of this base sequence : 198527890
  Distance between 3'-terminus of neighbour sequence of sequence listing upward to telomere on chrosomal short arm and 5'-terminus of this base sequence : 42164
gaatactcagataaccatcttgaagtcttttactctttgaaatcctaacatttttctatgtattggatgctacattatttccaacataaaaattcattattttacctcctagctccttggtaggttgcatcatgtacagtttatttcatatccactttcttttcattagcattcttctgtttatttttaaactttctatgtcatttaaattttttttatttttaagtgaactttgttatgaaatataacggcattttcttttgggtaattctcttctaaattgtgtgtgtgtgtgtgtgtgtgtgtgtgtgtgtgaaatataacggtattttcttttaggtaattctcttcaaaattgtgtgtgtgtgtgtgtgtattcttttttaacccatactaaatatgtactaaaagttgaatttgatccatttatacgtactgt

SEQ ID NO: 4095 - DNA, 411 bp, Homo sapiens
  HUMUT7188
  Located on chromosome 2
  Distance between a terminus base of telomere on chromosomal short arm and 5'-terminus of this base sequence : 198537236
  Distance between 3'-terminus of neighbour sequence of sequence listing upward to telomere on chrosomal short arm and 5'-terminus of this base sequence : 8907
gcacacatatccctgaagttaaaataaaagttggaaatcaaaaaagaaagaaaaaagaaagaaaggaaaggaaaggagaaaggaagaaaagagagaagaaggaaggaaggaaggaagggaaagaaagagagagagagagaaagaaaaagaaagagaaagaaagaaagaaaagaaagaaagaaagaaagaaagaaagaaagaaagaaagaaagaaagaaagaaagaaagaaaaaaagaaagaaagaaagaaagaaaaaacaaaacagcatgaagcctacagatcttaggatatagtttcatgatgcatgcctaaatttaatagagagacattgaatgtccacgtatgagtgtgcaaataaagcacaccataaaatttctaaataagctatttgaaaaagtgtattttggccg

SEQ ID NO: 4096 - DNA, 418 bp, Homo sapiens
  AC073417.3_109038
  Located on chromosome 2
  Distance between a terminus base of telomere on chromosomal short arm and 5'-terminus of this base sequence : 198560956
  Distance between 3'-terminus of neighbour sequence of sequence listing upward to telomere on chrosomal short arm and 5'-terminus of this base sequence : 23309
tagactcctacattcagcaaagctatctttcaaaaatgaaggtaaaatgcattcttagataaacaaaaatgaagaaaatttgttgttagatgacctgtcttacaagaaatactaaagaaagttcttcatgttgaaaactgcagacaataattcagacacacacacacacacacacacccccgcactagtgaagataattatgtaattacagaaaataatatacctgcataattttctcctttctactcttaactgtttttaaaacaattttataaaataatacctatatgatgttttatggggtatataatatatagaaatgtactatatttgctaataaaagcacaaagaaagtgagtggaagcaaagctttatttggtgaaagaaatgactctagacggtaacttaaatctacagg

SEQ ID NO: 4097 - DNA, 451 bp, Homo sapiens
  chr2.fa.O7frz.207930134
  Located on chromosome 2
  Distance between a terminus base of telomere on chromosomal short arm and 5'-terminus of this base sequence : 198660022
  Distance between 3'-terminus of neighbour sequence of sequence listing upward to telomere on chrosomal short arm and 5'-terminus of this base sequence : 98648
ggaattgtaattcctacctcacaggattaagtggaataatgtatgtaaatttcagtacaatgcctggcatgtgctaagtcttcaaaaatggtatatgttttcacagtggagcactaaggaaatgtggagcagggcattgagaactgacatctaccaatcaacacgtgatgaacagaggcaggaagattgtcactgcaccaagggccatctactttagtgttgcacaacattagagttttagggtgaggttttgtgtgtgtgtgcgtgtgtgtgtgtgtgtgtgtgtgctcaagaagcataaccacttaatggcacagagtctattttgaagctcgaaaaccagtaagaccatagaactctctcaggaggaatgaggagttggctgagttctgcccaaggaagttctcacaagagggcattgtaaaatgtccttattcctcagaacttaact

SEQ ID NO: 4098 - DNA, 243 bp, Homo sapiens
  AC018717.8_173064
  Located on chromosome 2
  Distance between a terminus base of telomere on chromosomal short arm and 5'-terminus of this base sequence : 198838455
  Distance between 3'-terminus of neighbour sequence of sequence listing upward to telomere on chrosomal short arm and 5'-terminus of this base sequence : 177982
attctagtgcttcagcaatgacccccaaaaatgaaccatggataaaataggaatagaatagaaaagagaagaatagaatagaatagaatagaatagaatagaatagaatagaatagaatagaatagaatagaatagaatagaatagaatagaatagaatagttgcagagatggagactctgcatcaatccaatagcatgaactcctatgctccaaggctgatccagctacagttactgctaaa

SEQ ID NO: 4099 - DNA, 396 bp, Homo sapiens
  chr2.fa.O7frz.208023864
  Located on chromosome 2
  Distance between a terminus base of telomere on chromosomal short arm and 5'-terminus of this base sequence : 198887519
  Distance between 3'-terminus of neighbour sequence of sequence listing upward to telomere on chrosomal short arm and 5'-terminus of this base sequence : 48821
atgcgataggtatgctattaatagtcatttcacagagaggaaaactgaagctcaaagagataccaaatcactgtatttgcccaaatcacatggtgatgaagtatcagagaagggacttgaacaagatcttcctcagccttgaaccacactcttaactggcacactgcctcctttaaaaaatatttcatctttctttctttctttctttctttctttctttctttctttctttctttctttctttctttctttccattcccactgttactgaactaagttttgtaatctgtcacatttttattgctacacaaaatccttttgtgtatctcttctcctcccaacctatattttaaaaatttcatctaaaaaaaagtctaactgtaagtcatgccttag

SEQ ID NO: 4100 - DNA, 408 bp, Homo sapiens
  AC016746.6_54220
  Located on chromosome 2
  Distance between a terminus base of telomere on chromosomal short arm and 5'-terminus of this base sequence : 199031824
  Distance between 3'-terminus of neighbour sequence of sequence listing upward to telomere on chrosomal short arm and 5'-terminus of this base sequence : 143909
gaactgacatttgaaatgttatttattatgaatttaagtttttcatctggaaatcttaaacatgaaaaactgggcagggttttcttttctaacagttccaggtttatttgtaaatgtttacatattattttattttatacacacacacacacacacacacacatacacgatttgttcttggtataaccatgaagcacaaatccaggaacacaaaatataaggtgacaaaatgaacacacacgatttgctcttggtataaccatgaagcacaaatccaggaacacaaaatataaggtgacaaaatgtattaaaatgctttttattgaatttgataatatatgaataatagagatcatgaactatttctggaaaatattcaatagactgaggatatgctacaatgtttat

SEQ ID NO: 4101 - DNA, 367 bp, Homo sapiens
  AC016746.6_82571
  Located on chromosome 2
  Distance between a terminus base of telomere on chromosomal short arm and 5'-terminus of this base sequence : 199055627
  Distance between 3'-terminus of neighbour sequence of sequence listing upward to telomere on chrosomal short arm and 5'-terminus of this base sequence : 23395
cacttaaagatttaattgtgcatttactatctttaaaaaaaaaaaaaaaagatacagcttgaagaattaaagctccaggaaagaaaaaagaaaagtagaagatatgagtgttaatgtgcgaatgcacacacacacacacacacaaacacacacacacattctgtagtggcaattctgaaaacactagagtgaagagtttccaatctttctgaatctggaattacactccagcctattaaaagaggacactctcttactttctcttataacagcaagtaaatgggatctaacaaatgaccttgaagctgcatgattcttttgattttcagccgaagaggatatgtcaaagtactttaacaatcctatt

SEQ ID NO: 4102 - DNA, 403 bp, Homo sapiens
  chr2.fa.O7frz.208375141
  Located on chromosome 2
  Distance between a terminus base of telomere on chromosomal short arm and 5'-terminus of this base sequence : 199105560
  Distance between 3'-terminus of neighbour sequence of sequence listing upward to telomere on chrosomal short arm and 5'-terminus of this base sequence : 49566
taatttcattatgctggaacacaactgactataacataacatgggccaagtgcggtgactcacacctgtaatcccagcactttgggaggctgaagcaggcggatcatgaggtcaggagatcgagaccatcctggctaacatggtgaaaccctatctctactaaaaatacaaaatattagccaggtatggtggcaggtgcctgtggtcccagctactccggaggctgaggcaggagaatggcgtgaacccgggaggcggagcttgcagtgagcggagatcacgccactgcactccggcctgggggacagagtgagactccgtctctcacacacacacacacacacacacacacacacacactcacaaaaaaaaataaataaaataacatgacctgctgtcttta

SEQ ID NO: 4103 - DNA, 243 bp, Homo sapiens
  AC017096.5_12553
  Located on chromosome 2
  Distance between a terminus base of telomere on chromosomal short arm and 5'-terminus of this base sequence : 199139834
  Distance between 3'-terminus of neighbour sequence of sequence listing upward to telomere on chrosomal short arm and 5'-terminus of this base sequence : 33871
atatgtacagactttgctggttacaaccctctgggaaaggatgatattgcttattttctgcaggggttaaaaaacagatgccttaagggacatctatgtagttccaacacacacacacacacacacacacacacacacacacacacactgcactacagatgatcttgagtatacaatggtcagtgggtttcttctgatggaacataaggcttccaaaattacttgaaacatcaaattatgctc

SEQ ID NO: 4104 - DNA, 403 bp, Homo sapiens
  chr2.fa.O7frz.208522566
  Located on chromosome 2
  Distance between a terminus base of telomere on chromosomal short arm and 5'-terminus of this base sequence : 199251561
  Distance between 3'-terminus of neighbour sequence of sequence listing upward to telomere on chrosomal short arm and 5'-terminus of this base sequence : 111484
atctggtcctggacttatacagtatattctcttattttctggctttattcattcagcattattattatgagatccatgttatgtgtatcaatagcccatccctttttattgctaagcattattccatcatacgggtatatcacaatttgtatatccattcacctgttgatggccatttggattgtttccaatttttggctatttgtattggcttggttctccagagtgacagaatcaagagtatatatatatatatatatatggatatatgagaggagacttattaggggggttagctcacactattatggaggatgagaagtcctgcaacatgccatctgcaaacaagagaccctggggtgctggtagcatggctcagtccaagtagaaaggccttgaaacc

SEQ ID NO: 4105 - DNA, 426 bp, Homo sapiens
  chr2.fa.O7frz.208692641
  Located on chromosome 2
  Distance between a terminus base of telomere on chromosomal short arm and 5'-terminus of this base sequence : 199470707
  Distance between 3'-terminus of neighbour sequence of sequence listing upward to telomere on chrosomal short arm and 5'-terminus of this base sequence : 218743
cctgtggaaggagatagaatagaatacatatttggcagacaaaatgtcacataccatgtttgtgaggtattgtttttttttcttgttttttgtttgtttgtttgtttgttttgagaaggagtctcgctctgtcgcccaggctagcatgcagtggcgccatctcggctcactgcaagctccgcctcccgggttcacaccattctcctgcctcagcctcccgagtagctgggactacaggcgcccgccaccacacctggctaattccttttttgtatttttagtagagacagggttccaccatgttagccaggatggtctcgatctcctgacctcgtgatcttgccgcctcagcctcccaaagtgctggaattacaggcatgagccactgcgccaggcctttgtgaggtgtcgttaatttgctctacc

SEQ ID NO: 4106 - DNA, 437 bp, Homo sapiens
  AC012529.2_121331
  Located on chromosome 2
  Distance between a terminus base of telomere on chromosomal short arm and 5'-terminus of this base sequence : 199555043
  Distance between 3'-terminus of neighbour sequence of sequence listing upward to telomere on chrosomal short arm and 5'-terminus of this base sequence : 83910
gcagactttgcgtaaagataagtaatatgcatagctccttagtttcccccaagatcattaaaaacctgatattaatgatgtatagtgacgtcagtttcttttgttgttgttgttgttgtttgtgggttttttgtttgtttgtttgtttgtttgtttgttttttggtttttggaggttttctttgtgacaggatctcacgctgtctcccaggctggagtacagtggtgatcacagctcactgcagcctcaacctcctgggctcaggtcctcccacctcagcctcctgagtagctgggactacagacacctgccaccatgcctggctaattgtgtgtgtgtgtgtgtgtgtgtgtgtgtgtgtgtgtgtgtattttttgtagaaacaggtttttgccatgttgcccagcctggtcttgaactcctagactccaagcagt

SEQ ID NO: 4107 - DNA, 349 bp, Homo sapiens
  chr2.fa.O7frz.208872966
  Located on chromosome 2
  Distance between a terminus base of telomere on chromosomal short arm and 5'-terminus of this base sequence : 199611193
  Distance between 3'-terminus of neighbour sequence of sequence listing upward to telomere on chrosomal short arm and 5'-terminus of this base sequence : 55713
acgactgctagacatcagaattttaatgattatttttaattggttatatggatgatttttctatcttacctgtacctttgtatatagaatttttgtagtatttactagtttttatttttaaatagagaaaatgtgcatgttgctaaaagttcagattatttacggttttacattgaaaagtaattctttcaccccattccctccagttgcccatttcccttccccaaggctgccactgttatttttatatatatatatatatatatatgcttccagagacattctatacttatgtgtttttttccttattctttttctcttttttttgaggcaaggtctaactctattg

SEQ ID NO: 4108 - DNA, 317 bp, Homo sapiens
  AC037452.2_126981
  Located on chromosome 2
  Distance between a terminus base of telomere on chromosomal short arm and 5'-terminus of this base sequence : 199679821
  Distance between 3'-terminus of neighbour sequence of sequence listing upward to telomere on chrosomal short arm and 5'-terminus of this base sequence : 68279
ttactcagactctgaaggtatgactgactgagaattgggttcactaggttctggcctatacaggagcttttttggaaaacaaccaaaattacacacacacatagacacacacatacacacagacacacataaacacacacacacacacacacacacacagtcgtgtgctgcataatgacttttcagtcatttcagatggaccacagatatgatggcggtcccataggattctaatactgttttaacatacctttcctgtttagataggtttagatacacaaatactcaccattgtgctataactgcctacagtattc

SEQ ID NO: 4109 - DNA, 423 bp, Homo sapiens
  AC037452.2_51987
  Located on chromosome 2
  Distance between a terminus base of telomere on chromosomal short arm and 5'-terminus of this base sequence : 199722572
  Distance between 3'-terminus of neighbour sequence of sequence listing upward to telomere on chrosomal short arm and 5'-terminus of this base sequence : 42434
aacagagtagactataaggcctgactgatgcagaaagtgaggagagggaggttttctgggggagggggaagtaatttatttatttatttatttattttgagacagagtcttgctctgtcacccaggctggagtgcagtagcaacatctcggctcactgcaaactccgcctcctgagttcacgtcattctcctgcctcagcctcccgagtagctgggactacaggcgcccaccaccatgtctggttaattttttgtatttttagtagagacggggtttcaccgtgttagccaggacggtctcgatctcttgacctcatgatccgcccgcctcggcctcccaaagtgctaggattacaggtgcgagccaccgcgcctggccaatttgtttgagcttctgtaatgttgagtggtagatctgagcat

SEQ ID NO: 4110 - DNA, 416 bp, Homo sapiens
  AC037452.2_17812
  Located on chromosome 2
  Distance between a terminus base of telomere on chromosomal short arm and 5'-terminus of this base sequence : 199727463
  Distance between 3'-terminus of neighbour sequence of sequence listing upward to telomere on chrosomal short arm and 5'-terminus of this base sequence : 4468
cagaaagattgtccaaatttagactctcaacataaggtataaatatacttattttatcaaattatccccagtattatcattatttaaaaatcactattaatctgatagttgaaaaatagaggctggaaatgggtgggtgtgcttgggagccttagtgcctgggttcagaggtcagtcctgcctataatccctgtcttttgggagaccaagtcaggaggatcacttgaggccaggagttcaaaacagcctgggcaacatagcaacatagggagacctcatctctacaaaagtgttattattattattattattattattagctaggcatggtggtgtgtgcctgtagtcctagctacatgggaggctgaggtgggggactcgcttgagcccaagatttcaaggctacagtgagctat

SEQ ID NO: 4111 - DNA, 350 bp, Homo sapiens
  AC004464.1_42829
  Located on chromosome 2
  Distance between a terminus base of telomere on chromosomal short arm and 5'-terminus of this base sequence : 199753592
  Distance between 3'-terminus of neighbour sequence of sequence listing upward to telomere on chrosomal short arm and 5'-terminus of this base sequence : 25713
aatcagtaatagcatctgtagcaggtgtggaaaaacctttttgtttctaagcaccactgacctgccaaaaatttaatcaaagattttgtgtaagtacaagacaactgattgtgagtttttgttgttgtcatttggagatggacatagatagatagatagatagatagatagatagatagatagatagatagatagaatagctctataaattaagatatgtatatatatgattattctataaattaaaagcggacacattatatatagaatacaaaaacattcaataaattagaacatatagaaatcaacctattacagttccatagtatagtcagttctttaaccaaagg

SEQ ID NO: 4112 - DNA, 280 bp, Homo sapiens
  D2S1367
  Located on chromosome 2
  Distance between a terminus base of telomere on chromosomal short arm and 5'-terminus of this base sequence : 199753680
  Distance between 3'-terminus of neighbour sequence of sequence listing upward to telomere on chrosomal short arm and 5'-terminus of this base sequence : -262
tgtaagtacaagacaactgattgtgagtttttgttgttgtcatttggagatggacatagatagatagatagatagatagatagatagatagatagatagatagatagaatagctctataaattaagatatgtatatatatgattattctataaattaaaagcggacacattatatatagaatacaaaaacattcaataaattagaacatatagaaatcaacctattacagttccatagtatagtcagttctttaaccaaaggggcagaattccactaagt

SEQ ID NO: 4113 - DNA, 313 bp, Homo sapiens
  DISO7_00012842
  Located on chromosome 2
  Distance between a terminus base of telomere on chromosomal short arm and 5'-terminus of this base sequence : 199990877
  Distance between 3'-terminus of neighbour sequence of sequence listing upward to telomere on chrosomal short arm and 5'-terminus of this base sequence : 236917
ggcctgtctgatggaactggagccacagaggagatgcagtctccacaaaggatgctgccctgggctggcagaaaatgagagagagaaccccctcatttctctgtacccacctcagacccttcctacacacaaacacacacacacacacacacacacacacacacacacacacacagagcagagaatggatttgggggaagacagacagggccttcccagagggtctactaaatagctagtggtagatgagacagactagctttgtgccttcgttgagcttacagtctaatagattgaccaggtgaagcttaac

SEQ ID NO: 4114 - DNA, 323 bp, Homo sapiens
  DISO7_00012845
  Located on chromosome 2
  Distance between a terminus base of telomere on chromosomal short arm and 5'-terminus of this base sequence : 200197349
  Distance between 3'-terminus of neighbour sequence of sequence listing upward to telomere on chrosomal short arm and 5'-terminus of this base sequence : 206159
tgatgccattgtacgaccccccgcccccaccagagttcatcatctggtttcccaatggtaggatagaacagaacagagcagaacagggctgtgtgtgtgtgtgtgtgtgtgtggggggtgtgtgtgactgtgtatgtgtgtctgtgaattgcttctggatccatggtgagactccctttctagctccaccccactattccccaccccaccgacgtacacacacatccctacacagatacacacacctacatacacatacacactgttcctaccattaaattttgcaatctgtggcacattatagaatggacataggtgaaagc

SEQ ID NO: 4115 - DNA, 344 bp, Homo sapiens
  AC012459.6_171775
  Located on chromosome 2
  Distance between a terminus base of telomere on chromosomal short arm and 5'-terminus of this base sequence : 200354688
  Distance between 3'-terminus of neighbour sequence of sequence listing upward to telomere on chrosomal short arm and 5'-terminus of this base sequence : 157016
acatgtcctcaagcagagtagcttaaccatatatttgtagtttgggcttctggctccacatctgtagattctccccatatctccccaacagcttgtctcgaacagtctttgtttccctaaagtaaggtagcagtgcccctctctaagaaggttgtaaataatgaaaacatacatacacacacacacacacacacacacacacacacacacagatgcctctgtcatggctatgtttgtgaacttggcagagaagctcataatcacaggagcacaaagcctattgactcaacccggcatttcatacaattactgaatatatgctggttgattacatagacagtctc

SEQ ID NO: 4116 - DNA, 460 bp, Homo sapiens
  AC012459.6_36122
  Located on chromosome 2
  Distance between a terminus base of telomere on chromosomal short arm and 5'-terminus of this base sequence : 200365903
  Distance between 3'-terminus of neighbour sequence of sequence listing upward to telomere on chrosomal short arm and 5'-terminus of this base sequence : 10871
ccaggaaggcaagtataagtatttacaacaaaataggaagaaattttaaaattccccttatccactttttcacccagtatactacacacacacacacacacacacacacacacacgccttccagcttcttacccacttccaggaaactagagtggttgcaagacacagctgctgctagctttgaaagtaagattgcaaattggggcataaaactgcttggcaatgattgacagtggcaagtgacttttcaactccctccctcctggttgggcatgaaagcgggccccatggggaagaggacctcacctgagggtgctgagggcgtcagtggcctttccctcctcagcttctctgctctggcctttgtggcctcccacccagccaattgcagtggcctccacactagtctctctgcctacactgtctcccttcagcctcgtactccactaagaccagacgt

SEQ ID NO: 4117 - DNA, 136 bp, Homo sapiens
  D2S116
  Located on chromosome 2
  Distance between a terminus base of telomere on chromosomal short arm and 5'-terminus of this base sequence : 200701217
  Distance between 3'-terminus of neighbour sequence of sequence listing upward to telomere on chrosomal short arm and 5'-terminus of this base sequence : 334854
caatctccacaagttgctcataatccacaaaaattgaggaaatacacacacacacacacacacacacacacacacaatccaatcctcttctccttggccctaatgctcttcttcccactcctaaattatctatccc

SEQ ID NO: 4118 - DNA, 204 bp, Homo sapiens
  D2S309
  Located on chromosome 2
  Distance between a terminus base of telomere on chromosomal short arm and 5'-terminus of this base sequence : 200967153
  Distance between 3'-terminus of neighbour sequence of sequence listing upward to telomere on chrosomal short arm and 5'-terminus of this base sequence : 265800
gctctagtaggctggttacataagaagaaacacacacacacacacacacacacacacacacacacacacacacacgcataaaagcaacacacacacacacacgcataaaagcaaagatttaactggtactcaaaacactacagaattccacctaaaatagaaccagaaattttctttgtgactgagattgcattattcttggaa

SEQ ID NO: 4119 - DNA, 103 bp, Homo sapiens
  DISO7_10001031
  Located on chromosome 2
  Distance between a terminus base of telomere on chromosomal short arm and 5'-terminus of this base sequence : 201030027
  Distance between 3'-terminus of neighbour sequence of sequence listing upward to telomere on chrosomal short arm and 5'-terminus of this base sequence : 62670
gtggttgttggttctcaaagtctatttcctagggggggaaaaatatatatatatatatatatatatagtgttagctccagccaccagtgagtcaggagaggct

SEQ ID NO: 4120 - DNA, 404 bp, Homo sapiens
  AC074016.4_50887
  Located on chromosome 2
  Distance between a terminus base of telomere on chromosomal short arm and 5'-terminus of this base sequence : 201213565
  Distance between 3'-terminus of neighbour sequence of sequence listing upward to telomere on chrosomal short arm and 5'-terminus of this base sequence : 183435
ttaaataacctgttcctgaatgattattgagtcaacaatgaaatcaagatggaaatttaaaaaaattcttcaaactgaatgacaacagtgacataaaacctatcaaaacctctgggatacagcaaaggcagtgcaaagaggaaagctaaaagccctaaacacttatataaaaaagtctgaaagagcaaaaacagacaatataaggtcacacctcaaggaactagagaaacaagaacaaaccaaacacaaacccagcagaagaaaggaaataaccaagatcagagcagaactgaatgaaatcaaacaaacaaacaaacaaaaaatacaaaagataaatgaaacaaaaagctggttctttgaaaagataaataaaattgatagatcattagcaagattaaccaaga

SEQ ID NO: 4121 - DNA, 477 bp, Homo sapiens
  AC007256.2_111589
  Located on chromosome 2
  Distance between a terminus base of telomere on chromosomal short arm and 5'-terminus of this base sequence : 201242787
  Distance between 3'-terminus of neighbour sequence of sequence listing upward to telomere on chrosomal short arm and 5'-terminus of this base sequence : 28818
tcggtgctagcttgactataggtgcatgacccattctcttcctgcagagggctgtggataagcagggaaaagaaagcagaggctgaatgcccctgggtgggaagacaagataagcagggtgaatgcccctggcccctgggtggccctctgggccaggtcagatcagggagactccatggcatggcctcattctacttgaggggccttcagactcaccctcaacctgaatcccttccccagatgtaaccactgctaacggtttggttgaattctgccaatacactagcagataggtagatgattgtgtgtgtgtgtgtgtgtgtgtgtgtgtgtgtgtatgtgtgtgtgtgttttctattgttggtcttttagacttgtgtgttgaaaaaataattcttacagcaaaatcagcctgagggaagaggcacttggagagccattcagtagtgcagttaagaagtaagatgcctgaacatg

SEQ ID NO: 4122 - DNA, 357 bp, Homo sapiens
  chr2.fa.O7frz.210941171
  Located on chromosome 2
  Distance between a terminus base of telomere on chromosomal short arm and 5'-terminus of this base sequence : 201418785
  Distance between 3'-terminus of neighbour sequence of sequence listing upward to telomere on chrosomal short arm and 5'-terminus of this base sequence : 175521
tctgaattctaccaaagtttaaagaagaattaataccaattcttctcaaactattccaaaaaattgaagcagataaaactctttgtattagtttgttctcacactgttataaaaaactacctgagactgggtaatttatgaagaaaagaggtttaattgactcacagttccacaggcttaacaggaagcatggctgggaggcctcaggaaacttacaatcatggcaaaaggtgaggaaaagcaagcaccttcttcacatggtggcaggagagagagacagacagagagagagagagagagagaaagagacacacagagagaggtgcccacacttttaaaccatcagatctcctgata

SEQ ID NO: 4123 - DNA, 226 bp, Homo sapiens
  chr2.fa.O7frz.211023872
  Located on chromosome 2
  Distance between a terminus base of telomere on chromosomal short arm and 5'-terminus of this base sequence : 201501680
  Distance between 3'-terminus of neighbour sequence of sequence listing upward to telomere on chrosomal short arm and 5'-terminus of this base sequence : 82538
agattctcatgtcttgttctgtactttgaaaacagaataacagatttttctggttctcagcctagatactgcgtcctccctctgtgtggtgtgtgtgtgtatgtgtgtgtgtgtgtgtgtgtgtgaaagagagaggggggtgtttgcttttgtttctaggaggttttttggatcggggaggggcgcaggatcaattttcagactttagcatgatctagcaataaat

SEQ ID NO: 4124 - DNA, 194 bp, Homo sapiens
  D2S2309
  Located on chromosome 2
  Distance between a terminus base of telomere on chromosomal short arm and 5'-terminus of this base sequence : 201656302
  Distance between 3'-terminus of neighbour sequence of sequence listing upward to telomere on chrosomal short arm and 5'-terminus of this base sequence : 154396
tgcttcttattgtacccaaagatctcaaagggaatatacacattccttcatttgtcctaaactaaaatacaaatataatgtgtgtgtgtgcgcatgtgtgtgtgtgtgtgtgtgtgtgtttgtttgtatattttaacattggcatctgacttcctaaaggaaataattcctggtacctagcgaagtgcctgaca

SEQ ID NO: 4125 - DNA, 280 bp, Homo sapiens
  D2S2214
  Located on chromosome 2
  Distance between a terminus base of telomere on chromosomal short arm and 5'-terminus of this base sequence : 201763618
  Distance between 3'-terminus of neighbour sequence of sequence listing upward to telomere on chrosomal short arm and 5'-terminus of this base sequence : 107122
agcaaacagttttgaggacatgagtgaatgtgtgtgtgtgtgtgtgtgtgtgtgtgtgtgtgtgtttggggtgagggtgaagggcacgtaggagaaaaagagttacagattttggcagtgcagttttcaagttactgcttcagatagcgaaataaggctaacaacattatcaactatttaaatatacggtatctcaagaatgcattgtattcaggaaattccagaggtgtagttcagtagacagcactataagataaccttagggtgattgtggcaagac

SEQ ID NO: 4126 - DNA, 234 bp, Homo sapiens
  AC007358.2_116118
  Located on chromosome 2
  Distance between a terminus base of telomere on chromosomal short arm and 5'-terminus of this base sequence : 201814871
  Distance between 3'-terminus of neighbour sequence of sequence listing upward to telomere on chrosomal short arm and 5'-terminus of this base sequence : 50973
ctacaggacgtggtatttgtaggggtgaagatattgggggtcacatttgtcagaccttaaaagatcagatcagtgtttagtcctgttaattaccaagtcatagaacactttgtgagatgttattctattatcactactgggcacacacacacacacacacacacacacacacacacacacacacacaaaactacctttaacttgccacattaagatttctacagaaatggagtc

SEQ ID NO: 4127 - DNA, 371 bp, Homo sapiens
  AC007358.2_21338
  Located on chromosome 2
  Distance between a terminus base of telomere on chromosomal short arm and 5'-terminus of this base sequence : 201909719
  Distance between 3'-terminus of neighbour sequence of sequence listing upward to telomere on chrosomal short arm and 5'-terminus of this base sequence : 94614
atgccagacaaggtctagatacttagaaaagaaaagaaagagagagaaagaaagaaagaatgaaagaaagaatgaaagaaagaaagaaagaaagaaagaaagaaagaaagaaagaaagagaaaagaaaaagagagggagggagggaggaaggaaggacagacagacggatggacagaaggaagaaaggaaggaaggaaggacccattctaaactagggaaatatgatatagatcgatcaacaagaattcttggccaggtgcagtgtctcacgcccgtaatcccaacactttgggaggctgaggcaggtgggtcacttgaggtcaggagtttgagaccagctctcaaactttagtaaagacagatggtgaaa

SEQ ID NO: 4128 - DNA, 361 bp, Homo sapiens
  AC069148.2_132366
  Located on chromosome 2
  Distance between a terminus base of telomere on chromosomal short arm and 5'-terminus of this base sequence : 201959805
  Distance between 3'-terminus of neighbour sequence of sequence listing upward to telomere on chrosomal short arm and 5'-terminus of this base sequence : 49715
ccagccatgaactatttatctatttatccctattatactgtttaatctctccccaaaacattcttgtagaaggtgctctctctctctgtctctctctctctctctctctgtgtgtgtgtgtgtgtgtgtgtgtgtgtgtgtgtgtgtggttttgttttttttttgagatggagtgtcgctcttgttgcccaggctggagtgcaatggcgcgatgtcagctcacctcaacctccacctcccgggtttaagcgattctcccgcctcactctcccaagtagctgggattacaggcatgtgccaccatacccggctaattttgtatttttagtagagatggggtttctccatgttagtcaggctg

SEQ ID NO: 4129 - DNA, 310 bp, Homo sapiens
  AC069148.3_149714
  Located on chromosome 2
  Distance between a terminus base of telomere on chromosomal short arm and 5'-terminus of this base sequence : 202066974
  Distance between 3'-terminus of neighbour sequence of sequence listing upward to telomere on chrosomal short arm and 5'-terminus of this base sequence : 106808
aaagacagtgaattcatggagttcttccccatttacatgtcataaggaccctcctttaaaagcatcatgagcctaactcaaaatgtgttaagcaaaaataaagaaaaggaaaggggaaaaaggaaggaaagatggaaggaagggagacacagaaggaaaaggaaagaaggaaggaagggaagaaatgaaggaaggaagggaaggaagggaagaaaggaagaaaggaagggagggagggagagaggaaaggaaggagggaaggaagggaaggaaggaaggaaggaatttgttcatgcaagaatcaggtaac

SEQ ID NO: 4130 - DNA, 450 bp, Homo sapiens
  AC009960.7_36456
  Located on chromosome 2
  Distance between a terminus base of telomere on chromosomal short arm and 5'-terminus of this base sequence : 202311896
  Distance between 3'-terminus of neighbour sequence of sequence listing upward to telomere on chrosomal short arm and 5'-terminus of this base sequence : 244612
gcattggacaaatttatgaaatagagctatttaatttaaaaagattaataatggagttgaattgtttggctttaaagacattaggcattacacattagtttatatatatcaagtgtgtgtatatatatatacacacacacacacatatatatgtatcgtgtgtgtgtgtatatatatatataaataaaatttttatttatttatttatttatttatttattttttattgataattcttgggtgtttctcacagagggggatttggctgggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcac

SEQ ID NO: 4131 - DNA, 450 bp, Homo sapiens
  AC046191.2_3768
  Located on chromosome 2
  Distance between a terminus base of telomere on chromosomal short arm and 5'-terminus of this base sequence : 202507460
  Distance between 3'-terminus of neighbour sequence of sequence listing upward to telomere on chrosomal short arm and 5'-terminus of this base sequence : 195114
tccagtgtctttggctaatattttgttgaggatttttacatttatattcatgaggtatattggtttgtagtgttctgttcttataatgcctttgcttggtttagatattgggggaaagttggctttataaaatgagttgagaagtgttcccttccttatctgtttttagaagaggttatgtagcattgatagtatctcttccttgactgccaaaatttccccagtgaaatcatcttggcctggagtgggtgcgggaagagagtgagagagagagagagagagagagagagagagagagagagagagagagagagagagtgtgtgtgtgtgtgtgtgtgtgttgaagactagtttagtgtggtaatgagaaggggagaaagagtagaacagggagtttgatctgtaagacagtgaacaatcaattgggagaactcactacctttggaatgt

SEQ ID NO: 4132 - DNA, 441 bp, Homo sapiens
  AC046191.2_137087
  Located on chromosome 2
  Distance between a terminus base of telomere on chromosomal short arm and 5'-terminus of this base sequence : 202543552
  Distance between 3'-terminus of neighbour sequence of sequence listing upward to telomere on chrosomal short arm and 5'-terminus of this base sequence : 35642
tgttgaattaatgtaccggtaggcaactgaagcaacaatggtcatagttagggaagaaaagtgccagacagcttttagccatttgatataatgcatatataccagtttacattgtgtgtgtgtgtgtgtgtgtgtgtgtgtgtgtgtgtgtgtgtgtgtgtgcgcgcgcgcctccccaccctgccagctgagactagttttcttgcgactatcccgaaagggatttttttttagttagaggaaaaattgtgaacatgtatatttattgcgtttcacttgtcacagttaataatgtgggtacatattttcctgaaaatgagtatatactgcatttgttttctgaaaatgtgctacaaaaggaaaactgaacatggagagataggtagcatttataacaattacgtattagtgaaataactgtgccatagtgaaataactgag

SEQ ID NO: 4133 - DNA, 441 bp, Homo sapiens; identical to SEQ ID NO: 4132
  AC009960.6_137154
  Located on chromosome 2
  Distance between a terminus base of telomere on chromosomal short arm and 5'-terminus of this base sequence : 202543552
  Distance between 3'-terminus of neighbour sequence of sequence listing upward to telomere on chrosomal short arm and 5'-terminus of this base sequence : -441

SEQ ID NO: 4134 - DNA, 456 bp, Homo sapiens
  AC010900.9_196433
  Located on chromosome 2
  Distance between a terminus base of telomere on chromosomal short arm and 5'-terminus of this base sequence : 202847052
  Distance between 3'-terminus of neighbour sequence of sequence listing upward to telomere on chrosomal short arm and 5'-terminus of this base sequence : 303059
tttaactatcagaatgcttcattgttttaaacaaatcttaaaatgtgggaaagaaaaaatattctattttaataatttgagaaaatttctcataaaaaaccttgtgctatatatattacatttgttaggacattattgttgttgcttttctaagtagagtacatgtatgtatatacatatatgtgtgtgtgtgtgtgtgtgtgtgtgtgtgtagttttagctttttgtccccctaccttttgttagtcatggtttttcagtggtttcctaaagttactgttgtgattgtttgatgagggttttaaaaatcattattacaagcctcatggaatgctatggatattagagcatttattaaaacaatcatgcaaccaaatcaccttatgttacaactatagtgcattgtgtggcttacctaaaatcatcgtatatcttgtaagaaactgagtactcctg

SEQ ID NO: 4135 - DNA, 424 bp, Homo sapiens
  AC010900.9_167804
  Located on chromosome 2
  Distance between a terminus base of telomere on chromosomal short arm and 5'-terminus of this base sequence : 202875701
  Distance between 3'-terminus of neighbour sequence of sequence listing upward to telomere on chrosomal short arm and 5'-terminus of this base sequence : 28193
tgcattagagtttctaattctgagacccaccagcttgtgtttcatcttctttatatcctgtcagaatacatacttaatcatgtgggtatgagaaagatgttgtttaacttgtaccaggtttaaaaaaagaggtttaaaaaatgtctgtgcgtatatatatatatatatatatatatatatatatatatatagcaacttgatgtatagtgtccttgttaccatgtatttttttcattaaaaatcctgctttttttttatacttgttagttttctttttatatttttcttagagatagtggcaattttgttcatcttgaagatgctgaataaacacttgaatacccgagaattttggccagagatttatgtccaatttggaacctgaaagttttaagcataactacaagtaactcctgttagcatt

SEQ ID NO: 4136 - DNA, 436 bp, Homo sapiens
  AC023271.8_132974
  Located on chromosome 2
  Distance between a terminus base of telomere on chromosomal short arm and 5'-terminus of this base sequence : 202976437
  Distance between 3'-terminus of neighbour sequence of sequence listing upward to telomere on chrosomal short arm and 5'-terminus of this base sequence : 100312
cctatggtaaagagtcacatacagtgaattttgtatgtgcctctataacatctctgtagaggtcgcttcaaaaatctgccctttctctagagggcctccgtttttgtttctttttttcctcagagcctgtgtgtgtgtgtgtgtgtgtgtgtgtgtgtgtgtgtgtgtgtgtttctcttcccttctctttgtgttggttgttttgtgtcattctgcttatttatctctgtctctatgctctgcaagctccttcaccaatatattatgatttcttattgtgttcccatgtaaggttgttaaatacaaatattattaactgatagttccttttagaagtaaaacgttttcattagagctaaactaggaaattcagataagtaaaaagaaaagttatttatatcctgccactcactcataacgaacattaattgtttgg

SEQ ID NO: 4137 - DNA, 438 bp, Homo sapiens
  chr2.fa.O7frz.212652742
  Located on chromosome 2
  Distance between a terminus base of telomere on chromosomal short arm and 5'-terminus of this base sequence : 203144037
  Distance between 3'-terminus of neighbour sequence of sequence listing upward to telomere on chrosomal short arm and 5'-terminus of this base sequence : 167164
tcactgactcttaaattgttcatattttaaaaacagtttgctgggtgcggcagctcatgcctgtaatctcagcactttgggaggctgaggcaggcggatcacttgggatcaggagttcgagaccagcctggccaacatgttgaaaccccgtctctactagaagtacaaaattagccaggagtgttggcacacgcctgtaatcctagctacttgggaggctgaggcaggagaattgcttgaaactcggaggcggaggttgcagtgagccgagatcatgacattgcactccagcctaggcgagaagagtgaaactctgtctcaaaagaaaactatatatatatgtgtatatatatatatatatatatataaaaaataaaaaataaaaacaagggaattatgaaaaacagttgccatgctttcagctacaattctttacct

SEQ ID NO: 4138 - DNA, 432 bp, Homo sapiens
  chr2.fa.O7frz.212838328
  Located on chromosome 2
  Distance between a terminus base of telomere on chromosomal short arm and 5'-terminus of this base sequence : 203227457
  Distance between 3'-terminus of neighbour sequence of sequence listing upward to telomere on chrosomal short arm and 5'-terminus of this base sequence : 82982
gtgttaaacctcaacatttatcacttgtatttatggataattttttcaaaatgtggtcaaaacaagcttattgaactcagttttcccctcaactttattaataagtaaatatatatatatatatacacacacacacacacacacacacacacacacacacatttttttttaacctgtcactgacttggagctcaaggaaattttattttgaagtggtacgcttttgaattacctttattgtagctacattcatctcagaaaatgtcgggaagtgctgatgatctcttactgtttataaatactcatgttttggtggctcttatttctttagcagcagtgggagtagtggagggagccacccaagtagtcggagcagcagtcgagagaacagtggaagtggtagtgtgggggttcctattgctgttcctactc

SEQ ID NO: 4139 - DNA, 377 bp, Homo sapiens
  AC018891.3_88363
  Located on chromosome 2
  Distance between a terminus base of telomere on chromosomal short arm and 5'-terminus of this base sequence : 203266065
  Distance between 3'-terminus of neighbour sequence of sequence listing upward to telomere on chrosomal short arm and 5'-terminus of this base sequence : 38176
gtttactgacataactggcaagagtaacttggaaaataacttaatccagcagaacaaaaacatcctcagaaaaacatcctcagtagtactgaatatatctctctcatatatctatctatctatctatatatatatatatatatatatagctttgcacaatcagggagcaaggcacataatgaaatgagcatacatttatgcagaagaaaataatagcaacaaagctgcgagaaaaattgtaacttcatcttcactgagctgtgcataatcctttgaataataatgtcctctacctggtacattataatgaagttccttgtcttcttcatgctttaaaaaagtatacttctacattgtatctacctatggcaaagctc

SEQ ID NO: 4140 - DNA, 422 bp, Homo sapiens
  AC018891.3_6340
  Located on chromosome 2
  Distance between a terminus base of telomere on chromosomal short arm and 5'-terminus of this base sequence : 203313550
  Distance between 3'-terminus of neighbour sequence of sequence listing upward to telomere on chrosomal short arm and 5'-terminus of this base sequence : 47108
taacagaacaagcactcaatttttctattttgcccccttttctctttattctactctccttctactggatattatatagccggtaaatctgtaaatgtttttaaaactatttctttttgttttatagcccctattcattttaaatagatgaatatatatatatatatatatatatatacacattttttttttgagatggaggctcgctctgtcacccaggatggagtacagtggcatgatcttggctcactgcaacctccacctcctagattcaagtgattctcctgcctcagcctcccgagtagctggaattgcaggtgtctgccaccacgccaggataatttttttttttttttgtatttttagtagagacggggtttcaccatgttggccaggctggtctcgaacttctgacttcaaac

SEQ ID NO: 4141 - DNA, 264 bp, Homo sapiens
  AC018891.3_31014
  Located on chromosome 2
  Distance between a terminus base of telomere on chromosomal short arm and 5'-terminus of this base sequence : 203384811
  Distance between 3'-terminus of neighbour sequence of sequence listing upward to telomere on chrosomal short arm and 5'-terminus of this base sequence : 70839
tatgcatatgatagcaatgctaagtaaaagttatattataattagaatatatggtaatgtaggatgagtaatatgtgtgtgtgtgtgtatgtatgtgtgtgtgtgtgtgtatatatatatatatatatatataacagagattctttgctattaccacaacaaatcatgggaaaccacaagggcttttcatgcatttttctatttaaagggccgtctatatagaatatttgtcaaatccctaccatgtactaagtgaaagatttc

SEQ ID NO: 4142 - DNA, 127 bp, Homo sapiens
  HUMUT426
  Located on chromosome 2
  Distance between a terminus base of telomere on chromosomal short arm and 5'-terminus of this base sequence : 203527723
  Distance between 3'-terminus of neighbour sequence of sequence listing upward to telomere on chrosomal short arm and 5'-terminus of this base sequence : 142648
ttttcttcttggcattcccagtgcgctgtataaagagtgcaatggagattatagcagggagacctggtttagatgggtcagaagtggggagtgtgtgtgtgtgtgtgtgtagccaatggtggctgga

SEQ ID NO: 4143 - DNA, 338 bp, Homo sapiens
  G09915
  Located on chromosome 2
  Distance between a terminus base of telomere on chromosomal short arm and 5'-terminus of this base sequence : 203578664
  Distance between 3'-terminus of neighbour sequence of sequence listing upward to telomere on chrosomal short arm and 5'-terminus of this base sequence : 50814
agccgacttgaattctccttgcttccttccttccttccttccttccttccttcctcccttccttccttccagttcttgtcatgtgagacagtaaataactttattgtttaagcccttttgggttagattttctattacatgaagtttaaagcattctgataacttcatgtttattgatgtgtataaatactaatatattctattatttgggggatacaaagaatttgactcaatagtatcttgttctattgacatgttcaattattaatcactgataaccctgaataactaaatgttattaccacatttaggacaatatccacgtccactgacatatg

SEQ ID NO: 4144 - DNA, 219 bp, Homo sapiens
  D2S307
  Located on chromosome 2
  Distance between a terminus base of telomere on chromosomal short arm and 5'-terminus of this base sequence : 203621960
  Distance between 3'-terminus of neighbour sequence of sequence listing upward to telomere on chrosomal short arm and 5'-terminus of this base sequence : 42958
agcttttcctgtaggctgtctggcagtagcaggaaagcaggctgagtatcccatgattgccaaagcaaggagggcttctggtggaaatggacttctttgatatatttttcccctgggctgatctgcttttctatttctcctctttcactggtgtgtgtgtgtgtgtgtgtgtgtgtgtgtgtgtgtgtgtgtgtgtgtctatgtttatttcaggtcatg

SEQ ID NO: 4145 - DNA, 418 bp, Homo sapiens
  AF225900.1_4678
  Located on chromosome 2
  Distance between a terminus base of telomere on chromosomal short arm and 5'-terminus of this base sequence : 203635191
  Distance between 3'-terminus of neighbour sequence of sequence listing upward to telomere on chrosomal short arm and 5'-terminus of this base sequence : 13012
ataccatgaaattacattgcagagaattctaattcatagtcagaacagttataaatatatttggctacaaaaaacagagacaatgaaaggaatgagacagagtgctatgaacactcttcaaagataaaagattagtcttgaaactatatcataattttatagaatggggagtctaggctgagaaaaccttatatggtggcataagaaaacatggtgcattgcggggactgggagatacagagtttagtgtggctgggtaaggagtgtgtttggtgtggctgtgtgtgtgtgtgtgtgtgtgtgtgtgtgtgtgtctgtgtgtgtgtatgggaggcaggggaaggggagattagggatagggaggagcatgaaccctgagagacaaggtcagggtgggaggaagatccagatcactaaa

SEQ ID NO: 4146 - DNA, 465 bp, Homo sapiens
  chr2.fa.O7frz.213371883
  Located on chromosome 2
  Distance between a terminus base of telomere on chromosomal short arm and 5'-terminus of this base sequence : 203761983
  Distance between 3'-terminus of neighbour sequence of sequence listing upward to telomere on chrosomal short arm and 5'-terminus of this base sequence : 126374
gtgattacaaatgagtgaactttcgctcagagaggttaggcatctttctcaagaccacacagttggtaagtgacagagtcaggtctaaaacaaaggtctttgaattttatgtgcatatatatatatatatgtatgtatgtactgccaattgagtgtcatcctttaaagcagaagttaaaaatgaatagtccatgggccaaactggatctttagatatgttttgtttgcttcctataatgttggctcatggtgtattttaaactttttgaataagctccaaaatttaaaaatggggatgtttcccacaaagactagaatttcatgtgtctttggaaaaaatcagaagaggtggttacactggattcatattccctagcggcaatgtacagctgaagctgtgtgtgtgtgtgtgtgtgtgtgtgtgtgtgtgtgtgtatgtgtgtgattctagctggttataaactg

SEQ ID NO: 4147 - DNA, 245 bp, Homo sapiens
  HUMUT7430
  Located on chromosome 2
  Distance between a terminus base of telomere on chromosomal short arm and 5'-terminus of this base sequence : 203935489
  Distance between 3'-terminus of neighbour sequence of sequence listing upward to telomere on chrosomal short arm and 5'-terminus of this base sequence : 173041
aagggaaataaagagaagcataaacaatggaaatttaggacaacttggaatagaaacaagtttttgaaaagtagaagttgggcataaaattagtaggacatcatagaataattgcatcagttagagataagtctagtattttgatgagtgggtacctgttaggctttgtattaagttatctatctatctatctatctatctatctatctatctatctatctatcatcttctaatctggaccttcc

SEQ ID NO: 4148 - DNA, 280 bp, Homo sapiens
  D2S2189
  Located on chromosome 2
  Distance between a terminus base of telomere on chromosomal short arm and 5'-terminus of this base sequence : 203945247
  Distance between 3'-terminus of neighbour sequence of sequence listing upward to telomere on chrosomal short arm and 5'-terminus of this base sequence : 9513
tacaaaaggacttgtccagggttaattacctggtaaatatctgggttgagattagatccagtttttctgcctttgtacctgtgcttttgctctctctgtctctctctctctctctccatatatatatatatacacacacacacacacacacacacacacacacatatatatataaaaatacaatatattttaattttatctttattttttagagacagggtcttgctctgttgcctaggctggaatgcagtggtgtgatcatacctcacggcaatcttga

SEQ ID NO: 4149 - DNA, 324 bp, Homo sapiens
  AC009498.3_31298
  Located on chromosome 2
  Distance between a terminus base of telomere on chromosomal short arm and 5'-terminus of this base sequence : 204005617
  Distance between 3'-terminus of neighbour sequence of sequence listing upward to telomere on chrosomal short arm and 5'-terminus of this base sequence : 60090
ataaactatcaaacatgaccagagctgtgtgtgtgtgtgtgtgtgtgtgtgtgtgtgtaagacagctacaagccctggggctgaagaatcaaatcagggcctcgtaggaagtattaaagtgtttagacttaattctgagggcaatcgcagagccacagaagaatttaaatagggcagtgatgtgatcagtgttgagggtgtagagaatggattaggaaggggtcattttgaaagcagggagacccattaggaaaggatcgccctaaaccaggtggcctgtctcagggtaacagtgcggatggggtgaaagtaagaaaggaagcc

SEQ ID NO: 4150 - DNA, 303 bp, Homo sapiens
  AC009498.3_46937
  Located on chromosome 2
  Distance between a terminus base of telomere on chromosomal short arm and 5'-terminus of this base sequence : 204021230
  Distance between 3'-terminus of neighbour sequence of sequence listing upward to telomere on chrosomal short arm and 5'-terminus of this base sequence : 15289
tctacagatgacaagaatccatcaacaatttcaaacagatcccagttgctctgtgtgtgtgtgtgtgtgtgtgtgtgtgtgtgtgtgtgtgtgtgtgtgagatgcgttttggggaggagctgatggttgggaaagaaggatccacttatagtgaggggcctggagatacacagggtgaggccagtgaacaggttattgtaatccttctagtgagattttattcaagaagataaaaggaaataatgcagacatttttgtttgtttgtttgtttccatagaattacaggctggtaactacaatct

SEQ ID NO: 4151 - DNA, 401 bp, Homo sapiens
  AC009498.3_74970
  Located on chromosome 2
  Distance between a terminus base of telomere on chromosomal short arm and 5'-terminus of this base sequence : 204049039
  Distance between 3'-terminus of neighbour sequence of sequence listing upward to telomere on chrosomal short arm and 5'-terminus of this base sequence : 27506
cagcttttgctattacagaagtatgagattagtattttcaattcacagttgtattttcaattcactttctacatcgggaaatgttgctttttatttcaccataggggatttctacattgttattacaagacaaatattattattatgaatatcactgaaacccaaaatttagtctaataaaaacatatttatgctttgaccaatggtccatggtaatagtaccttgttggtcttgttatagcaaaatttcctcatatatattacgtgtatgcaagacacacacacacacacacacacacacacacaatctcagtacaatcaatgttccattactggtcctagtggcttgttataatgaaaacatctaacacctgactgtgtaacataatgcaaactggaag

SEQ ID NO: 4152 - DNA, 322 bp, Homo sapiens
  AC009498.3_114082
  Located on chromosome 2
  Distance between a terminus base of telomere on chromosomal short arm and 5'-terminus of this base sequence : 204088385
  Distance between 3'-terminus of neighbour sequence of sequence listing upward to telomere on chrosomal short arm and 5'-terminus of this base sequence : 38945
gttctgtcagtgatagatctgaagaggtagggcatgtgtgatgtgtgtgtgtgtgtgtgtgtgtgtgtgtgtgtgtgaaaaagagatggagggaaggaggtaggagggactgaaacagagacagagatagagacatggatagtaggagggtagtggagtggcgaggggagggtactgtgattgtggcctagagacctggcaggctggcattacaaagcacctccttaccgagagctggagcaccggtgtgacaaatcactgcttccctccattcccacctccccatctccccacctcactgtctgtactagctgattaggtc

SEQ ID NO: 4153 - DNA, 250 bp, Homo sapiens
  AC009498.3_193084
  Located on chromosome 2
  Distance between a terminus base of telomere on chromosomal short arm and 5'-terminus of this base sequence : 204167314
  Distance between 3'-terminus of neighbour sequence of sequence listing upward to telomere on chrosomal short arm and 5'-terminus of this base sequence : 78607
tcataggaagcgtctactgtattatattgcacatcaatattaacatgtgttctaagactgttatgtgaatgttatttagaggacttagctttctgctctgtgtgcacaatcatgcacacacacacacacacacacacacacaaatgcttttagtggatgcagtagaccctctaagtcccataattctgaaagctgactttgtttgttgcttggggactgattttgcaggctagttgcactgttgaaatga

SEQ ID NO: 4154 - DNA, 164 bp, Homo sapiens
  DISO7_10001032
  Located on chromosome 2
  Distance between a terminus base of telomere on chromosomal short arm and 5'-terminus of this base sequence : 204301078
  Distance between 3'-terminus of neighbour sequence of sequence listing upward to telomere on chrosomal short arm and 5'-terminus of this base sequence : 133514
ctccctcatatagagttggtagcttctctctctctctctctctctctctctctctctctctctctctcgtgtactcttccctagggtatgttctttttaccattttgtcattcttacatatgcaaaatagatggattttaagttcttagggaactgtgattggc

SEQ ID NO: 4155 - DNA, 105 bp, Homo sapiens
  DISO7_10001034
  Located on chromosome 2
  Distance between a terminus base of telomere on chromosomal short arm and 5'-terminus of this base sequence : 204314662
  Distance between 3'-terminus of neighbour sequence of sequence listing upward to telomere on chrosomal short arm and 5'-terminus of this base sequence : 13420
tgcctgcagtgtttaatccagtgtcacacacacacacacacacacacacagatacatacatgtctagtcaacaaaaataagttatttccaactgcagctcaagtc

SEQ ID NO: 4156 - DNA, 104 bp, Homo sapiens
  DISO7_10001035
  Located on chromosome 2
  Distance between a terminus base of telomere on chromosomal short arm and 5'-terminus of this base sequence : 204349573
  Distance between 3'-terminus of neighbour sequence of sequence listing upward to telomere on chrosomal short arm and 5'-terminus of this base sequence : 34806
aatgctgcccaagacaacacaaacattgattttgtgtgtttgtttgtttgtatgtgtgtgtgtgtgtgtgtgtgtttgtttaagaattactttggcagctcagt

SEQ ID NO: 4157 - DNA, 124 bp, Homo sapiens
  DISO7_10001036
  Located on chromosome 2
  Distance between a terminus base of telomere on chromosomal short arm and 5'-terminus of this base sequence : 204357385
  Distance between 3'-terminus of neighbour sequence of sequence listing upward to telomere on chrosomal short arm and 5'-terminus of this base sequence : 7708
tctccattgagacttagaggttctgtgtgtgtgtgtgtgtgtgtgtgtgtgttttattattattaatgttgttgagttactacagcaataaattacaatgactatactgtaatctccttgaggg

SEQ ID NO: 4158 - DNA, 264 bp, Homo sapiens
  chr2.fa.O7frz.214210477
  Located on chromosome 2
  Distance between a terminus base of telomere on chromosomal short arm and 5'-terminus of this base sequence : 204477960
  Distance between 3'-terminus of neighbour sequence of sequence listing upward to telomere on chrosomal short arm and 5'-terminus of this base sequence : 120451
caggttatccagctagatacaagtgtattgtgtgcttggtgttcctaggctctttattatccttatttggctcacaggcctttctgagctaagactttagaggtcaggtgagtgtgtgtgtgtgtgtgtgtgtgtgtgtgtgtgtgtgcagttattctttttaaattctagaagaacagggtccttttctttcttgatgccatgtttatctacctgaaatctcacaaagcagcagccagcatgtacttcctaactttactggtg

SEQ ID NO: 4159 - DNA, 126 bp, Homo sapiens
  D2S2237
  Located on chromosome 2
  Distance between a terminus base of telomere on chromosomal short arm and 5'-terminus of this base sequence : 204606288
  Distance between 3'-terminus of neighbour sequence of sequence listing upward to telomere on chrosomal short arm and 5'-terminus of this base sequence : 128064
ggcaagttggctacctgaccagcaggctgaatctggcatgcatgcgtgtgtgtgtgtgtgtgtgtgtgtgtgtagttaattttttaatttacatttgaaataggcttggacaggacaggcattctg

SEQ ID NO: 4160 - DNA, 450 bp, Homo sapiens
  chr2.fa.O7frz.214435186
  Located on chromosome 2
  Distance between a terminus base of telomere on chromosomal short arm and 5'-terminus of this base sequence : 204702590
  Distance between 3'-terminus of neighbour sequence of sequence listing upward to telomere on chrosomal short arm and 5'-terminus of this base sequence : 96176
gcaaatgctatacataattgaatcactgaattacttagggggttatagtcattaccacacatctccaatttgttttctggaatctctgaagccacttattacaaatagacatttagttcctaatgatttcattgggggctgctacaatttttcatttgtagctttttcacctattgctacctaatacctttctctctctctctctctctctctctctctctctctctctctctctctctctcgtacctcttatttgatattgtgtttccagaattaattaatttagatgactttcacgtagtaacttttatccacaagtaatactttaagcagaaatatataacttggtttttctaaaataattaatttaacatatcaagaatggtattaagaaaaatatttggggatttttaaatgaaatttaaagtggaaatgtattacttgaggtag

SEQ ID NO: 4161 - DNA, 294 bp, Homo sapiens
  DISD22_0002230
  Located on chromosome 2
  Distance between a terminus base of telomere on chromosomal short arm and 5'-terminus of this base sequence : 204975460
  Distance between 3'-terminus of neighbour sequence of sequence listing upward to telomere on chrosomal short arm and 5'-terminus of this base sequence : 272420
aggtaatagcatttattgagcaactatatgctctcttctctctctcttctcttctctctctctctctctctctctctccctctctctttctctctctctctctctctctatatatatatatatagttaatcttttcaatgaccctgtgtctttctttggatagaaatttaaaataaacttccattttaaatatgaggaaaccaagacttaaggaggttaaggaattgggtctagtaatatatcaagtcaatggcagaaacacagggaactcaggtcccttggattctgtagcac

SEQ ID NO: 4162 - DNA, 150 bp, Homo sapiens
  Z66826
  Located on chromosome 2
  Distance between a terminus base of telomere on chromosomal short arm and 5'-terminus of this base sequence : 205118693
  Distance between 3'-terminus of neighbour sequence of sequence listing upward to telomere on chrosomal short arm and 5'-terminus of this base sequence : 142939
agctatattcgtcttcattatgggtacctataggccatatatatgtatacacacacacacacacacacacacacgtaagaccagtcactaggaaaatggacacaaaccagaatgctcaaataaaactctgaccacagtatgaactctgca

SEQ ID NO: 4163 - DNA, 396 bp, Homo sapiens
  chr2.fa.O7frz.214955832
  Located on chromosome 2
  Distance between a terminus base of telomere on chromosomal short arm and 5'-terminus of this base sequence : 205336947
  Distance between 3'-terminus of neighbour sequence of sequence listing upward to telomere on chrosomal short arm and 5'-terminus of this base sequence : 218104
gcttgagtatcattgtttctagactctctcaggaaacagaacctggaaagtttacatagatagatagatagatagatagatagatagatagatagatagatagatagatagatcgatctaaactatgtctacacatatctatatttacttccaaatctatctgtatgcacattaaaaaaccatgagtttatactgatacctccaattctaatccaataccacagtaatcattctagcctcttcctctttcattatttgtaacttctttctcatgcagtaagaaagctgtctctgactatctgcaatataattatttgttcaaccctcatatattcataaattttttttcagaattgctaatccataccctagtactaagcagagtgcagtacttgt

SEQ ID NO: 4164 - DNA, 460 bp, Homo sapiens
  AC046197.2_111295
  Located on chromosome 2
  Distance between a terminus base of telomere on chromosomal short arm and 5'-terminus of this base sequence : 205405292
  Distance between 3'-terminus of neighbour sequence of sequence listing upward to telomere on chrosomal short arm and 5'-terminus of this base sequence : 67949
tagaatttcaactttccagtaaacaaagtcaagagagaagtgagtagtgagtggcttttagggcgacactctatggaatccaccacaaatagattacctttagatgtcttttctcttttttttcagttccctttaataatgcaaaagttatagattcatagtatatagtactttcgtcaaatatattcttattaactccctgtgagaggctatccttattatgtagaccctcttttatagctaaggcagaaatatttcagcctgaacaacttgttttacattttttatttttaatttttgtgattatgtaataggtatatatatatatatatatatgtatttatgggatgcatgagatattttgatacaggcatacaatgcataataatcacatcatggaaaatgggatctccatcccttaagcatttaccctttgtgttgcaaacaatccaattatact

SEQ ID NO: 4165 - DNA, 451 bp, Homo sapiens
  chr2.fa.O7frz.215033142
  Located on chromosome 2
  Distance between a terminus base of telomere on chromosomal short arm and 5'-terminus of this base sequence : 205414126
  Distance between 3'-terminus of neighbour sequence of sequence listing upward to telomere on chrosomal short arm and 5'-terminus of this base sequence : 8374
gatcatttgagtctaaatgcagctttgaggatatgcagttcgtaaatttcctactgggtcattttttttctgagagggtatttctctaaactatatcagataaaggatgcccagaatttgctcagatgtgagtttcaggatctagaaacacaatatgaggattatcaagactaaggatgttgatagtgatgatgatgatgatgatgatgatgatgatgatgatgatgatagtcaatagtagtatttattgtatatttaatatatgcccagcattgaggtactttacatgcaatatgatgtctcttgagcaacatttaactttctattgattacttctcttgaggttatcatctttctcctagtggtcattaacatagagtttgaagctgggcataaatcctaggtataaatcctaactccacagctgctgtgatctttgtccatacaatgt

SEQ ID NO: 4166 - DNA, 431 bp, Homo sapiens
  AC007385.3_127068
  Located on chromosome 2
  Distance between a terminus base of telomere on chromosomal short arm and 5'-terminus of this base sequence : 205496125
  Distance between 3'-terminus of neighbour sequence of sequence listing upward to telomere on chrosomal short arm and 5'-terminus of this base sequence : 81548
gatcaataagatcattgagcatgcataagaaggacaagataaacctggaaagttaggttgctatgggttactaaaggccttgcataccagactaagaggctgagttttttttctctagttaacaggaaactattcagtagtttgtgtttgtgtgtgtgtgtgtgtgtgtgtgtgtgtatgtatgtatgtatgtgtgcttatttggtttggttttccaaaccaggttttgacataagaacatcagttttcagaaggttatcccttcagttcttcctttctcctcaacttcattcatcttcctagaacttgaactcagctgctgcagtcatcacaaaataacttggttaatataaatttgaggaaaatgcctgtctgattccagcatgaatggtaggacaggtctgataatgttgtgactccagtaaacactg

SEQ ID NO: 4167 - DNA, 358 bp, Homo sapiens
  AC007385.3_86050
  Located on chromosome 2
  Distance between a terminus base of telomere on chromosomal short arm and 5'-terminus of this base sequence : 205537094
  Distance between 3'-terminus of neighbour sequence of sequence listing upward to telomere on chrosomal short arm and 5'-terminus of this base sequence : 40538
tcttcatttaacaagtacgcaggcactgcctgtgttatcagcttgaaagtctgctaagaatggatgggagaaacagagcagttcacatttgctctttgaactcagagaactgatctgagtgcatggcaatgatgatggaaggaattaggaaacgctggaaatcatatgcaaagaaattagtcatctctctcctcctaagctctgtgtgtgtgtgtgtgtgtgtgtgcgcgcgcacgcgcgtgtgagagagagagagagagatgcacatactactctggattgccttgagaatagacatcatgatggtggtggtggtgatgaagaggatgaaagcagctgatagtcattgactgctcat

SEQ ID NO: 4168 - DNA, 258 bp, Homo sapiens
  AC007385.3_61571
  Located on chromosome 2
  Distance between a terminus base of telomere on chromosomal short arm and 5'-terminus of this base sequence : 205561656
  Distance between 3'-terminus of neighbour sequence of sequence listing upward to telomere on chrosomal short arm and 5'-terminus of this base sequence : 24204
gcttctgaatttcagagtaagacaattgccgtggcaggattctcctgtgtcttaatgaaatcatgacatggaggccctctcccccaacacccatacacacacacacacacacacacacacacacacacacacacacacacacagaggcatgaagatggaagtgtttaagtctccttcgttgtactccttgcccttggtgaagagggattctaataatctaatgatcataggtagtttacatcaaaatcttcctattgc

SEQ ID NO: 4169 - DNA, 201 bp, Homo sapiens
  AC007385.3_26547
  Located on chromosome 2
  Distance between a terminus base of telomere on chromosomal short arm and 5'-terminus of this base sequence : 205596682
  Distance between 3'-terminus of neighbour sequence of sequence listing upward to telomere on chrosomal short arm and 5'-terminus of this base sequence : 34768
gactgtttaagtcatccttatcatcatgttaataaatgtggcagtgtgacggcctaaacacaggaaaagaccaagacaaaaaggaaaaacaaaaaccaacaaaacactcgcacacacacacacacacacacacacacacacccatcaatctttgcaaagccggatatttctttttcttgcctagcaggatacagcatcttt

SEQ ID NO: 4170 - DNA, 292 bp, Homo sapiens
  AC067978.2_67819
  Located on chromosome 2
  Distance between a terminus base of telomere on chromosomal short arm and 5'-terminus of this base sequence : 205675974
  Distance between 3'-terminus of neighbour sequence of sequence listing upward to telomere on chrosomal short arm and 5'-terminus of this base sequence : 79091
cttccttaaggattgaaataacttacatttctggagtgagcagctgagtaattgagaaagaagactctgttcctcttttcaagagaatccctctctctctctctctctctctctcatacacacacacacacacacacacacacacacacacacacacttctctgtacctccaccccactccccaattcctcaattgctgctctcactctaataattatgtagagcaagccagctgtgcctccctaatttatgagggcttgaaacgtgcatgtgaagagtatgttgcttcaag

SEQ ID NO: 4171 - DNA, 452 bp, Homo sapiens
  chr2.fa.O7frz.215446060
  Located on chromosome 2
  Distance between a terminus base of telomere on chromosomal short arm and 5'-terminus of this base sequence : 205723229
  Distance between 3'-terminus of neighbour sequence of sequence listing upward to telomere on chrosomal short arm and 5'-terminus of this base sequence : 46963
caatcactgtacaggtaaatctttagtgaaatacaataaaagtggcctttggacctggagttattagatggtcgcaatcttttatatttggaagtatctttcattttccgcctcttactgatttcttgccatgcaatattattttaaatttaaatcatcctgtgttttctgctgtgtgtgtgtatatacatacatacacacacacacacacacacacacacacacacacagacacattgtgtgccaggatgtgagtcagtaatgaagaaaagcctggaagaaaaagagatctgtgttgagaagggagaaagagaagaaagaatgaataaactgtgttgtcatgtgattttttaaaaagacccttttttgtggttgttatgagtcacattttaaacaatgtagcctgggtgtgcattcttttcttttcttttttaaagcagtggctataaaca

SEQ ID NO: 4172 - DNA, 459 bp, Homo sapiens
  chr2.fa.O7frz.215557457
  Located on chromosome 2
  Distance between a terminus base of telomere on chromosomal short arm and 5'-terminus of this base sequence : 205834547
  Distance between 3'-terminus of neighbour sequence of sequence listing upward to telomere on chrosomal short arm and 5'-terminus of this base sequence : 110866
cctagtgtcactacgcttgtagtccagtgcaggaaacaaatgtgcaaatgcaaaatcacagtccaacaccctgagtcctatgatagggagagggagggatataaaatatggaatgagcctcaaccatgaaaataacacaccccaaattatatgaaaacccccaaagtataaaatcaatgactacagcaggaacactcctctatcttatctaaatctggggatggggccaggagttcaagactagcctggcaacatggcaacaccctgtctccacaaaacacacacacacacacacacacacacacacacacacacacacacacacacaaataaatcagggtgtggtggtgtgcctgggaaggagggtcactgaagctgggaagatcaaggcagcagtgagctgagatcatgccactactcactccagcctgggtgacagaatgagactttatctaggaa

SEQ ID NO: 4173 - DNA, 435 bp, Homo sapiens
  chr2.fa.O7frz.215665406
  Located on chromosome 2
  Distance between a terminus base of telomere on chromosomal short arm and 5'-terminus of this base sequence : 205942464
  Distance between 3'-terminus of neighbour sequence of sequence listing upward to telomere on chrosomal short arm and 5'-terminus of this base sequence : 107458
aagtcattacaatgagcatgacggggaggcaagtgcacatgctcaggccctcacaacgccagggttggggaaggggctgactttccccttcagagagcgtcggggaggagagctagcccgatagcactggaataccagctccataatttgctagctgggagactctggaaacatgatttaaggtctctttttgggcctgtaactaaaataaaataaaataaataaaataaaataaaataataaaataaaataaaataaaataaaataaaataaaataaaataaataaaataaataaaataaaataaataaaataaataaaataaataaaataaataaaataaaataaaataaaataaaataaaataaaataaaaaaataaaataaaataaaataaaataaaataaaataaaatacaaatagataacagctgttcc

SEQ ID NO: 4174 - DNA, 304 bp, Homo sapiens
  AC007383.3_23231
  Located on chromosome 2
  Distance between a terminus base of telomere on chromosomal short arm and 5'-terminus of this base sequence : 206037968
  Distance between 3'-terminus of neighbour sequence of sequence listing upward to telomere on chrosomal short arm and 5'-terminus of this base sequence : 95069
gatttggaaatttatgtttatcactttttttttttttaacgttcagagctcagggcaccaaaatatagctaaaattgaatccatttaaacagaaaacatacgtgtgtgtgtatgaatatatatgtgtttatatatgcatataaaatatatacatacacatatatttttttttcgtttaaatgttatacatacacacacacacacacacacacacacacacacaccccaaaaccaaagtagttttgctaggttccgagggctcttccacagacccttctgagttgtagcaataacaagtttaggt

SEQ ID NO: 4175 - DNA, 219 bp, Homo sapiens
  AC007383.3_79913
  Located on chromosome 2
  Distance between a terminus base of telomere on chromosomal short arm and 5'-terminus of this base sequence : 206094739
  Distance between 3'-terminus of neighbour sequence of sequence listing upward to telomere on chrosomal short arm and 5'-terminus of this base sequence : 56467
aatccacgctgagaatttaggtataaaagggcaccatgtccaccagaaacttccaaatgattcagaaaattagattcacacacacatatatatgtagtgtgtatatatatatatatatatatacacacacactgagaatcataatacaaatatggcaagatgttaacatcagttaatctatgtgaacaatatacaaaatggtatacaaagaccatttca

SEQ ID NO: 4176 - DNA, 93 bp, Homo sapiens
  Z67505
  Located on chromosome 2
  Distance between a terminus base of telomere on chromosomal short arm and 5'-terminus of this base sequence : 206280526
  Distance between 3'-terminus of neighbour sequence of sequence listing upward to telomere on chrosomal short arm and 5'-terminus of this base sequence : 185568
actccacagtctgtttcccatattggagatgagtgtgtgtgtgtgtgtgtgtgtgtgtgtgtgttagtgccagttgtaatttggataataatc

SEQ ID NO: 4177 - DNA, 147 bp, Homo sapiens
  G08117
  Located on chromosome 2
  Distance between a terminus base of telomere on chromosomal short arm and 5'-terminus of this base sequence : 206325381
  Distance between 3'-terminus of neighbour sequence of sequence listing upward to telomere on chrosomal short arm and 5'-terminus of this base sequence : 44762
gctggcatgataaattgcttcagttctggagagtaatctgttaagatgtttgaatcataatgatatgatgatgatgatgatgatgatgatgatgatgatggcgtgtgccagaaatggtgctgagtgagtttgagggagtggccattt

SEQ ID NO: 4178 - DNA, 165 bp, Homo sapiens
  D2S369
  Located on chromosome 2
  Distance between a terminus base of telomere on chromosomal short arm and 5'-terminus of this base sequence : 206373003
  Distance between 3'-terminus of neighbour sequence of sequence listing upward to telomere on chrosomal short arm and 5'-terminus of this base sequence : 47475
agttttgaccacatggctgtttatgtgtctacttacattagaaacatgaatctcatattcaaggattccaacaaatacacacacacacacacacacacacacacacacacacacagacacacacagacacacgtctatacacatacatataaaactttcctgagg

SEQ ID NO: 4179 - DNA, 209 bp, Homo sapiens
  D2S2358
  Located on chromosome 2
  Distance between a terminus base of telomere on chromosomal short arm and 5'-terminus of this base sequence : 206513525
  Distance between 3'-terminus of neighbour sequence of sequence listing upward to telomere on chrosomal short arm and 5'-terminus of this base sequence : 140357
ggctaaacacccaacacttgaccaggaacacaggggaggaagaatattgcagttcatggattgtaggtctgctttggcttctctttttgtctagttgttcattggtttaagaatgaaccaagaagttgggtgcactcactcatgggtgtgcgtgtgtgtgtgtgtgtgtgtgtgtgtgtgtgttatcttagtgctttaggaggccaagt

SEQ ID NO: 4180 - DNA, 389 bp, Homo sapiens
  chr2.fa.O7frz.216510659
  Located on chromosome 2
  Distance between a terminus base of telomere on chromosomal short arm and 5'-terminus of this base sequence : 206684069
  Distance between 3'-terminus of neighbour sequence of sequence listing upward to telomere on chrosomal short arm and 5'-terminus of this base sequence : 170335
acaagctcattgtaagaaatttagaaaatatagacaaatgaggattgggatgaattattcatgtatacttctcagtaaggtaggaacagcaatttggcaattgaaaattggaacaatgccaccatgaagtgacttttgaatgttatgatacacacacacacacacacacacacactcttcattctatagctcaagtcttctagaaaacagtaataagactgccttgccccctcattccttccttcctcccctcctttttgatctttctgaataaactaaccccttgtgaataacatgaaatccacttttacaaggtttatcaaacaaggagccatgtgctatactaggacttgtgaggcagttttgagaataacaagacattcaagatg

SEQ ID NO: 4181 - DNA, 405 bp, Homo sapiens
  chr2.fa.O7frz.216614445
  Located on chromosome 2
  Distance between a terminus base of telomere on chromosomal short arm and 5'-terminus of this base sequence : 206764169
  Distance between 3'-terminus of neighbour sequence of sequence listing upward to telomere on chrosomal short arm and 5'-terminus of this base sequence : 79711
tccttaacacagtctactttcaacaatatttaattatattacacacagtataaagaaccctacaatgatataaagaggcttttcagctcccaccttaccctttgtcttctggtggttataaattttacttctacatttgctataaggcccaaaacacattgctaccttttgctttagaaaatctctctctctctcttcctctctctctctctctctctctctctctctatatatatatatatatatatagcttatttaccatttcagctgctcctcattcttccctgcaaatcttcagaggtgaatttttctcacttctcctgctctgtcctcagtcttctaagtattaacccaatgaacttagtgaaggactgtgggaaagagttcctaaattggtgtagactt

SEQ ID NO: 4182 - DNA, 456 bp, Homo sapiens
  chr2.fa.O7frz.216916401
  Located on chromosome 2
  Distance between a terminus base of telomere on chromosomal short arm and 5'-terminus of this base sequence : 206927825
  Distance between 3'-terminus of neighbour sequence of sequence listing upward to telomere on chrosomal short arm and 5'-terminus of this base sequence : 163251
taattccaatagtgctgaagtaagcagccagtctgccttgctgagttcacctggtttccttcttcatcttcttccatctggctagggcaaggcataaagaatagacgtatatattttaaatatagttgagtgcatgacagtgtgtatgtgtgtgggtctgtgagtgtgtgtatatgtgtgtgtgtgtgtgtgtgtgtacagaggtttataagtgagaactttcttctgcgaggcaatgggtccccgcctgaagtccagccccctgcctcatggcgtttcctttagacactagccgatgccatggcaactctggcctttcggttttttagatatgtctcttcatgtggagggcaagatggtcagacctggaaaaacacctaggagatataaacaacaaggatattagagaactcccagcaaacagcttgacttgcatcactccttaggaaatgattt

SEQ ID NO: 4183 - DNA, 361 bp, Homo sapiens
  AC007879.3_136675
  Located on chromosome 2
  Distance between a terminus base of telomere on chromosomal short arm and 5'-terminus of this base sequence : 206998528
  Distance between 3'-terminus of neighbour sequence of sequence listing upward to telomere on chrosomal short arm and 5'-terminus of this base sequence : 70247
gacattctatgaccacataatgtctgcctttccctttctttttctctctcttcctttttagaaatatttttcagaaatattttaatagtagctaattcacacagtcaaatagtcattggttttgaaaaattttacacacacacacacacacacacacacacaaaatagtaataatcttgggcctttatttggcactcaaaattttttaaaaagaaaaaaaagtaatcggagattggaaaaatggaggaacacccagcagcaagtaatttttttaaatggctttttttaatcaggaaaagaatgaccctaaaaatcaccatctggtcaacctaaatgatatccttagtaatgtaagaaagcc

SEQ ID NO: 4184 - DNA, 307 bp, Homo sapiens
  AC007879.3_136117
  Located on chromosome 2
  Distance between a terminus base of telomere on chromosomal short arm and 5'-terminus of this base sequence : 206999156
  Distance between 3'-terminus of neighbour sequence of sequence listing upward to telomere on chrosomal short arm and 5'-terminus of this base sequence : 267
aacatgcttctatgtcagactaagaaaactaagaactggttacatgtttttcttacacacacacacacacacacacacacacacacacacacggagtttttactacaactgaccagctgggtctctgggagtggcaaaagaaactgtgacaatagcaggcttttttgttaatgagggatgtctgatgggaaaaaaaaattgtttggtattgtctcattttactcccacttagaccaagaggctgcatgctcaggaaaatcagtcagtttccaaattggaaaatgttacaaataccaataaggaatga

SEQ ID NO: 4185 - DNA, 160 bp, Homo sapiens
  AC007879.3_43958
  Located on chromosome 2
  Distance between a terminus base of telomere on chromosomal short arm and 5'-terminus of this base sequence : 207091314
  Distance between 3'-terminus of neighbour sequence of sequence listing upward to telomere on chrosomal short arm and 5'-terminus of this base sequence : 91851
gccacctgtataatttctgatataggtgatgtgtttgtcttttggtggtggtcttggccatttcattgacacacacacacacacacacacacatatttttgtttcagaacagtttcctaagctcctcattcattcactttgtacatattgataccaaacc

SEQ ID NO: 4186 - DNA, 100 bp, Homo sapiens
  D2S355
  Located on chromosome 2
  Distance between a terminus base of telomere on chromosomal short arm and 5'-terminus of this base sequence : 207091337
  Distance between 3'-terminus of neighbour sequence of sequence listing upward to telomere on chrosomal short arm and 5'-terminus of this base sequence : -137
aggtgatgtgtttgtcttttggtggtggtcttggccatttcattgacacacacacacacacacacacacatatttttgtttcagaacagtttcctaagct

SEQ ID NO: 4187 - DNA, 161 bp, Homo sapiens
  AC007879.3_37538
  Located on chromosome 2
  Distance between a terminus base of telomere on chromosomal short arm and 5'-terminus of this base sequence : 207097715
  Distance between 3'-terminus of neighbour sequence of sequence listing upward to telomere on chrosomal short arm and 5'-terminus of this base sequence : 6278
tattgaaaccaagaacttcagtagtaaaaatagaccacgcttatgtagtgtgccagttgtttttttgtttggtgtgtgtgtgtgtgtgtgtgtgtgtgtgtgtgtgtgtgtgagacagggtttcactctactggccaggctggagtacagtgacatgatct

SEQ ID NO: 4188 - DNA, 170 bp, Homo sapiens
  D2S2192
  Located on chromosome 2
  Distance between a terminus base of telomere on chromosomal short arm and 5'-terminus of this base sequence : 207097752
  Distance between 3'-terminus of neighbour sequence of sequence listing upward to telomere on chrosomal short arm and 5'-terminus of this base sequence : -124
cgcttatgtagtgtgccagttgtttttttgtttggtgtgtgtgtgtgtgtgtgtgtgtgtgtgtgtgtgtgtgtgagacagggtttcactctactggccaggctggagtacagtgacatgatcttgatcactgcagcctccacctcctgggctcgagcaatcctcctgac

SEQ ID NO: 4189 - DNA, 202 bp, Homo sapiens
  D2S325
  Located on chromosome 2
  Distance between a terminus base of telomere on chromosomal short arm and 5'-terminus of this base sequence : 207303196
  Distance between 3'-terminus of neighbour sequence of sequence listing upward to telomere on chrosomal short arm and 5'-terminus of this base sequence : 205274
ccagtcttcagagataacagggtacttatcaaccttcttcattttaaagatgccaaaattgagtcagtaaagtcaagtatcaagttcagccaaatagaattggaacccaattccatcgtgtgtgtgtgtgtgtgtgtgtgtgtgtgtgtgtgtgtatatataattattgtaattattatcattcaacggcatttctgaagct

SEQ ID NO: 4190 - DNA, 103 bp, Homo sapiens
  D2S2321
  Located on chromosome 2
  Distance between a terminus base of telomere on chromosomal short arm and 5'-terminus of this base sequence : 207306413
  Distance between 3'-terminus of neighbour sequence of sequence listing upward to telomere on chrosomal short arm and 5'-terminus of this base sequence : 3015
ccatgtagtgtttggcagcacagtactcccagacacacacacacacacacacacacacacacacacacacacacacactcacatgtgccctgcaattctgctc

SEQ ID NO: 4191 - DNA, 106 bp, Homo sapiens
  DISO7_10009286
  Located on chromosome 2
  Distance between a terminus base of telomere on chromosomal short arm and 5'-terminus of this base sequence : 207533076
  Distance between 3'-terminus of neighbour sequence of sequence listing upward to telomere on chrosomal short arm and 5'-terminus of this base sequence : 226560
cacatctgtggctttcagctggaaacggctggacaactatttgttgaatgaatgaatgaatgaatgaatgaatgaatgttacaatacatcacatcaaattattgcc

SEQ ID NO: 4192 - DNA, 406 bp, Homo sapiens
  AC036191.2_164080
  Located on chromosome 2
  Distance between a terminus base of telomere on chromosomal short arm and 5'-terminus of this base sequence : 207643930
  Distance between 3'-terminus of neighbour sequence of sequence listing upward to telomere on chrosomal short arm and 5'-terminus of this base sequence : 110748
tcaggtagtggtaagtagcaagaagatgaagcagcataaagggatacagagtgacaggaggggctcactattttagatagaatgatcaggaagaacctctctagaggtgacatttgagcagtgacctgatcaaagcaagaaggtaaagagtgctggcattacaggcagccagacaagtgccaagactagacaggaacattttgtgtgtgtgtgtgtgtgtgttcaaggaacaaacagcaaggtgtcccgtgtggttggagtgagttggaaagagtggaggaggttgaggtcacatagggccttttggcttgcaggccacaggaaggttttttttgttttgttttgttttgtttttgagatgcggagtcttgctatgtcacccaggctgtagtgcagtggctcaatc

SEQ ID NO: 4193 - DNA, 126 bp, Homo sapiens
  DISO7_10001040
  Located on chromosome 2
  Distance between a terminus base of telomere on chromosomal short arm and 5'-terminus of this base sequence : 207663032
  Distance between 3'-terminus of neighbour sequence of sequence listing upward to telomere on chrosomal short arm and 5'-terminus of this base sequence : 18696
attcacctgcaccaaacccgtatcaaaagtcaccaaatctctcatatatatatataatatatattatgtatatatacaacccacaaaacatacatactatacatagtttgtaacaacatgaagtca

SEQ ID NO: 4194 - DNA, 168 bp, Homo sapiens
  D2S2208
  Located on chromosome 2
  Distance between a terminus base of telomere on chromosomal short arm and 5'-terminus of this base sequence : 207782912
  Distance between 3'-terminus of neighbour sequence of sequence listing upward to telomere on chrosomal short arm and 5'-terminus of this base sequence : 119754
agctaagtacctgctcaggaaactggaggctgaactctgcctctgtgtgtgtgtgtgtgtgtgtgtgtgtgtgtgtgtgtgtgtgtgtgtgtatctgcatgtctatgtgtttatgtgtctgtttttctgtgtgtgggccaacccaaattcccgcatgtttacaaatag

SEQ ID NO: 4195 - DNA, 158 bp, Homo sapiens
  HUMUT7691
  Located on chromosome 2
  Distance between a terminus base of telomere on chromosomal short arm and 5'-terminus of this base sequence : 208011210
  Distance between 3'-terminus of neighbour sequence of sequence listing upward to telomere on chrosomal short arm and 5'-terminus of this base sequence : 228130
gaaaagaaagaaagctaaatgaaccctgcagtactagaccaaaatcagagttatccatataaaacccattttaagatagatagatagatagatagatagatagatagatagatagatagagtattcatttgttctcatgctgctaataaagacatacc

SEQ ID NO: 4196 - DNA, 269 bp, Homo sapiens
  G12425
  Located on chromosome 2
  Distance between a terminus base of telomere on chromosomal short arm and 5'-terminus of this base sequence : 208011955
  Distance between 3'-terminus of neighbour sequence of sequence listing upward to telomere on chrosomal short arm and 5'-terminus of this base sequence : 587
gggagttaggggagctacaattcaagatgagatttgtgtggggacacagccaaaccatatcagatagatagatagatagatgattgatagatagatagatgattgatagatgacagatagatagatagatagatagatagatagatagatgatagatagatagatagatagatagatagatagataatcagacagacagacagatagatagtaccctgtactaactgtagggtagtcctgctccacaaggagcagtatgagttagacat

SEQ ID NO: 4197 - DNA, 453 bp, Homo sapiens
  chr2.fa.O7frz.217978745
  Located on chromosome 2
  Distance between a terminus base of telomere on chromosomal short arm and 5'-terminus of this base sequence : 208074568
  Distance between 3'-terminus of neighbour sequence of sequence listing upward to telomere on chrosomal short arm and 5'-terminus of this base sequence : 62344
caagtatcaccttcattaacttctgtttttatgacactgtatcccatgcctcccacacaccacaattctaagaattctgcagtcactgcccagaaaatatggaatctcaaactttagtttcagatttggccttttctctaatttatacctctaagtgagctaataggtactgaccattaaattagaatagaaatcagaagacaggatcctatcttctcaggaggaataatcaaatagaaaagtaagacaaagcaagcaaaagtttgttgttgttgttgttgttgttgttattgtcgttttgagatggagtctcactctgtcaccaggctggagtgcagtggcacgatctcggctcactgcaacctccatctcccggcttcaagcaagcaattctcctgccccagccgcccgagtagctgggatttaagaataatgtgattaaataggccggat

SEQ ID NO: 4198 - DNA, 435 bp, Homo sapiens
  AC016697.6_113894
  Located on chromosome 2
  Distance between a terminus base of telomere on chromosomal short arm and 5'-terminus of this base sequence : 208117409
  Distance between 3'-terminus of neighbour sequence of sequence listing upward to telomere on chrosomal short arm and 5'-terminus of this base sequence : 42388
gattatcatttaaatcagtggactttgaaagcagattgccctctatctgagtgagccttttccaatcagtcgaaagccttgatagaacaaaagactgacctcccccatgcaagaaggaatctgccagtaggcagcctttggattcaaactgcaactcttccctgagtctgctggcagctggcctcctctatcagattttggactggccaagactccacaatcatgtgagccaattctgtaaaatcaaaatatttgaaagagatggttaagcctatactgcaccgtgtgtgtgtgtgtgtgtgtgtgtgtgtgtgtgtgtgtgtgtatccacacacatcctgtcagttcaatttctctgaggaaccctaatactcaaatataacaaaatgttaatagttgttgactctggaattctaagtccatggatgttcatta

SEQ ID NO: 4199 - DNA, 402 bp, Homo sapiens
  chr2.fa.O7frz.218279857
  Located on chromosome 2
  Distance between a terminus base of telomere on chromosomal short arm and 5'-terminus of this base sequence : 208378871
  Distance between 3'-terminus of neighbour sequence of sequence listing upward to telomere on chrosomal short arm and 5'-terminus of this base sequence : 261027
cttcatagcaccaattcataaccaaaagcaactgaagttgctttgttaattttgactgcttcaccagaatataagttttagaaaacagggatattgtttatttgttcattatttatatcatttagaacaatctttgacacataaatagacaataaatgattaatggagaaatgtgatagatagatagataaatagatagatagatagatagatagaatatgcaaactgaacctaagaaataaccagaattaggtaggtctattttgacaaaaaattcctagaacacagaatttgagcagattaaagaaagaatactatagaaacaagaaataaaattggaatatagaatcataaaattcagtagtgatataggcaggctgaacttaagttagatggtcacta

SEQ ID NO: 4200 - DNA, 224 bp, Homo sapiens
  AC019185.6_54610
  Located on chromosome 2
  Distance between a terminus base of telomere on chromosomal short arm and 5'-terminus of this base sequence : 208516302
  Distance between 3'-terminus of neighbour sequence of sequence listing upward to telomere on chrosomal short arm and 5'-terminus of this base sequence : 137029
gaatagtcacatggcctatgactcagcaatttcatttctgagtgtacattctagaaacttcttgtgcattgtaagaatagccataatattatatcaaatgagcttggcaattaaggaaggaaggaaggaaggaaggaatagccgtaacagcctggtttataattaaagtggaaacaaaaatattgataaaagaatggtgaataaagtcatgtgttcatgaactg

SEQ ID NO: 4201 - DNA, 441 bp, Homo sapiens
  chr2.fa.O7frz.218652126
  Located on chromosome 2
  Distance between a terminus base of telomere on chromosomal short arm and 5'-terminus of this base sequence : 208711566
  Distance between 3'-terminus of neighbour sequence of sequence listing upward to telomere on chrosomal short arm and 5'-terminus of this base sequence : 195040
atgcatgagttgctatttagagtagatggtaccgaacctgtgctagccagatggatattcattcgttttctccttttcaagggaaatcttgattattttcatgaatgtatgcagaatctcctaatacttggactaaacaagctttaatattactggaaattgtgaggaataattttccgatttatcattagaaattcaagcatatttttacctgttacatatggttcatgaagggattaaaaaacataattgtaattattcatataaccatgtgtcagaaaatttatgttatgtaatcgatatttcagacccttagaggtgctgggctattattttttgctatgtaagcatttgtttggcctgaaaagtgatcacacacacacacacacacacacacacacacacggtgtctgaagagttaggaaacagtggaaaatttat

SEQ ID NO: 4202 - DNA, 221 bp, Homo sapiens
  DISD22_0002239
  Located on chromosome 2
  Distance between a terminus base of telomere on chromosomal short arm and 5'-terminus of this base sequence : 208897398
  Distance between 3'-terminus of neighbour sequence of sequence listing upward to telomere on chrosomal short arm and 5'-terminus of this base sequence : 185391
cttggttctcgcttctctaacagtgtgtgtgtgtgtgtgtgtgtgtgtgtgtgtgtgtgtgtgtgtgtgttcccaggctcaaaaagcagaatgggaacctaaagaaaaacaaagtatatgaatatatgggatcaaatacaggatttaccacaaattatatatttcataatgagcaatattttttccttcatgaggccctttggagtagaactaggttatct

SEQ ID NO: 4203 - DNA, 280 bp, Homo sapiens
  AC013409.6_163862
  Located on chromosome 2
  Distance between a terminus base of telomere on chromosomal short arm and 5'-terminus of this base sequence : 209005076
  Distance between 3'-terminus of neighbour sequence of sequence listing upward to telomere on chrosomal short arm and 5'-terminus of this base sequence : 107457
tagtacattccaacactggaacaaaatgcaggcttaaaaataaataagaattttttttacatactaatatacaacaatctgtaggatacactattatgtgaaaaatgctgggttcaagagagtatatttagtattctatcagttatataaaaatggaaataaaacattgtgtgtgtgtgtgtgtgtgtgtgtgtgtgtgtgtatttgccagtaaaaattaaaactggttgctggcagaaagggacttgggtggttgaaagaaagaggtggcaagaatact

SEQ ID NO: 4204 - DNA, 328 bp, Homo sapiens
  AC016743.8_186549
  Located on chromosome 2
  Distance between a terminus base of telomere on chromosomal short arm and 5'-terminus of this base sequence : 209235599
  Distance between 3'-terminus of neighbour sequence of sequence listing upward to telomere on chrosomal short arm and 5'-terminus of this base sequence : 230243
ataccagctggtaagtatttatgtcctttgtacagcctctcttggttatctcactcctatttattcaataataaaatcgaagttaaatggacaagattcgtattcccacttttctattcctatagcaactctatgagagacacttaggaaaatttgctttcaacaaagctctgtgtgtgtgtgtgtgtgtgtgtgtgtgtgtgtgtgtgtgtgagagagagagagagagagagagacagagacagagaatgagagagagaaggccaagagacaggagagacagagataaagacaagaaaatagcttgtaagcaactcaaatgtagtaa

SEQ ID NO: 4205 - DNA, 265 bp, Homo sapiens
  AC016743.8_139942
  Located on chromosome 2
  Distance between a terminus base of telomere on chromosomal short arm and 5'-terminus of this base sequence : 209282296
  Distance between 3'-terminus of neighbour sequence of sequence listing upward to telomere on chrosomal short arm and 5'-terminus of this base sequence : 46369
catttattaaaccaataaatgcttattttaaaatattaaaaatttttaaaaattaatacattttgtattaaagatacgtattacacacatacacacacacacacacacacacacacacacacaaataggttaactttactgagtttaagcaaagaggtgataggtgatatctgaactgggaattgaaagacaaaggtgtttacttggtagacatgaggacgaggacattccagggagaagtcatagcatgtttaaaggcataact

SEQ ID NO: 4206 - DNA, 254 bp, Homo sapiens
  D2S2274
  Located on chromosome 2
  Distance between a terminus base of telomere on chromosomal short arm and 5'-terminus of this base sequence : 209299185
  Distance between 3'-terminus of neighbour sequence of sequence listing upward to telomere on chrosomal short arm and 5'-terminus of this base sequence : 16624
acctaatcaggtctccattgaaatggcaattttctgtatttcctcccctccctaccctttttcccctgtgtgtgtgtgtgtgtgtgtgttgtgattttgtatatgtgcatgtgtgttgagagtgaaggagtgagaaaggaaataaaactcattctctctctctctctgtcttcagttcattgccacaggtaaacattttacatctcaccttcttctctgtaatttctatagcctccccacagacaaaagagctt

SEQ ID NO: 4207 - DNA, 214 bp, Homo sapiens
  D2S1366
  Located on chromosome 2
  Distance between a terminus base of telomere on chromosomal short arm and 5'-terminus of this base sequence : 209499160
  Distance between 3'-terminus of neighbour sequence of sequence listing upward to telomere on chrosomal short arm and 5'-terminus of this base sequence : 199721
cctagtcattgtcttgatgttccatgcaataaggttaaaacagtatgcttgcaaatatcttgatttatctgcaagtataaatcaaaatatctctatctatctatctatccatctgtctgtctgtctatctatctatctatctatctatctatctatctatctgtctatcctatctatctatttatctatggtagaagtgaatatgtcctcaaat

SEQ ID NO: 4208 - DNA, 270 bp, Homo sapiens
  D2S1369
  Located on chromosome 2
  Distance between a terminus base of telomere on chromosomal short arm and 5'-terminus of this base sequence : 209591104
  Distance between 3'-terminus of neighbour sequence of sequence listing upward to telomere on chrosomal short arm and 5'-terminus of this base sequence : 91730
caagcaagtcatttaacgcatgcttgccaaaggaaacactctcagccaaagccttgctgcccctactcatagatagatagatagatagatagatagatagatagatagataggcagatagatagatagagagatggatgtatataggcagatagatagatagagagatggatgtatatacacaaagagatacaggaaaggagactctcttaaattcaatatatatatttatttcacaggtatatacacgtgagtcatagaaaggtgtgtt

SEQ ID NO: 4209 - DNA, 364 bp, Homo sapiens
  chr2.fa.O7frz.219721323
  Located on chromosome 2
  Distance between a terminus base of telomere on chromosomal short arm and 5'-terminus of this base sequence : 209756148
  Distance between 3'-terminus of neighbour sequence of sequence listing upward to telomere on chrosomal short arm and 5'-terminus of this base sequence : 164774
tataactgaggcttaaactcaaagaatgtagggtctctcacatttggtgaatatttcttcttttttcaaaattccttccttccttccttctcttctctccttccttcctttccttctctctttctttctctttctcttttcttgctcttttcttttctttctttctttctttctttctttccttccttccttccttccttccttccttccttccttccttccttccttccttccttccttccttccttcctttttctttccaaatctccttctttctttctttctttcctttcttccttctttctttttgagacagggtcttcccctgtcacccatgctggagtgcaatggtacaatcatagtc

SEQ ID NO: 4210 - DNA, 272 bp, Homo sapiens
  Z67583
  Located on chromosome 2
  Distance between a terminus base of telomere on chromosomal short arm and 5'-terminus of this base sequence : 209826451
  Distance between 3'-terminus of neighbour sequence of sequence listing upward to telomere on chrosomal short arm and 5'-terminus of this base sequence : 69939
ccagaggcaacaatttttaagtttctcaggaatccttctagggtaaactgtgtgtgtgtgtgtgtgtgtgtgtgtgtgtgtatataaatacacacatatatgtatgtatatatgtaagttgtgtattgaatgttttgtttttcatgcaaatgggacatgctgtaagtgcactttgaattttttcatttatatctagaagactgtttttaaatatcagtttatagttttacctcttctctttttaatggctacaaaatgttccactgaatgaa

SEQ ID NO: 4211 - DNA, 201 bp, Homo sapiens
  D2S322
  Located on chromosome 2
  Distance between a terminus base of telomere on chromosomal short arm and 5'-terminus of this base sequence : 209850451
  Distance between 3'-terminus of neighbour sequence of sequence listing upward to telomere on chrosomal short arm and 5'-terminus of this base sequence : 23728
caaattaccccagcccatgattttggggtaagataattgaaaccctaatcaataatggtgcttgcctagtctctgtctctctctctctctctctctctctctctctctctgtgtgtgtgtgtgtgtgtgtgtgtgtctattcatcatgtttaagaacaagttttcaaagaatgccatcaaatggagttcttgctctgatgt

SEQ ID NO: 4212 - DNA, 324 bp, Homo sapiens
  AC006994.3_62403
  Located on chromosome 2
  Distance between a terminus base of telomere on chromosomal short arm and 5'-terminus of this base sequence : 209985429
  Distance between 3'-terminus of neighbour sequence of sequence listing upward to telomere on chrosomal short arm and 5'-terminus of this base sequence : 134777
gtttcatgtgctcaatagctacatgtgtctaggagctaccatattggacagtatagatttatagagcatttgaatcattacagaaagttctatggttctcaagactttccataaagaaaaaaaagaaagttctatgggatatggaatatcactattctagaccactgcagtaggcaaatctaggaaacacacaaacacacacacacacacacacacacacacacacagttccaattctctattgccttttaaatattttcctatgttccacttcgttaattctttaacacattaaacaattatttactgagcacattctatcag

SEQ ID NO: 4213 - DNA, 234 bp, Homo sapiens
  HUMUT430
  Located on chromosome 2
  Distance between a terminus base of telomere on chromosomal short arm and 5'-terminus of this base sequence : 209991953
  Distance between 3'-terminus of neighbour sequence of sequence listing upward to telomere on chrosomal short arm and 5'-terminus of this base sequence : 6200
tcatacctgccctgccaccctacaacacacacacacgcgtgcacacacacacacacacacacacacacactgcttaaaatcttccaacatcctcccattgctcttgaaagacttaaatccttaatcttttaaaaggccctgataggtctggcctcttccatagttctcttgcctcatcttgcatgatgctttcccttgtctcatcttgcatgatgctttcccttgttctctgtg

SEQ ID NO: 4214 - DNA, 440 bp, Homo sapiens
  chr2.fa.O7frz.220172167
  Located on chromosome 2
  Distance between a terminus base of telomere on chromosomal short arm and 5'-terminus of this base sequence : 210209934
  Distance between 3'-terminus of neighbour sequence of sequence listing upward to telomere on chrosomal short arm and 5'-terminus of this base sequence : 217747
cgaaatgatattagcattaggtattatttctaatatctaatgcttaacattagatattagcatgacattttaccacgcttgcaaattctcaaaggaagtttaacttattttataaagcaaaaagctgagactttctatggccaagaggcacacttaccacaatcaagaataaactgagccctattatgtgaaacatttttaaatcaatctttctctctctcacacacacacatactacacacacacacatactacacacacacacacacacacacacacactgctacacacttccctatacttccacacttcttggaaaaattgatgggttaccttcattgctggggtttcccagaactttcctgacctctgcattggtgggatttgtgcccagagctcgaaggacatcaccgacctggcttaaggtgatcttggaatca

SEQ ID NO: 4215 - DNA, 468 bp, Homo sapiens
  AC021150.5_63186
  Located on chromosome 2
  Distance between a terminus base of telomere on chromosomal short arm and 5'-terminus of this base sequence : 210253357
  Distance between 3'-terminus of neighbour sequence of sequence listing upward to telomere on chrosomal short arm and 5'-terminus of this base sequence : 42983
cctacttgatcgtagtgaattaactttttgatgttcctgttgaattttgtttactcttattttgttaaagaattttgtgtctatctttatcacagatattggcccatagttttcttttgtgtgtgtgtgtgtgtgtgtgtgtgtgtgtgtgtgtgtgtgtgtctttgccaagttttggtatcagagtaatgctggcttcatagaatgagttagagaagagttcctgctccttgatgttttggaatagtttcagtaggattggtaccagctctttttcatatgtttggtagaattctgctgtgaatccatctggtcaggggctttttaagctttttattactgattccatttaggaattccttattggtcttttctgggtttcaatttctttctgattcagttttttaaaattttagttttctataggttattgaggtacaagtggtgtttggttacataagtaaatcc

SEQ ID NO: 4216 - DNA, 295 bp, Homo sapiens
  AC021150.7_126548
  Located on chromosome 2
  Distance between a terminus base of telomere on chromosomal short arm and 5'-terminus of this base sequence : 210371378
  Distance between 3'-terminus of neighbour sequence of sequence listing upward to telomere on chrosomal short arm and 5'-terminus of this base sequence : 117553
acatttagaatgttcaatagccacatgtggctagtggctgtcgcgatggaaataacaacatttccattactgcagaacattccaaggagagtactgctctgaagaccaggaatagatgtcattccgtacaagaagttcaggaagtctggcactgcctgtcagtttaccctaagaatttcttggtcttgaaatgttgataactattaaaaacaaacaaacaaacaaacaaacaaacaaacaaacatgctgtgaggaccaaataaaattcctgttgtaataggaatcagtcctggct

SEQ ID NO: 4217 - DNA, 381 bp, Homo sapiens
  AC021150.7_98846
  Located on chromosome 2
  Distance between a terminus base of telomere on chromosomal short arm and 5'-terminus of this base sequence : 210398668
  Distance between 3'-terminus of neighbour sequence of sequence listing upward to telomere on chrosomal short arm and 5'-terminus of this base sequence : 26995
aatgcattgtaggtcaacttctcctttgctcaatctgccttcctcacactctggcttttcacagctcttattccagagggcactccaccataacctcttacatgccaatttctaccttgagtttgtttccaggaaccaagcctaaaaacaggacccatgccttttatttatttatttatttattttttgcttgctttgaattcttactctgtaaatgaattgtgctgtctacacacacaaaaatatacattgaagcatgtctttgtttattcctagttacattttttggaaatgaagtataactcaagaatattcttaacctacattctcatttccttaaataagctattcttaactttctcagaaggacctactgaacaa

SEQ ID NO: 4218 - DNA, 457 bp, Homo sapiens
  chr2.fa.O7frz.220458525
  Located on chromosome 2
  Distance between a terminus base of telomere on chromosomal short arm and 5'-terminus of this base sequence : 210491361
  Distance between 3'-terminus of neighbour sequence of sequence listing upward to telomere on chrosomal short arm and 5'-terminus of this base sequence : 92312
ggtattaagagtcctatgcctaactgtagcaacaatttactgtgttctgacaatacagtcaccctgggtcagagaaaagaaagagtggagaaattatttactgctcaagaagatagatgaggccaagtttgtaacttgaaaacaatatgctggatttaatctcctccaatttcactgtcactacaatttttttcttataggttcctgcaatttatggagtggacacaagaatgctgactaaaataattcgggataaggtataatcatcatctttagccaaatctatgtttcttcgggtgtgtgtgtgtgtgtgtgtgtgtggtgtttccctcagtgcctaagggatccattaatatgtaaaggagtgaatctggccagcttctgctatctgggtctctgttattttgttttactattttcactgtaattttcaagattgaatacttgattggtatgt

SEQ ID NO: 4219 - DNA, 249 bp, Homo sapiens
  AC007968.3_119551
  Located on chromosome 2
  Distance between a terminus base of telomere on chromosomal short arm and 5'-terminus of this base sequence : 210642845
  Distance between 3'-terminus of neighbour sequence of sequence listing upward to telomere on chrosomal short arm and 5'-terminus of this base sequence : 151027
accaagacttttgaatcttgactcagttttttgttacacacacacacacacacacacacacacagagagagagagagagagagagagtgagagagaggttcacgacaagccctcttttggagttagctagctaaatagagggtcactgctatttcttcctttcagtcctgtactacttcctactggttataaggatattaaaccttatataatggtggttattaaacctttaaggaccacttgagaatc

SEQ ID NO: 4220 - DNA, 309 bp, Homo sapiens
  AC007968.3_66987
  Located on chromosome 2
  Distance between a terminus base of telomere on chromosomal short arm and 5'-terminus of this base sequence : 210695367
  Distance between 3'-terminus of neighbour sequence of sequence listing upward to telomere on chrosomal short arm and 5'-terminus of this base sequence : 52273
tctgtttaccataacaaggactatgggagttatgagccagaaaccatgaacaaaaccataaatctatctatctatctatctatctatctatctatctatctatctaggtttaatgtacataaatatgtatagtatatataacacctatgttgtatttgaacatgcgaatactaagaaactttcagaagtatagcaattcctagtaagtcttcactatcaacccattactatcattggaattgctagtaatttgcagaaaggaacaaagcaccactaagagccaagagctgtcaagataggctgagtcta

SEQ ID NO: 4221 - DNA, 334 bp, Homo sapiens
  AC012356.4_4327
  Located on chromosome 2
  Distance between a terminus base of telomere on chromosomal short arm and 5'-terminus of this base sequence : 210938292
  Distance between 3'-terminus of neighbour sequence of sequence listing upward to telomere on chrosomal short arm and 5'-terminus of this base sequence : 242616
ccattcttgagttacttcacttagaataatggtctaccaattcataccaggtcgctgcaaatgccattattttgttcctttttatggctgagtagcattccatggtgggggtgtgtgtgtgtgtgtgtgtgtgtgtgtgtgtgtgtgtgtgtgtgtatatcaatttgtttatccactcattgatttatgggcatttgggctagttccatattttgcaattgcaaattgtgccaccataaacatgtgtgtgcaagtatctttttgtgtaatggcttcttttcctttgggtagaaacccagtagtgggattgctgattcaaatggtagttctacat

SEQ ID NO: 4222 - DNA, 467 bp, Homo sapiens
  chr2.fa.O7frz.220852088
  Located on chromosome 2
  Distance between a terminus base of telomere on chromosomal short arm and 5'-terminus of this base sequence : 210938318
  Distance between 3'-terminus of neighbour sequence of sequence listing upward to telomere on chrosomal short arm and 5'-terminus of this base sequence : -308
taatggtctaccaattcataccaggtcgctgcaaatgccattattttgttcctttttatggctgagtagcattccatggtgggggtgtgtgtgtgtgtgtgtgtgtgtgtgtgtgtgtgtgtgtgtgtgtatatcaatttgtttatccactcattgatttatgggcatttgggctagttccatattttgcaattgcaaattgtgccaccataaacatgtgtgtgcaagtatctttttgtgtaatggcttcttttcctttgggtagaaacccagtagtgggattgctgattcaaatggtagttctacatttcgttctttaaggaatttccacactgtttcccatagtggttgtactagtttacattcccaccagcagtgtaaaagtgctcccttttctccacacccccatcgactctattatttttttatttttttgattatggccattcttgcaggaataaggtagt

SEQ ID NO: 4223 - DNA, 445 bp, Homo sapiens
  AC012491.4_54400
  Located on chromosome 2
  Distance between a terminus base of telomere on chromosomal short arm and 5'-terminus of this base sequence : 211012672
  Distance between 3'-terminus of neighbour sequence of sequence listing upward to telomere on chrosomal short arm and 5'-terminus of this base sequence : 73887
gagataggatttcctgtcatactctataggtatcaacaattcggtcttcacagttttatactcattgtacataatgaaattaatactttttgtaaaatatcaaaaataagaataaaactatacactagaaatagcaaatatcaaaagtgaccaggtgtgactgctaatgccctctattggtgataggcaggttgcacaggttttaattctgccacttatttgtgaacattggtaagttcaaagttcatgagcaaaggacaatctgtatgtgtgtgtgtgtgtgtgtgtgtgtgtgtgtgtatatatatatgaatttccatcttgagcaaaaataaatgtcaaatgtgtggcagggaatgaaagcagcttatgtttattttgtttacataattttattgaatgcttacaacaagcctgtaaagtgaatattgtttccattctgtac

SEQ ID NO: 4224 - DNA, 345 bp, Homo sapiens
  AC012356.4_127146
  Located on chromosome 2
  Distance between a terminus base of telomere on chromosomal short arm and 5'-terminus of this base sequence : 211034452
  Distance between 3'-terminus of neighbour sequence of sequence listing upward to telomere on chrosomal short arm and 5'-terminus of this base sequence : 21335
ttacatgaatttaagaatccgtatttctctaatacattctatttatcaaatatttttaaggtggaggctggggagtagagatttaaattccttggggtacaaataatgtatacacacacacacacacacacacacacacacacacacacacacatatataggaaaaaaccctagaaaactgtcagtgtctactttaaagggcagtcttctgattataaatcacatttgggttggctcttcattgccaaaataatatttctattatggatgtttgtgactcagtttctttttacagccacatgtagaaatatatgccaatagattaggcaaattgaatattacaac

SEQ ID NO: 4225 - DNA, 333 bp, Homo sapiens
  chr2.fa.O7frz.221073165
  Located on chromosome 2
  Distance between a terminus base of telomere on chromosomal short arm and 5'-terminus of this base sequence : 211125455
  Distance between 3'-terminus of neighbour sequence of sequence listing upward to telomere on chrosomal short arm and 5'-terminus of this base sequence : 90658
gttgttctttagcagatacatcacaatgaattcatagtgttctctgatatttgctcaaaagtgacatttgttcgtgatgatgaaaatgtatatgccagtaaaacagatactgttgtagaagatagataagtaggtaggtagattagatagatagatagatagatagatagatagatagatagatagatagacagatagacagataatttcaagaaatttgcttagaactggccagacaaatctgaagtccatagggtgagtcatcaggaagggtagagcagaaactttgaaggagctggattccaaaagtggaattacttcaaggaaaccttg

SEQ ID NO: 4226 - DNA, 204 bp, Homo sapiens
  D2S1365
  Located on chromosome 2
  Distance between a terminus base of telomere on chromosomal short arm and 5'-terminus of this base sequence : 211125518
  Distance between 3'-terminus of neighbour sequence of sequence listing upward to telomere on chrosomal short arm and 5'-terminus of this base sequence : -270
acatttgttcgtgatgatgaaaatgtatatgccagtaaaacagatactgttgtagaagatagataagtaggtaggtagattagatagatagatagatagatagatagatagatagatagatagatagacagatagacagataatttcaagaaatttgcttagaactggccagacaaatctgaagtccatagggtgagtcatcag

SEQ ID NO: 4227 - DNA, 379 bp, Homo sapiens
  AC012069.6_153834
  Located on chromosome 2
  Distance between a terminus base of telomere on chromosomal short arm and 5'-terminus of this base sequence : 211312781
  Distance between 3'-terminus of neighbour sequence of sequence listing upward to telomere on chrosomal short arm and 5'-terminus of this base sequence : 187059
gcatctgaaactcattatcttaagtataaaatgctgataatgtgttacattactgctccaccccacttattttcacttaaattagttacaaggacataaactggaaagaaggaaactttgagtattaagagttaatagcgtgtgtgtgtgtgtgtgtgtgtgtgtgtgtgtgtgtgtgtgtgtatttttccattctttcctacaagtcctttttatctaaaatcatgttgtgtatatatacatttacctacctcaccaagagcaaagccagccctgaagcaggaggagacaattttaaataactggagagcacaaagatttttcatgacagcactcttgcttatggatttattgttcctagtacaaggcttagtcaata

SEQ ID NO: 4228 - DNA, 339 bp, Homo sapiens
  AC012069.6_134270
  Located on chromosome 2
  Distance between a terminus base of telomere on chromosomal short arm and 5'-terminus of this base sequence : 211332411
  Distance between 3'-terminus of neighbour sequence of sequence listing upward to telomere on chrosomal short arm and 5'-terminus of this base sequence : 19251
ggtcaagactgcagtgaaccatgaatgattgtgccactgcactctggcttggggacagagagagaccctgtcttaaaaacacacacacacacacacacacacacacacacacacacattgataaaaaaaaaaataaaaaaaccaaaaacaaacaaaagcccttgtcatagggaggatcttaagaagaagagccccttcttttgtcttaataaaaacaaacaaataaacaaaaaccctcaagcatcatgtcaaagataccaccatgtcaagccaatatcctgagactacaatcatttatcatcaagtagcagccgttgttagaagtgatgttgatccttg

SEQ ID NO: 4229 - DNA, 384 bp, Homo sapiens
  AC012069.7_105519
  Located on chromosome 2
  Distance between a terminus base of telomere on chromosomal short arm and 5'-terminus of this base sequence : 211361404
  Distance between 3'-terminus of neighbour sequence of sequence listing upward to telomere on chrosomal short arm and 5'-terminus of this base sequence : 28654
cttcctaccatgctacagacacatgcttggtcaaatttaacgtttcttagatcacaaattagatgtcatttcctccacaagatcttccccaactcctaaatagattgggtcactctacaacatagtgataatgtccaactttatctatagacaggtatctatccatccatccatccatccatccatccaaccatccatctggagctaaaccctgagattatcaagcattattttaaaaaagctttttggatttgcagctaaatcaaagtttttttatgatcagaaaggacataaacttgtatgctcagactttaaaaatgctatataacaaattacccaatgctaacagtttcatgtagagagtagataaagcacaaagccaaa

SEQ ID NO: 4230 - DNA, 215 bp, Homo sapiens
  Z67163
  Located on chromosome 2
  Distance between a terminus base of telomere on chromosomal short arm and 5'-terminus of this base sequence : 211429730
  Distance between 3'-terminus of neighbour sequence of sequence listing upward to telomere on chrosomal short arm and 5'-terminus of this base sequence : 67942
ataatttggcattcctgtgcttcagtctttccatctccgaaatgggaataatgtattctctctagtgctgctgggaaaaacataatgagaaaaaaaaagagagagagagagtgtatgtgtgtgtgtgtgtgtgtgtgtgtccatgcacatgtgttgtgtatagaaagtgtaaaatctggtctatggccataccaccccgaatgcacccgatctcg

SEQ ID NO: 4231 - DNA, 101 bp, Homo sapiens
  DISD22_0002246
  Located on chromosome 2
  Distance between a terminus base of telomere on chromosomal short arm and 5'-terminus of this base sequence : 211518323
  Distance between 3'-terminus of neighbour sequence of sequence listing upward to telomere on chrosomal short arm and 5'-terminus of this base sequence : 88378
tatactttcagtccgatagtcagtcctctctctctgtctctctctctctctctctctttggttctctttcttacaaagaaaaacacaccaacttggtttgc

SEQ ID NO: 4232 - DNA, 454 bp, Homo sapiens
  chr2.fa.O7frz.221799870
  Located on chromosome 2
  Distance between a terminus base of telomere on chromosomal short arm and 5'-terminus of this base sequence : 211777398
  Distance between 3'-terminus of neighbour sequence of sequence listing upward to telomere on chrosomal short arm and 5'-terminus of this base sequence : 258974
actaagttggaagctttggtagattcatttacataataacacaaactttcaattgtaagtatacatatttcaaaaaattcataagttgaagattctatcatctctaaagtgtgtgtgtgtgtgtgtgtgtgtgtgtgtgtgtatttgttttctacatatttatacaggtaggcttatattttgaagcttgtatttcaaatagacattttaataatctttaataactatttaaaatataatactgagttcaatttttttcctatcagataaacacattaagctccaatgacttggggaattgacttttaactgaaattagatacaacgcataaatgcaaaaatagtaagaatgtttggaaacctttgaattaaactttgtttagatatagatagagctgaagtaaaaagaaattattagttttcggcactttcgtacaactgaagctatacctga

SEQ ID NO: 4233 - DNA, 236 bp, Homo sapiens
  DISO7_00000976
  Located on chromosome 2
  Distance between a terminus base of telomere on chromosomal short arm and 5'-terminus of this base sequence : 212009563
  Distance between 3'-terminus of neighbour sequence of sequence listing upward to telomere on chrosomal short arm and 5'-terminus of this base sequence : 231711
aatccagttgctcaagtcagagatcaggtagccatccatgtcaaatcccaaatcctgtcagatctcccttataataccttcaggtctctctctctctctctctctctctctctctctctctctctctctctctccccccccctctcaccccctccctccctccctcttctctccctccctcttctctccctccctcttctctccctccctctctatcccgctacccactacaactc

SEQ ID NO: 4234 - DNA, 414 bp, Homo sapiens
  chr2.fa.O7frz.222262041
  Located on chromosome 2
  Distance between a terminus base of telomere on chromosomal short arm and 5'-terminus of this base sequence : 212055362
  Distance between 3'-terminus of neighbour sequence of sequence listing upward to telomere on chrosomal short arm and 5'-terminus of this base sequence : 45563
cagagttctgtcctaaattaacagtatttctctagatgtttttgtatatgtctctttgcattatttattattattattattattattattattattattattatgctttaagtcttgggatacatgtgcagaacgcacaggtttgttacataggtatacacatgccatggtttgctgcactcatcaacccatcacctacattaggtatttcttctaatgccatccctcccctagcccctcaacctctgacaggccctgttgtgtgatgtttccctccctgtgtccatgtgttcttattgttcaattcccaattatgagtgagaacatgcagtgttgggttttctgttcctgtgttagtttgctgagaatgatggtttccagtatcatccatgtccctgcaaaggacatgaactc

SEQ ID NO: 4235 - DNA, 245 bp, Homo sapiens
  chr2.fa.O7frz.222155433
  Located on chromosome 2
  Distance between a terminus base of telomere on chromosomal short arm and 5'-terminus of this base sequence : 212205980
  Distance between 3'-terminus of neighbour sequence of sequence listing upward to telomere on chrosomal short arm and 5'-terminus of this base sequence : 150204
caggagtgaatttctacatgagggaatgttgtaaatgcaaaggaagaatagaattgttgttcttaaattccatgtttgtggaatatatatatatatatatatatatatatatacacacacacacacactcacacacacaaacacacacacattataactactaccctacaaggtgttccacaatatattatttttaaaagagagataaaaaagaatcgtttgtgtagctgcaatcttcatgttta

SEQ ID NO: 4236 - DNA, 334 bp, Homo sapiens
  chr2.fa.O7frz.222377339
  Located on chromosome 2
  Distance between a terminus base of telomere on chromosomal short arm and 5'-terminus of this base sequence : 212309267
  Distance between 3'-terminus of neighbour sequence of sequence listing upward to telomere on chrosomal short arm and 5'-terminus of this base sequence : 103042
agttcactgataacctccaaacctccaaactctatggatgatatctaattttaattcttcttgccctctctgtgctatttgaccctttgaatcactccttttatccctttgaatgtgtgacccttggaatcaccatttgcaactcctctcttggcttcttgaataccactctgctttgctttttttcctacctattttcacttttttctaagtttcctcgctcctctctctctctctctctctctctcctctctctcacaatatgctaaaaataacattggccttttaattatagtcatccctctagttttaacctctatagtctgtcatccat

SEQ ID NO: 4237 - DNA, 250 bp, Homo sapiens
  D2S317
  Located on chromosome 2
  Distance between a terminus base of telomere on chromosomal short arm and 5'-terminus of this base sequence : 212458010
  Distance between 3'-terminus of neighbour sequence of sequence listing upward to telomere on chrosomal short arm and 5'-terminus of this base sequence : 148409
ggcaaagattttgttttaggagtgtgtgtgtgtgtgtgtgtgtgtgtgtttgtgtctctgtgtatgtttaataaaaggatatccatttgctttaaaaaacggcaaagttaaagttaacagtttttgcttacacgttatgagcatctaactgattgttatatccttaacacctaacattgacttttagaatttaaccatttattcatggaacaaaaattattgaatgcatgctaagttctaggcactgctc

SEQ ID NO: 4238 - DNA, 403 bp, Homo sapiens
  chr2.fa.O7frz.222632208
  Located on chromosome 2
  Distance between a terminus base of telomere on chromosomal short arm and 5'-terminus of this base sequence : 212569205
  Distance between 3'-terminus of neighbour sequence of sequence listing upward to telomere on chrosomal short arm and 5'-terminus of this base sequence : 110945
tcattacatactggtttccaagtgggcatgtaatacaattttatccattaaaatagaaaaattccgctatggtctttgggaaaatgcttcctccctaataataattatagaaacagaggaagttcccctattccattgcatgttgtatgtcatgataggatatctgattctgctgttgccattttatggttattaaggctgctagcctaggaactagtagatgtgtaaacatgctgagaatggtagggaaaggaaaatacaaacacatacacacatacacacacacacacacacacacacacacaccagctcctaatgatgtctttaaaacgctaacttattggtgtgatagataaggaattgtctatatggttaatatgagtcagagttgtctgctcattac

SEQ ID NO: 4239 - DNA, 457 bp, Homo sapiens
  AC022978.3_140340
  Located on chromosome 2
  Distance between a terminus base of telomere on chromosomal short arm and 5'-terminus of this base sequence : 212665821
  Distance between 3'-terminus of neighbour sequence of sequence listing upward to telomere on chrosomal short arm and 5'-terminus of this base sequence : 96213
tagcctggattactgaaatgaccaccaatctgagcttctagctctcactttttttcctgtctgcagtggattaagcacccaattgccaagtttatcttttgaacaggcagtgaaattatgtttgtgttgttttgttttgtttcgagacagggtctcactctgtcacccaggctggagtgcaatggtgcaatcatggctcactgcagccttgatctcctaggctttagtgattttcccatctcagcctgctgagtagctgggaccacaggcacacaccactaaccctttatttatttatttatttatttatttattttgtagagacggtgtcttgctatgttgtccaggctggtctagaattcctgggctcaagggatccacctgccttggcctcccaaagtaaaagtatctttattttcctatttaaaatgctctttcagcttctgattgaatttag

SEQ ID NO: 4240 - DNA, 153 bp, Homo sapiens
  Z67071
  Located on chromosome 2
  Distance between a terminus base of telomere on chromosomal short arm and 5'-terminus of this base sequence : 212820811
  Distance between 3'-terminus of neighbour sequence of sequence listing upward to telomere on chrosomal short arm and 5'-terminus of this base sequence : 154533
gataaatgtgccatccccatgtgtttccttcagttgaatgttggctagtatccaggagggagaaaacacacacacacacacacacacacacacacacacaacatactcaaaactttaaaaagaaaaaagaagtgctacaaccttcacaaaaag

SEQ ID NO: 4241 - DNA, 273 bp, Homo sapiens
  Z66883
  Located on chromosome 2
  Distance between a terminus base of telomere on chromosomal short arm and 5'-terminus of this base sequence : 212876024
  Distance between 3'-terminus of neighbour sequence of sequence listing upward to telomere on chrosomal short arm and 5'-terminus of this base sequence : 55060
agcagtcaagcaaaatcccagagaccacctgtcatgcatgctgtcaaggatattcttgctttgttaaggaagttgttctaaatgacctttggggtcacttttaagtaactgattcaaggattattttcagtgagatgaatggcatgggtgcatgtccttgtgtgcacgcacacatgcgctcgcgcgcgcgcgcacacacacacacacacacacacacacacacacacacacacacacagccacacaaaagaacttggaagcctgatattttta

SEQ ID NO: 4242 - DNA, 324 bp, Homo sapiens
  AC013736.6_178651
  Located on chromosome 2
  Distance between a terminus base of telomere on chromosomal short arm and 5'-terminus of this base sequence : 212885473
  Distance between 3'-terminus of neighbour sequence of sequence listing upward to telomere on chrosomal short arm and 5'-terminus of this base sequence : 9176
tacttgaggtcagaagttcaagactagcctgaccaacatggtaaaacccagtctctactaaaaatacaaaaatttgctaggcatggtggcaggtacctgtaatctcagcttctcgggaggcgaaggttgcagtggagccgagatcgcaccaccgcactctagcctgggcgacaaagatagactccgtctcgaaaaaataaataaataaataaataaataaataaaataaatattcactattttccagtaatgctaagtactatcaaaaagagtagattactctgacactggttgcataaatattaagctcaagttttgatcagc

SEQ ID NO: 4243 - DNA, 378 bp, Homo sapiens
  AC013736.6_43368
  Located on chromosome 2
  Distance between a terminus base of telomere on chromosomal short arm and 5'-terminus of this base sequence : 212936459
  Distance between 3'-terminus of neighbour sequence of sequence listing upward to telomere on chrosomal short arm and 5'-terminus of this base sequence : 50662
accatcctaggagtcaacttatttactggcaaaagcataagttttgagattatatgcctgcatttaaatctgaactcttcattcatccatccatccatccatccatccatccatccatccatccattcatttttgagtaaccactttgtgcctggcatagttcttgcctctgtggatacagcagtgaacactgacaaagcctcccttctggaacttttattttagaggcacaaaataattaacaaaagaagaagtatagtacttcagatgatgataaaatgctctggagtgatggttgtgatgaaattgatgtgcatatttagtagtattcagagatacggaaaaaagggggtaagtcttcaaggtggaggtgtatta

SEQ ID NO: 4244 - DNA, 469 bp, Homo sapiens
  AC024246.6_5418
  Located on chromosome 2
  Distance between a terminus base of telomere on chromosomal short arm and 5'-terminus of this base sequence : 213113660
  Distance between 3'-terminus of neighbour sequence of sequence listing upward to telomere on chrosomal short arm and 5'-terminus of this base sequence : 176823
tgtcaagttatgacaaaggaactgtagtgggcacctgcagaggttggtggatccccaactaaatttgatttggatattcagactgataatgccacacacacacacacacacacacacacacacacacacacagaggctgtgaataaattcactacttgtggaactgaatttgctgaggagagctgcacattacctcccaagcatttctgaaatggcttgagagagcaagtaagggagactggcttggggtttttattgcggttgggggttagggccagggtgagaattctcatatgtgaggtgaggcttgagtcatttgaatctcccatcagtaccagacaagggagtacccaggcattcttgtccagttgcccagatgttgggcacaagggaagaaggaggaggtaaaacttaaaggctgttgacactcaaacatcaaacaataaagtcaggttcctcattataggaa

SEQ ID NO: 4245 - DNA, 474 bp, Homo sapiens
  AC024246.6_165787
  Located on chromosome 2
  Distance between a terminus base of telomere on chromosomal short arm and 5'-terminus of this base sequence : 213137584
  Distance between 3'-terminus of neighbour sequence of sequence listing upward to telomere on chrosomal short arm and 5'-terminus of this base sequence : 23455
atggcatgtattgtctcataagacagaagactctgaattgcccttggtgaagagaggtgtgctcgtctctaaaagggagaagcaggccatttttgcagggccagagagttcagggaaatatgaagatttaagatttttaagtacgttgtctcagatttcttcatctctgtccacacacacacacacacacacacacgtatgacttcttgtaactcagaataaatttatttttccataaaattcatgtactaaaatactgttggttttcctaaaatgactttcctataatatgttttcaaatttcacttctttgctgatatctttaaatttttatattattatactataactttataacaatatttggagtcatctacagcaatttatgttttgagataaaaataacatgacaattcacaaataactatcatatttcacaaacattaatttcttcatctttgaaatgtcttctaa

SEQ ID NO: 4246 - DNA, 395 bp, Homo sapiens
  chr2.fa.O7frz.223400214
  Located on chromosome 2
  Distance between a terminus base of telomere on chromosomal short arm and 5'-terminus of this base sequence : 213283245
  Distance between 3'-terminus of neighbour sequence of sequence listing upward to telomere on chrosomal short arm and 5'-terminus of this base sequence : 145187
ccttaaaatctagtgcataacctatcagcctttgttttgctcatgcatttcttttctgtttattaaaaaagatgtgagtgtgtgtgtgtgtgtgtgtgtgtgtgtgtgtgtgtgtttatgattctctttggcagaatgtgttaggctgcctgcactcagcaatttagcaatagaggagagagaatggatggtgaagaggcacgtggggagtagctgcaagatgcagttgtttcatggacagaaactgcaccaatcctatcctcctgcccccatccccagttttccaggcttttgcacagtacctacggattccaagtccagcgcttctttagagttttgccaaagatatatggatctttttcttatgcagatcatttccatgcattctaagtgta

SEQ ID NO: 4247 - DNA, 107 bp, Homo sapiens
  D1S1649
  Located on chromosome 2
  Distance between a terminus base of telomere on chromosomal short arm and 5'-terminus of this base sequence : 213446802
  Distance between 3'-terminus of neighbour sequence of sequence listing upward to telomere on chrosomal short arm and 5'-terminus of this base sequence : 163162
gggatggatggaaaagattcaagttaggtagatctatctgtctatctatctatctatctatctatctatctatctatctatctatccattcatccatctaagacaga

SEQ ID NO: 4248 - DNA, 442 bp, Homo sapiens
  AC009964.10_5395
  Located on chromosome 2
  Distance between a terminus base of telomere on chromosomal short arm and 5'-terminus of this base sequence : 213499091
  Distance between 3'-terminus of neighbour sequence of sequence listing upward to telomere on chrosomal short arm and 5'-terminus of this base sequence : 52182
aacctaggcaacatagtgagtccccatccttacaaaaaataaaaataaattagccaggcggttgagaggtcgcttgagcctgggaggtggaggctgcagggacctctgattacattactatgctgcagcctgggcaatggagtgagatcttgtctttttgaaaaaaaaagagaacaacatacttcacacacacacacacacacacacaaaatcagatataagaatttatgaatcctttaggttactaaaggcagaagttttaagctatttttgatgttttgcctactttctccactggaataacttaaaattaatgtagttcaaattaatgtgacatttattgggcaacaaatgagcctgccactgagatggctttgagtgataaaatggtacagaagtagacaagatgtagtctactctttcagagtttgtagactagcag

SEQ ID NO: 4249 - DNA, 115 bp, Homo sapiens
  D2S334
  Located on chromosome 2
  Distance between a terminus base of telomere on chromosomal short arm and 5'-terminus of this base sequence : 213499221
  Distance between 3'-terminus of neighbour sequence of sequence listing upward to telomere on chrosomal short arm and 5'-terminus of this base sequence : -312
tgggcaatggagtgagatcttgtctttttgaaaaaaaaagagaacaacatacttcacacacacacacacacacacacaaaatcagatataagaatttatgaatcctttaggttac

SEQ ID NO: 4250 - DNA, 474 bp, Homo sapiens
  chr2.fa.O7frz.224216121
  Located on chromosome 2
  Distance between a terminus base of telomere on chromosomal short arm and 5'-terminus of this base sequence : 213603252
  Distance between 3'-terminus of neighbour sequence of sequence listing upward to telomere on chrosomal short arm and 5'-terminus of this base sequence : 103916
aggctaagttgtaaacttccagaatgttaaagatgtgtcctaacatgcacacagagacacttgccaaagattgggtgacttactggttcaaagcatttaatgaccagttgaccaatcattatttggctattaagctaatctagaagaaacttctgtgaccacaccaaacatggaatacagactttactgaattacctcaggaaattcacacacacacacacacacacacacacacacacacacacacagagagagagagagagagagcaaacagcagtaaaaacaaaccttagaaggaagcctgattttcagaaatttcaaattatttaaaatgtcaggttttaaacaatgtcaaaaaatagaaaacatgaaaaggatcaggacaaagaacaaaacttatgaatatgtcatgttatatgacaaagtgccattaaagttgcaggtgtgatggaaatctgtaatcagctgacttta

SEQ ID NO: 4251 - DNA, 313 bp, Homo sapiens
  AC008169.2_37735
  Located on chromosome 2
  Distance between a terminus base of telomere on chromosomal short arm and 5'-terminus of this base sequence : 213773385
  Distance between 3'-terminus of neighbour sequence of sequence listing upward to telomere on chrosomal short arm and 5'-terminus of this base sequence : 169659
tctgatctacattgttgcagtattttcacacacacagggaagatgttttctgaaatatttttaaacaaaacaataacaccttgtgggaggtgttatttaatccaatttaaatatgtacatatttatatatagtctgtgtatatattatatatatcttttgtgtatatatttatatatatatagtttgtgtatatatttgtgtgtctgtgtgtgtatatatatatatatatatatatatatatacacacacacacaaatatatacacaaacatgtaataagtgtaccaaaacctatcagctggaagttttcttt

SEQ ID NO: 4252 - DNA, 234 bp, Homo sapiens
  AC008169.2_52037
  Located on chromosome 2
  Distance between a terminus base of telomere on chromosomal short arm and 5'-terminus of this base sequence : 213787786
  Distance between 3'-terminus of neighbour sequence of sequence listing upward to telomere on chrosomal short arm and 5'-terminus of this base sequence : 14088
ataacgtgacagtaaagtccatacacacaaaatggaaataatcctgcatcctttattcaagcctggttaatcaaaatgtcttgaatttttttttgcacaagatgtagtagaaatacacacacacacacacacacacacacacacacacgcatagagagagagagagagggagagaagtcatttataagcataccttggagatactgcagtttctgttccagactaccacaataa

SEQ ID NO: 4253 - DNA, 281 bp, Homo sapiens
  D2S2319
  Located on chromosome 2
  Distance between a terminus base of telomere on chromosomal short arm and 5'-terminus of this base sequence : 213793524
  Distance between 3'-terminus of neighbour sequence of sequence listing upward to telomere on chrosomal short arm and 5'-terminus of this base sequence : 5504
ccaacaagataaagttcccagtgtttgttatccaataaaaaagcaggaaaatagcatacataatgaataaaagcatgcacacacacacacacacacacacacacacacacacacacgcagtgtgtagtattcagaagaaagactgctacagtgatatgttaaaatgtattatcagcatttctattgtgatctttaatagacatcttaaagttacatcaaaaaccaacctcctgggccaggcagagtggctcatgcctgtaatcccagcactttgggaggcc

SEQ ID NO: 4254 - DNA, 315 bp, Homo sapiens
  AC008169.2_72300
  Located on chromosome 2
  Distance between a terminus base of telomere on chromosomal short arm and 5'-terminus of this base sequence : 213807986
  Distance between 3'-terminus of neighbour sequence of sequence listing upward to telomere on chrosomal short arm and 5'-terminus of this base sequence : 14181
aagatcagcaacatactgataaatggaaattaactgtaaattaaattcaatcattaaaataaggacatgcctgaaacaaaattaagaaattggcctaaagtgaaaattagggtatctcaatttattttaattcttcttattttattctgtgtgtgtgtgtgtgtgtgtgtgtgtgtctgtgtgtgtgtgtgtgtgtgtgtttgtgttgagagagtgtatgctacaataaaaagagcacagcccttagattctggcaaacagatgtttgactactgagtctattagttttaaaatatggtagcaagttacttgacc

SEQ ID NO: 4255 - DNA, 124 bp, Homo sapiens
  D2S143
  Located on chromosome 2
  Distance between a terminus base of telomere on chromosomal short arm and 5'-terminus of this base sequence : 213840017
  Distance between 3'-terminus of neighbour sequence of sequence listing upward to telomere on chrosomal short arm and 5'-terminus of this base sequence : 31716
ggaaaagtctataggtatatagggttgcagaattttaaaattcacacacacacacacacacacacacacacacacacacacacccccacacacaccccaagtcgtagcaggagtgacaaggaat

SEQ ID NO: 4256 - DNA, 138 bp, Homo sapiens
  D2S1327
  Located on chromosome 2
  Distance between a terminus base of telomere on chromosomal short arm and 5'-terminus of this base sequence : 213926874
  Distance between 3'-terminus of neighbour sequence of sequence listing upward to telomere on chrosomal short arm and 5'-terminus of this base sequence : 86733
tgaccaggggaagatactgagttcaaacacacacagatagatgagagatgatagatagatagatagatagatagatagatatttgagagatatatagacttgacatatttcaagcacagaatgttattattcaattca

SEQ ID NO: 4257 - DNA, 192 bp, Homo sapiens
  Z16658.1_97
  Located on chromosome 2
  Distance between a terminus base of telomere on chromosomal short arm and 5'-terminus of this base sequence : 213959265
  Distance between 3'-terminus of neighbour sequence of sequence listing upward to telomere on chrosomal short arm and 5'-terminus of this base sequence : 32253
cagttgagtagccaggaatttttgctattaataaatttctttcttgtggaaggtgtatgtgtgtgtgtgtgtgtgtgtgtgtgtgtgtgtgtgtaaatgtgtatatctaaaactttaattttcctatcttattattttcttccccttagacaaatctcagtttgttattattgtacctagagtaggagctaa

SEQ ID NO: 4258 - DNA, 154 bp, Homo sapiens
  D2S128
  Located on chromosome 2
  Distance between a terminus base of telomere on chromosomal short arm and 5'-terminus of this base sequence : 213959274
  Distance between 3'-terminus of neighbour sequence of sequence listing upward to telomere on chrosomal short arm and 5'-terminus of this base sequence : -183
agccaggaatttttgctattaataaatttctttcttgtggaaggtgtatgtgtgtgtgtgtgtgtgtgtgtgtgtgtgtgtgtgtaaatgtgtatatctaaaactttaattttcctatcttattattttcttccccttagacaaatctcagttt

SEQ ID NO: 4259 - DNA, 179 bp, Homo sapiens
  D2S1345
  Located on chromosome 2
  Distance between a terminus base of telomere on chromosomal short arm and 5'-terminus of this base sequence : 214032577
  Distance between 3'-terminus of neighbour sequence of sequence listing upward to telomere on chrosomal short arm and 5'-terminus of this base sequence : 73149
aaaagctacaggccagtgtgtcactgatgaacacagatgcgaaaattctcatgtaccctaaaacttaaagtataataataataataataataataataataataataataaaagttagcaagctaaatccagaagcacatcaaaaagaaaatatatcatgatcacacgggttttagtgc

SEQ ID NO: 4260 - DNA, 261 bp, Homo sapiens
  chr2.fa.O7frz.224446961
  Located on chromosome 2
  Distance between a terminus base of telomere on chromosomal short arm and 5'-terminus of this base sequence : 214238337
  Distance between 3'-terminus of neighbour sequence of sequence listing upward to telomere on chrosomal short arm and 5'-terminus of this base sequence : 205581
ttcactctagaaattcaacttgatgagggcagccagaatgtatcagactcagggtagccaaacaaaattacctaagagtgacatatatatatatatatatatatatatatatatatatatagaatacaaatcttagatcacaaacctagttgttcaagaaatattactagttatgtttcctatttgaatttagcttcgattttatgacttcatgctgctaagtggagaaatttaatactactcatttcatggtaatctgtt

SEQ ID NO: 4261 - DNA, 340 bp, Homo sapiens
  chr2.fa.O7frz.224828210
  Located on chromosome 2
  Distance between a terminus base of telomere on chromosomal short arm and 5'-terminus of this base sequence : 214640516
  Distance between 3'-terminus of neighbour sequence of sequence listing upward to telomere on chrosomal short arm and 5'-terminus of this base sequence : 401918
ctggctaacatggtgaaaccccggctctattaaaaatacaaaaattagccgggcgtggtggcacgtgcctataatcccagctacttgggaggctgaggcaggagaatcgcttgaacctgggaggtggaggttgcagtgagccgagatcacgccactgcactccagcctgggcaacagagggagactccatctcaatacatacatatatatatatatatatatataatatttttattttttaatttaaaaattttttgcaaataaaatattagaacatattattagttgatttatattgaagtcaaccataaaaagcatgtatctgtaggaagcacattca

SEQ ID NO: 4262 - DNA, 260 bp, Homo sapiens
  chr2.fa.O7frz.224944724
  Located on chromosome 2
  Distance between a terminus base of telomere on chromosomal short arm and 5'-terminus of this base sequence : 214738895
  Distance between 3'-terminus of neighbour sequence of sequence listing upward to telomere on chrosomal short arm and 5'-terminus of this base sequence : 98039
tacagatctttagcttcgattaacacacaaatttttactatgtgcttgtcaacggactgagtcttaagagcaaatatagatatgaaaaataaaattcttacctaaatgtgcatacaggcttcgtgtgtgtgtgtgtgtgtgtgcatgtgtgtgtgtgttttgtggtgggggaagttcataaagataggagaaaaaagacaagtatatgtacaaaacaatttcaattggcatgattcttcttacgctaatagagtcatgca

SEQ ID NO: 4263 - DNA, 144 bp, Homo sapiens
  DISD22_0002258
  Located on chromosome 2
  Distance between a terminus base of telomere on chromosomal short arm and 5'-terminus of this base sequence : 214894601
  Distance between 3'-terminus of neighbour sequence of sequence listing upward to telomere on chrosomal short arm and 5'-terminus of this base sequence : 155446
ttctccaaactgtggctggccctggggacttgtgtttttctcttttcaatctctctctctacacacacacacacacacacacacacacacacacacacacccatacattcactgtacttaaaacttctgatgtccttcaaccga

SEQ ID NO: 4264 - DNA, 439 bp, Homo sapiens
  AC012462.2_80913
  Located on chromosome 2
  Distance between a terminus base of telomere on chromosomal short arm and 5'-terminus of this base sequence : 215080582
  Distance between 3'-terminus of neighbour sequence of sequence listing upward to telomere on chrosomal short arm and 5'-terminus of this base sequence : 185837
agtctcgaactcctgaccttaggtgatctacccacctcggcctcccaaagtgctggaattacaggcatgagccatcacacctggccaaaaaaaaaaaaaatcttatttttaaataaaagatttgttttgggttttagcaccaaaaataagaaagaaagaaagagagagagagtgagagagaaagaaagaaaagaaagaaagaaagaaagaaagaaagaaagaaagaaagaaagaaagaaaggaagaaagaaaggaaggaaaggaaaggaaaggaagaaaagagagagagagaaaggaaggaaggaaggaaagagaaagaaagaaagggaaaggaaaggaaagaaaaagaaagaaagaggcatgtatatataaagttaagatagagatttccaacaaccttgcaaatcttattataaatgtagaaaggtaagatcgcaga

SEQ ID NO: 4265 - DNA, 462 bp, Homo sapiens
  AC073284.2_43028
  Located on chromosome 2
  Distance between a terminus base of telomere on chromosomal short arm and 5'-terminus of this base sequence : 215080631
  Distance between 3'-terminus of neighbour sequence of sequence listing upward to telomere on chrosomal short arm and 5'-terminus of this base sequence : -390
gtgctggaattacaggcatgagccatcacacctggccaaaaaaaaaaaaaatcttatttttaaataaaagatttgttttgggttttagcaccaaaaataagaaagaaagaaagagagagagagtgagagagaaagaaagaaaagaaagaaagaaagaaagaaagaaagaaagaaagaaagaaagaaagaaaggaagaaagaaaggaaggaaaggaaaggaaaggaagaaaagagagagagagaaaggaaggaaggaaggaaagagaaagaaagaaagggaaaggaaaggaaagaaaaagaaagaaagaggcatgtatatataaagttaagatagagatttccaacaaccttgcaaatcttattataaatgtagaaaggtaagatcgcagaaggccagatattttgagttgggtaagtttaagttcaagggtatcaagtgtgttcatagctctggtcacatgt

SEQ ID NO: 4266 - DNA, 334 bp, Homo sapiens
  AC073284.2_28760
  Located on chromosome 2
  Distance between a terminus base of telomere on chromosomal short arm and 5'-terminus of this base sequence : 215102596
  Distance between 3'-terminus of neighbour sequence of sequence listing upward to telomere on chrosomal short arm and 5'-terminus of this base sequence : 21503
tgtgctctttacaaagacaaacctgtgcaaattcatatttccagacttacaaataagtaattatatttttgacattaaatcatgtcaatgaggtttaaaaattatataaataattatctaattattcttcccaatccttatgtatatgatgtaacatcacacacacacacacacacacacacacacacaaacacacttcacatgaagttttctgttgtctcaaaattgtgttaatgaatgaaatgggagtaaactggacactagtctttagtctctactccctaaattgttgtcaaacaagacaacccacaagggcttcatcttaccagccatg

SEQ ID NO: 4267 - DNA, 378 bp, Homo sapiens
  AC012462.2_118292
  Located on chromosome 2
  Distance between a terminus base of telomere on chromosomal short arm and 5'-terminus of this base sequence : 215118063
  Distance between 3'-terminus of neighbour sequence of sequence listing upward to telomere on chrosomal short arm and 5'-terminus of this base sequence : 15133
cgttggacttccttaagaattctattttatccaggtgggttcttcctcagtaaattgtattctcctattggtaggaaatactcttggatttctttctttctttctttttctttctttctttctttctttctttctttctttctttctttctttttccttctttccttctttctttctaaaactgtattcagagagagaaatgtgacaaaaaaagggaaatcaatagagacagaaagtagattcatgggtacccaagtttatgggctgggaacaggaattaactgtaaaagggcacagggaatcttattgaggtgatggaaatctgtgttctaaaactacattgcagtgatgactgtacaatttggtaaaagcttcaaa

SEQ ID NO: 4268 - DNA, 419 bp, Homo sapiens
  AC012462.2_6369
  Located on chromosome 2
  Distance between a terminus base of telomere on chromosomal short arm and 5'-terminus of this base sequence : 215180150
  Distance between 3'-terminus of neighbour sequence of sequence listing upward to telomere on chrosomal short arm and 5'-terminus of this base sequence : 61709
ctaagttatatggccacctaagaacctcagttagaattttattttttaaaaaaagagaaaaaccccagagctctttcttttctttctttttctctttcttgctttctttctctttctgtctctcttccttcctcttccttccttttttctctgtctttctttttctttctctcccttttccttccttccttccttcctttctttccttctttctttcttccaactaagtttattcttctagtgatccccaagtagatatgctgctatgcaaaactccttgtgtgaaccaatatactttaaatattcctcatgttcccaggttgtaaaataagctgatcaattcaataataaaacaatttgaatgtctatctactctatagtcactggtgatgttggttatttggttacctcaatgaaga

SEQ ID NO: 4269 - DNA, 264 bp, Homo sapiens
  AC068082.2_50256
  Located on chromosome 2
  Distance between a terminus base of telomere on chromosomal short arm and 5'-terminus of this base sequence : 215224702
  Distance between 3'-terminus of neighbour sequence of sequence listing upward to telomere on chrosomal short arm and 5'-terminus of this base sequence : 44133
ttacgtgttcagtggattaaagagtatttgatgcacaggtgtttatgtaaccagatcttcaactgaattcccaaacttaataaagatgttaaaataagatgcgtacacacacacacacacacacatatagatgttctgaaccctgactacacattgcaatcacttaggagctctaaatgagaaaaaaaaaaataccgatgcccggattccatctccagacatttgtatttagttactctggcgtacctttcagtcattggactt

SEQ ID NO: 4270 - DNA, 248 bp, Homo sapiens
  D2S2361
  Located on chromosome 2
  Distance between a terminus base of telomere on chromosomal short arm and 5'-terminus of this base sequence : 215293292
  Distance between 3'-terminus of neighbour sequence of sequence listing upward to telomere on chrosomal short arm and 5'-terminus of this base sequence : 68326
ctggacgaccaagattcttctaacctttgaaaaaccaagacatgtcagaataatgcaagttatctgtttttataaacataccacacacacacacacacacacacacacacacacacacacacacacgacagggtcagtactagacaatgtaggtgtgtaaaaaagtactccaggctgggtgtggtggctgatacctatagtcccagcactttgaaaggccaaggtgagagaattgctttgagcccagg

SEQ ID NO: 4271 - DNA, 346 bp, Homo sapiens
  chr2.fa.O7frz.225596117
  Located on chromosome 2
  Distance between a terminus base of telomere on chromosomal short arm and 5'-terminus of this base sequence : 215466411
  Distance between 3'-terminus of neighbour sequence of sequence listing upward to telomere on chrosomal short arm and 5'-terminus of this base sequence : 172871
tgaggttctgtaaagaaattacactagctccattgtaaggtgatggtaagtatgtgtgtgtgtgtgtgtgtgtgtgtgtgtgtgtgtgtgtgtgtatgcaggtgcacatttgtactttatccccttagaggaaatggaatcttttattttgtgaggcattctgttttgctgtttttctagcaatacataaagctgtcttattctaagaaggtcaaagcattttatagacattacctcagcaggccatgcaagagtctagcagagtccgcatggtcaggtattattgtttcctgaatcaatgtcctgctgcaactcctaaaagggctcttgaatgctaaccaaagta

SEQ ID NO: 4272 - DNA, 355 bp, Homo sapiens
  AC010686.5_53275
  Located on chromosome 2
  Distance between a terminus base of telomere on chromosomal short arm and 5'-terminus of this base sequence : 215629233
  Distance between 3'-terminus of neighbour sequence of sequence listing upward to telomere on chrosomal short arm and 5'-terminus of this base sequence : 162476
gtgtctaactatgattggcttaaccattcaactctcttatgaagacaggttgaatccttttggctggatctaatgaccagttcaaagttcacttttgattaaaaactttgagctaaaatcttttcacaatctgaagaccaaccattaagatgaccttgtcttttgtctttcttggatggtgaaaaaccatcttcagaggaagatgttcatactcaggctaaaatgatccttattgtatttgatctgtgtacaacacacacacacacacacacacacacacacacacacacaaaacaaccagaagagtattgctcaaatgttatagatgacactctggtgaagttatgtaacttgc

SEQ ID NO: 4273 - DNA, 140 bp, Homo sapiens
  D2S137
  Located on chromosome 2
  Distance between a terminus base of telomere on chromosomal short arm and 5'-terminus of this base sequence : 215629456
  Distance between 3'-terminus of neighbour sequence of sequence listing upward to telomere on chrosomal short arm and 5'-terminus of this base sequence : -132
tgatccttattgtatttgatctgtgtacaacacacacacacacacacacacacacacacacacacacaaaacaaccagaagagtattgctcaaatgttatagatgacactctggtgaagttatgtaacttgccccatgcc

SEQ ID NO: 4274 - DNA, 257 bp, Homo sapiens
  AC012513.8_114051
  Located on chromosome 2
  Distance between a terminus base of telomere on chromosomal short arm and 5'-terminus of this base sequence : 215809962
  Distance between 3'-terminus of neighbour sequence of sequence listing upward to telomere on chrosomal short arm and 5'-terminus of this base sequence : 180366
tattaggtaagtgaggtcaaggacttggctttgttttttcacagggctcaagacagtgcctggcaaagaacaggcactgagtaaagtagcctttgaattgaactgaaaaagtaatgattctgttatgaaatctgtacaggattctaatggccaggtcttggggtcataggttttttgtttgtttgtttgttttgtttttacaacagcatggctgggaggtcataggtttttaactttgataaggttaaccgtgatag

SEQ ID NO: 4275 - DNA, 371 bp, Homo sapiens
  AC008123.9_52596
  Located on chromosome 2
  Distance between a terminus base of telomere on chromosomal short arm and 5'-terminus of this base sequence : 215858954
  Distance between 3'-terminus of neighbour sequence of sequence listing upward to telomere on chrosomal short arm and 5'-terminus of this base sequence : 48735
tcattaaagaccatgcaactagaaaacaagaataccaagagcaaagagcactcttcagtccgaactcttttagaagtggaagcagaaagaagggtgtttaagaaataagtcagcactgtgtgtgtgtgtgtgtgtgtgtgtgtgtgtgtgtgtgtgatttagagaaaaaatatttaagataccttctttttgtacttaaaatttcataagtacgtttgacttctgagaggaccagaatgccatgggaagtgctcagttgcatccagtacctgttgtttattgtcatggtccacacggttgcatgtcacaaccgtgttagaactgaaggaaaggaaatgtatgtaactctaaagacgtttcaagtagaagtg

SEQ ID NO: 4276 - DNA, 259 bp, Homo sapiens
  D2S2382
  Located on chromosome 2
  Distance between a terminus base of telomere on chromosomal short arm and 5'-terminus of this base sequence : 215859000
  Distance between 3'-terminus of neighbour sequence of sequence listing upward to telomere on chrosomal short arm and 5'-terminus of this base sequence : -325
agcactcttcagtccgaactcttttagaagtggaagcagaaagaagggtgtttaagaaataagtcagcactgtgtgtgtgtgtgtgtgtgtgtgtgtgtgtgtgtgtgtgatttagagaaaaaatatttaagataccttctttttgtacttaaaatttcataagtacgtttgacttctgagaggaccagaatgccatgggaagtgctcagttgcatccagtacctgttgtttattgtcatggtccacacggttgcatgt

SEQ ID NO: 4277 - DNA, 426 bp, Homo sapiens
  AC012513.8_63241
  Located on chromosome 2
  Distance between a terminus base of telomere on chromosomal short arm and 5'-terminus of this base sequence : 215870286
  Distance between 3'-terminus of neighbour sequence of sequence listing upward to telomere on chrosomal short arm and 5'-terminus of this base sequence : 11027
taaaggctatgaaatccacagtgattcccaccctggccacacattagttacttggtgagcttgtttttcttttttttcttttcttttcttttcttttcttttcttttcttttcttttctctttcttttctctctctctctgtttctttctttcttttttttttttgttaatactgattaaaaatcagaattaccctagagattctgttagtctgagatgggtcctgggcacagttggtttgtttgcattttaaaacccctcaggtgattgtattgtatagtgaatagagaaacactagtattctagcataagggacatccaagtattttcagtaaaagaccccatgcagtccccatgagcttcttattcacacacattgttaggcctaggcctccttgtttggtgtgtattgaatctgattcagcc

SEQ ID NO: 4278 - DNA, 303 bp, Homo sapiens
  AC008123.9_94947
  Located on chromosome 2
  Distance between a terminus base of telomere on chromosomal short arm and 5'-terminus of this base sequence : 215901323
  Distance between 3'-terminus of neighbour sequence of sequence listing upward to telomere on chrosomal short arm and 5'-terminus of this base sequence : 30611
attggcatactgaagtgataatactttttgtaagtttattttgcatcctgcaactttactgaatttatttagcagatctataagagtttgtgtgggtttgtgtgtgtgtgtgtgtgtgtgtgtggagcctttaggtgtttctagatataagataataccgtaagtaaaaagggacaatttttttccttttcttttttattttttaaatttagattccttttatttccttctcttgcctggctcctctggctaggaatgggagtggtgaaagcaggcatccttgttcgaattcttagaggcttt

SEQ ID NO: 4279 - DNA, 348 bp, Homo sapiens
  AC008123.9_103657
  Located on chromosome 2
  Distance between a terminus base of telomere on chromosomal short arm and 5'-terminus of this base sequence : 215910032
  Distance between 3'-terminus of neighbour sequence of sequence listing upward to telomere on chrosomal short arm and 5'-terminus of this base sequence : 8406
cagtgtaaaccaacagctttagctgggagaggcccagtgccccacatggccctgcatggcacacaggaacagtggcaggtggtcatggagccaggtagatgtgtgtgtgtgtgtgtgtgtgtgtgtgtgtgtgttttgagacagagtctcaccccgtcgcccatgctggagtgcagtggtgtgatctgcaacctccgcctcccaggttcaaatgattctcctgcctcagcctctcaagtagctgggattataggcatgcaccaccactcttggctaattttttgtatctttagtagagatgggatttcaccatgttggtcaggctggtcttgaacttctgatcttgtg

SEQ ID NO: 4280 - DNA, 196 bp, Homo sapiens
  AC008123.9_124154
  Located on chromosome 2
  Distance between a terminus base of telomere on chromosomal short arm and 5'-terminus of this base sequence : 215930597
  Distance between 3'-terminus of neighbour sequence of sequence listing upward to telomere on chrosomal short arm and 5'-terminus of this base sequence : 20217
atccactggaaatctgtacttttctctaggggtgtgtgtgtgtgtgtgtgtgtgtgtgtgtgtgtgtgtgtcctgtaaacatctttgaaccaaatcactataaaataaattaacaagggcacagaaggacacccttttccaaacctaagccctcttttagcccacctgaaatcgggagttccatttggaagttcct

SEQ ID NO: 4281 - DNA, 153 bp, Homo sapiens
  DISD22_0002264
  Located on chromosome 2
  Distance between a terminus base of telomere on chromosomal short arm and 5'-terminus of this base sequence : 216045561
  Distance between 3'-terminus of neighbour sequence of sequence listing upward to telomere on chrosomal short arm and 5'-terminus of this base sequence : 114768
tgcagctgtagactttggtcactgaaaacttaggattgctttttttgcctttccttataaacctctctcccccaccccgctctctctctctctctctctctctcacacacacacacacacacacacacacacccctctagggccatagagaag

SEQ ID NO: 4282 - DNA, 447 bp, Homo sapiens
  M2_216231292
  Located on chromosome 2
  Distance between a terminus base of telomere on chromosomal short arm and 5'-terminus of this base sequence : 216231247
  Distance between 3'-terminus of neighbour sequence of sequence listing upward to telomere on chrosomal short arm and 5'-terminus of this base sequence : 185533
acaacagaatggaaaggaaagaatgttttctcttttgtcttttactttatttatttatttatttatttatttatttatttatttatttatttattttttgagacagagccttgctctgtttcccaggctggagtgaagcggtgtgatcatggctcaccacagcctcaacttcctgggctcaaacgatcctcctgcctcagccctcctgagtagctgagacaataggcatataccaccacactcggctgttttataattttttattttttagtagagacaaggtcttactctttcccagtctggtctcgaattcctgatctcaggtgatcctccaccttggtccctgaaagtgttgggattatgggcatgagccactttgcccagcctggaaagaatgtttttgaaagatgatgttaataaagaacaaacaggattccactgattaaa

SEQ ID NO: 4283 - DNA, 406 bp, Homo sapiens
  AC073321.1_130350
  Located on chromosome 2
  Distance between a terminus base of telomere on chromosomal short arm and 5'-terminus of this base sequence : 216326781
  Distance between 3'-terminus of neighbour sequence of sequence listing upward to telomere on chrosomal short arm and 5'-terminus of this base sequence : 95087
gcaagtagctttaacttctcagagcatcactttcctcacctgaaaagtggagatgataagagctgatttgtaggggttttttgaagattaaatgagatcacttttggatatcactttgctaaggggctggcacatagtggactacccagccatgccactgttccgttcctccttcttctttctcctccttcctattcctcctccacttcctctcttgttgttgctattactattattattattattattattactagctagccaggctgcctgtatttctccagaaaaccattacccatggtttaaaaaatccacccttggccaggtgcggtggctcacgcctgtaatcccagcactttgggaggtcgaggtgggcggatcaggaagtcaggagatcaagaccatc

SEQ ID NO: 4284 - DNA, 320 bp, Homo sapiens
  chr2.fa.O7frz.226513113
  Located on chromosome 2
  Distance between a terminus base of telomere on chromosomal short arm and 5'-terminus of this base sequence : 216475430
  Distance between 3'-terminus of neighbour sequence of sequence listing upward to telomere on chrosomal short arm and 5'-terminus of this base sequence : 148243
aggagtgacaatctatccattttcctttccagctcctcttgcccaagcccatgtatcaaatgagaaagtaggctaggtgcagaatgccacatgaaggtgagagggaggacttggttggggagaggttgctaattagaggggtcttgtggcctagaacagcttcttagtcttggctttaggccaaagcctaactagatgtaaaacaattgatcaaattaaaagtgtgtgtgtgtgtgtgtgtgtgtctgtgtgtgctgggaaaagtgttgagaggagtggttcataggtattatttgcttattggttaggttgtatcttga

SEQ ID NO: 4285 - DNA, 161 bp, Homo sapiens
  chr2.fa.O7frz.226685930
  Located on chromosome 2
  Distance between a terminus base of telomere on chromosomal short arm and 5'-terminus of this base sequence : 216648362
  Distance between 3'-terminus of neighbour sequence of sequence listing upward to telomere on chrosomal short arm and 5'-terminus of this base sequence : 172612
gattacagctgtgagccactgtgcccagcctactcagttctttttacagagagctcggttttctggcacaggtaaagaactccataaataggttctttcttttaatcaacaacaacaacaacaacaacaacaaaacccttgaatggagatactgttatcat

SEQ ID NO: 4286 - DNA, 234 bp, Homo sapiens
  D2S301
  Located on chromosome 2
  Distance between a terminus base of telomere on chromosomal short arm and 5'-terminus of this base sequence : 216734863
  Distance between 3'-terminus of neighbour sequence of sequence listing upward to telomere on chrosomal short arm and 5'-terminus of this base sequence : 86340
ggaaaatctcgaatgtaccaatagtaataatcttgggttaaaattgttggcatcagcaaaaactcatggttttattaaatatattaacatttaataaataatatgtattaatatataatttcatatatacgtacatctatatgtatcttatatgtatttcttttttatatataacatctgtgtgtgtgtgtgtgtgtgtgtgtgtgtgtgtgtgtacaccccttcagtcctatg

SEQ ID NO: 4287 - DNA, 171 bp, Homo sapiens
  D2S2248
  Located on chromosome 2
  Distance between a terminus base of telomere on chromosomal short arm and 5'-terminus of this base sequence : 216786791
  Distance between 3'-terminus of neighbour sequence of sequence listing upward to telomere on chrosomal short arm and 5'-terminus of this base sequence : 51694
tcgctaaatgtccccccaccacacacacacacacacacacacacacacacacacacctgcccctggcaggcccagcctcagggctcagccaggtgactttttcttctgggtcattaggagtctggggtgagcccaggctacaggaggaaggcattactttgtcattttggg

SEQ ID NO: 4288 - DNA, 285 bp, Homo sapiens
  D2S164
  Located on chromosome 2
  Distance between a terminus base of telomere on chromosomal short arm and 5'-terminus of this base sequence : 216807593
  Distance between 3'-terminus of neighbour sequence of sequence listing upward to telomere on chrosomal short arm and 5'-terminus of this base sequence : 20631
gtcctaacaggccacagacccgtactggtccatggtccagggattggggatccctgctgtatcatatacttgacatttgctaagagagtagatcttgtgttcttaacacacacacacacacacacacacacacacacacacacacggtacctatgggaagacatggatatgttacttagcctgattgtagtattcagttgtacatcttagatatatacaattatgatttaaaaaagaaaaaggaaacagagacacacaggaagaatgtcatgtgataatgacagc

SEQ ID NO: 4289 - DNA, 455 bp, Homo sapiens
  AC009492.3_50045
  Located on chromosome 2
  Distance between a terminus base of telomere on chromosomal short arm and 5'-terminus of this base sequence : 216997332
  Distance between 3'-terminus of neighbour sequence of sequence listing upward to telomere on chrosomal short arm and 5'-terminus of this base sequence : 189454
ccttagctacagaatcagtcatttttttttcaaagagccctaattccttttagtagagaatagtatttaaaaaccaagatcgggaagccaggtggtctcgctgcactgcaattccttggttttaggccctctaagaatacacagctaggaaatagatttatgtacacacacacacacacacacacacacacacacctgcatccacatacatctcaatatttatatccacataggtcgatctctttttgtagctatctagatagtatatgccatgagttctcactgaaagctccaattccaatccaacaccactgaagtgttgctaacatttcccctcaccatgtttgtaactaccttctcttataaggtgaacactggctgccatcttctataatatatttacttatttgctcaatactagaattcacacagaatagtttcagaattgctatcct

SEQ ID NO: 4290 - DNA, 412 bp, Homo sapiens
  AC009492.3_111140
  Located on chromosome 2
  Distance between a terminus base of telomere on chromosomal short arm and 5'-terminus of this base sequence : 217043550
  Distance between 3'-terminus of neighbour sequence of sequence listing upward to telomere on chrosomal short arm and 5'-terminus of this base sequence : 45763
gtaaagccttccagatgttaacaactatttagggagaaaaaggcttatcctgaattactaaaagatttagctagtatgtgaattatgtcattatagacagtgatacaataaagcaacatagcataatgtgctattcacaggtctagaactttctgaaaaggagaatgagaggtgaggaagctctcgaggggcccatgtgttgggggtggtggatatgtacacacacacacacacacacacacacacacactcaccctgtcctgccaccattaggtaaagtttcctgccactccttgcacatccgtcattaccaaagagatattaaactagacaactgtaaaaaaataacaccttcagtggcaaaactgccttatgcagagatgtggatgatttgttacctacttcatcgttg

SEQ ID NO: 4291 - DNA, 381 bp, Homo sapiens
  chr2.fa.O7frz.227174867
  Located on chromosome 2
  Distance between a terminus base of telomere on chromosomal short arm and 5'-terminus of this base sequence : 217054402
  Distance between 3'-terminus of neighbour sequence of sequence listing upward to telomere on chrosomal short arm and 5'-terminus of this base sequence : 10440
gatactaggaaggttatggcaggagaatcacttgagcccaggagttggaggctgcagtgagctatcatcacgccactgcactccaacctgggcaacaaagtgagaccctgtctcttagaaaagaaatttaaaaaaaagagaaaaagagagagagaaggaaagaaaaagaaagaaagaaaggaaggaaggaaggaagagagaaagaaagaaagagagagaaagagagagagaaagagagggagggagggagggaggacggaaggaaggaaggaaggaagggaaagaagaatagaaatggaattatcacagcatatatcaagggactcacaacacaaggaaaacccctagctctagagcaggtatgcaaatgcgtacataagt

SEQ ID NO: 4292 - DNA, 409 bp, Homo sapiens
  AC009492.3_154660
  Located on chromosome 2
  Distance between a terminus base of telomere on chromosomal short arm and 5'-terminus of this base sequence : 217087095
  Distance between 3'-terminus of neighbour sequence of sequence listing upward to telomere on chrosomal short arm and 5'-terminus of this base sequence : 32312
agatcactctagtctatccattgtttttattagtttgggtccatacagaccattctctaattttactttcatatgtgttgagttagtgcatccatgggcagggggaccaagagaggaggcctgaatccagataggagagggccagaatagaaacaggaaattaaaagtagaaaagggtagtgtgtgtgtgtgcgtgtgtgtgtgtgtgtgtgtgcgtgtagaaaagggaggaaaagccacaatcaggaaacccagatctttcctccctctgcctctccagccttggaaattctttctgaaatacagctggcattcacttcttatatactgagcctcgtgaccttggctggtacccatgtccacactacatttatggcatccaaattgctaatttggtgttaaggtggat

SEQ ID NO: 4293 - DNA, 108 bp, Homo sapiens
  D2S1371
  Located on chromosome 2
  Distance between a terminus base of telomere on chromosomal short arm and 5'-terminus of this base sequence : 217094651
  Distance between 3'-terminus of neighbour sequence of sequence listing upward to telomere on chrosomal short arm and 5'-terminus of this base sequence : 7147
ttggggggaagcattaaaatatctctatctatctatctatctatctatctatctatctatctatctatctatcattcctacagagaaaggaaagcccttcttgctatc

SEQ ID NO: 4294 - DNA, 476 bp, Homo sapiens
  chr2.fa.O7frz.227381340
  Located on chromosome 2
  Distance between a terminus base of telomere on chromosomal short arm and 5'-terminus of this base sequence : 217261022
  Distance between 3'-terminus of neighbour sequence of sequence listing upward to telomere on chrosomal short arm and 5'-terminus of this base sequence : 166263
tcactttcagactgaaactcacacaattggctctcctgattctcaggcctctggatttagatcttagacttgtcagcctccagaatcacacaagccaactcctcataatatatctatctatctatctatctatctatctatctatctatctatctatctatctatctatccatctacccatattatatataatatatacacacatatatacacacacattatatatatacacatgatatatattatatatacatatatatgttcagatatgtatatataatatataatgtgtatatatataatgtgtgtatatataatgtgtatatatataatgtgtgtatatatgtgtatatatataatgtgtgtatatacgcacacacacacacacagacatcctattggttccgttctctggagaaccctgattaaaacagatttcaattctccccaaaattagcttatagattcaatgcact

SEQ ID NO: 4295 - DNA, 333 bp, Homo sapiens
  chr2.fa.O7frz.227478054
  Located on chromosome 2
  Distance between a terminus base of telomere on chromosomal short arm and 5'-terminus of this base sequence : 217345270
  Distance between 3'-terminus of neighbour sequence of sequence listing upward to telomere on chrosomal short arm and 5'-terminus of this base sequence : 83772
gcaagtgcctacagtatctagtacagtaacatgctgtacaggtttgtagcctaggagtaacagactatatcatacagtagcataggtgtttagtaggctctacggttgaggtttatgtaaatacactctacgatgttcacacaatgacagaagtcacctaatgacatatcccgggaacaaatctttgttggtaagtaatgcatgactcgtgtgtgtgtgtgtgtgtgtgtgtgtgtgtgtgtggtgtgtgtggtgtgtgtgttgtgtgcatgcgtgttttaaattcaggaaatgtgagctctgcaaacctggtggacaaattcctataaagga

SEQ ID NO: 4296 - DNA, 266 bp, Homo sapiens
  G08158
  Located on chromosome 2
  Distance between a terminus base of telomere on chromosomal short arm and 5'-terminus of this base sequence : 217424191
  Distance between 3'-terminus of neighbour sequence of sequence listing upward to telomere on chrosomal short arm and 5'-terminus of this base sequence : 78588
taaatcactagcctttgccgggtctctactttctcatctcaggaatacaccaccagcccttgctactctgcagaacttcgtagaagaacatgtaagagtatggatgtggaaatcatagccaacttcctacttggtgggatacctggagaagactcagagatggcagatagatagatagatagatagatagatagatagatagatagatagatagatagaaagaaaaacagatcatctcccagatttctgggaacagtacagatggc

SEQ ID NO: 4297 - DNA, 144 bp, Homo sapiens
  D2S2249
  Located on chromosome 2
  Distance between a terminus base of telomere on chromosomal short arm and 5'-terminus of this base sequence : 217562948
  Distance between 3'-terminus of neighbour sequence of sequence listing upward to telomere on chrosomal short arm and 5'-terminus of this base sequence : 138491
ggaactcagtgatttcacaccctgtacagtcagcagcccagccaccagccccgacagacacacacacacacacacacacacacacacacacacacacacgcacgcacgcacctccccttactctaatccaggctctccgttagc

SEQ ID NO: 4298 - DNA, 355 bp, Homo sapiens
  AC009469.3_77237
  Located on chromosome 2
  Distance between a terminus base of telomere on chromosomal short arm and 5'-terminus of this base sequence : 217567835
  Distance between 3'-terminus of neighbour sequence of sequence listing upward to telomere on chrosomal short arm and 5'-terminus of this base sequence : 4743
ccagactcaggtaaacctctacggtgctcctgttgtcccttgtagacatctctactgtgacaacagtcacccacagaatggtcattactgatgtccatgtctgtcttcccactttgctgagagcttgttgaggaagagcctttatctctctctctctctctctctctccctctccctagggccggttcccagacggtgccatccacaatgtggtctgtgtgaatgatgcctcttgaagttcaatatgtaacctgcatggctgtacagaatggccctagagaagagtgcttgttccataaatgcttcttgccttacaccgagtagccgagaaagctttatgtagttctgtcagcca

SEQ ID NO: 4299 - DNA, 118 bp, Homo sapiens
  D2S173
  Located on chromosome 2
  Distance between a terminus base of telomere on chromosomal short arm and 5'-terminus of this base sequence : 217621962
  Distance between 3'-terminus of neighbour sequence of sequence listing upward to telomere on chrosomal short arm and 5'-terminus of this base sequence : 53772
gagggctgttgacccacaggtgcctgggtgcccacacacacacacacacacacacacacacacagttagacctacggtgggacttaaggacgtgcatttctaccaggtttccaggcaa

SEQ ID NO: 4300 - DNA, 110 bp, Homo sapiens
  D2S2179
  Located on chromosome 2
  Distance between a terminus base of telomere on chromosomal short arm and 5'-terminus of this base sequence : 217659336
  Distance between 3'-terminus of neighbour sequence of sequence listing upward to telomere on chrosomal short arm and 5'-terminus of this base sequence : 37256
tccccagtgtcatttccaccatcgctctctctctctctctctctctctctctctctcacacacacacacacacacacacacagtaaaaactgctctctgaacaagtctgc

SEQ ID NO: 4301 - DNA, 456 bp, Homo sapiens
  AC010136.6_87350
  Located on chromosome 2
  Distance between a terminus base of telomere on chromosomal short arm and 5'-terminus of this base sequence : 217699037
  Distance between 3'-terminus of neighbour sequence of sequence listing upward to telomere on chrosomal short arm and 5'-terminus of this base sequence : 39591
gccgactatttggactgaggaactcctacacatccctcaagacccaacctgcacatgccttccctgctgaagcctgacaagaacatctctactgagtcagaaacggccctccacatacacacacacacacacacacacacacacacacgcacgcacgcacgtacctgtgtcagctttggtaccgtgctccatgattgtctgactgtgtctgtcttcccaggtaaggggctggctctcagcaccaggacctggcacagcatctgacccagaggacagctcagttcatgattgccagatggctgcacgcagcgcggaggaggtgagcagcagcctgcgtgggggaagctatcctacctctgcagactccaaccagggagttttccaggccctccccactgtcagggcctcagcaagtattcttggtccagccctgttaatcatagatgaggaaactga

SEQ ID NO: 4302 - DNA, 182 bp, Homo sapiens
  chr2.fa.O7frz.228362472
  Located on chromosome 2
  Distance between a terminus base of telomere on chromosomal short arm and 5'-terminus of this base sequence : 217904580
  Distance between 3'-terminus of neighbour sequence of sequence listing upward to telomere on chrosomal short arm and 5'-terminus of this base sequence : 205087
acctgcatcctagagtctatctccccatcatttttcagaagcctcacactattcatttttttctttctttctttctttctttctttctttcctttctttcctttttctttcctttctttcctttctttctttctctttctttctttccaacttttccctctctcttgcatccacctagtcag

SEQ ID NO: 4303 - DNA, 140 bp, Homo sapiens
  DISO7_10001045
  Located on chromosome 2
  Distance between a terminus base of telomere on chromosomal short arm and 5'-terminus of this base sequence : 218122702
  Distance between 3'-terminus of neighbour sequence of sequence listing upward to telomere on chrosomal short arm and 5'-terminus of this base sequence : 217940
tcttgtccttgtaatcgagtgtatctctctctctctctctctctctctctctctctctatatatatatatatatatatatatactcctttttattcacaagaaagtgttatttttttcataacctgtgacataggaggca

SEQ ID NO: 4304 - DNA, 101 bp, Homo sapiens
  DISO7_10001044
  Located on chromosome 2
  Distance between a terminus base of telomere on chromosomal short arm and 5'-terminus of this base sequence : 218144689
  Distance between 3'-terminus of neighbour sequence of sequence listing upward to telomere on chrosomal short arm and 5'-terminus of this base sequence : 21847
tccctcacctcaagtgtgtgctggcttctctctcagcctcattcactcattcattcattcattcattcagcataagtgtgctctaggatatggagatggga

SEQ ID NO: 4305 - DNA, 449 bp, Homo sapiens
  AC064861.2_168104
  Located on chromosome 2
  Distance between a terminus base of telomere on chromosomal short arm and 5'-terminus of this base sequence : 218169606
  Distance between 3'-terminus of neighbour sequence of sequence listing upward to telomere on chrosomal short arm and 5'-terminus of this base sequence : 24816
aaccgctaattccagctactcgggaggctgaggcatgagaattgcttgtacccaggacgtggaggttgcagtgagccaagattgcaccactgcactccagcctgggtgacagagtgagaggctctcccccacaataaacacacacacacacacacacacacacacacacacacacacacacacacacacacactttctttatatgttcttctatgtgtgaatggtaattttaccattaaaaaaatgtaattaaaaagatctccacaccttgaagacttaactcggtagctcttttgaggtcatcatcttctttctgttcccaagcctcctaaagggaaaagaacaaaaactaaggtatttaaagaggtactgattaaacttacttaatgaggataaaatcagtttctctggaagcatttgctaagaatgctttctataaccttatggat

SEQ ID NO: 4306 - DNA, 441 bp, Homo sapiens
  chr2.fa.O7frz.228855966
  Located on chromosome 2
  Distance between a terminus base of telomere on chromosomal short arm and 5'-terminus of this base sequence : 218259349
  Distance between 3'-terminus of neighbour sequence of sequence listing upward to telomere on chrosomal short arm and 5'-terminus of this base sequence : 89294
ggtaagtgtctaagatttatgcaacaaggtaacttttcccaactgtaatttaaatcctcctccctggtggaggttgcagtgagctgagatcacacgactgcactccagcctaggtgttagagcaagactccatttcaaaacaaacaaacaaacaaacaaacaaataaataaataataaaaaatcctgctcctttgtctaatcatattgttttgtggaatctacatataagatcaagtcatctgcaaacacaaataattttacttcttcctatccaatttggatgcctgttatttccttttcttgcctaatggctctggctaagacttctagtactatgttaaatagaagtggcaagagcaggtattcctgccttgctaatgatcttagaggaaacatttccagtttttcacccctaagtacgatgttagctgtaagttgtt

SEQ ID NO: 4307 - DNA, 316 bp, Homo sapiens
  chr2.fa.O7frz.228933538
  Located on chromosome 2
  Distance between a terminus base of telomere on chromosomal short arm and 5'-terminus of this base sequence : 218303041
  Distance between 3'-terminus of neighbour sequence of sequence listing upward to telomere on chrosomal short arm and 5'-terminus of this base sequence : 43251
gtaactaggcactttggtcaggtgatccttgtcatgcctgcttctcccctctgtctacctacacaacacacacacacacacacacacagccctgctaagatggcagtagtggttcttttgtgaacatgttttttggggagactccatctgaggtacaaaagctgtttgggaggctgggagggggatgatgccccttacctgataaaagtatgttttactgggacagaacttcactcctggccatattggccagaacttagtgccagtgtagggagagacttccatagtgacaaggtaatgcttgaaacatcttacg

SEQ ID NO: 4308 - DNA, 304 bp, Homo sapiens
  AC009974.7_162285
  Located on chromosome 2
  Distance between a terminus base of telomere on chromosomal short arm and 5'-terminus of this base sequence : 218487283
  Distance between 3'-terminus of neighbour sequence of sequence listing upward to telomere on chrosomal short arm and 5'-terminus of this base sequence : 183926
tttcaggattagtctacttgaaaggaaataagttctgagagtcgaagtgcaaaggaatacaaaagaaagcattcttatgatctaacactgtgaactaattggtgttttctggtatttggttaagtatagtataaggatttggcactataggatgtaagagaattatgacctcgttaatggctcctaagtcttgaactagatcatatatatatatatatatatataattttttttttttgagatggagtctcactctgttgtccaggttggagtgcatggcacaatctcagctcactgcaatctc

SEQ ID NO: 4309 - DNA, 402 bp, Homo sapiens
  AC073128.2_139839
  Located on chromosome 2
  Distance between a terminus base of telomere on chromosomal short arm and 5'-terminus of this base sequence : 218498991
  Distance between 3'-terminus of neighbour sequence of sequence listing upward to telomere on chrosomal short arm and 5'-terminus of this base sequence : 11404
ctagcgaaatgtacctgaaatttttattgtcttcccaggaatatgggtttgacaaaccaaatattggtcataaactattttagcaatgtagaagtcactacacacacacacacacacacatttaatttggatcattttatgtttttcatgatgagttatggaatgcagaacttttaataaaaaaaagctttaaggactcaggaaggacaaggtggctgtcctggttctctgtgagtccatgcttaacattggacttacatcctcttggataccagttgtttctccaatttaggtgcatagcactaataattgataagttatcataggtaatttgacttagaacatggagttcattcaaactgtatatctaaacaatttcagtactggatgatttagcatgaa

SEQ ID NO: 4310 - DNA, 177 bp, Homo sapiens
  D2S2250
  Located on chromosome 2
  Distance between a terminus base of telomere on chromosomal short arm and 5'-terminus of this base sequence : 218599289
  Distance between 3'-terminus of neighbour sequence of sequence listing upward to telomere on chrosomal short arm and 5'-terminus of this base sequence : 99896
ctgaaactcaccgaacacccctccacccaccccaccacacacacacacacacacacacacacacacacacacacacacacacacggcctggagcgagatacagcggggccagcaccctcctgctcctggcccctaccccaggggtggcaggagagggaatttccctgcctatttggg

SEQ ID NO: 4311 - DNA, 198 bp, Homo sapiens
  G08149
  Located on chromosome 2
  Distance between a terminus base of telomere on chromosomal short arm and 5'-terminus of this base sequence : 218608143
  Distance between 3'-terminus of neighbour sequence of sequence listing upward to telomere on chrosomal short arm and 5'-terminus of this base sequence : 8677
cctggagtgtcattgtttccagacctctcagtggacagtcctaggaaatatatgtattattatacacacatttatgtctactatgtatctatgtatctatccatctatctatctatctatctatctatctatctatctatctatctatctatctatcatctatctattgatctttccatgtaaaaaacaatgagttca

SEQ ID NO: 4312 - DNA, 273 bp, Homo sapiens
  AC020575.3_3481
  Located on chromosome 2
  Distance between a terminus base of telomere on chromosomal short arm and 5'-terminus of this base sequence : 218760871
  Distance between 3'-terminus of neighbour sequence of sequence listing upward to telomere on chrosomal short arm and 5'-terminus of this base sequence : 152530
gcagtaattctcagtcaccaggaaagatccccgcccactgggtggctgcctccttctcaccaccctcccctcaaggctgtgtgtgtgtgtgtgtgtgtgtgtgtgtgtgtgtttgggagggggtcattccaagcagagatctctttgttgtgcaaacccaggatgtggaatcctggcccctgacatggttggggagggaaggggaagccctcaaagacacagggaaggtgcaccaggaccatgccaggcccctgacaggcaaatctttcagtg

SEQ ID NO: 4313 - DNA, 465 bp, Homo sapiens
  AC027000.3_77499
  Located on chromosome 2
  Distance between a terminus base of telomere on chromosomal short arm and 5'-terminus of this base sequence : 218800441
  Distance between 3'-terminus of neighbour sequence of sequence listing upward to telomere on chrosomal short arm and 5'-terminus of this base sequence : 39297
tagctacatatggctattggctaccacattggacagcatcactttaataccttttttgaacatatgtttatttttcagactactcagtatcctccctcacttcttcaaataacaatctcaaaaataataatgtctattaacatgtactgagaatccacgtgccaggcagtgttgtaaagtccttagagggattttatttatttatttatttatttatttatttatttatttaagacagactctcattctgttgcccaggctggagtgcagtggcaagatcttggctcactgcaacctccacctcccaggttcaagcaattctcccttacaggtattttaattcttacaacagtttatgattacgtgtgacttgcccatttatttggcctaaaatgatcctttttcaagtttgtcgtttagttccttattttaatgtgttcagatttagcaaacaatttcatgatc

SEQ ID NO: 4314 - DNA, 480 bp, Homo sapiens
  AC020575.4_98474
  Located on chromosome 2
  Distance between a terminus base of telomere on chromosomal short arm and 5'-terminus of this base sequence : 218875503
  Distance between 3'-terminus of neighbour sequence of sequence listing upward to telomere on chrosomal short arm and 5'-terminus of this base sequence : 74597
cttaccaggcctaagaaatgtctgaacagagtcttattcaagccaagggaaaacgctgttaaaacacacaaaactcctttgactaatgtgagagggggaaagagcctctataattaacagaaactgtcacaggcattgggggcctccgacgtgttcaatgctaaccacttgaaaagacccggtcttctaggaggttggggtttgtgagtggggctccaacagactggggacagcttttccaaaagaatcccaccgtattttaaaaagaagaagaagaagaagaagaagaagaagaaagggggcagggggaggaaaaacccaaacctcagcttaatgtttttccaccagtggaactaaaaagcaaaaaagaagaagaaaagtccaaatgtaaccagttttcaattagggcctaattagaaagaaaagtggccatgctattacagatctaggaaggaagaaatgcagtcaatgactttagtt

SEQ ID NO: 4315 - DNA, 228 bp, Homo sapiens
  D2S2244
  Located on chromosome 2
  Distance between a terminus base of telomere on chromosomal short arm and 5'-terminus of this base sequence : 219081556
  Distance between 3'-terminus of neighbour sequence of sequence listing upward to telomere on chrosomal short arm and 5'-terminus of this base sequence : 205573
agctgctcagggggactgaggcaggaggatcacttgagcctgggaagttgaggccgcagtgagccaagattgcatcactgcactccagcctgggcaacagaccaagacactgtctcaaaacaaacaaacaacacacacacacacacacacacacacacaatccatgcttacagcataattaggagacagaaaacaccacaaactatgatggtaaaatgttgccacctg

SEQ ID NO: 4316 - DNA, 172 bp, Homo sapiens
  chr2.fa.O7frz.229821506
  Located on chromosome 2
  Distance between a terminus base of telomere on chromosomal short arm and 5'-terminus of this base sequence : 219246786
  Distance between 3'-terminus of neighbour sequence of sequence listing upward to telomere on chrosomal short arm and 5'-terminus of this base sequence : 165002
gcttgtcggtctatttgttcttctgttcgcccatccgtcgatctggccatctgccatccatccatccatccatccatccatccatccatccatccatccatgcatgcatcccagcatcctctccacacctccttgtgtgtctgaggcctcacatagttgattagctctggtg

SEQ ID NO: 4317 - DNA, 466 bp, Homo sapiens
  chr2.fa.O7frz.230117682
  Located on chromosome 2
  Distance between a terminus base of telomere on chromosomal short arm and 5'-terminus of this base sequence : 219398154
  Distance between 3'-terminus of neighbour sequence of sequence listing upward to telomere on chrosomal short arm and 5'-terminus of this base sequence : 151196
ctttacctgccttcctgttggatggatacatggctattttcttactgttagagacacattctctctctctctctctctctctctctctctctctctgtccatctctcctctccctttgtctctctcattaaagcaaataacatagcaggaggaatgggaaaagtagcaaatcccaggctagtctcatcatttctgggctgaaatggaaccacttgtggtgtgtggaatcgtggcatccggcatgccacattccctgctccctgttgtcctgccctgtctgtctgctacaatcacctggagcccctccctcaaccaagacatcaacaacagaaacaaaactgcttcctctgaccagcaggaaatttccaggtgaacacactctggcttaagtaattaggcaaagaatgtggctttgtgcagttgtggagagactcaacttgctcttagagtctttgtttctgttcag

SEQ ID NO: 4318 - DNA, 264 bp, Homo sapiens
  chr2.fa.O7frz.230194727
  Located on chromosome 2
  Distance between a terminus base of telomere on chromosomal short arm and 5'-terminus of this base sequence : 219475082
  Distance between 3'-terminus of neighbour sequence of sequence listing upward to telomere on chrosomal short arm and 5'-terminus of this base sequence : 76462
gctgacatatgcctattaagttagcctgatccaccctgccaccgaggcttatctaccagtaaaggatctatggaaatggcaagatcgtctgaccgtcttcacttggtctgaacctgctctgccttcaaactgttccactctgtattttgccctggacccctgggcccctccacttgctctctctctctctctctcttttttttttttgagacagagtctcactctgttgcccaggctggagcgcagtggtgagatcttggttca

SEQ ID NO: 4319 - DNA, 294 bp, Homo sapiens
  chr2.fa.O7frz.230359920
  Located on chromosome 2
  Distance between a terminus base of telomere on chromosomal short arm and 5'-terminus of this base sequence : 219639599
  Distance between 3'-terminus of neighbour sequence of sequence listing upward to telomere on chrosomal short arm and 5'-terminus of this base sequence : 164253
ttaccaattagcatcggatagcatcagcttataaatgccctatttcaaaagaaagttttggaaaaattcaccattatttctacatttcaaccttgaatgatatgaggagaatcttattgttaactgttagtttttggatgtttagcctctttatttgtctatagtttgcaaaaagagtctgtagacaggtgtgtgtgtgtgtgtgtgtgtgtgtgtgtgtgtgtgtgaatagaagagtctatttttgattcttagagatacctggaaggactattagtttacctatggtcagca

SEQ ID NO: 4320 - DNA, 216 bp, Homo sapiens
  D2S163
  Located on chromosome 2
  Distance between a terminus base of telomere on chromosomal short arm and 5'-terminus of this base sequence : 219639726
  Distance between 3'-terminus of neighbour sequence of sequence listing upward to telomere on chrosomal short arm and 5'-terminus of this base sequence : -167
tagtttttggatgtttagcctctttatttgtctatagtttgcaaaaagagtctgtagacaggtgtgtgtgtgtgtgtgtgtgtgtgtgtgtgtgtgtgtgaatagaagagtctatttttgattcttagagatacctggaaggactattagtttacctatggtcagcaaaccctgatggtctgagacagggagagagtcctgtcctgccctggatac

SEQ ID NO: 4321 - DNA, 461 bp, Homo sapiens
  chr2.fa.O7frz.230445466
  Located on chromosome 2
  Distance between a terminus base of telomere on chromosomal short arm and 5'-terminus of this base sequence : 219724958
  Distance between 3'-terminus of neighbour sequence of sequence listing upward to telomere on chrosomal short arm and 5'-terminus of this base sequence : 85016
ttatggtgagtggaagctaagagaacgtgacatgaacaaaggttttagctgcgcttatgtggtttggcttaacttcttgagcccctgctctctgccatgagatgagcatgctccaggtagctgtagctgatgttgcctggatctcagaatgagtgaccatggagcagaactaaaccctgctagtgagtgagtccaaatccagctgagtccagcagagcacagaaaacctacagacatatgaaaaataaattttccttccttccttctttccttccttccttcctctctctttgtctgtctttcttttcttttcttttctttctttctttctttctttctttctttcttttctctctctctttctttctctttctttctctctctctctctttctttctctctctctctctcttttaaaattcagtgacctacaacagcagctctgccattagtcactgaat

SEQ ID NO: 4322 - DNA, 171 bp, Homo sapiens
  DISD22_0002279
  Located on chromosome 2
  Distance between a terminus base of telomere on chromosomal short arm and 5'-terminus of this base sequence : 219827975
  Distance between 3'-terminus of neighbour sequence of sequence listing upward to telomere on chrosomal short arm and 5'-terminus of this base sequence : 102556
tctcaccaaggtgttgttaagtttaaaacacacacacatacacacacacacacactctctctctctctctctctctctcttaaaatctgatcacatctaaagaaaaatgacagagaaatatctgggtatatacctctgtattgaaaatgaagtgacaggatgcacaccaaa

SEQ ID NO: 4323 - DNA, 165 bp, Homo sapiens
  HUMUT1459
  Located on chromosome 2
  Distance between a terminus base of telomere on chromosomal short arm and 5'-terminus of this base sequence : 220077379
  Distance between 3'-terminus of neighbour sequence of sequence listing upward to telomere on chrosomal short arm and 5'-terminus of this base sequence : 249233
ccattctcatccagcaggatttctttctgaacagaatatagagggtgggaactttttctttttctttctttctttccttctttctttctttctttctttctttctttctttctttctttctttctttcatttatttattttttgagacagggtctcactatgtca

SEQ ID NO: 4324 - DNA, 181 bp, Homo sapiens
  G08120
  Located on chromosome 2
  Distance between a terminus base of telomere on chromosomal short arm and 5'-terminus of this base sequence : 220207912
  Distance between 3'-terminus of neighbour sequence of sequence listing upward to telomere on chrosomal short arm and 5'-terminus of this base sequence : 130368
tggtggagatgtttaaaggctgaattcaggtaagagtcgtagagtacacacatagatgttgtccgtgctgtgccacagttgagtattggtggtttctttcattcatttattcattcattcattcattcattcattcattcaacaaatactgagtgcccgttatacaatcctttttctgccc

SEQ ID NO: 4325 - DNA, 263 bp, Homo sapiens
  chr2.fa.O7frz.230953488
  Located on chromosome 2
  Distance between a terminus base of telomere on chromosomal short arm and 5'-terminus of this base sequence : 220360905
  Distance between 3'-terminus of neighbour sequence of sequence listing upward to telomere on chrosomal short arm and 5'-terminus of this base sequence : 152812
atcattcctaggactttcagacaactctggagtggaaggaaggagctccaataataataataataatgtaatgaaacttcctaatagtctagttgtatgagagcttagtgtcagattaaatttgatgtaagaacctgcgtgtgtgtgtgtgtgtgtgtgtgtatgtgtgtgtgtgagatatttattacgtaatttgctagaatgtgttaaatacaatggagaaaataaatcaagaaatgctgataggaaatgttatagttgga

SEQ ID NO: 4326 - DNA, 223 bp, Homo sapiens
  chr2.fa.O7frz.231042365
  Located on chromosome 2
  Distance between a terminus base of telomere on chromosomal short arm and 5'-terminus of this base sequence : 220449347
  Distance between 3'-terminus of neighbour sequence of sequence listing upward to telomere on chrosomal short arm and 5'-terminus of this base sequence : 88179
accttcaatataaacggtctaaacacactactcaaaagatggaaattggcagagtggataaaaagcataatcatgttcatgtatatgccatttgcaagaaattcacttaaaattcaataacataggagggtggaaaagaaaatggaaacacacacacatacacacacacacacaataccttttaaacaatcagaaaacccaagcagaattggcactattaata

SEQ ID NO: 4327 - DNA, 299 bp, Homo sapiens
  D2S344
  Located on chromosome 2
  Distance between a terminus base of telomere on chromosomal short arm and 5'-terminus of this base sequence : 220572590
  Distance between 3'-terminus of neighbour sequence of sequence listing upward to telomere on chrosomal short arm and 5'-terminus of this base sequence : 123020
gtagtcccaacttgaaacatttttaattgaacttttttcctacttttaattttccttagatggtaaatagcatctactcaaattcacttaatatatattcagacatcctatagttcttatcctatttggttcaccttatttaaggtgatgtgtgtcaatacctcctcctactactattgtgattttgctacattttttgctttcatttttctcttgataaatatgtgtgtgtgtgtgtgtgtgtgtgtgtgtgtgtataggtaaattaaaatactgaattgtttgtcctgtaatggttc

SEQ ID NO: 4328 - DNA, 414 bp, Homo sapiens
  chr2.fa.O7frz.231166090
  Located on chromosome 2
  Distance between a terminus base of telomere on chromosomal short arm and 5'-terminus of this base sequence : 220577867
  Distance between 3'-terminus of neighbour sequence of sequence listing upward to telomere on chrosomal short arm and 5'-terminus of this base sequence : 4978
caaagatcacaatcttacgtagacttttttttttaatgtacggaaatagttgcctcataatttctcaaattttatgttctttttttaatgggagagggtagtcttgatcagttacatcatcatggcaagcagcagaattattgcaatttatggctttaaagagttggacaaacatttaacatgtgatttcgaaatttcaaaataaatactgtactgtttgtgtgtgtgtgtgtgtgtgtgtgtaagagagaagctgccatagtttagaggttcaaaaaaggcctcttggagcaattgatgttaagtatacacctgaaagtttaagtagaatcaggcagatggagagagagggagagagttaaagtgctctgtttttaaattatgaagcatgaagactatgatcagatgctattg

SEQ ID NO: 4329 - DNA, 269 bp, Homo sapiens
  AC019208.4_3211
  Located on chromosome 2
  Distance between a terminus base of telomere on chromosomal short arm and 5'-terminus of this base sequence : 220629603
  Distance between 3'-terminus of neighbour sequence of sequence listing upward to telomere on chrosomal short arm and 5'-terminus of this base sequence : 51322
tgactatcttaatagcatgcactattttcccccaggaacataaggaaagagatgccattttactcgaagctgaaaccagacccacctgctgttaaatatatatatatatatatatatatatatatatatatatatgtatgtatcagtttaacttgtagatctagacgtctaaagtaactaaaggcctctcgtaaagtacttgtattggcatacttcatggcctccattttgtgcttgcaattttgtactaattagtattgaccagcaaa

SEQ ID NO: 4330 - DNA, 160 bp, Homo sapiens
  D2S377
  Located on chromosome 2
  Distance between a terminus base of telomere on chromosomal short arm and 5'-terminus of this base sequence : 220717863
  Distance between 3'-terminus of neighbour sequence of sequence listing upward to telomere on chrosomal short arm and 5'-terminus of this base sequence : 87991
agcagaataatctggcaccaaaaataactgagaaagtcaaatagaatatatatgtgtgtgtgtgtgtgtgtgtgtgtgtgtgtatgtatacacatacatatataagtctgtgtgtaggcattgggaaattgtgtaggtaaccaaaatgtgagggtgaaga

SEQ ID NO: 4331 - DNA, 137 bp, Homo sapiens
  D2S126
  Located on chromosome 2
  Distance between a terminus base of telomere on chromosomal short arm and 5'-terminus of this base sequence : 220897866
  Distance between 3'-terminus of neighbour sequence of sequence listing upward to telomere on chrosomal short arm and 5'-terminus of this base sequence : 179843
tgcctagcacagagcctacttaatagcagacacacacacacacacacacacacacacacaactaaaccagacataaatgctgatctcaacaatgggatccctttcaaagatattaaacttttgttctatgccatgga

SEQ ID NO: 4332 - DNA, 147 bp, Homo sapiens
  D2S2372
  Located on chromosome 2
  Distance between a terminus base of telomere on chromosomal short arm and 5'-terminus of this base sequence : 220907498
  Distance between 3'-terminus of neighbour sequence of sequence listing upward to telomere on chrosomal short arm and 5'-terminus of this base sequence : 9495
acaactgggtggtttctgtccaggtggtctcctctctaggtaccctgtcaccacacacacacacacacacacacacacacacacacacacatcccactgccaccaccaccaccaccatcaatccacccagtaccatttaccacagtg

SEQ ID NO: 4333 - DNA, 159 bp, Homo sapiens
  Z67181
  Located on chromosome 2
  Distance between a terminus base of telomere on chromosomal short arm and 5'-terminus of this base sequence : 221019995
  Distance between 3'-terminus of neighbour sequence of sequence listing upward to telomere on chrosomal short arm and 5'-terminus of this base sequence : 112350
agctgcactccaaaggtctaatacgcattttgtacaatatttgtaaaacatttatttgctatactcaacttccacatatgtgcgcgcacacacacacacacacacacacacacacacacacaaactcacaccactttaatgtaccacacgaagccctct

SEQ ID NO: 4334 - DNA, 453 bp, Homo sapiens
  AC010899.7_37599
  Located on chromosome 2
  Distance between a terminus base of telomere on chromosomal short arm and 5'-terminus of this base sequence : 221229018
  Distance between 3'-terminus of neighbour sequence of sequence listing upward to telomere on chrosomal short arm and 5'-terminus of this base sequence : 208864
caactgattaccgacaacatactggttggttaaaaaataatattaataataaaaaataagactatagatcatgatgaaactcttgtttcttgatgtagatttgtgtgtgtgtgtgtgtgtgtgtgtgtgtgtgtgtgatggagtctcgctctgtcacccaggctggagtgcagtggtgtgatctcagctcactgcaactttcacctcccaggttcaagcgattatcatgcctcagcctcccaagtagctgaaaatacaggtgtgtgccaccacacctgctatctttggcggagtttggccatgttggccaggccagtcttgaactcctgatttcaagtgatcggcctaccttggcctcccaaagtgctgggattacaggtgtgagccaccatgcccggccatgattggtcttaatagggcaaaaaaattgtgacacaaactgctttcaagtgg

SEQ ID NO: 4335 - DNA, 391 bp, Homo sapiens
  AC010899.7_599
  Located on chromosome 2
  Distance between a terminus base of telomere on chromosomal short arm and 5'-terminus of this base sequence : 221265870
  Distance between 3'-terminus of neighbour sequence of sequence listing upward to telomere on chrosomal short arm and 5'-terminus of this base sequence : 36399
ctcacttggattgttctttaaacacttcccatcacctacaaataatgaaattttatcttctcttcacagcctaaaatcagccagtaccttttctatcaagcattgctacactggggaatcagaattcaaatgttttctgtatacacagcacttctgtatacaaacacatatatgtgtctttgaacatatatttatttactttattatccagtaggcaactggtagacccagagtgtaagacttatttcctctaaccacacacacacacacacacacacacacacagagagagagagagagcaagaggggggagagagagagagagagaaacacagacagtgcctattatcttatcttaaatataatagatgtatctttaggaagcagaagt

SEQ ID NO: 4336 - DNA, 393 bp, Homo sapiens
  chr2.fa.O7frz.232006772
  Located on chromosome 2
  Distance between a terminus base of telomere on chromosomal short arm and 5'-terminus of this base sequence : 221395910
  Distance between 3'-terminus of neighbour sequence of sequence listing upward to telomere on chrosomal short arm and 5'-terminus of this base sequence : 129649
tgattactgtagcttcataggaactcttgaaattaggtagtgtgattcctccaactttgttctttttcaaaattatgctggctattacagttcctttgtcttaccatatatattttagaatcagcttgctgatttttacacacacacacacacacacacacacacaaacctgctagatttttcactagaactgtactgaattcatacatctatattattttttttttaagataaattgcttcataaatttattctgatgcttctggttcaaactcagggatacagaggtttctactttaacctcttctctgttaaacttgtgtctctttccttccacaccaaatatcctagttctctaggacactgaaagtgatagaattggaacatttcata

SEQ ID NO: 4337 - DNA, 349 bp, Homo sapiens
  AC009224.4_65202
  Located on chromosome 2
  Distance between a terminus base of telomere on chromosomal short arm and 5'-terminus of this base sequence : 221540507
  Distance between 3'-terminus of neighbour sequence of sequence listing upward to telomere on chrosomal short arm and 5'-terminus of this base sequence : 144204
gtgatggagaaagattctgttaaaaaaaaaaaagagagaaagagagaaagaaagaaagagagagaaagaaagaaagagaaaagaaaagaaagaaagaagaaaaagaaagaaagaaagaaagaaagaaggaaagaaagaaagaaggaaagaaagaaagaaagagagacagaaagaggctttagttcactccaaggtgttttcccatgaaagggttataacctattttggattgaaacctattactaattagtaaaattaatttattagttcagaatctgcattattggttcagaatctgcattttttaaaatgtaaagggagagaaatgtgaatgcatcctaggtagaaa

SEQ ID NO: 4338 - DNA, 131 bp, Homo sapiens
  D2S339
  Located on chromosome 2
  Distance between a terminus base of telomere on chromosomal short arm and 5'-terminus of this base sequence : 221584141
  Distance between 3'-terminus of neighbour sequence of sequence listing upward to telomere on chrosomal short arm and 5'-terminus of this base sequence : 43285
aagcaaaatgcaatcagactctgcatgtgtgagagtgtgtgtgtgtgtgtgtgtgtgtgtgtgtgtgtgttttcatttgttttaaagcagttttgttccttccattttttgcttggccttcccatgacttc

SEQ ID NO: 4339 - DNA, 353 bp, Homo sapiens
  AC009231.3_53909
  Located on chromosome 2
  Distance between a terminus base of telomere on chromosomal short arm and 5'-terminus of this base sequence : 221684096
  Distance between 3'-terminus of neighbour sequence of sequence listing upward to telomere on chrosomal short arm and 5'-terminus of this base sequence : 99824
aaagtaactatgtctgttctgcataatatgtaaacatttggcatcctttgtgagcaaagttgtgctaagaaacagctagaaaaatgtcatttccatatatatttagatttcactgtctctgagagttcagttattcttgatgtgtgtgtgtgtgtgtgtgtgtgtgtgtgtgtgtgtgtgattacctaatgattacctacttggacaacagaagaattaggagacctatctgcaactcacactggtgggaaactatagaagaggctaaacttaaatgttcacacctggactggactggaggtgaggctcagagtagcacatgccctattggagcctccaggatattagtttag

SEQ ID NO: 4340 - DNA, 450 bp, Homo sapiens
  AC009231.3_129726
  Located on chromosome 2
  Distance between a terminus base of telomere on chromosomal short arm and 5'-terminus of this base sequence : 221794608
  Distance between 3'-terminus of neighbour sequence of sequence listing upward to telomere on chrosomal short arm and 5'-terminus of this base sequence : 110159
taacaatatccgagtgagattaatgaagtatcatgggatgtattatacttcataaaggcaaaataaagagtgtttactgagagtaaaatattaacatgggaatgtgagtttccctgtgttccccaaactttgactatttatttgtgtatctatatatgtctctctctgtctctcttcgtgtgtgtgtgtgtgtgtgtgtgtgtgtgtgtgtgtgtgtgtatgaaaccctatttcttctaacctgctaggaataggtgggccagatatactgagggagagaaaagcagtccttgacctctgggagctggcctggcacttacagctgggcacaggtgtggttaggagctggcctggcacttacagctgggcacaggtgtggttaggagctggcctagcacacactggtgggccatggtgtctcctgcctcctgttggtcatgaacaatctca

SEQ ID NO: 4341 - DNA, 94 bp, Homo sapiens
  Z67099
  Located on chromosome 2
  Distance between a terminus base of telomere on chromosomal short arm and 5'-terminus of this base sequence : 221845886
  Distance between 3'-terminus of neighbour sequence of sequence listing upward to telomere on chrosomal short arm and 5'-terminus of this base sequence : 50828
acctgaacacctggtgctttaaaatgaaaacacacacacacacacacacacaccagtcatatcttaggtacctaggcacatatcagatgattga

SEQ ID NO: 4342 - DNA, 188 bp, Homo sapiens
  Z66993
  Located on chromosome 2
  Distance between a terminus base of telomere on chromosomal short arm and 5'-terminus of this base sequence : 221923623
  Distance between 3'-terminus of neighbour sequence of sequence listing upward to telomere on chrosomal short arm and 5'-terminus of this base sequence : 77643
gcatcataaacaagtcatccctacatacacatgtacacacacacacacacacacacaaacacacagatcataaaccacagtttgagaaacaataaattttattctaagtttgagaaaacatcaccggaagcagaagagttataagatttgactggcgtttagaagaatcactctggctgctgtgtgga

SEQ ID NO: 4343 - DNA, 335 bp, Homo sapiens
  AC012591.7_124513
  Located on chromosome 2
  Distance between a terminus base of telomere on chromosomal short arm and 5'-terminus of this base sequence : 221924359
  Distance between 3'-terminus of neighbour sequence of sequence listing upward to telomere on chrosomal short arm and 5'-terminus of this base sequence : 548
atcagtcctgaaatgcatgtacgggtcatggcaggcattctttgaatgaaatgaaatggataggataggatgggatgggatggaatagaatagaatagaatagaatagaatagaatagaatagaatagaatagaatagaatagaatagaatagaatagaatagaataggaatagaatagaacagaatagaacaagaatagatcaaaggacaccacatgcacacttagcaagaactacacccttgtccaaaaaaaaaaccatgcaaccaattatttgatcttctattcacctacatctcatttgactttccagtaggtgatggtttaccataacag

SEQ ID NO: 4344 - DNA, 385 bp, Homo sapiens
  U12259.1_6241
  Located on chromosome 2
  Distance between a terminus base of telomere on chromosomal short arm and 5'-terminus of this base sequence : 221958106
  Distance between 3'-terminus of neighbour sequence of sequence listing upward to telomere on chrosomal short arm and 5'-terminus of this base sequence : 33412
ctagtttactgaattcgagctaaatgtcaagagcaatttttaaatattatactatacattgaaaaaatacacctctgatgaaacccagactgttttacagagacagattctttggaaaaacaaacacacacacacacacacacacacacacacacacgaatagtatacaactaatgactaaatcaagtcttctgtgtctgtagtacaaagcacacattcatcccctaattgaataaatatgcaagtattcagatttctgaagatattgccattttgcaaatgcaataataaattaaaagctttacatcgcattccacccacatataaagggttgattcaggccattggccccacataatatctagcacggctatgtattgctgac

SEQ ID NO: 4345 - DNA, 138 bp, Homo sapiens
  D2S2197
  Located on chromosome 2
  Distance between a terminus base of telomere on chromosomal short arm and 5'-terminus of this base sequence : 221958176
  Distance between 3'-terminus of neighbour sequence of sequence listing upward to telomere on chrosomal short arm and 5'-terminus of this base sequence : -315
acctctgatgaaacccagactgttttacagagacagattctttggaaaaacaaacacacacacacacacacacacacacacacacacgaatagtatacaactaatgactaaatcaagtcttctgtgtctgtagtacaa

SEQ ID NO: 4346 - DNA, 152 bp, Homo sapiens
  Z67452
  Located on chromosome 2
  Distance between a terminus base of telomere on chromosomal short arm and 5'-terminus of this base sequence : 222030171
  Distance between 3'-terminus of neighbour sequence of sequence listing upward to telomere on chrosomal short arm and 5'-terminus of this base sequence : 71857
tgacttggtgaaagcagacttagtggtgtggggtgtgtgtctgtgtgcgtgtgtgtgtgtgtgtgtgtgtgtgtgtgtttggtcttcattgttgcttctaagccctgaattaggctttatctgcccttgggcagagcccatctgctagtttg

SEQ ID NO: 4347 - DNA, 421 bp, Homo sapiens
  AC010980.6_142768
  Located on chromosome 2
  Distance between a terminus base of telomere on chromosomal short arm and 5'-terminus of this base sequence : 222118488
  Distance between 3'-terminus of neighbour sequence of sequence listing upward to telomere on chrosomal short arm and 5'-terminus of this base sequence : 88165
gttagtggccaagtagtgattatggtgggatttgggtgaaacccagtgtgatactggcttcaagtctgacctagtgcagtcccagtggtcgtggccacaggggtgcttgtgtcgacccaccctcagctctggacagtaaagaacagggagagagagagagagagagagagagagaggaagagagattctgggagaaagtaagaagaaaaaacaagagtctctgtctagtaatcttgttctgatcttatccaggaccatcaaggcagtacctctatgagtctacaagaaccacagggctactgagcttgggatgcccccagggcaggcacagcttagatcacaacacctaagtccttttgaataactggaaagccttcgcaagaaggacaggtacaaagaagctcagactgtaagaactaca

SEQ ID NO: 4348 - DNA, 151 bp, Homo sapiens
  D2S313
  Located on chromosome 2
  Distance between a terminus base of telomere on chromosomal short arm and 5'-terminus of this base sequence : 222149579
  Distance between 3'-terminus of neighbour sequence of sequence listing upward to telomere on chrosomal short arm and 5'-terminus of this base sequence : 30670
accacattattctgggtgtttctgtgtgtgtgtgtgtgtgtgtgtgtgtgtgttttcttttttttggatgagattaacatttaaatgggtagactgaataaattgattaccctccctaagatgggtggacctcatccatcagttgaaggcc

SEQ ID NO: 4349 - DNA, 217 bp, Homo sapiens
  DISD22_0002281
  Located on chromosome 2
  Distance between a terminus base of telomere on chromosomal short arm and 5'-terminus of this base sequence : 222239731
  Distance between 3'-terminus of neighbour sequence of sequence listing upward to telomere on chrosomal short arm and 5'-terminus of this base sequence : 90001
tgagaagcgtaaggtagtgtgtgcgttcctgccagtgcctggggagagagtggaggccattccaaggggcgagagggagagagggagagagggagggagggagggggagagggaggtgcgggtgtgcttgcgtgtgtttgtgcatcttcgtgtatgtgcatgcatttgtgtgtgtgtgtgtgtgtgtgtgtgtgtatacgtacgcgtgttgggatta

SEQ ID NO: 4350 - DNA, 123 bp, Homo sapiens
  DISD22_0002285
  Located on chromosome 2
  Distance between a terminus base of telomere on chromosomal short arm and 5'-terminus of this base sequence : 222323113
  Distance between 3'-terminus of neighbour sequence of sequence listing upward to telomere on chrosomal short arm and 5'-terminus of this base sequence : 83165
gtcacagagtgggtgctggcctctcatatatatgatatatatatatcattttatatatatatatatatcatatacataatttttactgctgtctctagttttaagtcccaacaataggaaggc

SEQ ID NO: 4351 - DNA, 473 bp, Homo sapiens
  chr2.fa.O7frz.233064901
  Located on chromosome 2
  Distance between a terminus base of telomere on chromosomal short arm and 5'-terminus of this base sequence : 222434947
  Distance between 3'-terminus of neighbour sequence of sequence listing upward to telomere on chrosomal short arm and 5'-terminus of this base sequence : 111711
gaatcactggagaagcttctaaaaagtgcagatgcccaggctccatcctggaatttgtttattattattattattattattattattattattatctttgagacggagtttcactcttgttgcccacgctggagtgcagtggcgccatctcggctcaccacaacctccgcctcccgggttcaagtaattcttctgcctcagcctgccgagtagctggggttacaggcatgtgccaccacatctggctaattttgtctttttagtagagacggggtttctccatgttggtcagggtggtctcgaactcccaatctcaggtgatccgcctgtctcagcctcccaaagtgctgggattacaggcgtgagccaccgcgcccggctcatccctggaatttctaagtcatttgtttcagaatgaagtctgtacacctttttttttttcctttttcctcttaagaactctccgagtgact

SEQ ID NO: 4352 - DNA, 126 bp, Homo sapiens
  D2S360
  Located on chromosome 2
  Distance between a terminus base of telomere on chromosomal short arm and 5'-terminus of this base sequence : 222592941
  Distance between 3'-terminus of neighbour sequence of sequence listing upward to telomere on chrosomal short arm and 5'-terminus of this base sequence : 157521
ttagtttgggttattgccattgggtaccttttagggtttttgtagatacacacacacacacacacacacacacacacacacacacacacacacagagagataatcatgcatcatttaatggtaggg

SEQ ID NO: 4353 - DNA, 306 bp, Homo sapiens
  AC016712.4_92274
  Located on chromosome 2
  Distance between a terminus base of telomere on chromosomal short arm and 5'-terminus of this base sequence : 222603791
  Distance between 3'-terminus of neighbour sequence of sequence listing upward to telomere on chrosomal short arm and 5'-terminus of this base sequence : 10724
gattacttatctaacatgccaactgttttacgctgaggttcacagaatgttgaatacacttccaagagactggagtatatgggctttggtgtgatataaaatataccaccagatggctgggcacaagactttgccttaggaaaaaaaaaataatatatatatatatatatatatatatatatatatatatcaccaggatgactgaccatactgcccttttttctggaaagtaatgtagtgccagggagaaagtgatgggctatagaaagttagacaggcctgggtgtacatccaggttataccact

SEQ ID NO: 4354 - DNA, 214 bp, Homo sapiens
  Z16672.1_105
  Located on chromosome 2
  Distance between a terminus base of telomere on chromosomal short arm and 5'-terminus of this base sequence : 222627606
  Distance between 3'-terminus of neighbour sequence of sequence listing upward to telomere on chrosomal short arm and 5'-terminus of this base sequence : 23509
aactaggttttccaagatgaactggagttttcccaggtcaacagggagccaggaaatagaatgttttaccttgattttggatcctctgtgtgtgtgtgtgtgtgtgtgtgtgtgtgtacacagatgtgtacgcattggagatgttataacgctaccaaagaatattgttagaaaaattaaaaattgcttatcttactatcctcatgttgattgc

SEQ ID NO: 4355 - DNA, 200 bp, Homo sapiens
  D2S130
  Located on chromosome 2
  Distance between a terminus base of telomere on chromosomal short arm and 5'-terminus of this base sequence : 222627625
  Distance between 3'-terminus of neighbour sequence of sequence listing upward to telomere on chrosomal short arm and 5'-terminus of this base sequence : -195
aactggagttttcccaggtcaacagggagccaggaaatagaatgttttaccttgattttggatcctctgtgtgtgtgtgtgtgtgtgtgtgtgtgtgtacacagatgtgtacgcattggagatgttataacgctaccaaagaatattgttagaaaaattaaaaattgcttatcttactatcctcatgttgattgctctag

SEQ ID NO: 4356 - DNA, 410 bp, Homo sapiens
  AC013476.6_190596
  Located on chromosome 2
  Distance between a terminus base of telomere on chromosomal short arm and 5'-terminus of this base sequence : 222783027
  Distance between 3'-terminus of neighbour sequence of sequence listing upward to telomere on chrosomal short arm and 5'-terminus of this base sequence : 155202
tttgtactgccgtagtcaataaaactatataattaattaattcacacctattcaacacatgttttgcacagagtaaaatttagcaaaatacgcaatacaataaacatagaattagacaacataatagaagggatatatatatatattccttctacaaatataaattgtaatatatatttaaattgttatatatatatatatatatatatatatatatatatatatatatatttagggctaagaaagacatgactttgaatagtaacccagtaccattttctatctatctatctatctatctatctatctatcatctatttatcatctattctatcatagtgataaatatacataacataaagtttaccattttaacctttttttgagtgtacaatttagtggcagtaaat

SEQ ID NO: 4357 - DNA, 271 bp, Homo sapiens
  G08145
  Located on chromosome 2
  Distance between a terminus base of telomere on chromosomal short arm and 5'-terminus of this base sequence : 222783253
  Distance between 3'-terminus of neighbour sequence of sequence listing upward to telomere on chrosomal short arm and 5'-terminus of this base sequence : -184
tatatttagggctaagaaagacatgactttgaatagtaacccagtaccattttctatctatctatctatctatctatctatctatcatctatttatcatctattctatcatagtgataaatatacataacataaagtttaccattttaacctttttttgagtgtacaatttagtggcagtaaatacattctcaatgttatgcaatcattgccactatccgtttcaagaactttggcatcaccccaaactgaaactccacacccgttaaaca

SEQ ID NO: 4358 - DNA, 199 bp, Homo sapiens
  Z66703
  Located on chromosome 2
  Distance between a terminus base of telomere on chromosomal short arm and 5'-terminus of this base sequence : 222816364
  Distance between 3'-terminus of neighbour sequence of sequence listing upward to telomere on chrosomal short arm and 5'-terminus of this base sequence : 32840
gtgctaggaattttcacatttatttctgcacttaagaatttagtatctttattaaggtaaaaaaaaaaactcttaaaattacaattgcatgtgtgtatgtgtgtgtgtgtgtgtgtgtgcatgcatgtatgtataaaatatatgtactttttgacccaaggaattaaaaaaggattaaaaaagaccctgattcattgaa

SEQ ID NO: 4359 - DNA, 321 bp, Homo sapiens
  chr2.fa.O7frz.233491126
  Located on chromosome 2
  Distance between a terminus base of telomere on chromosomal short arm and 5'-terminus of this base sequence : 222920662
  Distance between 3'-terminus of neighbour sequence of sequence listing upward to telomere on chrosomal short arm and 5'-terminus of this base sequence : 104099
gtctagtcagatcatttgcctatttttaattgggttgtttattattttattattgagttttaggatgtctgtgtttactttgaatacaagtcctttattagatacgtgatttgcaaacaatttctttcattttgtaagttgcctttttactttcttgatggtgttatttgcactaccccatgactttttatagcctccatgacctcagaattttatccatcaattgatccatccatccatccatccacccatttattcaatgattcactgatgaggagcctgttgattgactttttctcctccttcaagtatgaaaggttt

SEQ ID NO: 4360 - DNA, 362 bp, Homo sapiens
  HUMUT1340
  Located on chromosome 2
  Distance between a terminus base of telomere on chromosomal short arm and 5'-terminus of this base sequence : 223152901
  Distance between 3'-terminus of neighbour sequence of sequence listing upward to telomere on chrosomal short arm and 5'-terminus of this base sequence : 231918
acccaaatagaacaaaaacgctaaataagagggaactccttcagcctaactgctggaattggacattggtgtttgcttgcctttagactcaaactgaaaaattggctcttcttgggtcttgagcctgccagtcttctaactgaatcttacaccatttgctctgctgactgcaggtcttggaacttagcctccataatcatgtgagacaattccttacaataaagccatctatctgtctattatctatctatctatctatctatctatctatctatctatctatctatctattcacccacccacatatatatctcctactctggagaaccctgactaatacagaggcctatctagatggctgc

SEQ ID NO: 4361 - DNA, 449 bp, Homo sapiens
  chr2.fa.O7frz.233871961
  Located on chromosome 2
  Distance between a terminus base of telomere on chromosomal short arm and 5'-terminus of this base sequence : 223288309
  Distance between 3'-terminus of neighbour sequence of sequence listing upward to telomere on chrosomal short arm and 5'-terminus of this base sequence : 135046
tgaggtttatgtcagagttcattattttgcctttcaatgtccaattgtttcaataccaattgttgaaaagatgatcttttctccattgagttgcttttgcatctttgtcaagtaccagttggctgtacttgagtgggtctatccaggattttcttctcttctcttctcttctcttctattgatttatgtgtgttcatctgtcaataccacaccgtcttgactactataactgtagaagccttaaatttgggaagtgtgatttctccaaccatattcttctttttcaaatttgttttgtctattcttgttcctttgcattacacatataaattttgcaatcattttatctatacctacaaagaatcctgaatattgataggaactgcattaagcctatagatcaatttgaggagaattgacatctttactatgttgagtcttccagttca

SEQ ID NO: 4362 - DNA, 273 bp, Homo sapiens
  D2S2323
  Located on chromosome 2
  Distance between a terminus base of telomere on chromosomal short arm and 5'-terminus of this base sequence : 223477792
  Distance between 3'-terminus of neighbour sequence of sequence listing upward to telomere on chrosomal short arm and 5'-terminus of this base sequence : 189034
tgcccatcatcttccatagttacctcatgtgtgtgtgtgtatgtgtgtgtgtgtgtgtgtgtgtgtgtgtgtgtatgtggcaacagtacttcaaatctactctcttagcaaattatatatatgagtatgaatttatatacataatatatataatttatataatatatatctactgtatatactgtatatatatattttaaacagggtcctgccctgtctcaggctggagtgcagtggtgccatctctactcactgcagcctttgaccacctaa

SEQ ID NO: 4363 - DNA, 372 bp, Homo sapiens
  AC068343.2_52721
  Located on chromosome 2
  Distance between a terminus base of telomere on chromosomal short arm and 5'-terminus of this base sequence : 223612691
  Distance between 3'-terminus of neighbour sequence of sequence listing upward to telomere on chrosomal short arm and 5'-terminus of this base sequence : 134626
ctagtggaatagaggaattccacacttcctgtgtgaaattgagcaggtcatttaacctcttggtgtctcagtttactcatctgtaaagtgggagtaacaataccacctactttttcgagttgttgtgaggattaaataagctaatacatataaatagtttagaaactgtacccagcacagagtaagtactcagtaagtctggttaatattataattattaacaccatcatcatcatcatcatcatctttctcccatggtttgggaaaccgtactgacctcctgtaacatatcagagtcttcaatggctttgacagcaattttcttggatgtttcctgaatttccccacctattataaactcgtccaggatga

SEQ ID NO: 4364 - DNA, 283 bp, Homo sapiens
  D2S133
  Located on chromosome 2
  Distance between a terminus base of telomere on chromosomal short arm and 5'-terminus of this base sequence : 223618028
  Distance between 3'-terminus of neighbour sequence of sequence listing upward to telomere on chrosomal short arm and 5'-terminus of this base sequence : 4965
caggaatccaagacagacaggagcctcattaggagaaaccagcaattaaactcctgcaaagtgaacctgacagatactaatgaaaattctccaggaacttcttataccccactttgacacgtccccaggtctgggtcctccagcagccatggggcaattaatttactgtactagtttcaagggataagggtaaggtaaggtggtattcagagttagagagacaatacacacacacacacacacacacacacacacacaccccttgatatacagttactatctg

SEQ ID NO: 4365 - DNA, 315 bp, Homo sapiens
  AC016701.4_17483
  Located on chromosome 2
  Distance between a terminus base of telomere on chromosomal short arm and 5'-terminus of this base sequence : 223621908
  Distance between 3'-terminus of neighbour sequence of sequence listing upward to telomere on chrosomal short arm and 5'-terminus of this base sequence : 3597
tcaggagttcaagactagcctggccaacatggtgaaaccccatctctaataaaaatataaaaatgagccgggcatggtggcgggggcccgtaaacctagctactcaggaggctgaggcaggaagatcgcttgaactcgggaggcagaggttgcagtgagcagagatcgtgccattgcactccagcctgggcaacaagaacaaaactccgtctcaataaataataaataaataaataaataaataaataaataaataaataagggtagtgtatcaaggatggaggagtggtcagggatccatgctttgaaaggtta

SEQ ID NO: 4366 - DNA, 328 bp, Homo sapiens
  AC016701.3_91992
  Located on chromosome 2
  Distance between a terminus base of telomere on chromosomal short arm and 5'-terminus of this base sequence : 223646853
  Distance between 3'-terminus of neighbour sequence of sequence listing upward to telomere on chrosomal short arm and 5'-terminus of this base sequence : 24630
agaaatagacattgcagatgtaacttgttaagatgaggtcatactagagtagggtgggcccctagttcattgtcactggtggactcatataaaagggaaattcgggcctagacacacacacacacacacacacacacacacacacacacacacaaacaccacatgaaggtgaaggcagagattggggtaatgcaactgaagcaaaggtgcaccaaagactgcccttaaaccaccgcaagccaggagaaaggcaagcaacccattctctcttgagagttcctagaagaaaccattcttgccaggcttctagcctccagaactatgagat

SEQ ID NO: 4367 - DNA, 328 bp, Homo sapiens; identical to SEQ ID NO: 4366
  AC068343.2_94506
  Located on chromosome 2
  Distance between a terminus base of telomere on chromosomal short arm and 5'-terminus of this base sequence : 223646853
  Distance between 3'-terminus of neighbour sequence of sequence listing upward to telomere on chrosomal short arm and 5'-terminus of this base sequence : -328

SEQ ID NO: 4368 - DNA, 207 bp, Homo sapiens
  D2S2228
  Located on chromosome 2
  Distance between a terminus base of telomere on chromosomal short arm and 5'-terminus of this base sequence : 223679850
  Distance between 3'-terminus of neighbour sequence of sequence listing upward to telomere on chrosomal short arm and 5'-terminus of this base sequence : 32669
aaaaggacttattctggggattattaaaggagttttctctctgtgtgtgtgtgtgtgtgtgtgtgtgtgtgtgtgtgtgtgtgtgtgtgttggaaaggggagtaattttatcattatgtcttaaaatgaaataattcacgggacccaaaagggcagacattgacaacaccgttcagcaaatacacagtgtgctgcttccttacagct

SEQ ID NO: 4369 - DNA, 435 bp, Homo sapiens
  AC012460.4_120608
  Located on chromosome 2
  Distance between a terminus base of telomere on chromosomal short arm and 5'-terminus of this base sequence : 223891769
  Distance between 3'-terminus of neighbour sequence of sequence listing upward to telomere on chrosomal short arm and 5'-terminus of this base sequence : 211712
acatgacttccatctcagtcaccaaagcacaaagatgggaatgaattctttctttctttcttctttccttccttccttccttccttccttcctttttctttctttccctctttcttttctttctttctttctttctttctttctttctttctttctttctttctttctttctttctttctctttctttctttttccctccttccttccttcctttctttttgagacagagtgtcactcttgtcacccaggctggagtgcagtggcatgatctcagctcactgcaacctctgcctcccggattcaagtgattctccttcctcagcctcccaagtagctgggattacaggcgtgcaccaccatgcctggctacttttttgtatttttagtagagagggggtttcaccatgttggccagactggtctcgaactcctga

SEQ ID NO: 4370 - DNA, 365 bp, Homo sapiens
  AC012460.4_138472
  Located on chromosome 2
  Distance between a terminus base of telomere on chromosomal short arm and 5'-terminus of this base sequence : 223909560
  Distance between 3'-terminus of neighbour sequence of sequence listing upward to telomere on chrosomal short arm and 5'-terminus of this base sequence : 17356
gcaagttaggccaagtagatactctcctcctgcaattggaatcttaagcaatatggcgcaaaaagacggaaaacagctggagattgttcttcatgacaatggcaatttgaggtgactcattaaatagtttctgacacctttgtacctgaagctactctgttcttagccctttccgaaatctgcgtgtgtgtgtgtgtgtgtgtgtgtgtgtgtgtgtttcaagcttttccttttatgattatgagagcctgtatcctttcaataagtttttctttttcttaatttagttacagttgatttctgtgttggaagcaaagcatccccaaagatactttgatatgctgtccttcatgagactattaaag

SEQ ID NO: 4371 - DNA, 402 bp, Homo sapiens
  chr2.fa.O7frz.234598779
  Located on chromosome 2
  Distance between a terminus base of telomere on chromosomal short arm and 5'-terminus of this base sequence : 223968040
  Distance between 3'-terminus of neighbour sequence of sequence listing upward to telomere on chrosomal short arm and 5'-terminus of this base sequence : 58115
aaaccaaatactgtatgttctcacttataaattggagctaagctatgagtacacaaagacatacagagtggttaatggacattggagactcagatggagggagggtgggaggtgggtgagggataaaaaactacatattgggtacaatttgcctttagggtcttagtcatgaattctttgcctaggccaatgtccagaagagatttttctaggtctatctatctatctatctatctattgctatatagatctgccatttatatagctttagatagatagataggtagatagatagatagatatacagatatatatatatattttcttgttcttttctatagaagagaataagaatggaaaaaaagaaaaagaaaaaagaacagtaagattgcttcaagaata

SEQ ID NO: 4372 - DNA, 388 bp, Homo sapiens
  chr2.fa.O7frz.234756803
  Located on chromosome 2
  Distance between a terminus base of telomere on chromosomal short arm and 5'-terminus of this base sequence : 224172859
  Distance between 3'-terminus of neighbour sequence of sequence listing upward to telomere on chrosomal short arm and 5'-terminus of this base sequence : 204417
attaggaaccaatgtttcctagggattctagtatgctttacaagttcctttctgactggctgatgtaggcacgggacgttgatggcaaaattccccggtataaaaaattcataaggagacacctgggcccagaaagttttcctaacgaaacacacacacacacacacacacacacacacacacacagatggcttacaaaatgatttaatcaaatcacatatgtgcatttcataaatgggcttttttgaaaacaacaagattacatgaaattgacatagttctaggaaatccagtctgtttctgtagcaaccaataattagcatgcacatgatcctctagtacaattaatttctaagtgttggaatggtttgatgcttctaaacatcac

SEQ ID NO: 4373 - DNA, 287 bp, Homo sapiens
  D2S353
  Located on chromosome 2
  Distance between a terminus base of telomere on chromosomal short arm and 5'-terminus of this base sequence : 224270112
  Distance between 3'-terminus of neighbour sequence of sequence listing upward to telomere on chrosomal short arm and 5'-terminus of this base sequence : 96865
agcctaagtgcagtacctccctcctttatcctgcataaaaatgtcaggtaaaatgagtccaaatgaattcaaagttcattggtgaaaacaaagtgtttagattttgcagtagttcgtgaatttattttataatagattgcaaaatttcaaagcaaataaaacataaaatagaactgtacatatccatgatatacatttacatttcaaaggcagaatcttaactgtacatgtgtacacacacacacacacacaccagcaacattttaccaaacacaataccctgcgtt

SEQ ID NO: 4374 - DNA, 444 bp, Homo sapiens
  AC073052.2_40381
  Located on chromosome 2
  Distance between a terminus base of telomere on chromosomal short arm and 5'-terminus of this base sequence : 224329729
  Distance between 3'-terminus of neighbour sequence of sequence listing upward to telomere on chrosomal short arm and 5'-terminus of this base sequence : 59330
tggatgtggtcacctaaataagtgtcttcttaaatacctgcagaaaaacatggatgtgcagatcgtgctgatgagtcaaaatgagtattctttttaaatgggaggggaggggctcactctggagcctaacacaacactcctcacttgagtgcagcagaaggggttgttgtgcaagtgcctatatatgacctatatgcacgctgggggatggaatttgagaaaggcaggtggtggtggtggtggtggtggtggtgaagactgtcaactctggaaactgcccccccagattacaattaatctaattcttttcaaaggctgtgttattttagtaattcctttaacttctttgcatgaacttttactactggctacagtaaaagcagcataaataggtagggtctgagtcttcgaatatttgattatgttactgagcctttgacagta

SEQ ID NO: 4375 - DNA, 480 bp, Homo sapiens
  AC023985.2_57264
  Located on chromosome 2
  Distance between a terminus base of telomere on chromosomal short arm and 5'-terminus of this base sequence : 224532373
  Distance between 3'-terminus of neighbour sequence of sequence listing upward to telomere on chrosomal short arm and 5'-terminus of this base sequence : 202200
cttagtggcataaagccatacatatgtgttatcttacagttctggaggccagatgtcctgaaatcaaggtgtcttcagggctgtgttgcttctggaagcttcaggagagaatctgtttccttgcccttgccagcttctaaaggctgcctgcggtccttggctcatggctcctacctctatctttaagccagcaacataacatcttcaaatctcaatctctatctctctctctctcacacacacacacacacacacacacatacacacacaaacacacacacacacacacacacacgcttccatcattacatcttctctgactctgactcctttatctccctctttgacttacaaggatctttgtgattgcatcaggcccactcagatcacccaggatagtcttcccatctcaagagccttagcttgatcacatttgtaaaattctcttgccttggaaggtgacatagacacaggtttcag

SEQ ID NO: 4376 - DNA, 164 bp, Homo sapiens
  D2S351
  Located on chromosome 2
  Distance between a terminus base of telomere on chromosomal short arm and 5'-terminus of this base sequence : 224705564
  Distance between 3'-terminus of neighbour sequence of sequence listing upward to telomere on chrosomal short arm and 5'-terminus of this base sequence : 172711
acagcaatatccaggcttccaggaatggtctgcattttgcttattctgtcggccctgtaagagtgcatgagcaaggacacacacacacacacacacacacacacacacacacagagtattattccaattttcaaggaaaaagcagtcatctataattctgagct

SEQ ID NO: 4377 - DNA, 381 bp, Homo sapiens
  AC011739.6_32246
  Located on chromosome 2
  Distance between a terminus base of telomere on chromosomal short arm and 5'-terminus of this base sequence : 224717482
  Distance between 3'-terminus of neighbour sequence of sequence listing upward to telomere on chrosomal short arm and 5'-terminus of this base sequence : 11754
atgttccaggcttatcctatactactcatgctccagatatttctccaaggagccctggttccttacagtgagggtgacatttacaaaccacgatctgggtgcttgttgtgctcactgtcacagggatatcattgcttctctgccctccgatcatacagagctaagaaatacacacacacacacacacacacacacacacacaaaatttatttatctctatctgtgtatgaatacttattaaaaaccagttagttcatgtttatacctctgcttccgatacaaacactcaagggttcattctagcctttccatttttaatattggtaagtaggtcctccaacagtgagaatgcgggatctcattaccatgaatctgtttact

SEQ ID NO: 4378 - DNA, 267 bp, Homo sapiens
  chr2.fa.O7frz.235467819
  Located on chromosome 2
  Distance between a terminus base of telomere on chromosomal short arm and 5'-terminus of this base sequence : 224876222
  Distance between 3'-terminus of neighbour sequence of sequence listing upward to telomere on chrosomal short arm and 5'-terminus of this base sequence : 158359
cacaaaggctatgttctatcatttataaagcagcattgggatcactcaagtcacacacacacacagacacacacacacacacacagacacacacacacacacatgcaattactggttttacacatgatggaaaactgacttcagtcttattgctgcagtttataatgatctatgtggccagattctaaaactagaaggaaagaaccgctggggatctcctagtatctataaacacatattctatttattacagtcattcgtggaatt

SEQ ID NO: 4379 - DNA, 451 bp, Homo sapiens
  AC017095.4_177964
  Located on chromosome 2
  Distance between a terminus base of telomere on chromosomal short arm and 5'-terminus of this base sequence : 224915628
  Distance between 3'-terminus of neighbour sequence of sequence listing upward to telomere on chrosomal short arm and 5'-terminus of this base sequence : 39139
tctaggagtctgcaagtacataagcctactacatacagtgctttgggtaaaaactgacatcaaatttgctttggcatacacctgtattgtcctcaacaactgccttaaaatttggctttcccagtcattaccctcactcagcatctccttgatctctcctctccatattcaaacacattttgaaggcttcctgtcttctctctctctctctctctctctctctgtatacacaccccattctcagggaagaaaactatcttgttaacctgacaaccttacctaaacttattggagagagcagaattcaaaccctatggcaatcttttggcaatgtcctggaggatttgtgtccccaagacagggatttcagaaaggggaatatacaaatctagcagtaagatactttttctcagcaggagtttctagtctctttcaaataccttgcaataga

SEQ ID NO: 4380 - DNA, 462 bp, Homo sapiens
  AC017095.4_73194
  Located on chromosome 2
  Distance between a terminus base of telomere on chromosomal short arm and 5'-terminus of this base sequence : 224939593
  Distance between 3'-terminus of neighbour sequence of sequence listing upward to telomere on chrosomal short arm and 5'-terminus of this base sequence : 23514
catttggcatttgtttacttctttgtgtctcagcacaaatgatgataccactagaaagagtccagggaataatatttctttgttatggtgcagcccgcacacctgcagggtcagtgcatgcattgttttgtggttttctcatatgccagaccagatgagaaagcaattcttgttattgctttgtgattcagtataccaacccattctaatccacacacatacacacacacacacacacacacacacacacacacacacaaatgccagttggaatgtgtgtgcaactaagtgcatacttcagaactctaggcaactattaatttttgtgttttacattttatagcagatgttaattaggaaaatttttaactgagtcaaaaaatgttaattgaattatcatgggattacatcggtaagtgctgatttcaccattatgctatgtaaagttgcatccatgagtaa

SEQ ID NO: 4381 - DNA, 436 bp, Homo sapiens
  AC017095.4_19046
  Located on chromosome 2
  Distance between a terminus base of telomere on chromosomal short arm and 5'-terminus of this base sequence : 224958133
  Distance between 3'-terminus of neighbour sequence of sequence listing upward to telomere on chrosomal short arm and 5'-terminus of this base sequence : 18078
aagccacttaacagatcaacaggttcctcaattgcatttctcagacatgaatacaccctactcaaatcattctgatgattagaaaatggggtttctgactgtggccccaggctctttattatactattttattacacaaaaagatacatatatattttcaattccttttcaatcattattctctattctagtcccttttttcctgtcctgagatgccaccctgttgtgacatctctagatagataaacaggatagatagatagatagatagatagatagatagatagatagatagatagattagatagatagattgatagatagataatagatagatacttatccaatttgcttttttcactcaacaatgtttttgcaaggaattttatgtgcaaatttgtcctcagtaaactatagcatgtaactgagtggatga

SEQ ID NO: 4382 - DNA, 281 bp, Homo sapiens
  D2S2390
  Located on chromosome 2
  Distance between a terminus base of telomere on chromosomal short arm and 5'-terminus of this base sequence : 224982712
  Distance between 3'-terminus of neighbour sequence of sequence listing upward to telomere on chrosomal short arm and 5'-terminus of this base sequence : 24143
attcacctgggataagtttgcgcacagtagacttgcaacaaacgcattgagtgttaatgagtattgaacattagagcagatggggacctacagactctaatctagagactgttaagtatgaccgttaaggatatatatttatccaggacatacacaaatttacaggacatatacatttgtgtgtgtgtgtgtgtgtatgtgtgtgtgtgtgtgtgtatcccataaatttttttagtttctaaatttaaattttgaatattctacattcaaaaatccagatt

SEQ ID NO: 4383 - DNA, 429 bp, Homo sapiens
  AC017095.4_13867
  Located on chromosome 2
  Distance between a terminus base of telomere on chromosomal short arm and 5'-terminus of this base sequence : 224984676
  Distance between 3'-terminus of neighbour sequence of sequence listing upward to telomere on chrosomal short arm and 5'-terminus of this base sequence : 1683
gaaacttcaaacatgccagcagttcaaaagatccaaagttcccaaagccaccccagtctaaaaattcacaatataaaccttccccaactacacacacacacacacacacacacacacacacacacacacacacagaggattgaaatccattctttcctttgaactatgatccctccctaggcttattttgtttcttgcagagaaggaggctgtggagaagagaagacaaatgggagtttctatgcctctcctttgcttcttccaagttcagagtaaacggtttttctttctctaaaactttttctatctataatataaatattcactgacatctttgctggttcaagtctttccactttaacaaaccagttgggccatgttatgctgcccccttggaccttgcatcttcatctactgtgagcactttat

SEQ ID NO: 4384 - DNA, 360 bp, Homo sapiens
  chr2.fa.O7frz.235734545
  Located on chromosome 2
  Distance between a terminus base of telomere on chromosomal short arm and 5'-terminus of this base sequence : 225178307
  Distance between 3'-terminus of neighbour sequence of sequence listing upward to telomere on chrosomal short arm and 5'-terminus of this base sequence : 193202
aatggtaataacaaaggctgactttggaagaaatgggacgactgggaaataacttgccattcaaaaataattttagaggtctacaaatgaggagctctgaaaggataagcatggagtggtttaaaacaaacaaaaaacaactataaacgttaatgatgtgaaaatggtcataaaccaattgtgggaataatttcaacagaagaaccaggtcaacaagaagctatagttcttgaatttaccctaaatttaattttaaaagggagttctatgtgctttctctctctctctctctctctgtctttctctctgtctctttccttcctgcatgtactataaactcaattaaagttaacgtgagtt

SEQ ID NO: 4385 - DNA, 333 bp, Homo sapiens
  chr2.fa.O7frz.235852059
  Located on chromosome 2
  Distance between a terminus base of telomere on chromosomal short arm and 5'-terminus of this base sequence : 225259898
  Distance between 3'-terminus of neighbour sequence of sequence listing upward to telomere on chrosomal short arm and 5'-terminus of this base sequence : 81231
ctgcagataaggtacataatgattactcgtttactaaaaacactttatccagcatccaggacattcataaatctgtaacaaagccttttctaatgactaacagcgtggccaccaagttccattgaaatgcatggaaagaaaaggagtatctagggggcaggattaggagaagggggagcaacagtccaaaggttaaatttaatatcccacaggacaaattggtcagccccgcttgacctttttatatacatatatatatatatatatatatatatattttattatttaagttttagggtacatgtgcacaacttgcaggtttgttacatatgt

SEQ ID NO: 4386 - DNA, 280 bp, Homo sapiens
  AC067961.5_109424
  Located on chromosome 2
  Distance between a terminus base of telomere on chromosomal short arm and 5'-terminus of this base sequence : 225323195
  Distance between 3'-terminus of neighbour sequence of sequence listing upward to telomere on chrosomal short arm and 5'-terminus of this base sequence : 62964
cctaaattctcaagtgatggtatttggagatgggaccttgaggaggtaattaggtcatggggtagagcccttatgatgggattagtgactttatgagagctagctctctctctctctctctctctctctctctctctctctctctctctcccccaccccatatgaggacgccagaaagagagtcttcaccagaacccaagcatgttggcattctgaactcagacctccactctctagaactgtgataaattaatttctgttatttaagccacctagtcta

SEQ ID NO: 4387 - DNA, 250 bp, Homo sapiens
  D2S2204
  Located on chromosome 2
  Distance between a terminus base of telomere on chromosomal short arm and 5'-terminus of this base sequence : 225590559
  Distance between 3'-terminus of neighbour sequence of sequence listing upward to telomere on chrosomal short arm and 5'-terminus of this base sequence : 267084
tcacagtgcctggcattcaaaatgtctagacagatacagtaaaggcatatacattttaccattggttgaacataataagtatatatatagagagagatatatatatgtatatatatgtgtgtgtgtgtatacacacacacacacacacacacacacacacacacacacttttcctcacttgtcttttataaaaaatcaatccaaaaaaatttcagagtaaactgctgaagccagttttagaaaagtcaca

SEQ ID NO: 4388 - DNA, 439 bp, Homo sapiens
  chr2.fa.O7frz.236243501
  Located on chromosome 2
  Distance between a terminus base of telomere on chromosomal short arm and 5'-terminus of this base sequence : 225696134
  Distance between 3'-terminus of neighbour sequence of sequence listing upward to telomere on chrosomal short arm and 5'-terminus of this base sequence : 105325
atgagttgactctaacattcatctagatttaaaaatgtgtgagaataggcaatacaaaattgaaaatgaacaaatggggagaaattggcctgataggttttaaaacatgctatgaaagtccaataattaaaattgtgtcatattgacacaaaaaaatagagtaggggaggtaaaaataacagaatagaggtcagagagagcaaagtatattatatctatatctatatgtgtgtatgtgtgtgcatatatatatatatatatatatatatatatatatatatatatatatatggaataaacacagaatgcatgtggcatttcaagtcagcagggaaaaaagattattcgacaaatagtgggaatagttgcttattcattcaaacaaaaattcattttggtctctactttattaaaataaattccagttacattgaggaat

SEQ ID NO: 4389 - DNA, 434 bp, Homo sapiens
  chr2.fa.O7frz.236317169
  Located on chromosome 2
  Distance between a terminus base of telomere on chromosomal short arm and 5'-terminus of this base sequence : 225772602
  Distance between 3'-terminus of neighbour sequence of sequence listing upward to telomere on chrosomal short arm and 5'-terminus of this base sequence : 76029
catttctgttagattcttgcagttttcagatttgtacttttagccatgaattttgcagagacaggaggagtgagttttcaacatgttcggcttatgtgggtgttcaataaattatttttaatcagctggatgactcaaaggaggcaaatttgagatgggggctggggttagttaccactagcacaatgtatttttaaaacctaaaatgccttaaacatttgcgttttgggctcctaatttctttctttccttccttccttccttccttccttccttccttccttccttccttccttccttccttccttccttccttccttccttctttctttcttttttgaaaacatactctcctctgcttagctggaagaataaaatcaatggcagctctgttccagacatttgttatggtgtgactggaaactattgcatac

SEQ ID NO: 4390 - DNA, 418 bp, Homo sapiens
  chr2.fa.O7frz.236473645
  Located on chromosome 2
  Distance between a terminus base of telomere on chromosomal short arm and 5'-terminus of this base sequence : 225915818
  Distance between 3'-terminus of neighbour sequence of sequence listing upward to telomere on chrosomal short arm and 5'-terminus of this base sequence : 142782
tgactgaggtatttgttcaaatatctccttttcagggaggactatattaaccattctatctaaaacaaacaaacaaacaaacaaacaaacaaacaaacggatggatggacaaaccctcttatcccattagcctccctaatttttaaaaatgtgctaagcatttattttttaaattgacataataactgtacctatttatggagtacaaagtggtatttcaatatgtgtgtacaatgtataatgatcaaacctgggtagttagcatatccatcacctcaaacatttatgatattttttccattttggaaacattgaaaatcttctatttgaaaatatacaataaattattgtgaactatagtcaccctccagtattataaaacactagaacacattactcctatctagctggatttctg

SEQ ID NO: 4391 - DNA, 306 bp, Homo sapiens
  D2S1333
  Located on chromosome 2
  Distance between a terminus base of telomere on chromosomal short arm and 5'-terminus of this base sequence : 226143544
  Distance between 3'-terminus of neighbour sequence of sequence listing upward to telomere on chrosomal short arm and 5'-terminus of this base sequence : 227308
tctgtcataaaccgtctgcaactaatcaattccactacacagtgagagttgtaatgattctgaatccattttgtttctgaatagatagatatgtctataatcacactcaatctttaaactttctgctttctctgactgtatcatgtatattatgtatttggaagcatttgatacatagatgatattaatagatggatggatgcatagatggatggatggatggatagatagatagatagatagatagatagatagatagatagatcaagcaaatgatggagtgaagtagcaactggggagacaaag

SEQ ID NO: 4392 - DNA, 189 bp, Homo sapiens
  D2S1363
  Located on chromosome 2
  Distance between a terminus base of telomere on chromosomal short arm and 5'-terminus of this base sequence : 226143664
  Distance between 3'-terminus of neighbour sequence of sequence listing upward to telomere on chrosomal short arm and 5'-terminus of this base sequence : -186
ttctgctttctctgactgtatcatgtatattatgtatttggaagcatttgatacatagatgatattaatagatggatggatgcatagatggatggatggatggatagatagatagatagatagatagatagatagatagatagatcaagcaaatgatggagtgaagtagcaactggggagacaaagaat

SEQ ID NO: 4393 - DNA, 449 bp, Homo sapiens
  chr2.fa.O7frz.236824020
  Located on chromosome 2
  Distance between a terminus base of telomere on chromosomal short arm and 5'-terminus of this base sequence : 226215388
  Distance between 3'-terminus of neighbour sequence of sequence listing upward to telomere on chrosomal short arm and 5'-terminus of this base sequence : 71535
gtttctagcatagaacatcttgagcttcaaggcagataagaaattttccttaaaagattaccctgaggccaggcatggtgggtcacgcctgtaatcccagcaccttgggaggccaaggctggtggatcacctgaggtcaggagtttgagacctgcctggccaaaatgatgaaaccccatctctaccaaaactataaaaattaaccgggcatggtggtgggcgcctgtaattctagctattctggcggctgaggcacaagaattgcatgaacctgggaggctgaggttgcaatgagccgagatcgcgccactgcactccagcctgggtgacagagtgagactttgtctcaaaaaaaaaaaaaaaaaaaagaaaacacacacacacacacacacacacacacacacacacacacagctagaagagtaatttagcattctgaattcgatcta

SEQ ID NO: 4394 - DNA, 268 bp, Homo sapiens
  Z66852
  Located on chromosome 2
  Distance between a terminus base of telomere on chromosomal short arm and 5'-terminus of this base sequence : 226247361
  Distance between 3'-terminus of neighbour sequence of sequence listing upward to telomere on chrosomal short arm and 5'-terminus of this base sequence : 31524
ctaatgagtcaactaatgtgtggaaatacattgtgtgtgtgtgtgtgtgtgagagagagagagagagagatcttttcagtcttctctccccttttcagttcaccaattcattttccaaacttggagatctgaaggtttgccaagtctccttgccctacaatgtaaaccattaagtaattttttccgcagttctcttgagaagtagggttactcttcctgctgcttttgcagaacagcagggaagtgcatgggcttgctcctagtccca

SEQ ID NO: 4395 - DNA, 133 bp, Homo sapiens
  DISD22_0002296
  Located on chromosome 2
  Distance between a terminus base of telomere on chromosomal short arm and 5'-terminus of this base sequence : 226512459
  Distance between 3'-terminus of neighbour sequence of sequence listing upward to telomere on chrosomal short arm and 5'-terminus of this base sequence : 264830
agctggaatccattgctgtcacacatgacaaaatacaactcaaagtaaatatgctttatttggcatatatatatatatatatatatatatatatatatatatatggaattttggctttactacacggagcctt

SEQ ID NO: 4396 - DNA, 414 bp, Homo sapiens
  chr2.fa.O7frz.237200534
  Located on chromosome 2
  Distance between a terminus base of telomere on chromosomal short arm and 5'-terminus of this base sequence : 226604595
  Distance between 3'-terminus of neighbour sequence of sequence listing upward to telomere on chrosomal short arm and 5'-terminus of this base sequence : 92003
accagacctttagtaattggagaaaaatgtctgtaggtgaattgtctgagaataaatcattttgatctgcagagcactttagtctttaagcactctgaggcttcagtgaaattcttttcatttttttttcagtcaggtgctgatatttattgtggcttttaatggtatgccaaaaaagatcccaccatgtgtgtgcatgtgtgtgtgcgtgtgtgtgcgtgtgtgcatgtgtgcgtgtgtgtgtgcgcgtgcgtgtgtgtgtgcacgtgtgcgtgtgtgtgtgtatgcgtgtgtgtgtgtgtttgcatgtgtgtctgtctgactgacgatactgattagctggcggtaaagactctcttttccataagagaatcacaagaatattttgtttttaaagagcattgatttcttagg

SEQ ID NO: 4397 - DNA, 436 bp, Homo sapiens
  AC010735.7_101782
  Located on chromosome 2
  Distance between a terminus base of telomere on chromosomal short arm and 5'-terminus of this base sequence : 226773908
  Distance between 3'-terminus of neighbour sequence of sequence listing upward to telomere on chrosomal short arm and 5'-terminus of this base sequence : 168899
cggtgttctactcactatgaagctgtttttgttctccataactgagctcacagtctagaggtcttttagtcttggcaaggtcatatttcctcacattcctagaagagcatgcttcttcctctcaagtttctcacaagcctatacatctatatatatatatatatatatatacacacacacacatatgtgtatctatatatgtgtgtatatatatctatatatgtgtatatatatctatatatgtgtgtatatatctatatatttgtatatattcatctatatatacacacacacatcccacacacacgtcacatatatatacacacacacaaagacacacacatgtcacatatatatacacacacacatatatatacacacacacaaacacacacacacacacacacacacatatacagcattacctccaactaac

SEQ ID NO: 4398 - DNA, 387 bp, Homo sapiens
  AC010735.7_111099
  Located on chromosome 2
  Distance between a terminus base of telomere on chromosomal short arm and 5'-terminus of this base sequence : 226783234
  Distance between 3'-terminus of neighbour sequence of sequence listing upward to telomere on chrosomal short arm and 5'-terminus of this base sequence : 8890
tcagttacctcactgctgatacacttaatttacagtaccactaactggaagcaaatcatgtcttctagaatgcttattaataaagcaccttacaacacacacattcagcatacctgaatctggcaaatgagcccagtaaacacacacacacacacacacacacacacacacacacacacataacacacacacacatattatcatcagtctcaaatacctttatagttctggtaatagatgggtgttgttcattaaaattcatacctccataaaatcccactataaaatctcagatgaataaaaatgaccactgacctatggatagactgtgaaacgcttattaaaggaagttcccagcttaaagccttggttctagcatttgagtta

SEQ ID NO: 4399 - DNA, 231 bp, Homo sapiens
  D2S2389
  Located on chromosome 2
  Distance between a terminus base of telomere on chromosomal short arm and 5'-terminus of this base sequence : 226823321
  Distance between 3'-terminus of neighbour sequence of sequence listing upward to telomere on chrosomal short arm and 5'-terminus of this base sequence : 39700
gcctctgtagggacttgtgagggactaaaggctcaggctgcaaaatatttttaaagaccaagttttaggaatgtaaccttttttattggactgcagtttccactcccttgccctcctcctcacccctaaatacacacacacacacacacacacacacacacacacacacacacgtttgggcaaaagggagttttaattatactcttggtaacttccagggtactctacaaa

SEQ ID NO: 4400 - DNA, 444 bp, Homo sapiens
  AC010735.7_14667
  Located on chromosome 2
  Distance between a terminus base of telomere on chromosomal short arm and 5'-terminus of this base sequence : 226844695
  Distance between 3'-terminus of neighbour sequence of sequence listing upward to telomere on chrosomal short arm and 5'-terminus of this base sequence : 21143
caatttagaacagtgcttgaaggacaattgaatgtggattttctcactttaagatctgtttttattttaagatggctcaatagtaataagcatttgaatgcttactctgcaaggcaatatgaaatagataaaaagacagcttcttacagctttgatggggtaataagagagtacaaaataacaatagttgatgactaaaatgtgtgtgtgtgtgtgtgtgtgtgtgagagagagagagagagatgtcaaataacaagtggtatttactttcatgatggatgaaataactacttaatttttacagaagagaggagccttaagcttgaacttgaaatgggctataactcagataaatggcaattattttttcccactcaagttttttggaacacctacttgtgttaggcactaggctggacactgaggatttagatatcaaagaca

SEQ ID NO: 4401 - DNA, 370 bp, Homo sapiens
  AC010735.7_190099
  Located on chromosome 2
  Distance between a terminus base of telomere on chromosomal short arm and 5'-terminus of this base sequence : 226894371
  Distance between 3'-terminus of neighbour sequence of sequence listing upward to telomere on chrosomal short arm and 5'-terminus of this base sequence : 49232
ttagctatccactatcatagctcaccacagcctcaaagtcctaggctcaagtgatcctcctgcctcagcctcctaagtacctaggattataggtgtgtgccactgcacctggctaatttattattattattattattattattattattattattattattatttgtagagatgaggtcttgctatgttttccaggctggtcttgaattcctggcctcaagcagtcctcctacattggccttacaaaatgctgggattataggcgagagccactgagccaagcctgcagattttcttttcttattattaaattctaattaaattttacactgcatattacagatggatgttgagctaaaatgaagcattg

SEQ ID NO: 4402 - DNA, 268 bp, Homo sapiens
  D2S1349
  Located on chromosome 2
  Distance between a terminus base of telomere on chromosomal short arm and 5'-terminus of this base sequence : 226994984
  Distance between 3'-terminus of neighbour sequence of sequence listing upward to telomere on chrosomal short arm and 5'-terminus of this base sequence : 100243
ggacataaggaggggaacatcacacacccgggcctgtcagggcgtgggaggctaggggagggataccattaggagaaatacctaatgagaatgacaggttgatgggtgcagcaaagcaccatggcacatgtatacctatgtaacaaacctgcacattctgcacatgtatcccagaacttaaagtataataataataataataataataataataatcagatttgatcttgtttccactgtcctcaggattaaacacaaaaccttcaaa

SEQ ID NO: 4403 - DNA, 377 bp, Homo sapiens
  AC073149.1_134842
  Located on chromosome 2
  Distance between a terminus base of telomere on chromosomal short arm and 5'-terminus of this base sequence : 227000688
  Distance between 3'-terminus of neighbour sequence of sequence listing upward to telomere on chrosomal short arm and 5'-terminus of this base sequence : 5436
cattgaattgtccactctaagtaggcgcattgtgtagtatagaaatgaaatctcaatgaagctgttgagtaaaatctcaatgaagcaattattttttcttaaagtaggtatatcatcctaataatagaggagaaaaactgaagtttactatatggtattccaaattgagcagtttgagtttaggatgaaggatttttctgtgtgtgtgtgtgtgtgtgtgtgtgtgtgtgtgtgtgtgtgtaaatctggaatattgaaattttaaagacgccaggttcttgggacatatcttctttttcacagactccaggagttggatacccagtccccaatccctctttgagttcattcccttgattcagttagagctagacata

SEQ ID NO: 4404 - DNA, 169 bp, Homo sapiens
  D2S159
  Located on chromosome 2
  Distance between a terminus base of telomere on chromosomal short arm and 5'-terminus of this base sequence : 227000856
  Distance between 3'-terminus of neighbour sequence of sequence listing upward to telomere on chrosomal short arm and 5'-terminus of this base sequence : -209
gcagtttgagtttaggatgaaggatttttctgtgtgtgtgtgtgtgtgtgtgtgtgtgtgtgtgtgtgtgtgtaaatctggaatattgaaattttaaagacgccaggttcttgggacatatcttctttttcacagactccaggagttggatacccagtccccaatccct

SEQ ID NO: 4405 - DNA, 235 bp, Homo sapiens
  D2S2158
  Located on chromosome 2
  Distance between a terminus base of telomere on chromosomal short arm and 5'-terminus of this base sequence : 227063205
  Distance between 3'-terminus of neighbour sequence of sequence listing upward to telomere on chrosomal short arm and 5'-terminus of this base sequence : 62180
agctgtcatctcctatgataaaaatgtcttcttctggatatctcctgaaggacctgcctgaggctgttctacagcatacacacacacatacacacacacacacacacacacacacacatatatatatatatgtggcatagactctaaaataataataaaaagtatattatggtaaacaaactagtaaaatatttatcgtcattatcaagtattatgtatcgtacataactgcacg

SEQ ID NO: 4406 - DNA, 335 bp, Homo sapiens
  AC073149.2_89869
  Located on chromosome 2
  Distance between a terminus base of telomere on chromosomal short arm and 5'-terminus of this base sequence : 227228746
  Distance between 3'-terminus of neighbour sequence of sequence listing upward to telomere on chrosomal short arm and 5'-terminus of this base sequence : 165306
ggaggccagtatagttcaagaccagcctgggcaacacagtgagacccccatctctacaaaaaaattaaaaaattatctgggcatggtggtgtgtgcctgtagtcccagctactcgggaggctgaggtgagaggatcgctggaacccaagagttggaggctgcagtgagcaatgattgtgccactacactccagcctgggtaatggagcaaataataataataataataataataataataataataataaatttcttttataaagagcatagtttcatggaagacagacatgcacatgaaaggatatgtcagtttaaatccagttaagtgtcctg

SEQ ID NO: 4407 - DNA, 285 bp, Homo sapiens
  chr2.fa.O7frz.237970327
  Located on chromosome 2
  Distance between a terminus base of telomere on chromosomal short arm and 5'-terminus of this base sequence : 227370515
  Distance between 3'-terminus of neighbour sequence of sequence listing upward to telomere on chrosomal short arm and 5'-terminus of this base sequence : 141434
gtcaggagttcaagatcgacctggccaacatggtgaaatcccgtctctactaaaaatagaaaaattagaccgctatggtggcgtgtgcctgtaatcccagctacttgggaggctgaggcacaagaaccacttgaacctgagaggtggaggctgcagtgagccgagactgtgccactgcactccaccctgggtgacacagtgagactctgtctcaataaataaataaataaataaataaataaataataaaataaaatgaaataaactacctgagtgatatggttt

SEQ ID NO: 4408 - DNA, 361 bp, Homo sapiens
  HUMUT8098
  Located on chromosome 2
  Distance between a terminus base of telomere on chromosomal short arm and 5'-terminus of this base sequence : 227450547
  Distance between 3'-terminus of neighbour sequence of sequence listing upward to telomere on chrosomal short arm and 5'-terminus of this base sequence : 79747
aattggctctgtctaggcagctggcaaggtaaacccattgggtggttatacagcagggttggttttttctgagtcttctcttcttggcttgcagatgaccctcctgccatgtcctcatacagcgttttctctgtgtccactcatctctggtgcctctttctttctttttctttctttcttttctttctttctttctttccttccttccttctttctttctttccttctttctctctctctccttccttccttcctttctttctttcttcctttctttctttctctctttctttttctttctttctttcttttctttctttcttcttttctttcttttttgagacagagtcttgccctgtca

SEQ ID NO: 4409 - DNA, 304 bp, Homo sapiens
  AC068692.3_3114
  Located on chromosome 2
  Distance between a terminus base of telomere on chromosomal short arm and 5'-terminus of this base sequence : 227607584
  Distance between 3'-terminus of neighbour sequence of sequence listing upward to telomere on chrosomal short arm and 5'-terminus of this base sequence : 156676
gaactatgattatgccactataatccagtctgagtgacagagtgagaccccatcttcttgatgaatatatttgtggatgaacacacacacacacacacacacacacacacccctcatattctagacagccatatgtggtgttacattatttgaaatgtattggacaatgatgtgtgatgttatattattactatatcacccctttaacaaccccataagatgctatatgttactttatactatttcggcatcatattcataataaccatttattacactaggctacaattaatctccaggacct

SEQ ID NO: 4410 - DNA, 375 bp, Homo sapiens
  AC068692.3_9554
  Located on chromosome 2
  Distance between a terminus base of telomere on chromosomal short arm and 5'-terminus of this base sequence : 227614094
  Distance between 3'-terminus of neighbour sequence of sequence listing upward to telomere on chrosomal short arm and 5'-terminus of this base sequence : 6206
gtgtcagctccataattctgacctatgtctgtataatctccttgtcagcaatgtatgacactacactgtatctgcatcatctccttgataaccacatttgaccctacactatgtttatgttatctctctgacaacatgtgacactaagctatgtctgtgtcgtctccctcatgaccatgcatgacagtatctatctatctatctatctatctatctatctgtctgtctgtctgtctgtctgtctgtctgtctgtctatctatgtatctatccatctatcgatcgatctatctactttttcttctttattggaattattctgaaggctgatttttttgtttctttttttttttttagatggagtcttgctctttcg

SEQ ID NO: 4411 - DNA, 423 bp, Homo sapiens
  AC068692.3_140690
  Located on chromosome 2
  Distance between a terminus base of telomere on chromosomal short arm and 5'-terminus of this base sequence : 227675815
  Distance between 3'-terminus of neighbour sequence of sequence listing upward to telomere on chrosomal short arm and 5'-terminus of this base sequence : 61346
ctggttcattgtagccttatttactcctctttctaacaaaacaaaacaaacaaacaaaaaactcctttttgcctaacccttaacacatttgcagatcttgtggttggagcattcttgttattgcaatagttctattctccattgaaagagtcccccaaccccgcttgccataacaagagacccctcctgagaccaggctgatctcaggataaaacattctctaatctactgtgtgatcacgccacctcactggctcaccctgtccatcccattccccacacctggttcattctagccttatttactcctctttctaacaaaacaaaacaaacaaacaaacaaacacaaaactcctttttgcctaacccttaacacatttgcagatcttgtggttggagcattcttgttattggaatagttcca

SEQ ID NO: 4412 - DNA, 232 bp, Homo sapiens
  DISD22_0002305
  Located on chromosome 2
  Distance between a terminus base of telomere on chromosomal short arm and 5'-terminus of this base sequence : 227829070
  Distance between 3'-terminus of neighbour sequence of sequence listing upward to telomere on chrosomal short arm and 5'-terminus of this base sequence : 152832
gatcttcccaacctctgcagcctatcagtcacccctttttcttgtcttcctagccctattcaccattcgaaaatagcttgtgaatcaatcaatcaatcaatcaatcaattctttgatctttcccttctataacatatgctcttctagggttataaccttgtctgttttgctcattgctcttttctcagtatccaaaagagtggctggccaggggttagtggcaaaccaactc

SEQ ID NO: 4413 - DNA, 288 bp, Homo sapiens
  AC010149.4_3407
  Located on chromosome 2
  Distance between a terminus base of telomere on chromosomal short arm and 5'-terminus of this base sequence : 227958371
  Distance between 3'-terminus of neighbour sequence of sequence listing upward to telomere on chrosomal short arm and 5'-terminus of this base sequence : 129069
gtttaaaggtgctgatcctttcctttcctttcctttcctttcctttcctttcctttcctttcctttcctttcctttcctttcctttcctctcctctcctctcctctcctctcctctcctctcctctcctctcctctcctctcctcccctcccctcccctcccctccttcccttcatcctttcctccttcccttcatccttccctccttccctctttccctcctcacaccatctccctgcatttttctttcctttctttctttatatggcctggccacaatttgaactt

SEQ ID NO: 4414 - DNA, 272 bp, Homo sapiens
  AC010149.4_72597
  Located on chromosome 2
  Distance between a terminus base of telomere on chromosomal short arm and 5'-terminus of this base sequence : 228016229
  Distance between 3'-terminus of neighbour sequence of sequence listing upward to telomere on chrosomal short arm and 5'-terminus of this base sequence : 57570
gagtcactgttcaccaatgatatgattagtatcctaagatatagatctgataaatgaattcagttaagtttcaggatacaaaatcataagtagcactgctatacaccaacaatgatcaagctgagaatcaaatcaaatcccttttacaacagctgcaaaaaaataaataaataaaaaataaaccaaaaaaacaaagcaaaacaacaacaacaacaacaacaacaaaaatccaaaaaaccttaggatatacctaaccaaggaggtgaaagatc

SEQ ID NO: 4415 - DNA, 399 bp, Homo sapiens
  AC009949.5_8163
  Located on chromosome 2
  Distance between a terminus base of telomere on chromosomal short arm and 5'-terminus of this base sequence : 228017088
  Distance between 3'-terminus of neighbour sequence of sequence listing upward to telomere on chrosomal short arm and 5'-terminus of this base sequence : 587
ttaaagaactatcatttgatccagcaatcccactactgggtctctacctagaggaaaataagtcatgatatgaaaaagacatttgcacacgcgtttatagcagcacaattagcaattgagaaaatgtggaacaagcctaaatgcccactaatcaatgagtagataaagaaatgtgatatatatatgtatatatacacatatacatgtatacacatatatatataccatatgtgtgtgtgtgtgtgtgtgtgtgtgtgtgtgtgtgtgtatatatatacaccatggagtactactcagccataaaaaggaatgcaataatggcgttctcagcatcctggatggagttggagaccattattctaagtgaagcaactcaggaatggaaccaagtatcgttat

SEQ ID NO: 4416 - DNA, 270 bp, Homo sapiens
  D2S172
  Located on chromosome 2
  Distance between a terminus base of telomere on chromosomal short arm and 5'-terminus of this base sequence : 228147905
  Distance between 3'-terminus of neighbour sequence of sequence listing upward to telomere on chrosomal short arm and 5'-terminus of this base sequence : 130418
catccaggttgctgtgaatgtcattatttcattcctttttatacctgagtagtattccatggtgtgtgtgtgtgtgtgtctctgtgtgtgtgtgtgtgtgtgtgtgtgtatatatatatatatatatatatatatatatatatacatgcatgtccaagtgtctttttcatataactttttttccactaggtagacacccagtagtgttacggaatccttggggtattgctttttcttgccagaaacctctgtaagcagttgtgcctttgc

SEQ ID NO: 4417 - DNA, 208 bp, Homo sapiens
  D2S2317
  Located on chromosome 2
  Distance between a terminus base of telomere on chromosomal short arm and 5'-terminus of this base sequence : 228411209
  Distance between 3'-terminus of neighbour sequence of sequence listing upward to telomere on chrosomal short arm and 5'-terminus of this base sequence : 263034
ccagcctgggcaatacagcgaaaccccatctacacacacacacacacacacacacatacacacacacacacacacacacacacacacacaaatacagacttattatcttactgttctggaggtcagcagagctgaattccttcttgaggctttaggggggaatttgtttccttgtcttttccagcatctggaggccactttcattctt

SEQ ID NO: 4418 - DNA, 448 bp, Homo sapiens
  AC009973.7_35544
  Located on chromosome 2
  Distance between a terminus base of telomere on chromosomal short arm and 5'-terminus of this base sequence : 228636771
  Distance between 3'-terminus of neighbour sequence of sequence listing upward to telomere on chrosomal short arm and 5'-terminus of this base sequence : 225354
tagcttaatgacaacgtacttctctgtggttgttgagtattcacatttttcaattgttggagtagtggaattaagtcttaaaagtaggaacattctaatagccatcatctgtgcaggaaatgaaagaggatgcaagggtttataattgtgtgtgtgtgtgtgtgtgtgtgtgtgtgtgtgtgtgtgtgtgtggtttttatttttacagaatattctttccattctcttttttgttagatacgttgttgtgttttttatttccttgccctttcattgttaattggattctatttattctggaacagatatttagaggtgtataacatttcctttgaagtatgggcatcattgtttaacaggtttttattattgtagcaagcctttgctcacaattgatatttccttaaaacagataatgttaaagctatcagttcatactggtcttagg

SEQ ID NO: 4419 - DNA, 240 bp, Homo sapiens
  D2S396
  Located on chromosome 2
  Distance between a terminus base of telomere on chromosomal short arm and 5'-terminus of this base sequence : 228636852
  Distance between 3'-terminus of neighbour sequence of sequence listing upward to telomere on chrosomal short arm and 5'-terminus of this base sequence : -367
aagtaggaacattctaatagccatcatctgtgcaggaaatgaaagaggatgcaagggtttataattgtgtgtgtgtgtgtgtgtgtgtgtgtgtgtgtgtgtgtgtgtgtggtttttatttttacagaatattctttccattctcttttttgttagatacgttgttgtgttttttatttccttgccctttcattgttaattggattctatttattctggaacagatatttagaggtgtat

SEQ ID NO: 4420 - DNA, 441 bp, Homo sapiens
  AC068155.2_36786
  Located on chromosome 2
  Distance between a terminus base of telomere on chromosomal short arm and 5'-terminus of this base sequence : 228669069
  Distance between 3'-terminus of neighbour sequence of sequence listing upward to telomere on chrosomal short arm and 5'-terminus of this base sequence : 31977
aaagaaacgattcacatagcttattttgcacaatattgttttgtggtttttggttttgggtttttggggtttttttgtttgtttgtttgtttgtttgttttttgagatggagtttcgctcttgttgcccaggctggagtgcaatggtgcaatctcagctcaccgcaacctctgcttcacgggttcaagcaattctcctgcctcagcccactgagtagatgggattacaggcatgcaccaccacacccagctaattttgtatttttagtagagatggggtttctccatgttggtcaggctggtctcaaactcccgatctcaggtgatccacccgcctcagcctcccaaagtgctgggattataggcaggagccaccacgcccagtcacaatattgtttaatttaatcatgtaatttattcatcacattaaatccagaattgc

SEQ ID NO: 4421 - DNA, 369 bp, Homo sapiens
  AC017104.4_23847
  Located on chromosome 2
  Distance between a terminus base of telomere on chromosomal short arm and 5'-terminus of this base sequence : 228827920
  Distance between 3'-terminus of neighbour sequence of sequence listing upward to telomere on chrosomal short arm and 5'-terminus of this base sequence : 158410
tcctctagcaagactgatcaagaaaaaaagaagacaaaacacaaatagccattatcaggaatgaaagaaggggtatcatcacattatagattgtactgattattattattattattatttttttaagagacagggtcttgctctgttgtccactgcccaggctggagtgcagtggcatgactgtagctcgctgcagcctggaactccagggctcaagcgatcctcctgcctcagcctctcaagtggctgaaaccacaggtgcatgccaccatgcctggctaattaaaaaaaattttttttttttaatttttgtaggaatggagtcttgttatgttgcccaggctggtcttgaacttctagcctcaagta

SEQ ID NO: 4422 - DNA, 267 bp, Homo sapiens
  D2S2193
  Located on chromosome 2
  Distance between a terminus base of telomere on chromosomal short arm and 5'-terminus of this base sequence : 228901868
  Distance between 3'-terminus of neighbour sequence of sequence listing upward to telomere on chrosomal short arm and 5'-terminus of this base sequence : 73579
gcctcctgtttacctcctctgcctgcgctcctgaggagtcagggggccatggaaaaatccagcgcttagcctttatttacgaccattgggaccagagatgtccccattgaagggtctgtgggcagatcaggtgcctgggggagggcacgcgacttttctctgctttccatttcccttcatacactcatacacacacacacacacacacacacacacacacacacacacacacacacacacacaccactaaatactgatgggttttat

SEQ ID NO: 4423 - DNA, 245 bp, Homo sapiens
  G08131
  Located on chromosome 2
  Distance between a terminus base of telomere on chromosomal short arm and 5'-terminus of this base sequence : 228933014
  Distance between 3'-terminus of neighbour sequence of sequence listing upward to telomere on chrosomal short arm and 5'-terminus of this base sequence : 30879
ttggtcaacatgtcaatttaggtaaaaaaaatttcttactaattggttttgagtatttgtgaatcacttaaagacattataaagcagtatgaatttctgtaaaaaaatacaggtatactctatctatctatctatctatctatctatctatctatcatctatctatctatcaatcaatcatctatatctctgtacacatagaaaataatctgaaaggggaggcagacactgttagcagtctacat

SEQ ID NO: 4424 - DNA, 254 bp, Homo sapiens
  D2S1392
  Located on chromosome 2
  Distance between a terminus base of telomere on chromosomal short arm and 5'-terminus of this base sequence : 228933069
  Distance between 3'-terminus of neighbour sequence of sequence listing upward to telomere on chrosomal short arm and 5'-terminus of this base sequence : -190
tttgtgaatcacttaaagacattataaagcagtatgaatttctgtaaaaaaatacaggtatactctatctatctatctatctatctatctatctatctatcatctatctatctatcaatcaatcatctatatctctgtacacatagaaaataatctgaaaggggaggcagacactgttagcagtctacataatattcaccctctccttcctgaccaacagaactgattttgtcggcacggcaatgtgtctactt

SEQ ID NO: 4425 - DNA, 346 bp, Homo sapiens
  AC018738.2_100663
  Located on chromosome 2
  Distance between a terminus base of telomere on chromosomal short arm and 5'-terminus of this base sequence : 228958511
  Distance between 3'-terminus of neighbour sequence of sequence listing upward to telomere on chrosomal short arm and 5'-terminus of this base sequence : 25188
ggtgaactaaagaaaattccagattaaaaaaaaaacaaaacagaatttgttgttaagagaccagcattacagagcactggaaatggtaaatatgtaggtggagatacacacacacacacacacacacacacacacacatacatacacacatgttccttctttaaatgatacatgactatttatagcaccgggttgataataaacataaatgtagcaaatatggcaacaagagcacaaaagaggaacagaaatcgagcctactgatgcaaagttcttctatttgaccagtaataaatcagtattaactcaaagtagtttgtgacaagtgaaagatgcatactgaatc

SEQ ID NO: 4426 - DNA, 459 bp, Homo sapiens
  AC018738.2_175591
  Located on chromosome 2
  Distance between a terminus base of telomere on chromosomal short arm and 5'-terminus of this base sequence : 229019341
  Distance between 3'-terminus of neighbour sequence of sequence listing upward to telomere on chrosomal short arm and 5'-terminus of this base sequence : 60484
aaactgcctagttaaatacattgtgaagaacaaaagcaatatgaatcattatattattctggtttttttctttattaagattttctcttcaagtataaaaatgtgcactttgtaccaagtcaaacattttctacacgtgtttaaaaaacattaacaacccctcttccaccccactctcttttaatcctgatcctgtccataggcaaaatcatcacctactttacggagattcttgtcccatttattttgtgtgtgtgtgtgtgtgtgtgtgtgtgtgtgtgtgtgtgtttctttttgccactacaggtagtgctgtattatgtactaaaatacatctgagaaacatataagcagatacagtgtgtagtgcttgtttgaactgactcaaataaaccaactgtaaaaagatattttgagaaaataaggaaaatcttgaatatggagtggactggtattaga

SEQ ID NO: 4427 - DNA, 342 bp, Homo sapiens
  chr2.fa.O7frz.241985181
  Located on chromosome 2
  Distance between a terminus base of telomere on chromosomal short arm and 5'-terminus of this base sequence : 229037487
  Distance between 3'-terminus of neighbour sequence of sequence listing upward to telomere on chrosomal short arm and 5'-terminus of this base sequence : 17687
gatctggtcatatggaaagatctccaagatatatcgaaagagaaataccaagtttcagaagagtaatgcatcatatgatcccaactaagggtacaaatgctgtacgcatgtgtgtacacacacacacacacacacacacacacacacgcatacgcagagaaatgttctaaaataatacacaagacaatgtcagtcttgaacatcaataaggaaatgaatctacagcattgtggtgaaggagcttttgctccttactacacgcttctctgaactgtttcaatcttttaccaaaacaacgcggttcttttacattagaaaggctagtaaagagtccagctttcc

SEQ ID NO: 4428 - DNA, 395 bp, Homo sapiens
  AC009407.5_118659
  Located on chromosome 2
  Distance between a terminus base of telomere on chromosomal short arm and 5'-terminus of this base sequence : 229091589
  Distance between 3'-terminus of neighbour sequence of sequence listing upward to telomere on chrosomal short arm and 5'-terminus of this base sequence : 53760
gtatcaagtgccagaaattcacctccaagtagcctgtgttttgcttaagcaaataaaacttgctgcctggaatgacacagtctggaagtagaggcacggctggacgtagggcttaggagagcccgtctggatccgcttcttagctcagcttcctcttggttggtgccacattcaggatctacatggtggaaggagcagtttcaggctacatcatcagtggaagatagatagatagatagatagatagacaatagatataagatagattaggtagagaggtaagataggtaggtagttaggtaggtagatagatagatcctgattgatagagagagatgggttcccaatagccagaacagataccccagaattgggtcttgttagctctgattggc

SEQ ID NO: 4429 - DNA, 378 bp, Homo sapiens
  AC044850.2_124278
  Located on chromosome 2
  Distance between a terminus base of telomere on chromosomal short arm and 5'-terminus of this base sequence : 229228333
  Distance between 3'-terminus of neighbour sequence of sequence listing upward to telomere on chrosomal short arm and 5'-terminus of this base sequence : 136349
gtcatggtatctttacttgcagttgaaagtgtcccgattccatgtccaacaatgggactggttgagtgaactatggctcacacatataatgggattcaggtattaaagacaatatataaaattccacagacctaaacacacacacacacacacacacacacacacacacacacacacacacactgcatagaagtaaaattggggaaatccgaataagatctgtggattacgtcagtgtcaatatcccgtttgtgctattgcactatagttttgcaaaatgttaccattgggggaaactgggcaaagtatacacaggatctctctgggtgatctccctttttgttttttgagacagggtctcactatgtcactcatgct

SEQ ID NO: 4430 - DNA, 418 bp, Homo sapiens
  chr2.fa.O7frz.241590395
  Located on chromosome 2
  Distance between a terminus base of telomere on chromosomal short arm and 5'-terminus of this base sequence : 229289701
  Distance between 3'-terminus of neighbour sequence of sequence listing upward to telomere on chrosomal short arm and 5'-terminus of this base sequence : 60990
atttacaacattgaatgagcacctgctctgtgtggagctccctatgtggcccaggctggtcttaaggatcgtgtgtgtgtgtgtgtgtgtgtgtgtgtgtgtgtgtgagagagatagggtctcactgtgtcatccaggctggaaggcagtggcacaatcacggctcactgcagcctcaacctcccaggctcaagcgatcctctggcctcagcctcccgagtagctgggactagggttgcacaccaccactcctggttaattttttgtgtgtattttttgtagagacgaggtctccctaagttgcccacgctggtcttgaactcctgggctcaagtgacccacctgcctcggcctctcaaaatgctgagattataggcatgagccactgtgcccggttcaagttaaagatcttgagatg

SEQ ID NO: 4431 - DNA, 452 bp, Homo sapiens
  chr2.fa.O7frz.241115416
  Located on chromosome 2
  Distance between a terminus base of telomere on chromosomal short arm and 5'-terminus of this base sequence : 229428964
  Distance between 3'-terminus of neighbour sequence of sequence listing upward to telomere on chrosomal short arm and 5'-terminus of this base sequence : 138845
gaaccacatagtcgttaaggtaaatacagaaggaataaatagataaagatatgcctggatggtaggatggctggctggatacagagtttcacaaccttgggaccattgttattttaggctgaaaaactcagttgtatgggctgtcctctgcattagtaacatccctggtctccaactactggatgccagaagcatcctgctcctcaccaccaattgtgataaccaaagaatatctatctctaggcattgctggaagttccttgcaaaattgcccctggttgatagatgtttggatggccacatggatggctgaatgaatggctggctggctggctggctggatggatggatggatgggtgaggatgacaaaggcaatagtgtggggaaaagcaagagagatcagattgttactgtgtctgtgtagaaagaagtagacataggagactccatt

SEQ ID NO: 4432 - DNA, 479 bp, Homo sapiens
  AC012507.4_142558
  Located on chromosome 2
  Distance between a terminus base of telomere on chromosomal short arm and 5'-terminus of this base sequence : 229431911
  Distance between 3'-terminus of neighbour sequence of sequence listing upward to telomere on chrosomal short arm and 5'-terminus of this base sequence : 2495
ttacagacaaggaaactgacatacaaaaggttaaggtggctgggcaaattggctcacacctataatcccagtactttgggaggccaaggcaggtggatcacctgaggtcaggagtttgagaccagcctggccaacatggcgaaaccccatctctactaaaaatacaaaaattagcggggcatggtggtgtgcacctgtagtcccagctacttgggaggctgaggcatgagaatcacttgaatccaggaggtagaggttgtgttgagctgagatcacgccactgcactctagcctgggtgacagagtgatacggtgtctcaaacacacacacacacacacacacacacacacacacacggttaaggtacttgcttgaggtcacacatttagtagatcagtctgtctggatgcatagcctggagctcttactgtgcaggcgaggactgtgggaaaggagctgtggaggacaattaggatga

SEQ ID NO: 4433 - DNA, 373 bp, Homo sapiens
  chr2.fa.O7frz.241015929
  Located on chromosome 2
  Distance between a terminus base of telomere on chromosomal short arm and 5'-terminus of this base sequence : 229511931
  Distance between 3'-terminus of neighbour sequence of sequence listing upward to telomere on chrosomal short arm and 5'-terminus of this base sequence : 79541
tcgaacatggaacgtagaggttacagtgagctgagatcgtgccactacactccagcctggctaaccgagcgagactccatctcaaaacaacaacaacaacaacaacaacaacaacaacaaataaaaaacaaacaaaaaacagtaccacttaccttacccaaggaagttctcttagaatctatattgtcttattataaattgtttcaattaatctagtttcccagtccaaagggcattagaaacattgaacagaatgagaaaatgcaaggaagctgggtaagcttaagatcagccagcagcacataccaaaagataataagcaataaaggaaaatacagacagaacagaaatgataactcataggtaccgaagc

SEQ ID NO: 4434 - DNA, 278 bp, Homo sapiens
  AC068155.2_97323
  Located on chromosome 2
  Distance between a terminus base of telomere on chromosomal short arm and 5'-terminus of this base sequence : 229563037
  Distance between 3'-terminus of neighbour sequence of sequence listing upward to telomere on chrosomal short arm and 5'-terminus of this base sequence : 50733
atcatttgaggtcagttcgagatcaccatgcccaacatggtgaaaccctgtctctactaaaaacacaaaaattagctgggcatggtggcgggcacctgtaatcccagctattcgggaggctgagacaggagaatcgcttgaacccgggaggcaaaggttgcagtaaggggagattgcaatgagccaagattgtgccactgcactccagcctgggcaatagagcagtactcagtctcaataataataataataataaaaggtggctcacgcttgtaatc

SEQ ID NO: 4435 - DNA, 295 bp, Homo sapiens
  AC074019.4_134417
  Located on chromosome 2
  Distance between a terminus base of telomere on chromosomal short arm and 5'-terminus of this base sequence : 229630213
  Distance between 3'-terminus of neighbour sequence of sequence listing upward to telomere on chrosomal short arm and 5'-terminus of this base sequence : 66898
ttaagtttcaaggttcagtggtatggccttcagctactgcagccttcaacttctttgaaacaaaacaaaacaaaacaaaacaaaacaaaacaaaacaaaacaaaaccaaaaccaaaaccaaaaccaaacaaaacaagagcaagtaaccaaaagctagcaggtcaggcagacctggttgaattaacctctcggtttagcctcatagatatgatctctcaattttcctaaactccattccttaaaatgtgcacaccagactaattttctagccttctaattggtttgacattctaaa

SEQ ID NO: 4436 - DNA, 244 bp, Homo sapiens
  G09123
  Located on chromosome 2
  Distance between a terminus base of telomere on chromosomal short arm and 5'-terminus of this base sequence : 229661768
  Distance between 3'-terminus of neighbour sequence of sequence listing upward to telomere on chrosomal short arm and 5'-terminus of this base sequence : 31260
ctcctggatatggaccactgattatttgatagtattgtttattgtcatttttctttattatctttagaggaacaaagtctcattctcttgttaaaaatatttggtgagaacagtctgttagttcttttaattcctcattctatctatctatctatctatctatctatctatctatctatctatctctatgtgtatgtgtgtgtagatacatatataatatatacctacacacatgtgttgtaaa

SEQ ID NO: 4437 - DNA, 187 bp, Homo sapiens
  G08176
  Located on chromosome 2
  Distance between a terminus base of telomere on chromosomal short arm and 5'-terminus of this base sequence : 229661835
  Distance between 3'-terminus of neighbour sequence of sequence listing upward to telomere on chrosomal short arm and 5'-terminus of this base sequence : -177
aggaacaaagtctcattctcttgttaaaaatatttggtgagaacagtctgttagttcttttaattcctcattctatctatctatctatctatctatctatctatctatctatctatctctatgtgtatgtgtgtgtagatacatatataatatatacctacacacatgtgttgtaaatgatatctgt

SEQ ID NO: 4438 - DNA, 314 bp, Homo sapiens
  chr2.fa.O7frz.238613781
  Located on chromosome 2
  Distance between a terminus base of telomere on chromosomal short arm and 5'-terminus of this base sequence : 229784622
  Distance between 3'-terminus of neighbour sequence of sequence listing upward to telomere on chrosomal short arm and 5'-terminus of this base sequence : 122600
gtagtcacaattcagcctacaacaccaatagttgataatattttaaagactttctttataagtctgcacctttcctccctccctccctctccctccctccctccctcccttccttccttcctcccttcctttcttccttccatccttccttctttccttcccaccttcctgccttcctgccttcctcttttttagtgatgtctgctaagttttgttattaggaatacgctggtctcttataatgagtttggcaatgtttacttcccttctgttttctaaaaaaatattttgttagatttcgatgttattgattc

SEQ ID NO: 4439 - DNA, 162 bp, Homo sapiens
  D2S2185
  Located on chromosome 2
  Distance between a terminus base of telomere on chromosomal short arm and 5'-terminus of this base sequence : 229861748
  Distance between 3'-terminus of neighbour sequence of sequence listing upward to telomere on chrosomal short arm and 5'-terminus of this base sequence : 76812
ttcagaaagacacagtaggctagcaccacaattccccaaatcacacataatattgagttattgccatgtaacttctggggcttctctctgtgtgtgtgtgtgtgtgtgtgtgtgtgtgtgtgtctgtctgtgtgtgcacatgctccaatactctacaaaatc

SEQ ID NO: 4440 - DNA, 190 bp, Homo sapiens
  Z66899
  Located on chromosome 2
  Distance between a terminus base of telomere on chromosomal short arm and 5'-terminus of this base sequence : 229940117
  Distance between 3'-terminus of neighbour sequence of sequence listing upward to telomere on chrosomal short arm and 5'-terminus of this base sequence : 78207
gcttacagactgtgggactctctgcctctattatccccagagtcagtactttataattaaaacacacacacacacacacagacacacagacacacacacacacacacacacacacaatctcccgttggctctttctctggagatctctgatgaatacaaactccctttgttgtaattccctgtactagca

SEQ ID NO: 4441 - DNA, 249 bp, Homo sapiens
  D2S1370
  Located on chromosome 2
  Distance between a terminus base of telomere on chromosomal short arm and 5'-terminus of this base sequence : 230018108
  Distance between 3'-terminus of neighbour sequence of sequence listing upward to telomere on chrosomal short arm and 5'-terminus of this base sequence : 77801
gtgttcttcagagaaacagaaccaataggatggatggatagatagatagatagatagatagatagatagatagatagataaagtgattggctcatgcaattatgaagactgagaagttctacaggtctgccatctgaaagctggagacccaggaaagctggtgttgtaattcaagtccaagtctgaaggactgagaaccagtggagtcaatggtaagtcttgatctgtgtacaaaggctggagaaccag

SEQ ID NO: 4442 - DNA, 367 bp, Homo sapiens
  AC012070.6_94118
  Located on chromosome 2
  Distance between a terminus base of telomere on chromosomal short arm and 5'-terminus of this base sequence : 230023149
  Distance between 3'-terminus of neighbour sequence of sequence listing upward to telomere on chrosomal short arm and 5'-terminus of this base sequence : 4792
tttgcaaggtactagataatcaagagtaaatgagagagatcttgtcctcacagtggagagacaaagaagtaaggaaaaaccataaatacaagtatcttttactatcaaacctattctattcatgagatatttagtgaaaaatagtattttatctgaatttagttggtttctatatttcaaataatgagaagtttggatgcaacagatatatatatatatatatatatatatatatataaatttattcaaatatatttgggatctgaattttgatatcaaaattaaaatagcaagaaatcttgtacttaaggatacctgtggcaatcgatgccacaaagtggggaaatgagttgctgtcgttagtaac

SEQ ID NO: 4443 - DNA, 275 bp, Homo sapiens
  AC007677.3_11077
  Located on chromosome 2
  Distance between a terminus base of telomere on chromosomal short arm and 5'-terminus of this base sequence : 230219206
  Distance between 3'-terminus of neighbour sequence of sequence listing upward to telomere on chrosomal short arm and 5'-terminus of this base sequence : 195690
gctacagatggatcattactttcatgttttttccagagacagagctaagaaaaaatgaaaatacaagagctagaaaatatatcgtgagtttatactgttattttcaattcaaatttgggattaactggtttttgcttcactttttttgtcttgtaatatgtctcttttgtattgaatattacggttcctaacagcattaccataatcacttatttgcttgtgtgtgtgtgtgtgtgtgtgtgtgtgtgtgtgtttcagactacattcagagttgt

SEQ ID NO: 4444 - DNA, 106 bp, Homo sapiens
  D2S362
  Located on chromosome 2
  Distance between a terminus base of telomere on chromosomal short arm and 5'-terminus of this base sequence : 230219382
  Distance between 3'-terminus of neighbour sequence of sequence listing upward to telomere on chrosomal short arm and 5'-terminus of this base sequence : -99
tattacggttcctaacagcattaccataatcacttatttgcttgtgtgtgtgtgtgtgtgtgtgtgtgtgtgtgtgtttcagactacattcagagttgttttttag

SEQ ID NO: 4445 - DNA, 321 bp, Homo sapiens
  AC007677.3_101263
  Located on chromosome 2
  Distance between a terminus base of telomere on chromosomal short arm and 5'-terminus of this base sequence : 230309477
  Distance between 3'-terminus of neighbour sequence of sequence listing upward to telomere on chrosomal short arm and 5'-terminus of this base sequence : 89989
ctcagaatgtgaccttatttgaatataaggtccttatggtggtaattaaggtaaaattagatcattgcggggggtgtctctaatccaccatgatggcatcctaataaaaagggaggaattttgagacagacagacacacacacacacacacacacacacacacacacacacacacacgcacacagggagatggccatgaacgtgaaaatggccacctataagccaaggaagagcctggaacagatccttccctcacagacctaagaaggaaccagcgctgccaaccaggactgccaagtcctttgatataggacttctagc

SEQ ID NO: 4446 - DNA, 444 bp, Homo sapiens
  AC006368.2_6758
  Located on chromosome 2
  Distance between a terminus base of telomere on chromosomal short arm and 5'-terminus of this base sequence : 230381644
  Distance between 3'-terminus of neighbour sequence of sequence listing upward to telomere on chrosomal short arm and 5'-terminus of this base sequence : 71846
ctagactgatttctgactcaagactgcaacgtctcttccctggatctcctgtctgcccaccttcccttaaaatgttgggactcgccagcccctacaatgatgtgagtcaattattttaaagatatgtctgtctctctctctctctccctctccacccccctccttccctctactcacacacatacatataaatggggccaatcatttatatgtgtgtgtgtgtgtgtgtgtgtgtgtgtgtgtgcaccaacctaacaccactcctttgttgcaaatgcaatgattctgataccaaaagatctgagaacacttgccccaaatcccacagctggtctcggaaaagtgagatgtagaacccaagtcctccaccacaaaacaaaagctctttccactgctttaatttcttcacttgaagaggattcagacaccttagtttccattctt

SEQ ID NO: 4447 - DNA, 326 bp, Homo sapiens
  AC006368.2_40395
  Located on chromosome 2
  Distance between a terminus base of telomere on chromosomal short arm and 5'-terminus of this base sequence : 230415305
  Distance between 3'-terminus of neighbour sequence of sequence listing upward to telomere on chrosomal short arm and 5'-terminus of this base sequence : 33217
ctcagagtgcctacaaattctgcccagcagcccagtgtcttctgtcctttctctctttgaggaagaatatctttcttttcctaaccatctctacctccagtttggaaaagagtttttaaaattttatctctcctcaataataataacaatcaaaatttctttcctttctttaacgagaagggtttttgtgtgtgtgtgtgtgtgtgtgtgtgtgtgtgtgtgagatgagggagcaagtagggtcaggtagaaaaattacatattttctcccatatttaaacaaggattatcaggtcaatttgtaataaactcagctgaggacatta

SEQ ID NO: 4448 - DNA, 155 bp, Homo sapiens
  AC006368.2_58162
  Located on chromosome 2
  Distance between a terminus base of telomere on chromosomal short arm and 5'-terminus of this base sequence : 230433163
  Distance between 3'-terminus of neighbour sequence of sequence listing upward to telomere on chrosomal short arm and 5'-terminus of this base sequence : 17532
ctttcagtatagcatgcttcatatttgcagagcatccgcatgcacataatattctcaccatcacaacacagttaagtatgcttgcacacgtgtgtacacacacacacacacacacacacacactgagaaggcagtcagtgactaccttccatttt

SEQ ID NO: 4449 - DNA, 424 bp, Homo sapiens
  AC006368.2_110232
  Located on chromosome 2
  Distance between a terminus base of telomere on chromosomal short arm and 5'-terminus of this base sequence : 230485186
  Distance between 3'-terminus of neighbour sequence of sequence listing upward to telomere on chrosomal short arm and 5'-terminus of this base sequence : 51868
agatgagacatacgaatgtagaaggaggaaaaaaaaatggaaagcgggtggggaaaagagcacagaggggtaatggacaggggatgaaagaagtaagagaaaaggggtactgaagaaaagagaaataaatagaaaaaaatagaagaaagaaagaaagaaagaaagaaagaaagaaagaaagaaagaaagaaagaaagaaagagaaagaaagaaagaaagagaaagaaagaaagaaagaaagaaagaaagaaagaaagaaagaaagaaagaaagaaagagaaagaaagaaagaaagaaagaaagaaagaaagcaagcgagcgagcaagcgagcttcccttgaccaaacactcccttggaatacatgtatttttagttttgcttcaccatgatagggcacttaacctgtctttagctacacttaaa

SEQ ID NO: 4450 - DNA, 448 bp, Homo sapiens
  AC006375.3_57698
  Located on chromosome 2
  Distance between a terminus base of telomere on chromosomal short arm and 5'-terminus of this base sequence : 230491305
  Distance between 3'-terminus of neighbour sequence of sequence listing upward to telomere on chrosomal short arm and 5'-terminus of this base sequence : 5695
ctatcttgtttaatgctttcgtacctaaagtatatttttttcatttaataaacaataaattacactactcttggagtagcaggtagacttgttctcacatttggttccctcagtacagattcccctaatgcaaaaggtgaatagaacattgaaaataagaatgacataacgaatgctgagtttaaatatatgtatgtgtatatatatatatatatatatatatatatatataaactcgagacagcattttaaaagttaacatcttatatttaagtatcatatttgtataaaccagattttagttttgaagttattataatctttggagagtctctaagaagttatacaatttccactggaaaccataaggcacattattaatgaatttctaccaacttaattagttttctgtggagtgtttctatggttggctaacaaatgaagtcta

SEQ ID NO: 4451 - DNA, 419 bp, Homo sapiens
  AC006375.3_149531
  Located on chromosome 2
  Distance between a terminus base of telomere on chromosomal short arm and 5'-terminus of this base sequence : 230583059
  Distance between 3'-terminus of neighbour sequence of sequence listing upward to telomere on chrosomal short arm and 5'-terminus of this base sequence : 91306
actatcaccaggtagaaggaagaggccaggagggtgatgtggaagacgatgggttacagaagacagataaagccacagtaattatcacagagcagggtaggcaaactatacccagttccaaaccagcacaatacctctttatatattaaaggtttatgtaaatgcagccacactcacttgctcatgtgttgtttatagatagctatttcatactacaacatcagggtagtgtgtcccgcaaagcctagcatgcggccttctcctttacacacacatacacacacacacacacacacacacacacacacacacactgacttctaatatagatgaggatctaagtattttggaaatcttgtaaaatattactccatattaagaaattaaaacaaacagaggaactacatgatagatcatga

SEQ ID NO: 4452 - DNA, 151 bp, Homo sapiens
  D2S2213
  Located on chromosome 2
  Distance between a terminus base of telomere on chromosomal short arm and 5'-terminus of this base sequence : 230583263
  Distance between 3'-terminus of neighbour sequence of sequence listing upward to telomere on chrosomal short arm and 5'-terminus of this base sequence : -215
atttcatactacaacatcagggtagtgtgtcccgcaaagcctagcatgcggccttctcctttacacacacatacacacacacacacacacacacacacacacacacacactgacttctaatatagatgaggatctaagtattttggaaatc

SEQ ID NO: 4453 - DNA, 199 bp, Homo sapiens
  D2S2218
  Located on chromosome 2
  Distance between a terminus base of telomere on chromosomal short arm and 5'-terminus of this base sequence : 230734144
  Distance between 3'-terminus of neighbour sequence of sequence listing upward to telomere on chrosomal short arm and 5'-terminus of this base sequence : 150730
ggcaatagaaggaacttaatacatttgaagacacttgaacacataaataaaaaggtaatttgcattctgtgtgtgtgtgtgtgtgtgtgtgtgtgttttttaattttcaacacaaagactctatttttttgatacgattctaatgcttttctgttcagcacatttttggctgcatgagtagcagtgaactctggatgac

SEQ ID NO: 4454 - DNA, 210 bp, Homo sapiens
  AC007748.2_78082
  Located on chromosome 2
  Distance between a terminus base of telomere on chromosomal short arm and 5'-terminus of this base sequence : 230734865
  Distance between 3'-terminus of neighbour sequence of sequence listing upward to telomere on chrosomal short arm and 5'-terminus of this base sequence : 522
ctgtttgtataaagtgcagaactctcagaaaattccagacgagggatcttttacttcagtaaaactaaaaaggaaatatatatatatatatatatatatatatatatatatatatatatatatatatatagcactggtaaaaagaatctttcctttagtgtacttaactagttaactagcttcatttagctagttaagtgaggttgattc

SEQ ID NO: 4455 - DNA, 263 bp, Homo sapiens
  HUMUT506
  Located on chromosome 2
  Distance between a terminus base of telomere on chromosomal short arm and 5'-terminus of this base sequence : 230745467
  Distance between 3'-terminus of neighbour sequence of sequence listing upward to telomere on chrosomal short arm and 5'-terminus of this base sequence : 10392
tgccgctcttttcagatggcatcattatttatgtagaaaatcccaagaaatctacaaaaaaaaaaaatcctaaaactagtaagttcagcaaggtcacaggatacaatttaaacatacaaaaatcaattatatttctatatactagcaagaacaattctatttacaatcactaaaaatacaccatacacacacacacacacacatgcatatatacatacctacttggatacttggatatacatgtacagggaaaaaatgttgat

SEQ ID NO: 4456 - DNA, 317 bp, Homo sapiens
  AC008273.2_32848
  Located on chromosome 2
  Distance between a terminus base of telomere on chromosomal short arm and 5'-terminus of this base sequence : 230781053
  Distance between 3'-terminus of neighbour sequence of sequence listing upward to telomere on chrosomal short arm and 5'-terminus of this base sequence : 35323
aacttctttgaaataaagccaggaacaaggctcaatctatatggaattatgaggtaagtaaagaagttttctcctagacattccttatcacttgagtaggcaagttcaggggacctcaccatttcttttcaagcaaccaaagattaaacactgtttttcaactttctttctcctcaaatctgcttacatatatagagacaatttatatatatatatatatacacacacacacacacacacacacgtgcacacacacacacagacacatcacatcacattcttcacatatttaggtttaaggttatggtagattgaaa

SEQ ID NO: 4457 - DNA, 373 bp, Homo sapiens
  AC008273.2_89873
  Located on chromosome 2
  Distance between a terminus base of telomere on chromosomal short arm and 5'-terminus of this base sequence : 230838058
  Distance between 3'-terminus of neighbour sequence of sequence listing upward to telomere on chrosomal short arm and 5'-terminus of this base sequence : 56688
ctatcactccttgatgtctgacagccttccttcactccacatctactttctccttcccctgtagttcaaactgatactgtctttgatggtaaaatcccatctcaattcctggcttctgctgagatggctgattaaatccatgaatcacatccatgatctcttaccaaatggttgctcagccataaccttaagtattctcttcagaacaacttccccatttttcccatttttgccatgattacacacacacacacacacacacacacagacacacagacacacaaacacactacatatatgcaaacatacacacgcatacactgtatacacaaatgcatatgcatattgtctagtcatcttcctcactgaaata

SEQ ID NO: 4458 - DNA, 388 bp, Homo sapiens
  AC008273.2_103100
  Located on chromosome 2
  Distance between a terminus base of telomere on chromosomal short arm and 5'-terminus of this base sequence : 230851313
  Distance between 3'-terminus of neighbour sequence of sequence listing upward to telomere on chrosomal short arm and 5'-terminus of this base sequence : 12882
cctaagaacattgcataggaccctccagccgtccctttgccttcagcagtactgtgaaggccacctcttgaggatgatatgttcataacatgaagggacctggatccctgagtcaccacctgaaggctaagtgcccccatcagactatgacacaagcaaaaattaaccttggcttggaagccactgaggcttgaggattatgtgttgctgcagtgtgtgtgtgtgtgtgtgtgtgtgtgtgtgtgtgtgtgtgttggctacaataaaaaagcagcactagaagctaagctaaaagagagagagagaaacctatgggaatgggggttcctgcagggaatcggaactggcaaagaagaaaccttcttaaggaaactcaagaacaagttat

SEQ ID NO: 4459 - DNA, 205 bp, Homo sapiens
  D2S2297
  Located on chromosome 2
  Distance between a terminus base of telomere on chromosomal short arm and 5'-terminus of this base sequence : 230851436
  Distance between 3'-terminus of neighbour sequence of sequence listing upward to telomere on chrosomal short arm and 5'-terminus of this base sequence : -265
aggctaagtgcccccatcagactatgacacaagcaaaaattaaccttggcttggaagccactgaggcttgaggattatgtgttgctgcagtgtgtgtgtgtgtgtgtgtgtgtgtgtgtgtgtgtgtgtgttggctacaataaaaaagcagcactagaagctaagctaaaagagagagagagaaacctatgggaatgggggttcc

SEQ ID NO: 4460 - DNA, 450 bp, Homo sapiens
  chr2.fa.O7frz.239881103
  Located on chromosome 2
  Distance between a terminus base of telomere on chromosomal short arm and 5'-terminus of this base sequence : 231046458
  Distance between 3'-terminus of neighbour sequence of sequence listing upward to telomere on chrosomal short arm and 5'-terminus of this base sequence : 194817
gcaattaaaccaattaaatatcatgttttacctatcagttaacacaaaaaaaatgggggctagtaggcattctcatatgctgtcagtaaatttgcaaaattctccaacctttttggatggcaacttagcagtatttattagaatgcttaatgtatatacatttatgtcaatatatgtgtgtgtgtgtgtgtgtgtgtgtgtgtgtgtgtataggggtcagtgcaacattttttttttttttttgagacagcatctcactctgtcatccaggctggagtgcagtggtgtgatctcggctcactgcaacctctgcctcccaggttcaagcaattctcccgcctcagcttcccaagtagctgggtttataggtgtgtgctaccacactcagctaattttttgtgacattatttaaaaactggaaataatgtgctttagtaaggactgaatatg

SEQ ID NO: 4461 - DNA, 216 bp, Homo sapiens
  D2S341
  Located on chromosome 2
  Distance between a terminus base of telomere on chromosomal short arm and 5'-terminus of this base sequence : 231057197
  Distance between 3'-terminus of neighbour sequence of sequence listing upward to telomere on chrosomal short arm and 5'-terminus of this base sequence : 10289
tcacaggtgctcagtgatttacagcacttaattaatttaatccttcccagaaccttagtgtgaacatcccacagagacaggatggacacccactcaaaatttggtttggaccctgagactgaaaatggcatgcatacacgcgcacacacacacacacacacacacacacacacacacacaggatacaaaaaggtttactgctgacataatggggct

SEQ ID NO: 4462 - DNA, 335 bp, Homo sapiens
  AL137126.8_287845
  Located on chromosome 2
  Distance between a terminus base of telomere on chromosomal short arm and 5'-terminus of this base sequence : 231113793
  Distance between 3'-terminus of neighbour sequence of sequence listing upward to telomere on chrosomal short arm and 5'-terminus of this base sequence : 56380
acctttagatccattgactagttctttccaaccttgtattttataccttcctgccaaaattatctgaactaattaaggacagataattgtgattaaaaaaacaaaacaaaacaaaaccaggtttctgacatttatctgtcccctcagggatttagttcattgctttttcagccctagtttagagaacagtggtctgcaaatatttttgttgttgttgttgttgttgttgttttgaaaagggccaggtagtgctgggcatggtgtctcacgcctgtaatcccagcactttgggaggctgaggcaggcagatcacgaggtcaggagatggagaccat

SEQ ID NO: 4463 - DNA, 158 bp, Homo sapiens
  DISO7_10009318
  Located on chromosome 2
  Distance between a terminus base of telomere on chromosomal short arm and 5'-terminus of this base sequence : 231334390
  Distance between 3'-terminus of neighbour sequence of sequence listing upward to telomere on chrosomal short arm and 5'-terminus of this base sequence : 220262
aaatacacatacctgcgtgtgcacacacgtgcacacacacacaggcgcacacacacacaggcacacacacacataagcatgctgcttatttgtaacccgtatacacacacacacacacacacacacacacacactctcacacaccgtcacactgtctc

SEQ ID NO: 4464 - DNA, 102 bp, Homo sapiens
  DISD22_0002314
  Located on chromosome 2
  Distance between a terminus base of telomere on chromosomal short arm and 5'-terminus of this base sequence : 231664021
  Distance between 3'-terminus of neighbour sequence of sequence listing upward to telomere on chrosomal short arm and 5'-terminus of this base sequence : 329473
tctgtgctgcctagaacgatccagaccacccctatacacacacacacacacacacacacacacacacacacacacacaccccccatatgctgggctgaagtc

SEQ ID NO: 4465 - DNA, 411 bp, Homo sapiens
  AC013435.3_26749
  Located on chromosome 2
  Distance between a terminus base of telomere on chromosomal short arm and 5'-terminus of this base sequence : 231805218
  Distance between 3'-terminus of neighbour sequence of sequence listing upward to telomere on chrosomal short arm and 5'-terminus of this base sequence : 141095
cactcagcactgattcttagacccaggatcctgccatcttgtggctctgctatcttcagcatgttgcttccagggtcaccatgcttgttcacatcaagctgtctgagggtgaagaacatggaggaatgaacatacacacacacacacacacacacacacacaaacttttcatgtgctaggaagtggcacgggttgcttctgctcatgttctgttggctggaactccgtcatatggccacacttaactgcaaaggaggctgggaaatgaagtcttgcaatgcctgggaagaagaggaaattggttggtgaacagataacggtttgtgcctgtagggaaggaaaatacatcttttttttctgctcttccaggttctctggctggggctctgtaaattagactaatggaagaca

SEQ ID NO: 4466 - DNA, 375 bp, Homo sapiens
  AC019130.4_140711
  Located on chromosome 2
  Distance between a terminus base of telomere on chromosomal short arm and 5'-terminus of this base sequence : 231899958
  Distance between 3'-terminus of neighbour sequence of sequence listing upward to telomere on chrosomal short arm and 5'-terminus of this base sequence : 94329
cttagcctaatgtcctctaggttcatccatgttgttgcaaatgagagggatttccttttcctttcctttcttttcctttcctttcctttcctttcctttcctttcctttcctttcctttctctttctctctttctctctttctgtctttctctctttctttccttctttctttcttcttcttcttttttttttttttttttttaagagactggatttcaccatgttgttgcccaggctggtctcaaactcctgagctcgagcagttctcctaccttggcctcccaaagtgctgggactacaggcatgagccactgtacccggcttccttttttttttgtttgtttgtttgtttgttaaaccgaatggtattccat

SEQ ID NO: 4467 - DNA, 386 bp, Homo sapiens
  AC019130.4_29555
  Located on chromosome 2
  Distance between a terminus base of telomere on chromosomal short arm and 5'-terminus of this base sequence : 231972017
  Distance between 3'-terminus of neighbour sequence of sequence listing upward to telomere on chrosomal short arm and 5'-terminus of this base sequence : 71684
cacttatgtttcataggctcactctgttatgttgggaatagactgaaaggaggcaagggtagaagcagggagaccccttacatggctattgcttacttccaggatggagatgatggagactaaaccaggatggtggcaatgaaggtagagctgacaagatcagctgacagttgggatgtggggtgtgtgtgtgtgtgtgtgtgtgtgtgtgtgtgtgttgctgtgtgtttgagagaaggggaggttgaggtggggtggggaaggaagtcgaatgattgattgataaggactgcacagggattttgggctgagtaattggaagaatggagagagattgttcattctttggctgttaactagataaaaggtacgtttggattagctac

SEQ ID NO: 4468 - DNA, 368 bp, Homo sapiens
  chr2.fa.O7frz.243167072
  Located on chromosome 2
  Distance between a terminus base of telomere on chromosomal short arm and 5'-terminus of this base sequence : 232150956
  Distance between 3'-terminus of neighbour sequence of sequence listing upward to telomere on chrosomal short arm and 5'-terminus of this base sequence : 178553
cttagatggaaacatctgtcaggagttctctgcctacacggagctctggcgcactcgcgcgctctctttttctcgtctctctctctctctctctctctctctctctctctctctctctctctctctctctgtctcgtctctctctctctctctctgtctctctcaggtgtctaggtctctgaaatatcccagtggttgtggtcttagattattccttcatctttcatattttattttcatgagctcctctctacaaagagctcaatgtgtcacagacacttctcgttgtgttacttattttaaaaagtacttacaagggtcctaaaatttaaaacagctgaaagaggtggttgacagtatcttgctaa

SEQ ID NO: 4469 - DNA, 446 bp, Homo sapiens
  AC068134.3_87977
  Located on chromosome 2
  Distance between a terminus base of telomere on chromosomal short arm and 5'-terminus of this base sequence : 232262047
  Distance between 3'-terminus of neighbour sequence of sequence listing upward to telomere on chrosomal short arm and 5'-terminus of this base sequence : 110723
gtccactcgtaaattgacgtccactcctgggataagcccctggaaccagtgttctcttcctttcaaaataaccatgtagccagacttggtggtgggtgcctgtaatcccagctacttaggaggctgaggcaggagaatcacttgaacccaggacatggaggttgcagtaagccaagatcgcgccactgcactccagcctgggcaacagagcaactcaagaaaaacaccaccaccaccaccaccaccaccaccaccaccaccccccccaaaaaaccgaccatgcactgctcctttcacctttcaaagccccccttgcctcccctcctccgatgcgcccctagtttactaaggccggggctctgcatgcagtgctgctgcttattcccagttaaactccatagttttggagagcctccctctgtttcttgaggttgacaggactatca

SEQ ID NO: 4470 - DNA, 422 bp, Homo sapiens
  AC074188.2_97322
  Located on chromosome 2
  Distance between a terminus base of telomere on chromosomal short arm and 5'-terminus of this base sequence : 232414480
  Distance between 3'-terminus of neighbour sequence of sequence listing upward to telomere on chrosomal short arm and 5'-terminus of this base sequence : 151987
cttcactagacctgaattgcagcaccccatccttgtcatcctccccttttctaccaccatcagcaccatcaccttatctagatcatccttttcgcctaattccccaacatcatcaccacctccatcatcatcatcatcatcatcatcatcatcatcatcatcatccctttcaacaaaaccgtcaccaccatcatcgccatcaggactcaccttgtacctgcactgttgcatctcactgaatccttgcaacacctaccaaggggcaggtaccattattatcctcccactttgcagggtgaggagaccatagcttacaatgaaggggcttttccaaagtcatgaccaggaagtgtcagaggtaggacttgaacctaaactgcttgacatcagagcccaaagtcataaccgctatactttaccac

SEQ ID NO: 4471 - DNA, 211 bp, Homo sapiens
  D2S2344
  Located on chromosome 2
  Distance between a terminus base of telomere on chromosomal short arm and 5'-terminus of this base sequence : 232496211
  Distance between 3'-terminus of neighbour sequence of sequence listing upward to telomere on chrosomal short arm and 5'-terminus of this base sequence : 81309
ctagggtgggacaggaaaagtcactagtggctggtcaagcctgtctgcatccaataaaaggcaactaagaggacacatattgggatcccccacatacataccacacacacacacacacacacacacacacacacacacacacacacacactttcaagaattagagccatgtttctaaagtaaagtgaaaggtacccagattttacttcctg

SEQ ID NO: 4472 - DNA, 270 bp, Homo sapiens
  AC073254.2_109203
  Located on chromosome 2
  Distance between a terminus base of telomere on chromosomal short arm and 5'-terminus of this base sequence : 232531424
  Distance between 3'-terminus of neighbour sequence of sequence listing upward to telomere on chrosomal short arm and 5'-terminus of this base sequence : 35002
tctgtcaatagcaggctattagcagttaacttgttggggaatgaaaagttatattaggattttttactgttgggggggcatccttaaccccctgcattgttcaagtgtcaactatagtgtgtgtgtgtgtgtgtgtgtgtgtgtgtgtgtgtgtgtatttacatattttttcttagaaggtcaaggttgatactgtatttacgcaccagagtaaccataattctccctcttatttcgcctttacttttaaatagatttggtgctcacctc

SEQ ID NO: 4473 - DNA, 419 bp, Homo sapiens
  AC064852.1_66868
  Located on chromosome 2
  Distance between a terminus base of telomere on chromosomal short arm and 5'-terminus of this base sequence : 232593173
  Distance between 3'-terminus of neighbour sequence of sequence listing upward to telomere on chrosomal short arm and 5'-terminus of this base sequence : 61479
gctatgatcataccactggaccacagcctgggcaacagagcaagaccctgcctctaaaacaaaacaaaacaaaacaaaaagcaaacaataaaagagagtttttagtccctgcctctagggattataattccataaaagtaaaagtgacctggtgcagtggctcacatctgcaatcccagcacattgggaggccaaggtgggaggattgcttaagtccaggagtttgagaccagcctgggcaacatggcaagaccccatctctacacacacacacacacacacacacacacacacacgtacacacacacatctttctataacacacacatacacacacacacacacacacgtacacacacacatctttctatataagcataactcttgctgttaatattatcagagttacctgtcttcag

SEQ ID NO: 4474 - DNA, 473 bp, Homo sapiens
  AC073254.3_112471
  Located on chromosome 2
  Distance between a terminus base of telomere on chromosomal short arm and 5'-terminus of this base sequence : 232611423
  Distance between 3'-terminus of neighbour sequence of sequence listing upward to telomere on chrosomal short arm and 5'-terminus of this base sequence : 17831
cgtgatgttgatgctactgtaccactttgagcggtaagggtataaaagtcaagggaagaaagtgtttcagaaggccgggagcggtggctcatgtctgtaatcccagcactttgggaggccgaggtgggcggatcacctgaggtcgggagttcaagaccagcctgatcaatatggagaaaccccgtctctactaaaaatacaaaattagccgggcgtggtggcatatgcctgtaatctcagttacttgggagggtgaggcaggagaatcgcttgaacctgggaggcggaggttgcggtgagcggagatcacgccattgcactccagcctgggcaacaagagcgaaactgtctcaaaaataaataaataaataaataaagtgtttcagaaagtaggaagaggccaatcatattgaagacagggaaacacgaagtcaagatgaggactgaaagactccagttatcaacctgtagga

SEQ ID NO: 4475 - DNA, 409 bp, Homo sapiens
  AC064852.1_152924
  Located on chromosome 2
  Distance between a terminus base of telomere on chromosomal short arm and 5'-terminus of this base sequence : 232666715
  Distance between 3'-terminus of neighbour sequence of sequence listing upward to telomere on chrosomal short arm and 5'-terminus of this base sequence : 54819
aatacaagtgatacggttctgtacttccaacatcaagtatttttattgaaagacttccctgaagatttggaaaaattttttcccatcgtttttgtttgcatttctttgcctgtagcagtaaacagttgtttttcagatgtttattcatcatttatatttctgttaatttttttcttgcctttgccaatttttcttttgggatattcatcttttccttgttgatttatgctatttatatgagctctgtgtgtgtgtgtgtgtgtgtgtgtgtgtatgtttgtgtgtgtgtgtattttttgtttacttatttagattttctattttgagctaggttctcactctgtcatccaggctggagtatagtgagggtctcactctgtcacccaggctgtagtacagcggcatgatc

SEQ ID NO: 4476 - DNA, 291 bp, Homo sapiens
  AC016692.6_85922
  Located on chromosome 2
  Distance between a terminus base of telomere on chromosomal short arm and 5'-terminus of this base sequence : 232795423
  Distance between 3'-terminus of neighbour sequence of sequence listing upward to telomere on chrosomal short arm and 5'-terminus of this base sequence : 128299
atagtttggttcagtatgccattcggtgctcattcattcattcattcattcattcattcaacacatgtttactgagtacctactcacttaaggtctggggatatagctgagtctaaaacaggcaagattttctgcattcatgaagctgaccctctgattgagaagagaaaagtagaaaatgaagcgtatgagaggttgataagtgtcagagaggtaacaagggaaggtgggtagggagagtgttgggagtcagggataatgatggtgtggtggattgtccaaatttaggta

SEQ ID NO: 4477 - DNA, 151 bp, Homo sapiens
  D2S206
  Located on chromosome 2
  Distance between a terminus base of telomere on chromosomal short arm and 5'-terminus of this base sequence : 232798042
  Distance between 3'-terminus of neighbour sequence of sequence listing upward to telomere on chrosomal short arm and 5'-terminus of this base sequence : 2328
gtcctcatgtgtttatgctgtgtgtgtgtgtgtgtgtgtgtgtgtgtgtgtgtgtgtgtgtgtgtgtataatctgtcattttggtgggggctttaggaagtaaacatgtgttttatttctgtgcttaaccaaaagcctacttaatttttaa

SEQ ID NO: 4478 - DNA, 209 bp, Homo sapiens
  D2S2176
  Located on chromosome 2
  Distance between a terminus base of telomere on chromosomal short arm and 5'-terminus of this base sequence : 232838320
  Distance between 3'-terminus of neighbour sequence of sequence listing upward to telomere on chrosomal short arm and 5'-terminus of this base sequence : 40127
gatggtggttccctactcagcctgactcaagggttctcaaagggctcatccaaaaagagggactcgcccagagtctgaagccccaagggaacacacacacacacacacacacacacacacgcacacacgcacacacgtacacgcgtacacgcatccaggaacctgcagccacccccagcggctccatagaaagtattggcgcagggtct

SEQ ID NO: 4479 - DNA, 407 bp, Homo sapiens
  AC067781.2_168216
  Located on chromosome 2
  Distance between a terminus base of telomere on chromosomal short arm and 5'-terminus of this base sequence : 232987185
  Distance between 3'-terminus of neighbour sequence of sequence listing upward to telomere on chrosomal short arm and 5'-terminus of this base sequence : 148656
cttgtaatcacaggcttaacatcaggcaagtcagggcctcagtttcctgtccagaaaacatggggtgggtgggtattcttgacttctagctctcaaatttggtgatccagggaggctcagagggtccttagagggatgttcatggtacattaagagtcagggggattgtcctccctgaaatgaggaggctctgaaaccctgagaagaagtattcccagatcttaccacctttgagatgattttacacacacacacacacacacacacacacacacacacacaggaagagattgtaaaactatctgtaaaactattctaattctgctgcaattatagactattttaagcaaatgtgctctgcgtctggaatctttttataattgctttgattcgtctataacgattaa

SEQ ID NO: 4480 - DNA, 264 bp, Homo sapiens
  D2S331
  Located on chromosome 2
  Distance between a terminus base of telomere on chromosomal short arm and 5'-terminus of this base sequence : 232987287
  Distance between 3'-terminus of neighbour sequence of sequence listing upward to telomere on chrosomal short arm and 5'-terminus of this base sequence : -305
tgatccagggaggctcagagggtccttagagggatgttcatggtacattaagagtcagggggattgtcctccctgaaatgaggaggctctgaaaccctgagaagaagtattcccagatcttaccacctttgagatgattttacacacacacacacacacacacacacacacacacacacaggaagagattgtaaaactatctgtaaaactattctaattctgctgcaattatagactattttaagcaaatgtgctctgcgtctg

SEQ ID NO: 4481 - DNA, 250 bp, Homo sapiens
  AC034291.2_21990
  Located on chromosome 2
  Distance between a terminus base of telomere on chromosomal short arm and 5'-terminus of this base sequence : 233116795
  Distance between 3'-terminus of neighbour sequence of sequence listing upward to telomere on chrosomal short arm and 5'-terminus of this base sequence : 129244
tggttcctttatgaattgtataaggggatttagaaaaagtaggcaagtgctccaagttgaaagaaaaatacttcatttaaaagttcacattaaaaagttggaaaagccaaatctttcccccttataattaaaacacacacacacacacacacacacacacacacacacacagacatacacacgtgcacagagatttttaaattggggttttaatactcacatatttataaggcacttcatatcttgataa

SEQ ID NO: 4482 - DNA, 316 bp, Homo sapiens
  AC034291.2_140444
  Located on chromosome 2
  Distance between a terminus base of telomere on chromosomal short arm and 5'-terminus of this base sequence : 233152813
  Distance between 3'-terminus of neighbour sequence of sequence listing upward to telomere on chrosomal short arm and 5'-terminus of this base sequence : 35768
gtctgatccatcacctagaatcagaatgttctctacctttggcaaagctagttgcaaagtcttactgttacttttttttctttttttggctgtagactcaatgtcaactgctgcttatttcaattcatgaatcagcaaatatctttgtgtgtgtgtgtgagagagagagagagagagagtgtgtgtgtgtgtgtaggctttattgatgcacctgtaactggaactctcttcttacctcttagacctcagctctctgcagagaccccttaagtaactgaccaaaaataaccagccctgttactcactaccacacctg

SEQ ID NO: 4483 - DNA, 185 bp, Homo sapiens
  chr2.fa.O7frz.245573013
  Located on chromosome 2
  Distance between a terminus base of telomere on chromosomal short arm and 5'-terminus of this base sequence : 233268240
  Distance between 3'-terminus of neighbour sequence of sequence listing upward to telomere on chrosomal short arm and 5'-terminus of this base sequence : 115111
tcataagttgaatagattctggacatctaatgcacaacatgataactgtagttaatagcaatgtattgtatacttgaggtttgctgagagtagatctgacactgttctcaccacacacacacacacacacacacacacacaaatacacacacacaaagatgaagtaatggatatgttcattgtgg

SEQ ID NO: 4484 - DNA, 235 bp, Homo sapiens
  AC006327.3_22508
  Located on chromosome 2
  Distance between a terminus base of telomere on chromosomal short arm and 5'-terminus of this base sequence : 233376708
  Distance between 3'-terminus of neighbour sequence of sequence listing upward to telomere on chrosomal short arm and 5'-terminus of this base sequence : 108283
aaactgcttaaattgctgattaactttctctctctctctctctctctctctctctctgtgtgtgtgtgtgtgtgtgtgtgtgtgtgtgtgtgtgtgtgtttggatgttatttttataagtgtcactggagttccatcccaaccattgaacaaattcatcctaggaaacacctttatggcagagtaggtttggagaagtacagaaaaactctattatcctctttgtctatggaatg

SEQ ID NO: 4485 - DNA, 476 bp, Homo sapiens
  AC027778.3_133092
  Located on chromosome 2
  Distance between a terminus base of telomere on chromosomal short arm and 5'-terminus of this base sequence : 233391017
  Distance between 3'-terminus of neighbour sequence of sequence listing upward to telomere on chrosomal short arm and 5'-terminus of this base sequence : 14074
accaggctgaattacctgtattgctgggcttcgtggttacaggaggcaagacttttgcctttgattgtttgtcagtttgagtggattttctttttctttcttttttctttctttctttctttcctttttctttctttctttccttctctttctctttctttctctctctctccttccttccttgctcccctccctccctctctcctttctttcttttctttctttcttttttcttttctttctttctttctttctttctttctttctttctttctttctttctttctctttctttctttctttctttccttctctctctgtttctttccctctctttcttccttcctttcttttttctttctttctttcctttttttggacagagtcttgttctgtcacccaggctggagtgtggtgacacaatctcggctcactgcaacatccgcctcccaggttcaaaggattctactgcctaa

SEQ ID NO: 4486 - DNA, 353 bp, Homo sapiens
  AC006327.3_57674
  Located on chromosome 2
  Distance between a terminus base of telomere on chromosomal short arm and 5'-terminus of this base sequence : 233411797
  Distance between 3'-terminus of neighbour sequence of sequence listing upward to telomere on chrosomal short arm and 5'-terminus of this base sequence : 20304
ccaggtttacatatctgctttaactctctcccccgacaagcagacatatatgtgtgcacatgcccatccacacaacacccagacgcacacaacatccatatacacacacacaacatacacacaccacacacatacacacacacacacacacacacacacacaccatcttttttggtacactctggaatggtagcctgatccagatatctgatttctccctttgcctgcttatgaccctggaatctggtatgagccaccctgccttgcaggtttgcagaaattcttcaacccctcgggctgtctcactgtgcaactgtaaacatgttcctgtctacaactggtgatgtagaaag

SEQ ID NO: 4487 - DNA, 250 bp, Homo sapiens
  AC006327.3_70784
  Located on chromosome 2
  Distance between a terminus base of telomere on chromosomal short arm and 5'-terminus of this base sequence : 233424996
  Distance between 3'-terminus of neighbour sequence of sequence listing upward to telomere on chrosomal short arm and 5'-terminus of this base sequence : 12846
atccatgatagctgtgacatagcccacaaagtaccataaactcagtgtgtgtgtgtgtgtgtgtgtgtgtgtgtgtgtacgatcctgtgcactaatttttatgcagcctgaagtctgaaaaccacaggaaggaaacatgggaacttttatatgcacatgtctggttcttaactcattttgtccctaggaaataatcacatctccagcagtagacctgggctctttgaaaagctgtagcaaaggactgtgc

SEQ ID NO: 4488 - DNA, 470 bp, Homo sapiens
  chr2.fa.O7frz.245257698
  Located on chromosome 2
  Distance between a terminus base of telomere on chromosomal short arm and 5'-terminus of this base sequence : 233569065
  Distance between 3'-terminus of neighbour sequence of sequence listing upward to telomere on chrosomal short arm and 5'-terminus of this base sequence : 143819
atcaacatgttagagtttaggaataattataagatttctctggatttaaaaagaattaattgggggtcaaagacagaaccaatatgcacatggctggatttaagcaaattctgtgtgtgtgtgtgtgtgtgtgtgtgtgtgtgtgtgtgtgtagatgacgtttcgctcttgtcacccaggctggagtgcagtggtgcaatctcggctcactgcaacctctgcctccctgcaacctcagcctcctaggttcaagcgattctcctgcctcagcctcccaagcagctgggactacaagcgcataccaccaaacccagctaatttttatatttttagtagagatggggtttcatcacgttggccaggctggtctcaaactcctgacctcaagtggtttacctgcctcggcctcccaaagttctgggattacaggcttgagacactgtgcccagcctcgatttaagcaaattcca

SEQ ID NO: 4489 - DNA, 306 bp, Homo sapiens
  chr2.fa.O7frz.245135067
  Located on chromosome 2
  Distance between a terminus base of telomere on chromosomal short arm and 5'-terminus of this base sequence : 233691746
  Distance between 3'-terminus of neighbour sequence of sequence listing upward to telomere on chrosomal short arm and 5'-terminus of this base sequence : 122211
caatagttgtatactgttccagaagtcctggaagaagagctagagcatagaataagattacacacacacacacacacacacacacacacacacacacacacaaacacaatgtgacacaggcattcaggaataccagaaaactgagggtggagcaggaacattaaaaaaaattcatgacaacacatctatcaccttgaacacaggcaaaagcatctcaccattgggaaatatgaagtgtatgggtcaatgaatgtatccaaagccacaacaaaaccccaacccagatagtcagctgactagactgac

SEQ ID NO: 4490 - DNA, 231 bp, Homo sapiens
  AC006985.2_25785
  Located on chromosome 2
  Distance between a terminus base of telomere on chromosomal short arm and 5'-terminus of this base sequence : 233774281
  Distance between 3'-terminus of neighbour sequence of sequence listing upward to telomere on chrosomal short arm and 5'-terminus of this base sequence : 82229
atagtctgtgaactccttccactccttcccgtcatactgagtcctcctagtgcacactcctctgtcctgtctttcacagagttagaactcaatgaatgtttacaaaattaaaccatgaaaatcattggtctacacacagacacacacacacacacacacacacacatacacacacacacgggccttaaagtaatggacacatttcaggtacttgctcaaatgatacagact

SEQ ID NO: 4491 - DNA, 479 bp, Homo sapiens
  chr2.fa.O7frz.244351187
  Located on chromosome 2
  Distance between a terminus base of telomere on chromosomal short arm and 5'-terminus of this base sequence : 233915522
  Distance between 3'-terminus of neighbour sequence of sequence listing upward to telomere on chrosomal short arm and 5'-terminus of this base sequence : 141010
ggtgcaatattgtaaatcttgaatacagtcatgggactacagagtgcccctaatgatgctggaattactcccaagaagcaaaaagaaatcatgacataaccaaaaaagtcgaattgcttgattgggaccataggctgagctctaccgtggtgaatgcctgccatttcaaaataaatgaagctagataaggaccagtggaaaagaaagaaagaaagaaggaaggaaggaaggaaggaaggaaggaaggaaggaaggaaggaaggaaggaagaaaggaaggaaggaagggagattcatgaagacattgctgcagctatgccagcaggagccaaaccttgcatttttttctgaaatacgtttttgtctcatattgaaaatgcagctttaacgtgggtgtagcattgctataagaaaggcgtatttatagatgccaatgtgatttgagaaaatgcaaagtcattatatgacaacttaaagcaa

SEQ ID NO: 4492 - DNA, 428 bp, Homo sapiens
  AC019072.5_112465
  Located on chromosome 2
  Distance between a terminus base of telomere on chromosomal short arm and 5'-terminus of this base sequence : 234012891
  Distance between 3'-terminus of neighbour sequence of sequence listing upward to telomere on chrosomal short arm and 5'-terminus of this base sequence : 96890
taccgtttaaaccagtaattctactttcacaagtttgtcttaaagtaatcagagctgtatatgaatgttgatgctcaaagatgtttattgttcctactattttaaaatagtgattaattggaaatcaccttaatgtctaacagaaaaagattggttaggttaattatgctccttatagaatggactactatgtaatcatttatttaagactttggaaaatacagtgtatgaaatgaaaatagatttgttgaatattatcccagtttttaaaattgtgtgtgtttgtgtgtgtgcctgtgtgtgtgtgtgtgtgtgtgtgtcttgggagtgaaattatgagcagtatctatttcttttacacttaaaaaaattccagaatttttacagtagtcatttattgtatttgtaatcaagatgaaaatctgagg

SEQ ID NO: 4493 - DNA, 171 bp, Homo sapiens
  D2S2205
  Located on chromosome 2
  Distance between a terminus base of telomere on chromosomal short arm and 5'-terminus of this base sequence : 234051661
  Distance between 3'-terminus of neighbour sequence of sequence listing upward to telomere on chrosomal short arm and 5'-terminus of this base sequence : 38342
catttactatgtggcacccattgtaccaggaactggggagacaagatagatggcctgcctcctcttgaaaattctgttgttttgaggaggcagattaaacgcctgcacacagacagacagacacacacacacacacacacacacacacacacgaggaacaggttgggatga

SEQ ID NO: 4494 - DNA, 226 bp, Homo sapiens
  AC013726.6_109687
  Located on chromosome 2
  Distance between a terminus base of telomere on chromosomal short arm and 5'-terminus of this base sequence : 234207790
  Distance between 3'-terminus of neighbour sequence of sequence listing upward to telomere on chrosomal short arm and 5'-terminus of this base sequence : 155958
ttctttacaattcctgatggaaatggacgaatgaatgaatgaatgaatgaacacagccaagagcattactcagtttacatgcttagggcaccacactagctagtgatacttctaaaaacagtagctgacattcctggagcactctctgtgtgtcaggccccacgcttcacatggattgtctcactgaatccttataatcactctatgagacttgaactattaccgc

SEQ ID NO: 4495 - DNA, 265 bp, Homo sapiens
  D2S2348
  Located on chromosome 2
  Distance between a terminus base of telomere on chromosomal short arm and 5'-terminus of this base sequence : 234303712
  Distance between 3'-terminus of neighbour sequence of sequence listing upward to telomere on chrosomal short arm and 5'-terminus of this base sequence : 95696
agtctcttggaatgcttgctctgtgataaaccagccagcatctacagagcccgactgcagggaggccaccatgctgtgaggaagcccaagatagtcatgtggagaggctgtgtggagagccagcaagtgagtgagagagagagagagagcaagaagagagagaaagacacacacacacacacacacacacacacacacacacacacgacacgggatggggggagggagagaaagagagagagttaccgagataccgagatactga

SEQ ID NO: 4496 - DNA, 109 bp, Homo sapiens
  D2S336
  Located on chromosome 2
  Distance between a terminus base of telomere on chromosomal short arm and 5'-terminus of this base sequence : 234576279
  Distance between 3'-terminus of neighbour sequence of sequence listing upward to telomere on chrosomal short arm and 5'-terminus of this base sequence : 272302
tttatttagttacagactttgcttcaagaaagacagacacacacacacacacagagttttgtatgaggaaaatcaagaaaaacaataagaagtccaagtgccctgtgac

SEQ ID NO: 4497 - DNA, 388 bp, Homo sapiens
  AC010148.11_113544
  Located on chromosome 2
  Distance between a terminus base of telomere on chromosomal short arm and 5'-terminus of this base sequence : 234596539
  Distance between 3'-terminus of neighbour sequence of sequence listing upward to telomere on chrosomal short arm and 5'-terminus of this base sequence : 20151
cgtatcataagacatggacaagaggtattagaaaacccagagtccacaggcccaagaggaataaagcccctcctccttttccccaacctgagaaattgtgtgtgtgtgtctgtttgtctgtgcgtgtgtgtgtgtgtgtgtgtgtgtgtgtgtgtgtgtattttgagaggggaaggaagagctcccaggcacgagaaatgtgagcgtctctggagcttggttgatgtttggcatcatcagctttggaaggtgtagataaggacagctgggggtgaggacatggggaaaagtctgtggacagagcctggggcacacccacacctatggctggagagggctgacactggactgcacatcaggggccccagagtaagtcagcatgacagtc

SEQ ID NO: 4498 - DNA, 155 bp, Homo sapiens
  Z67635
  Located on chromosome 2
  Distance between a terminus base of telomere on chromosomal short arm and 5'-terminus of this base sequence : 234618541
  Distance between 3'-terminus of neighbour sequence of sequence listing upward to telomere on chrosomal short arm and 5'-terminus of this base sequence : 21614
ctttcacccatgccagtcttctgtggtggctgcggcactcatgaatgcttggaaaagtgtgtgtgtgtgtgtgtgtgtgtgtgagagagagagagcacaggcgtgtgtgtgtgagcacaggtgtgtgtgtgtgagcacaggtgtgtgagcttgga

SEQ ID NO: 4499 - DNA, 232 bp, Homo sapiens
  D2S1357
  Located on chromosome 2
  Distance between a terminus base of telomere on chromosomal short arm and 5'-terminus of this base sequence : 234714553
  Distance between 3'-terminus of neighbour sequence of sequence listing upward to telomere on chrosomal short arm and 5'-terminus of this base sequence : 95857
tatccaagcatagtggcacctgtggtcccagctactcaggaggctgaggtaggaggatcatttgagcccataaggtcaagtctgtagtgagctatgatcatgccactgcactccagtctgggtgacacagtgagatcctgtctctacaaataataataataataataataataataataaaaacgaaacaaaaaaaaaaacacttgtatctacacaacaggtagaggctgga

SEQ ID NO: 4500 - DNA, 214 bp, Homo sapiens
  chr2.fa.O7frz.246496259
  Located on chromosome 2
  Distance between a terminus base of telomere on chromosomal short arm and 5'-terminus of this base sequence : 234847866
  Distance between 3'-terminus of neighbour sequence of sequence listing upward to telomere on chrosomal short arm and 5'-terminus of this base sequence : 133081
tgaatttaggaatagacaattcagaaagactaagaaaaaaactgtatcacaaatgtgtgtgtgtgtgttgcatgtgtatgttttatgtgtggtatatgggtgtggtgtgtatgtttttgtgtgtgtgtgtgcatcagtatggtgtgtgtgtgtgtgtgtgtgtgtgtgtgtgtgtgtgtgtgtgtgtagcaagtttaaaccatctcagaagctt

SEQ ID NO: 4501 - DNA, 473 bp, Homo sapiens
  chr2.fa.O7frz.246381215
  Located on chromosome 2
  Distance between a terminus base of telomere on chromosomal short arm and 5'-terminus of this base sequence : 234906086
  Distance between 3'-terminus of neighbour sequence of sequence listing upward to telomere on chrosomal short arm and 5'-terminus of this base sequence : 58006
aaatgagccttctctgatctagtggctcccagaaatgccacattaaatcaacccaggcaagtcggtttttgtcctgcagggctcctcagaatctggaatgtaccaatatgtattttgattttcctagaggggatacaggatgctatttctctcagatttagttcgctgtggatgtgtgtgtgtgtgtgtgtgtgtgtaaaacacttaataaccatctcatagaacatttttgtttaaagaaatgcattttgaaaaggctggcccagaggctttctaaagagctcaacaagaacatgcttggaagatttggggagggtaatctgtatctaaagacattgctatttctctgttctatttcacagactagtcaatgccgggtattctacagagctttgcagttttccagataatttatgtacatgttgatttctacatttgccagtggattcagcttgattagcaatttaaatgga

SEQ ID NO: 4502 - DNA, 136 bp, Homo sapiens
  DISO7_10001049
  Located on chromosome 2
  Distance between a terminus base of telomere on chromosomal short arm and 5'-terminus of this base sequence : 235028861
  Distance between 3'-terminus of neighbour sequence of sequence listing upward to telomere on chrosomal short arm and 5'-terminus of this base sequence : 122302
atattcattatggcagtatttatgggggtggggtgtcggaagcacccaagtgtgtgtgtgtgtgtgtgtgtgtgtgtgtgtgtgtgtgcacgcgcgcgcgcgcgcatgcgtgtgtgtgtttcctgacatatgcatc

SEQ ID NO: 4503 - DNA, 236 bp, Homo sapiens
  DISO7_10001048
  Located on chromosome 2
  Distance between a terminus base of telomere on chromosomal short arm and 5'-terminus of this base sequence : 235058360
  Distance between 3'-terminus of neighbour sequence of sequence listing upward to telomere on chrosomal short arm and 5'-terminus of this base sequence : 29363
tctagggagaacttcatgataagtcaactaaaatagaaagagagggaggaagaaggagggaagaaggaaggaaggaaggaaggaaggaaggaaggaaggaaggaaggaaagaagggagggagggaggaaggaaggaaggaaggaaaggaaagagagagggagggagggaaggaaggtgagtctggcccctgggagtctggggcctcctcctgctgctctcttgacaagccatgctc

SEQ ID NO: 4504 - DNA, 242 bp, Homo sapiens
  D2S1283
  Located on chromosome 2
  Distance between a terminus base of telomere on chromosomal short arm and 5'-terminus of this base sequence : 235264759
  Distance between 3'-terminus of neighbour sequence of sequence listing upward to telomere on chrosomal short arm and 5'-terminus of this base sequence : 206163
cttggctttcaccttcagagacccaaactgactcactctcaggaagtgatggatttctggcaatacacaaattaaaaaaaccccacaggtctctgttgtaaaataatatatatttatgctaccatcacatatatatgcaagtgtgtgtgtgtgtgtgtgtgtgtgtgtgtgtgtgtgtacataagctgccattttagattaagacagagaaacaagtcagtaagttattgccaacccaaaag

SEQ ID NO: 4505 - DNA, 297 bp, Homo sapiens
  AC067853.2_36338
  Located on chromosome 2
  Distance between a terminus base of telomere on chromosomal short arm and 5'-terminus of this base sequence : 235292725
  Distance between 3'-terminus of neighbour sequence of sequence listing upward to telomere on chrosomal short arm and 5'-terminus of this base sequence : 27724
agtctgagaggtcaaggctgcagtgagccgtggatcacaccactccactccagcctgggtgacaaagcaagactctgtctcaaaaaaaaatttttctttaattaattccctgttttaaatgaaaatgaagaaagccaacagtgcttgaatttggcactgacagctggtttgtgtgtgtgtgtgtgtgtgtgtgtgtgtgtgtgtgtgtgtgtgagatgaaatattttttggtgtgaatatatccaaggaacatcccatgatgtatttcggtgaaatatgcaaagcctgtatctattt

SEQ ID NO: 4506 - DNA, 430 bp, Homo sapiens
  AC067853.2_129581
  Located on chromosome 2
  Distance between a terminus base of telomere on chromosomal short arm and 5'-terminus of this base sequence : 235299685
  Distance between 3'-terminus of neighbour sequence of sequence listing upward to telomere on chrosomal short arm and 5'-terminus of this base sequence : 6663
atcattcaaaccatctttgatatttctgggacagaagacgttcactactttaaggcttggcttgctctcacagtggagttttcactcagagcttataagtgcctggaaggaccgtctcacacacacacacacacacacacacacacacacacacacacacacacacggctagaattcttggctctattcacagaagataaatctgcagcacattcctggtaaatgtcactgggtcccatgttgctggagaaacttccattttaattcagcaaatctttattaggcacctactatgtgcctggcatgatgagagaacagctcttaccataggagagatattgttgattaattaatttattgaacgtttgttgcattataatgctccaagccctgtgcaagagaaatatggtccttgtcttcatgacaatta

SEQ ID NO: 4507 - DNA, 355 bp, Homo sapiens
  chr2.fa.O7frz.247154452
  Located on chromosome 2
  Distance between a terminus base of telomere on chromosomal short arm and 5'-terminus of this base sequence : 235401035
  Distance between 3'-terminus of neighbour sequence of sequence listing upward to telomere on chrosomal short arm and 5'-terminus of this base sequence : 100920
tttcgaatttaaagataacagaacctgccaggataggccactcatttttgtttttgtttctgttttttttgttttgttttgttttaatgtgtgtgtgtgtgtgtgtgcgtgtgcgtgtgtgtgtgtgtgtgtgtgcatttttttttttttttttttttttgaggcggagtcttgctctgtcgcccaggctggagtgcagtggtgtgatctcggctcactgcaagctctacctcccgggttcatgccattctcctgcctcagcctcccaagtagctgggactacaggcacctgccactacgcccggctaatttttttgtatttttagtagagacggggtttcaccatgttagccag

SEQ ID NO: 4508 - DNA, 357 bp, Homo sapiens
  AC064874.1_152646
  Located on chromosome 2
  Distance between a terminus base of telomere on chromosomal short arm and 5'-terminus of this base sequence : 235465244
  Distance between 3'-terminus of neighbour sequence of sequence listing upward to telomere on chrosomal short arm and 5'-terminus of this base sequence : 63854
ttaaagatgcagttcaaatgagggaaggatataaatattctgtttttcaattagtgaattaacaacacaaaagtgggtaacaccgtagggaacttgtgattccatgaaatcagtcaaagagtaaacctcttggattgacagattccttaatattatgtgtgtgtgtgtgtgtgtgtgtgtgtacacctaggtgtgtaatatatgtatgtgtacttcagtcctagcactgtagtaacgaactgccacacacagtgtggcttaaaacagaaatgtattctcatagttctcagaagtctgaaatcaaggtgttgacggggttggttccttctgcagcttagaggttgaatctgttctatg

SEQ ID NO: 4509 - DNA, 233 bp, Homo sapiens
  D2S2202
  Located on chromosome 2
  Distance between a terminus base of telomere on chromosomal short arm and 5'-terminus of this base sequence : 235465325
  Distance between 3'-terminus of neighbour sequence of sequence listing upward to telomere on chrosomal short arm and 5'-terminus of this base sequence : -276
accgtagggaacttgtgattccatgaaatcagtcaaagagtaaacctcttggattgacagattccttaatattatgtgtgtgtgtgtgtgtgtgtgtgtgtacacctaggtgtgtaatatatgtatgtgtacttcagtcctagcactgtagtaacgaactgccacacacagtgtggcttaaaacagaaatgtattctcatagttctcagaagtctgaaatcaaggtgttgacg

SEQ ID NO: 4510 - DNA, 320 bp, Homo sapiens
  AC064874.1_66173
  Located on chromosome 2
  Distance between a terminus base of telomere on chromosomal short arm and 5'-terminus of this base sequence : 235526820
  Distance between 3'-terminus of neighbour sequence of sequence listing upward to telomere on chrosomal short arm and 5'-terminus of this base sequence : 61262
gtaactggcagtgacagaataggtgttgtatgggaggcagcattttcagctgtaagtgcaataaattgtggtttgtttattttagtttttaaccttttagactactttgtgatcggcaggagattgtgtgtgtgtgtgtgtgtgtgtgtgtgtctaggttgcagagtgaggatctggtcagtgattgacacttgttttcaaagtgttcaccatgaattttttttcttaaataccatttttctcagtgagctttgaaccatgatgtcaccaaagacaaagtgtttctcaggcttttcttagtgaaagatactttcctaagg

SEQ ID NO: 4511 - DNA, 482 bp, Homo sapiens
  chr2.fa.O7frz.247413152
  Located on chromosome 2
  Distance between a terminus base of telomere on chromosomal short arm and 5'-terminus of this base sequence : 235611165
  Distance between 3'-terminus of neighbour sequence of sequence listing upward to telomere on chrosomal short arm and 5'-terminus of this base sequence : 84025
ggaggtatgttaggcttcatgggtcgtgtggtttctcctgaactacctacctctcccagttcagggcaaatgcagccattccaaccaatgaacttgactgtgttccgataaaactttatttacagaaagaggcagaggatcagatttggccgacatgtgggagcttgccggccccagtcccgtaggatccccaacgctaatagtctggatgagggtgcacaggctgtgagagttcctgttaggcgggaaggctctggcccctcgggatcatacaccttatgctggtgctgcagtgtgtgtgtgtgtgtgtgtgtgtgtgtgtgtgtgtgtgcaagtgagggagggtgacccccacaccaagcacacagggccatggattttcactgtcttgggtccaggcctatttctagctaagtgttatctgcagggtatagcttagcataatgagagggcaaaagcaagatgactaagtgttcgttacg

SEQ ID NO: 4512 - DNA, 336 bp, Homo sapiens
  AC019047.4_49778
  Located on chromosome 2
  Distance between a terminus base of telomere on chromosomal short arm and 5'-terminus of this base sequence : 235725153
  Distance between 3'-terminus of neighbour sequence of sequence listing upward to telomere on chrosomal short arm and 5'-terminus of this base sequence : 113506
ggtatttcaataacttgatttgactcttcttaattaaataaataggtagctttgttctttggcttgattattcatttgggtctttcttgctttcttcaggtaggaatgattttccccttcagttggttttctgcagaagccatgatatactgtaggcatggttaccagaacacccctaagagagctgaccagaatttctaagttcatgttccatgcgtacacacacacacacacacacacacggtgttattttttttctttctgaatttcatgaaaataaaatattttctaccagaatacacatttagtgatgcctctttcaaagaggaaatcaat

SEQ ID NO: 4513 - DNA, 442 bp, Homo sapiens
  AC019047.4_160315
  Located on chromosome 2
  Distance between a terminus base of telomere on chromosomal short arm and 5'-terminus of this base sequence : 235756524
  Distance between 3'-terminus of neighbour sequence of sequence listing upward to telomere on chrosomal short arm and 5'-terminus of this base sequence : 31035
tttggagttacctgagacagatacttaggtaggaccttatagatagtgaagaaacctgaaggtatagacataaagaagtcttcacttgtgaaaaattaaatgtagacccgtatcctttaacaccgcagatgcctgctagtttagaggttgtttcttactaaattattattattattattattattattctcttgagatggaatctctcactgtcgcccaggctggagtgcagtggtacgatctcagctcactgcaacctccgcctccagagtagctgggattataggcgtgccccaccatgcacagctaatttttgtatttttagtagagacggtgttttgccatgttggccaggctggtttcgaacttctgtcctcaagtgatccgcccacctcagcctcccaaagtgctgggattacagacgtgaggacctggcctattt

SEQ ID NO: 4514 - DNA, 377 bp, Homo sapiens
  AC019047.4_134257
  Located on chromosome 2
  Distance between a terminus base of telomere on chromosomal short arm and 5'-terminus of this base sequence : 235782645
  Distance between 3'-terminus of neighbour sequence of sequence listing upward to telomere on chrosomal short arm and 5'-terminus of this base sequence : 25679
tgatacaggtataggcatagctagacagacagacaaaccaaccaaccacagaaatgatacaggtacacagagagacagaggcacatccctttgtatgtgtgtgtgtgtgtgtgtgtgtgtgtgtgatcacacacttgcattccagatgccagtgtaaactgtttaaacatattttgaatacttgggtatctaaccaaagggaattaaaattcaataacgcatgatgctaattagacagtagtgattaatacattataatttattatgtagcaagtaatatattatttcacatcaatttgatgagatgtttcaatttatgaagaattcttacgcaaaaatcaagcttattgtaactgtcctctgaaattgatcaattt

SEQ ID NO: 4515 - DNA, 389 bp, Homo sapiens
  chr2.fa.O7frz.247706634
  Located on chromosome 2
  Distance between a terminus base of telomere on chromosomal short arm and 5'-terminus of this base sequence : 235880738
  Distance between 3'-terminus of neighbour sequence of sequence listing upward to telomere on chrosomal short arm and 5'-terminus of this base sequence : 97716
ctactcagtcgcaatttatcaccactagagtccagtaaggctcctaattggcccataaatgtggtccaataaccgcgcctgacatccaaagacactgcaggcaattagcacttatttatttgcatatggtattgaccaatgcgctagctgcactcactttcaagatctgtttatttttaaagctggaggggaaaaaaagccctcatttactgcactacaaggggaactaccacacacacacacacacacacacacacacacacacacacaccactagcagggatgatgggaacttggcatcgcactgcctctggctaaagggattcagtgattcacttgtgtgcagggtcctgtcaatatcttacaaagtactcaatagatgcaacctg

SEQ ID NO: 4516 - DNA, 423 bp, Homo sapiens
  chr2.fa.O7frz.247784461
  Located on chromosome 2
  Distance between a terminus base of telomere on chromosomal short arm and 5'-terminus of this base sequence : 236031241
  Distance between 3'-terminus of neighbour sequence of sequence listing upward to telomere on chrosomal short arm and 5'-terminus of this base sequence : 150114
aggtttaagcagtggtctaaagggcagggcccggcagaggatggtggccttgcagtcagtgtgtcctgtttgggatatgaactccagcccccactatccagtggtgaatacaaggactccacaaccaccaaaagatgatgctgactgagcaatgcaacaacaacaacaacaacaacaaacagctgctaaaaataaggctgcattcaagactcaaacgtcaccttttgtgtgtgagtggggaaagggacattgcttctgaacattttgttagtaatgttaaacatctcatatggtttggttgtgtccccacccaaatctcaccttgagttttactcccataattcccatgtgttgtgggagggacccggtgggagataattgaatcatgggggtggtttccttcatactgttctcttggtagtg

SEQ ID NO: 4517 - DNA, 289 bp, Homo sapiens
  D2S338
  Located on chromosome 2
  Distance between a terminus base of telomere on chromosomal short arm and 5'-terminus of this base sequence : 236136937
  Distance between 3'-terminus of neighbour sequence of sequence listing upward to telomere on chrosomal short arm and 5'-terminus of this base sequence : 105273
tggaattttgattttcagatttgttgtgtgtgtgtgtgtgtgtgtgtgtgtgtgtgtgtgtgtgtgtgtgtgtttgagatggagtcttgctcaggcacacatcaccacacctggctaatttttgtatttttagtagaggcggggttttgccatgttgttcaggctggtctcgaactcctgacctcaagtgatccacctgccttggcctcccaaagtgttgggattacaggtgtgagccaccatgcctggccaagattcattttgaatgggaagttttgttttgggctct

SEQ ID NO: 4518 - DNA, 136 bp, Homo sapiens
  DISD22_0002323
  Located on chromosome 2
  Distance between a terminus base of telomere on chromosomal short arm and 5'-terminus of this base sequence : 236220344
  Distance between 3'-terminus of neighbour sequence of sequence listing upward to telomere on chrosomal short arm and 5'-terminus of this base sequence : 83118
gggttatccttactgatattcaccttgtaaaatgagactaacatatgtattacactaattgtacatctctctctctctctctctctctctctctgtgtgtgtgtgtgtgttttaaatcaaccacaaatagcagcaa

SEQ ID NO: 4519 - DNA, 159 bp, Homo sapiens
  DISD22_0002327
  Located on chromosome 2
  Distance between a terminus base of telomere on chromosomal short arm and 5'-terminus of this base sequence : 236294772
  Distance between 3'-terminus of neighbour sequence of sequence listing upward to telomere on chrosomal short arm and 5'-terminus of this base sequence : 74292
tgtggtgacttccagtgtgtggctgatcataatacacttgctaaaaagtcaacccaaatactttggatatgcttctaaagacattttatatacatatatgcgaatatacatataacacacacacacacacacacacacacagagcacactggcattgtt

SEQ ID NO: 4520 - DNA, 306 bp, Homo sapiens
  chr2.fa.O7frz.248104779
  Located on chromosome 2
  Distance between a terminus base of telomere on chromosomal short arm and 5'-terminus of this base sequence : 236421772
  Distance between 3'-terminus of neighbour sequence of sequence listing upward to telomere on chrosomal short arm and 5'-terminus of this base sequence : 126841
attataacgaggacaatggaagctaggtctctcactatggagaaaggagttacaaacatggaaatggagaaaacttgaatgaattttgtataatggattggaattagagatgctggtgggaaccaattactgttaatacagatatgtgcatatatattttcatgtgaacgtatgtgtgtgtgtgtgtgtgtgtgtgtgcatacgtatagatgtcttggcttttaccactgagagagcctggaagttgcaacacaccaatagcaaggagcacactttgcacccagatcttggcttctaaatcttgtt

SEQ ID NO: 4521 - DNA, 194 bp, Homo sapiens
  Z66881
  Located on chromosome 2
  Distance between a terminus base of telomere on chromosomal short arm and 5'-terminus of this base sequence : 236472374
  Distance between 3'-terminus of neighbour sequence of sequence listing upward to telomere on chrosomal short arm and 5'-terminus of this base sequence : 50296
tgtgtcctcacatagcctttctgctctgtgtgtgtgtgtgtgtgtgtgtgtggagcagggtggacttgtggttccttcctcttcctctagggacaccagttccaaggaccccacctttaggacctcatttgaccttaattacttccctaattactccatctctaagacaccttcacactggggtttagggcttt

SEQ ID NO: 4522 - DNA, 190 bp, Homo sapiens
  AC018893.3_103394
  Located on chromosome 2
  Distance between a terminus base of telomere on chromosomal short arm and 5'-terminus of this base sequence : 236528977
  Distance between 3'-terminus of neighbour sequence of sequence listing upward to telomere on chrosomal short arm and 5'-terminus of this base sequence : 56409
tccttggtctgaattggaaaaggcactaaggcaacagcctcccggtgcaatcgtgtgagtgaagatcggtgcaatcatgcgagtgaagatcacggcaaacttgacaatggagaagaggatacagaagcatttcacacatccctgggttattattattattattattatttctaaatggtctacaaaacca

SEQ ID NO: 4523 - DNA, 459 bp, Homo sapiens
  AC018893.2_134863
  Located on chromosome 2
  Distance between a terminus base of telomere on chromosomal short arm and 5'-terminus of this base sequence : 236576410
  Distance between 3'-terminus of neighbour sequence of sequence listing upward to telomere on chrosomal short arm and 5'-terminus of this base sequence : 47243
agtttcctgcttttagactcagagtgaaacaccagctcttcttaggtctcaagcctgccagctttgggacttggaactacacctttggctcttcagggtctccagcttgccgactgcggacgttggggcttcttggcctctataattgcatgagccaattccttataataaatctctctctccctacacaccacacacacacacacacacacacacacacacacaattggttctgtttctctgaagaaatgcagtgtattagatgaagaaatacagtgtattagattagttagtatatataaacaatgggatataggcatagatatggatatatattattatgggaattggctcatgagattatcgaggtggagaagacccacaggagaccatctgcaagctggagaaccagggaagcctggtggcctagcccagtccaagtcagaaggcctaagaacc

SEQ ID NO: 4524 - DNA, 369 bp, Homo sapiens
  AC011286.6_125201
  Located on chromosome 2
  Distance between a terminus base of telomere on chromosomal short arm and 5'-terminus of this base sequence : 236653429
  Distance between 3'-terminus of neighbour sequence of sequence listing upward to telomere on chrosomal short arm and 5'-terminus of this base sequence : 76560
acattcaagatgacagaactgtggagaacaagaagacagaaaagctatatgggaccagacagtctcacccataccaaagctaagatgcaaactgggctctgatctccctggtagccaaagcaagaacagaaacaggaatcctctgttggatttcgatgtttgtgaacagaaaacaaatgagtccctcagggaagcaaaattcctcttggatgtgtgtgtgtgtgtgtgtgtgtgtgtgagagagagagagagaggagagggagaccacttatcacagtggcttcttcagttctatacacactgtcctcaagggtttttcttatggcctccatacacacatgtagaaggtttaatgacaaagtgcaactc

SEQ ID NO: 4525 - DNA, 255 bp, Homo sapiens
  D2S345
  Located on chromosome 2
  Distance between a terminus base of telomere on chromosomal short arm and 5'-terminus of this base sequence : 236758055
  Distance between 3'-terminus of neighbour sequence of sequence listing upward to telomere on chrosomal short arm and 5'-terminus of this base sequence : 104257
ggaagccaccatgaatatctcccttagaagaacactactgtggccagggacacttatgcaattcccataaggttctttgttgttatatgaactgcattttacacacacacacacacacacacacacacacacacacacacaaacaactgcctagcagcacattgtaaaggctgtataatgtgactattatcatccttgttttctttattcctgaaatctaattaaataacttcagtgggttatgtctgttgatct

SEQ ID NO: 4526 - DNA, 333 bp, Homo sapiens
  AC012063.4_110192
  Located on chromosome 2
  Distance between a terminus base of telomere on chromosomal short arm and 5'-terminus of this base sequence : 236830526
  Distance between 3'-terminus of neighbour sequence of sequence listing upward to telomere on chrosomal short arm and 5'-terminus of this base sequence : 72216
aggatctgcatacagtagcaactcaataaacattgcatttgaatgaatgaatgaatgaatgaatgaatgaatgctggatcccacaaagctgtctttaaatgcatctctaaaaagaggctagaaagaaaagtctttcacagttcagaggccattgtatcttactgtttccccataacttgggcctttgtgatccgacagaacttttaggtcaatgcttgcagtcaagaggaaggtgagtaccacctcctcactgaggatacctttttacaattggaggggtggcttcaataggcatccagtctggtacccattgtcactaaggatgcctcaatc

SEQ ID NO: 4527 - DNA, 114 bp, Homo sapiens
  DISO7_10001052
  Located on chromosome 2
  Distance between a terminus base of telomere on chromosomal short arm and 5'-terminus of this base sequence : 236952587
  Distance between 3'-terminus of neighbour sequence of sequence listing upward to telomere on chrosomal short arm and 5'-terminus of this base sequence : 121728
gcatatctattattgctcattcttgtgttttcagggaaattagtggtgtgtgtgtgtgtgtgtgtgtgtgtgtgtacatgtgcacattttcttgttcaaggataacaggaatag

SEQ ID NO: 4528 - DNA, 113 bp, Homo sapiens
  DISO7_10001055
  Located on chromosome 2
  Distance between a terminus base of telomere on chromosomal short arm and 5'-terminus of this base sequence : 237330733
  Distance between 3'-terminus of neighbour sequence of sequence listing upward to telomere on chrosomal short arm and 5'-terminus of this base sequence : 378032
gctcagaaaggagacagatattcatgtgtgtgtgtgtgtgtgtgtgtgttgtgtgcgtgtcagagagagagagagagaggagagagaatgtcaggtagctcattaactttctg

SEQ ID NO: 4529 - DNA, 101 bp, Homo sapiens
  DISO7_10001056
  Located on chromosome 2
  Distance between a terminus base of telomere on chromosomal short arm and 5'-terminus of this base sequence : 237358141
  Distance between 3'-terminus of neighbour sequence of sequence listing upward to telomere on chrosomal short arm and 5'-terminus of this base sequence : 27295
agtgcattgcccaatatgttaaagtgcttgggagtagttgtgtgtgtgtgtgtgtgtgtgtgtgtgtgtgtgttaagcaggtacatggctgagtaagacaa

SEQ ID NO: 4530 - DNA, 345 bp, Homo sapiens
  chr2.fa.O7frz.249252191
  Located on chromosome 2
  Distance between a terminus base of telomere on chromosomal short arm and 5'-terminus of this base sequence : 237529685
  Distance between 3'-terminus of neighbour sequence of sequence listing upward to telomere on chrosomal short arm and 5'-terminus of this base sequence : 171443
gtgaatgacttcggtcataaccgttaccattgctgtgaccttcccgctgggcgaagctgctagttgaggatctgctccctctcataggcctccctcccttctcccaggggagagcctggccagggcccccagcccggtgggtctgcacttggcacacagcagaccctggatcactagcgtttagtggcagaaaagtgagtgagtgaatgaatacaggaacagatgaatgaatgaatgaatgaatgaatgaatggacttagcttgacttcacataacatttggaaattctgattgttttcaaactagaacaagatttgaaaaggcttgtcagaaatcgcttacata

SEQ ID NO: 4531 - DNA, 286 bp, Homo sapiens
  AC016776.4_8641
  Located on chromosome 2
  Distance between a terminus base of telomere on chromosomal short arm and 5'-terminus of this base sequence : 237794391
  Distance between 3'-terminus of neighbour sequence of sequence listing upward to telomere on chrosomal short arm and 5'-terminus of this base sequence : 264361
ctgcttgttattctaccaaggttatgttcaaggcttggggtgggttctctgtgtactggtccagcctcagtttagacaggcccttccctgtgcccttcaccccagcattcctacccctcttccctgtggcaaactctgtcggggtcttgggtgtgactgtcctgtcccttccccagtgagaagagacctctggtggtggtggtggtggtggtggtggtgtttttgagacagagtcttgctctgtcacccaggctagagtgcagtggcatgatctcggcatgatctc

SEQ ID NO: 4532 - DNA, 242 bp, Homo sapiens
  AC016776.4_151780
  Located on chromosome 2
  Distance between a terminus base of telomere on chromosomal short arm and 5'-terminus of this base sequence : 237827453
  Distance between 3'-terminus of neighbour sequence of sequence listing upward to telomere on chrosomal short arm and 5'-terminus of this base sequence : 32776
gtgcatgagtctgtaatcctagctacctgagaggctgaagtcagaggatcacttgagtccaggaattcaagaccagcctgggcaacataaaaagacccccatctcaaacacacacacacacacacacacacacatatgcacacacacacatgcacacacacgtgcacacacacacatgcacacacacacacacacaaacaccttagtagcaataagcacactgagcactcaaatacttgttt

SEQ ID NO: 4533 - DNA, 240 bp, Homo sapiens
  AC016757.6_119868
  Located on chromosome 2
  Distance between a terminus base of telomere on chromosomal short arm and 5'-terminus of this base sequence : 238011761
  Distance between 3'-terminus of neighbour sequence of sequence listing upward to telomere on chrosomal short arm and 5'-terminus of this base sequence : 184066
acagctacagcaacttatccaggggtaaaagcggggagacgggccggttgggcccaggccccttgtggatgggctgctgtccctcagaccccagcacacctcgcatgcatgggctagcagggcaagcaacagtcctcacgctgtgggccaccaccattaggggtctgtgaccagcttggagtggagtggagtggagtggagtggagtggagtggagtggaatggaattatcaacaggtgc

SEQ ID NO: 4534 - DNA, 273 bp, Homo sapiens
  AC013400.4_101481
  Located on chromosome 2
  Distance between a terminus base of telomere on chromosomal short arm and 5'-terminus of this base sequence : 238195585
  Distance between 3'-terminus of neighbour sequence of sequence listing upward to telomere on chrosomal short arm and 5'-terminus of this base sequence : 183584
attgtcttgcaaggcagacatctctctctctctctccccccgccccccaactataacacacacattctctctatataaaacacttcaagaaagggggtgctagcctttaacaggagcagtgggcctcctctgtaggtccagatgattcaggagaatctggggattctagtttgtttgtttgtttgtttgtttgtttttgagacagtggtctctcacgcccaccctgggggcttcagttgagccggtcagtggtgattcagctccgaaatctca

SEQ ID NO: 4535 - DNA, 462 bp, Homo sapiens
  chr2.fa.O7frz.250246308
  Located on chromosome 2
  Distance between a terminus base of telomere on chromosomal short arm and 5'-terminus of this base sequence : 238226799
  Distance between 3'-terminus of neighbour sequence of sequence listing upward to telomere on chrosomal short arm and 5'-terminus of this base sequence : 30941
ggaacattaagtcaggtctttattttgcttagtttccctcatttcatttttgcttacttctctaactgtttctattgtgaaaaatatggaaaagtagaaagaatagtacaactagtgcccatatacctctcacccagattcactagttttacgtttgccattttgcttaatgtacagttatgcgtgtgtgtgtgtgtgtgtgtgtatatatatatatagagagagagagacagagagacagagacagagacagagtctcactctgttgctcaggctcgggtacagtggcatgatctcagctcactgcaacctccgcctcccgggttcaagcgattcttctgcctcagcctcctgagtagctgggactacaggtgtgtgccacgatacccggcttcttatgtgtatttttgagacagggctttgctctgtcactcagcctggagtgcagtggtatgatcatag

SEQ ID NO: 4536 - DNA, 272 bp, Homo sapiens
  AC013400.4_10628
  Located on chromosome 2
  Distance between a terminus base of telomere on chromosomal short arm and 5'-terminus of this base sequence : 238237890
  Distance between 3'-terminus of neighbour sequence of sequence listing upward to telomere on chrosomal short arm and 5'-terminus of this base sequence : 10629
agttgaggaagtcgaggatgtttggggcaatgggtgttattttcagaggtcgttcccaagtgtctacattccctctggaccttgtgcatggcactgaagcaagggaggattttggtgtgtgtgtgtgtgtgtgtgtgtgtgtgtgtgcgcgcgcgcgcgtgtgcgtgcatgtgcttgtgtgtatgcgtgtgtgtgtgtgtgtgtgtgtatgcatgtgcacgcatgcagcactgcgataacggggcagggggagttaggtgattgcttaaagc

SEQ ID NO: 4537 - DNA, 165 bp, Homo sapiens
  chr2.fa.O7frz.250139857
  Located on chromosome 2
  Distance between a terminus base of telomere on chromosomal short arm and 5'-terminus of this base sequence : 238289000
  Distance between 3'-terminus of neighbour sequence of sequence listing upward to telomere on chrosomal short arm and 5'-terminus of this base sequence : 50838
ggctgcagtgagtcatagtcatgccactgcatgccaggctgggtgacagagcaagacccactctaaaataataataataataataataataataataataataataatacataaaacttgtttttaaatccatatatagagctgaattccaaattggttatcagt

SEQ ID NO: 4538 - DNA, 271 bp, Homo sapiens
  AC016999.4_81769
  Located on chromosome 2
  Distance between a terminus base of telomere on chromosomal short arm and 5'-terminus of this base sequence : 238402849
  Distance between 3'-terminus of neighbour sequence of sequence listing upward to telomere on chrosomal short arm and 5'-terminus of this base sequence : 113684
ttactttggtatcttagtgctcacttgaaaggggatgagggtaggcagccattatgtgagaagtccaactaccttgaggccacaattctatgatgaacccaagctagccatgtcaagaagccacttggagagagagagagagagagagagagagagagagagagagcgagctgtccagaccctagctattccacccatatcatcccgggtgctaggatcactagaccggcagtaaaagaagtcaccttggtaatttctgtcacatcaaagc

SEQ ID NO: 4539 - DNA, 271 bp, Homo sapiens; identical to SEQ ID NO: 4538
  AC040945.2_72255
  Located on chromosome 2
  Distance between a terminus base of telomere on chromosomal short arm and 5'-terminus of this base sequence : 238402849
  Distance between 3'-terminus of neighbour sequence of sequence listing upward to telomere on chrosomal short arm and 5'-terminus of this base sequence : -271

SEQ ID NO: 4540 - DNA, 234 bp, Homo sapiens
  chr2.fa.O7frz.249905900
  Located on chromosome 2
  Distance between a terminus base of telomere on chromosomal short arm and 5'-terminus of this base sequence : 238512916
  Distance between 3'-terminus of neighbour sequence of sequence listing upward to telomere on chrosomal short arm and 5'-terminus of this base sequence : 109796
cgtgagtcaattccttagaatatatatatgtgtgtgtgtgtgtgtgtgtgtgtgtgtgtgtgtatacgtgtgtgtgtgtgtgtgtgtgtgtgtgtatatatgtattcaattggtcctacatctctggagaaccctgactaatacactgtatgacttgcaaagctagaatatttactatctggccctttacagaagaagtttccacttctgctctatgtccagtataggcagtag

SEQ ID NO: 4541 - DNA, 355 bp, Homo sapiens
  chr2.fa.O7frz.250723325
  Located on chromosome 2
  Distance between a terminus base of telomere on chromosomal short arm and 5'-terminus of this base sequence : 238621355
  Distance between 3'-terminus of neighbour sequence of sequence listing upward to telomere on chrosomal short arm and 5'-terminus of this base sequence : 108205
tctaccacattccgtaagaagctcttgggtgagtaaggttcaagccccctgtatagatagatagatagatagatagatagatagattatatatgtttgtcattctcatcaattggaaaatagcgcctccactatggagcacacacggcaaaaaaaacaaacaaaaactgttcgctttctttttctttcaatagcagacttttaatcaatgccagagacaaagtgaggccgagctaagaacacgctcagcttcgttacaatgaagaaatggtttcctttcgatgcaaagtataattgtaaaccacagtgctcgcacagttcacgactgcttaaagtgaaatcttagccatacatca

SEQ ID NO: 4542 - DNA, 141 bp, Homo sapiens
  chr2.fa.O7frz.250847050
  Located on chromosome 2
  Distance between a terminus base of telomere on chromosomal short arm and 5'-terminus of this base sequence : 238745074
  Distance between 3'-terminus of neighbour sequence of sequence listing upward to telomere on chrosomal short arm and 5'-terminus of this base sequence : 123364
gttgaaatcctactgataatcagtaaagaaacagcaaaatagtgattaccaagctggtgaaaaaaaatatatatatatatatatatatatatcactaaaaacatacactaaaggcaagacaagtgcattagaatagttgag

SEQ ID NO: 4543 - DNA, 432 bp, Homo sapiens
  chr2.fa.O7frz.251093068
  Located on chromosome 2
  Distance between a terminus base of telomere on chromosomal short arm and 5'-terminus of this base sequence : 238992036
  Distance between 3'-terminus of neighbour sequence of sequence listing upward to telomere on chrosomal short arm and 5'-terminus of this base sequence : 246821
ctgtaccattcatcctgtttataggtgactcttttccttccccaaagattctctgcaataaccacagagatgctggaggggagatggtaattctgtttcctttcttgtcctcctatggccaaataggaaccaggcactttgagttactttaattttttaaaacaagcaaacaaacaacgctcaactgggctttcattgtgtgtaaagaaagtggccgagctcattctatttcacttagaatgggcacggagaagcataccagctgctgaggaaagggtgggtggccgatatgggtgtataggggagacaaagaaaatattgcgtctttcttttccctgtttttttttctagaaaaagaaagacttctttgttatacacacacacacacacacacacacgcacgcacccctcaattagaatctgaagaactga

SEQ ID NO: 4544 - DNA, 387 bp, Homo sapiens
  AC023787.5_5995
  Located on chromosome 2
  Distance between a terminus base of telomere on chromosomal short arm and 5'-terminus of this base sequence : 239123033
  Distance between 3'-terminus of neighbour sequence of sequence listing upward to telomere on chrosomal short arm and 5'-terminus of this base sequence : 130565
agcattaagaacaaacgctcaaccaaaagctgaaaatgtatttattgcaccaaaggcctttcaaaacccttccagatgacccagccttggtgctttcttcaaaaaggtggaagagggaccctgcccctgcccctgtgaggagaacgggacccttaaacaatcctgcacaaaacgtggctggtttaatttagtaaatgctataacttgtatctgcctcaatgaatcacacacacacgcacacacacacacacacacactggggatgtttgctgtatacaaaggaatgctctgatagatgatgagactgataaagccttgtcttcatccattcaggttgctataacaaaataccatggcctgggcagcttacaaaccacagacatttgt

SEQ ID NO: 4545 - DNA, 462 bp, Homo sapiens
  chr2.fa.O7frz.251343101
  Located on chromosome 2
  Distance between a terminus base of telomere on chromosomal short arm and 5'-terminus of this base sequence : 239338809
  Distance between 3'-terminus of neighbour sequence of sequence listing upward to telomere on chrosomal short arm and 5'-terminus of this base sequence : 215389
tgtagaagtttcttattggcatgccttagtccccaatagaatgtgagctcctggtggtcaagagtcattttattcagttatttttctcctgaatttagcataggcctggcttgtagtaagatattgataagtggtggatggatagataaataaacagatgaatggatggatggatggatgggatggatggatagatgggtggatgaatgaatggatagatgggtggagaactggatgatagatgaatagatggatggttgcataaataagtgggtagtggatgggtggattgatttttgggtgggtgtgtggatggataagtacatggatagataaatggatggatgaatgaacaaaagaatgagtgagtggatggatggatggatggatgggataaatggataggtaggtggatggatgggtggacaaatggatggatggaaagatgaatggatagatggt

SEQ ID NO: 4546 - DNA, 362 bp, Homo sapiens
  HUMUT7182
  Located on chromosome 2
  Distance between a terminus base of telomere on chromosomal short arm and 5'-terminus of this base sequence : 239368130
  Distance between 3'-terminus of neighbour sequence of sequence listing upward to telomere on chrosomal short arm and 5'-terminus of this base sequence : 28859
caaagaaacagaagcaacagtagatagatagatagatagatagatagacagacagatagatagataggggtgtgtgtgtgtgtgtgtatgtgtgtgtgtgtgtgtatgtgtgtgtgtgtgtgtgtagagagagagatttattatggaattggctcaagtgattatggaggctgagaagcattacaatctgtgtctgcaagctgcagacacaggaaagttgtggatttaatttattttgagaaagaagtcctgagaactagggtactgatgttaacatctccaggggcagaagaagattaaatgagttttcccagatcaagcattgaggcaggaagataggggcaaatttctccttcctccac

SEQ ID NO: 4547 - DNA, 442 bp, Homo sapiens
  chr2.fa.O7frz.251802718
  Located on chromosome 2
  Distance between a terminus base of telomere on chromosomal short arm and 5'-terminus of this base sequence : 239576653
  Distance between 3'-terminus of neighbour sequence of sequence listing upward to telomere on chrosomal short arm and 5'-terminus of this base sequence : 208161
aggtaatggcgatattaatgaggttaagtaaaaacccctgtggtccagaatgtaaatgggaaatataacttattaacttgagttcctttatctgtagtacacatgtacacacacacacacacacacacacacacacaccccttagctctgttcagtgaagaagtctagattcaatgtgtggccagcctagcagctctcactgtggttttgaaatattatttcccacaaaacaaaactagtgatctttagagaagttactgattttgaatctgagtccagaaatgtatcattgagcctggaacgcctagtcatacaatacggcaaggaagttgtcaaagtcaactgggattgcgtccaaaggattcaggcgctgacccaaagtggcttccactggctaaagacggagccactgaagtttcagtaggtacaagaaatgcaacag

SEQ ID NO: 4548 - DNA, 355 bp, Homo sapiens
  AC011298.3_95596
  Located on chromosome 2
  Distance between a terminus base of telomere on chromosomal short arm and 5'-terminus of this base sequence : 239748174
  Distance between 3'-terminus of neighbour sequence of sequence listing upward to telomere on chrosomal short arm and 5'-terminus of this base sequence : 171079
gccttgattactgtagcttcatagtgagtcttgaagtcaagtaagttctccggctttgttcttctccttcagtattgtattaatactctgagtcctttgcctctccacataaactttatttatttatttatttatttatttatttatttatttttgagacggagtctcactctgtcgtccaggctggagtgcactggtgcaatctcagctcactgctacttccgcctcccgggttcaagcaattctcctgtcttagcctcctcagcaccaccacacctggctaatttttttgtattttagtagagatgcagtttcaccatgttggccaggctggtctcgaattcctaacctcaag

SEQ ID NO: 4549 - DNA, 291 bp, Homo sapiens
  AC011298.3_84794
  Located on chromosome 2
  Distance between a terminus base of telomere on chromosomal short arm and 5'-terminus of this base sequence : 239806738
  Distance between 3'-terminus of neighbour sequence of sequence listing upward to telomere on chrosomal short arm and 5'-terminus of this base sequence : 58209
taacctcagttcagccatctctggctgcaacagctaccctcttctcaacacatgcatgagcgagcgcatggctgctctcaccccctcccccaccttctcgagccccgactccgacgccaccgagcctgccgaggagcagagcgtgggggaggaggaggaggaggaggaggaggaggaggatgaggaggaggaggacctggaggacgacgtctttccggagcacgcgctgtgcgacggccgggacccgttttacgaccggccccccctgttcagtttagtaggaaggttggt

SEQ ID NO: 4550 - DNA, 155 bp, Homo sapiens
  D2S140
  Located on chromosome 2
  Distance between a terminus base of telomere on chromosomal short arm and 5'-terminus of this base sequence : 239874134
  Distance between 3'-terminus of neighbour sequence of sequence listing upward to telomere on chrosomal short arm and 5'-terminus of this base sequence : 67105
gttgtcccatactgatcttacctcattccctaaattgctgcctttttctttagtgtgtgtgtgtgtgtgtgtgtgtgtgtgtgtgtgtgtgtgtctgctttggacatgcttagtctgttcacgtgtcatttctagactttggaaatcattgtagc

SEQ ID NO: 4551 - DNA, 103 bp, Homo sapiens
  DISD22_0002343
  Located on chromosome 2
  Distance between a terminus base of telomere on chromosomal short arm and 5'-terminus of this base sequence : 239999245
  Distance between 3'-terminus of neighbour sequence of sequence listing upward to telomere on chrosomal short arm and 5'-terminus of this base sequence : 124956
aatgaccagtgacaattattgggctggatttcaataaacacacacacacacacacacacacacacacacacacactttttttaggtagagtgatgcgtcatga

SEQ ID NO: 4552 - DNA, 138 bp, Homo sapiens
  DISO7_10009328
  Located on chromosome 2
  Distance between a terminus base of telomere on chromosomal short arm and 5'-terminus of this base sequence : 240301523
  Distance between 3'-terminus of neighbour sequence of sequence listing upward to telomere on chrosomal short arm and 5'-terminus of this base sequence : 302175
aaatcagctactgtcaattcattcgtgtgtgtgtgtgtgtgtgtgtgtgtgtgtgtgtgtgtgtgtgtgtccttgtgcctgtgtgcagggacttctgggagtaggggtgccgggccgaggcatgtgcatatggccaac

SEQ ID NO: 4553 - DNA, 387 bp, Homo sapiens
  AC005104.1_73462
  Located on chromosome 2
  Distance between a terminus base of telomere on chromosomal short arm and 5'-terminus of this base sequence : 240490248
  Distance between 3'-terminus of neighbour sequence of sequence listing upward to telomere on chrosomal short arm and 5'-terminus of this base sequence : 188587
aaatgaatcagatgtcttatgaactctcttttaaaggtttctgcatatcattttagcaacacaaaatcgtagaatgtcagctgcaaggaaatggagagaccacattagttcaccctcttatttttaaaggtttaggaaactccaaagatggcaaaaagtatttttatgagtgaccatagatcttaatagtgtattaaatgcctgacatttaccaaaaaaaaagtctcttttgagggaatcacttttaaatagagatagatagatagatagatgatagatagatagatagatagatagatagatagatagatacctgaaaatgatggataacaaagtgtcccctcattcaggatcctgggtctcaagttctaggactcatgctgataa

SEQ ID NO: 4554 - DNA, 383 bp, Homo sapiens
  AC005104.1_66506
  Located on chromosome 2
  Distance between a terminus base of telomere on chromosomal short arm and 5'-terminus of this base sequence : 240497350
  Distance between 3'-terminus of neighbour sequence of sequence listing upward to telomere on chrosomal short arm and 5'-terminus of this base sequence : 6715
ggtgaattctagattcaagtacactgaaagtgcagtgaggaggcagtgacaacatctttgggcacttatgtcgagaagcctgcctgtggaagaacaaagaactggaccctcagggtagttctgtgtgtgtgtgtgtgtgtgtgtgtgtgtgtgtgtgtgtgtgtgtctgggtgtgttctgtgtatacatgtgtggctgtgtggtcgtgtgtgcatgtatatgtgttcctatgcatgcattgtgtgtgtttctgtgtgtggctcatatgttcatgtgtgttgatgtgtgttcctgtgtacattgtatactgtggttatgtgtacttgcacatgttcttgtgcctgtgtctctgcatgtgtgtgtccttacatgtgcacatgtat

SEQ ID NO: 4555 - DNA, 101 bp, Homo sapiens
  DISO7_10001063
  Located on chromosome 2
  Distance between a terminus base of telomere on chromosomal short arm and 5'-terminus of this base sequence : 240574978
  Distance between 3'-terminus of neighbour sequence of sequence listing upward to telomere on chrosomal short arm and 5'-terminus of this base sequence : 77245
tgaggttgattcaaggataaagaaataaaccagtgggatagagttccgagacacacacacacacacacacacactcttcagctgatttatgttgagatgtt

SEQ ID NO: 4556 - DNA, 216 bp, Homo sapiens
  DISO7_10001065
  Located on chromosome 2
  Distance between a terminus base of telomere on chromosomal short arm and 5'-terminus of this base sequence : 240815757
  Distance between 3'-terminus of neighbour sequence of sequence listing upward to telomere on chrosomal short arm and 5'-terminus of this base sequence : 240678
agcgtttagtcggttattctgttcactcattcaacacagtataccagatgtctaaaaggtgataagctctgtttcaggcgttaggaatgcagagggaacaaacaggatgaaggcgtttcaccttgtggagcttttatgagtgtgtgtgtgtgtgcgcgtgtgtgtgtgtgcatgtgtgtgtgtgtgtgtaggggatgacagctaaagaatgaatat

SEQ ID NO: 4557 - DNA, 397 bp, Homo sapiens
  AC013469.7_149263
  Located on chromosome 2
  Distance between a terminus base of telomere on chromosomal short arm and 5'-terminus of this base sequence : 240856840
  Distance between 3'-terminus of neighbour sequence of sequence listing upward to telomere on chrosomal short arm and 5'-terminus of this base sequence : 40867
aaacctgtatctaacctatggaacacccctccccagtgaaacctgtatctatcctatggaacacctctccccagcttccacttttaggtacctgcctaagaaaaatggatgcatatgtgcgtgcgtgcacacacacacacacacacacacacacacacacacacagacacagagatgtgtccagtaatgcccagcagctttattcatcgtagttccacactggacaccgaaacagaatgtagagtccagaaataaacccacacatgcttggtcagatgaattgtgacaaaggggctaaggaaattcaatagggagaatcttcaacaaatggtattggaagaactagatatccatgtggaaatataaaatgatccagtgctgaccttacactgtacat

SEQ ID NO: 4558 - DNA, 417 bp, Homo sapiens
  AC013469.7_132912
  Located on chromosome 2
  Distance between a terminus base of telomere on chromosomal short arm and 5'-terminus of this base sequence : 240873088
  Distance between 3'-terminus of neighbour sequence of sequence listing upward to telomere on chrosomal short arm and 5'-terminus of this base sequence : 15851
ggtctagaactcctgaccttaggtgatccacctgcctcggcctcccaaagtgctgggattacaggcgtgagccactgcgcccggccaaattctctatttctaaaaaattcaaaataagcacctgcttgaaaaaacccaagctataaagaagtgagtaagtgaaaagggaccttcccacctttccctacaaaaagttagccctcttaacaattagtttgactctgcaggggtgtgtgtgtgtgtgtgtgtgtgtgtgtgtgtgtgtgtgcgcgcgcatgcatgagttttacttttgtcatttaaaaaaactagatcacgatactcattagatcttcagtttgattcttttttcacttaactcaatgccatgcacatcttagtttttttctgcctctgaatggtttactgtaatttgtt

SEQ ID NO: 4559 - DNA, 464 bp, Homo sapiens
  AC013469.7_280
  Located on chromosome 2
  Distance between a terminus base of telomere on chromosomal short arm and 5'-terminus of this base sequence : 241005575
  Distance between 3'-terminus of neighbour sequence of sequence listing upward to telomere on chrosomal short arm and 5'-terminus of this base sequence : 132070
aagcagaattgattagcatttatatgttataatggaaaataggagttggaaactggaatttccaaatcaccccagaactttgcagtattttgaagctccttagtgcatctagagagaggggagccagtcatgcttggcataacccattgcttgccccagcagagtgaagcccacccggtacacaggccctcactcaatcgtttttttgtttaatttatatatttacagtaatacaataaagggtttgttgctggaatatacacatatttatttatatgtataatatttatcaatatatttacaaatatatgtatacatgtacacacacacacacacacacacacacacacacatccttcatgaaaactctttcagctgggaaactgagcatccttgaatgtccctgaggtgactactaggatataaacatcccccaagagaagtgctttgagttacatacgaaa

SEQ ID NO: 4560 - DNA, 102 bp, Homo sapiens
  DISD22_0002345
  Located on chromosome 2
  Distance between a terminus base of telomere on chromosomal short arm and 5'-terminus of this base sequence : 241079841
  Distance between 3'-terminus of neighbour sequence of sequence listing upward to telomere on chrosomal short arm and 5'-terminus of this base sequence : 73802
agccagaacattgttgtttgtggttttcagatgattatcaaaatgaaatacacacacacacacacacacacacacgcacacacctcatggagctccttgact

SEQ ID NO: 4561 - DNA, 101 bp, Homo sapiens
  DISD22_0002346
  Located on chromosome 2
  Distance between a terminus base of telomere on chromosomal short arm and 5'-terminus of this base sequence : 241155723
  Distance between 3'-terminus of neighbour sequence of sequence listing upward to telomere on chrosomal short arm and 5'-terminus of this base sequence : 75780
aatgtgacctaaaggttaccaagaccccctctctcctctctgtctctctctctctcacacacacacacacacacacgccatcttacatactctatgattcc

SEQ ID NO: 4562 - DNA, 323 bp, Homo sapiens
  AC024898.13_126952
  Located on chromosome 3
  Distance between a terminus base of telomere on chromosomal short arm and 5'-terminus of this base sequence : 493960
  Distance between 3'-terminus of neighbour sequence of sequence listing upward to telomere on chrosomal short arm and 5'-terminus of this base sequence : 0
cttctatacataaacggacttgagggaaagctcccctttgaaaaaggggtaggctccaatcccatccaggttgctgtgaatgccgttaattcattcttttatggctgagtagtattccattgtgtgtgtgtgtgtgtgtgtgtgtgtgtatcacagtttctttattcacttgttgattggtgggcatttgggttggttccacatttttgcaattgtgaattatgctgctataaacatgtgtgtgcaagtatctttttcatgtaatgacttcctctgggtagatacccagtagtgggattgctggatcaagtggtagttctact

SEQ ID NO: 4563 - DNA, 458 bp, Homo sapiens
  chr3.fa.O7frz.524076
  Located on chromosome 3
  Distance between a terminus base of telomere on chromosomal short arm and 5'-terminus of this base sequence : 1853482
  Distance between 3'-terminus of neighbour sequence of sequence listing upward to telomere on chrosomal short arm and 5'-terminus of this base sequence : 1359199
tttaactgtcctttgctatacaacctaacatattcactgtttctggggattagctatggacatctttgggagaccattattctgcctgcaccagagacagagagagagagagagagagagagagacagagagagaaattcctctcacagcatatggttgggaagttgatatattaatgtataagtgaggagataaaaacaagactgctggtaaataagacagtataggacaattaattgatgagattcaggttatagccattggaatagagagaaggcacagatctaagtgcactggatatatccaagaaagttacatctatctgggtaatgaagactgcatagctattggatgaggcaggaagggaccccagtgaagtgaggagcagagttaggaaagaaggcatcatgtgtacagcacagggatggaaccgactctaacgagttaggtcatgttga

SEQ ID NO: 4564 - DNA, 368 bp, Homo sapiens
  chr3.fa.O7frz.882507
  Located on chromosome 3
  Distance between a terminus base of telomere on chromosomal short arm and 5'-terminus of this base sequence : 2155492
  Distance between 3'-terminus of neighbour sequence of sequence listing upward to telomere on chrosomal short arm and 5'-terminus of this base sequence : 301552
taaggacttctgtttgaccttctgagttagcagatatggtataaataataatatttataaaattttgcagtgctacgctcagtaaaaacatatgagggacaacccatgcttcatggtaagagagaagaggagtctatttaaatggaaatatgtgaaatgtgtatagaacacacacacacacacacacacactcgtgtgtcggattttttgttttaagaaagatgtggtgtcacagaattttatgtatattaatttgaaaaaattctgacttttcttttctattttgtagcaaattccatcaagcaaagaaaacccaaactgctgttgcctcccactgagagtggcagtgagtcttcaattaccatcct

SEQ ID NO: 4565 - DNA, 330 bp, Homo sapiens
  AC021997.2_4907
  Located on chromosome 3
  Distance between a terminus base of telomere on chromosomal short arm and 5'-terminus of this base sequence : 2244825
  Distance between 3'-terminus of neighbour sequence of sequence listing upward to telomere on chrosomal short arm and 5'-terminus of this base sequence : 88965
tctttagtattgtgctgtggtctaagctcttcatatccaattcttctttgtgtttcttctttcacagatgccagacctctattgcagtctgaagtttctacttacttttgctctgtctccctttatctttcacaggtgtctttttcttccttttcttttcttctttctttccttccttccttccttctttctttctttctttcttttttattctttctttccctttcctttccctcccttccttccttccttccttccttccttccttccttccttccttcctttcttctccgtcacccaggctggagtgcattggtgtgatcttgcctc

SEQ ID NO: 4566 - DNA, 455 bp, Homo sapiens
  AC068321.2_6522
  Located on chromosome 3
  Distance between a terminus base of telomere on chromosomal short arm and 5'-terminus of this base sequence : 2260159
  Distance between 3'-terminus of neighbour sequence of sequence listing upward to telomere on chrosomal short arm and 5'-terminus of this base sequence : 15004
ttgcaagtaacataattccttaacaatatttttatggaaaggtcagtgaggccacaaaacacatttagctgacagcacttggagtttctgcctttgaaaacatgttcagcagtttccaagtccatctatttcttattttgaactttctcttgcaaactacaaatgccgtgtgtatatatatatatatgaatatatattatatataatacatatgtgtgtatatatgtacttatatactatatatatatatatatatatatatatatatatatatatacacacaacatagtgaggccccatctctacaaaaaataaaataaggttaaaaaaataaaaattaaatcaaatttaaaaagtcagctggatgtggtgacatgtgcctgtagtcttagctacttgggaggctgaggctggaggattacttcaaccaaggagatcgaggctttagtacgtca

SEQ ID NO: 4567 - DNA, 252 bp, Homo sapiens
  D2S2394
  Located on chromosome 3
  Distance between a terminus base of telomere on chromosomal short arm and 5'-terminus of this base sequence : 2280167
  Distance between 3'-terminus of neighbour sequence of sequence listing upward to telomere on chrosomal short arm and 5'-terminus of this base sequence : 19553
cttcccaagtgctgagattataggtgtgagccacctgggccagcccgaaatttttcacaaacatgtttgtgtatgtgtgtatgtgtgtgtgtgtgtgtgtgtgtgtgtgtatgggtgaattggtgtgggtgtatgtatatacttatctactgaattctcttccccgtcccccttctccttttcctcctttccatctctctccctctttcacacacatacacacagacacacacacacgtgccctatgtagct

SEQ ID NO: 4568 - DNA, 270 bp, Homo sapiens
  Z66859
  Located on chromosome 3
  Distance between a terminus base of telomere on chromosomal short arm and 5'-terminus of this base sequence : 2454518
  Distance between 3'-terminus of neighbour sequence of sequence listing upward to telomere on chrosomal short arm and 5'-terminus of this base sequence : 174099
ttgaattggagtacagccaacctttactttgcacagatcatgttaacacaaatctgtgtgtgtgtgtgtgtgtgtgtgtgtgttggggggaacctagttcttactttacccaatccccacatgttctgatatgcaatagtttcagttagtagggtatcatgcaatgtgtggaatacccatatgtcttcttatatatgcttggcaaaaagtatgctgctagaaaaataatagcagccattgattaacttccattctggggcataattttcg

SEQ ID NO: 4569 - DNA, 417 bp, Homo sapiens
  chr3.fa.O7frz.1225856
  Located on chromosome 3
  Distance between a terminus base of telomere on chromosomal short arm and 5'-terminus of this base sequence : 2470314
  Distance between 3'-terminus of neighbour sequence of sequence listing upward to telomere on chrosomal short arm and 5'-terminus of this base sequence : 15526
cttactggtttataacatggaaagcagagtcagccttctacctggtgtacctgctattattaattactttgtccaattctaggaatttcgcaatgagtcctctgacgtgaatgctatttttgacacacacacacacacacacacacacagagagagagagagagagaaagagagagagagaaagagagagagagaatattttaaagggatggtataacataagaacccaatggagagcataatgtaacatgaggttataagagcagactctggagcgaatttctgagttcaaatcgtgtctcaaccatttactagctttttgaccttaggaaagttacttaacttctcttgtcctcagttttcttatctgtaaaatgggttaattaatagtacctaacgtataggagtgcttcaaga

SEQ ID NO: 4570 - DNA, 431 bp, Homo sapiens
  chr3.fa.O7frz.1634684
  Located on chromosome 3
  Distance between a terminus base of telomere on chromosomal short arm and 5'-terminus of this base sequence : 2635162
  Distance between 3'-terminus of neighbour sequence of sequence listing upward to telomere on chrosomal short arm and 5'-terminus of this base sequence : 164431
gtcaagtaacttgacctaattgacatttagagaacattccatcaaacaaaagcaatatctatctatctatctatctatcatctatctatctatctatcgtctatctatctatctatacacttttcaattgcatatggaacgttcaccaaatagaccacagtctgggacaagggtgttcaactataaaaaaaaatcattcaatgtgatccacataaaagcagactaagcaaggaaaacaacacataatcatatcaatatacaaagaaatgcatttgacaaactcaaaattcatgtatgattaaaaaaaattctccacaaacctagaaggtgatttccttaatatgaagaagaatatctatttaaaaatttacagctaacattatacctaatggagaactgctgaatgactacctctattggaaagactaagc

SEQ ID NO: 4571 - DNA, 425 bp, Homo sapiens
  AC073051.3_35595
  Located on chromosome 3
  Distance between a terminus base of telomere on chromosomal short arm and 5'-terminus of this base sequence : 2685087
  Distance between 3'-terminus of neighbour sequence of sequence listing upward to telomere on chrosomal short arm and 5'-terminus of this base sequence : 49494
aagaaacttagttatggctaggataaataatgtaatatgtgactattttgccagttatgtttcttctactgtgaatagcctatgccataaataacccatttttcaaatgagcaggcatttcttctattattagtttgcatgagctctttaaatatatcttatgtagcaattttcagttggttagatacatgagtttatccctagcttttctaatagcactatttccaatgttacacacacacacacacacacacacacacacacatacagcactcacttataagttgagtgaactccaggtaagataaaccaaagaattccatgccaagagacatttacaaatcttgaagagccagagaaaacccacaccgtacctttagagataaataatacaaatggcagtagatttcttatcagaaaccatg

SEQ ID NO: 4572 - DNA, 279 bp, Homo sapiens
  chr3.fa.O7frz.1754717
  Located on chromosome 3
  Distance between a terminus base of telomere on chromosomal short arm and 5'-terminus of this base sequence : 2909672
  Distance between 3'-terminus of neighbour sequence of sequence listing upward to telomere on chrosomal short arm and 5'-terminus of this base sequence : 224160
aggtgttacataagtctttgaattcttttggcagtaatgcacacacacacacacacacacacacacacacacatatatatatatatatatatatatatatagtgggaaattttaagtattcaggtaaggattaaatttaataatgaccaattcccacccccagaattaccaaatgctaaattttattggagatttaacatcttcagtattcataaaatgaaaatactaatacaatatataataagggcctacgttgtaactctacctagtccattcctc

SEQ ID NO: 4573 - DNA, 359 bp, Homo sapiens
  AC027123.4_52559
  Located on chromosome 3
  Distance between a terminus base of telomere on chromosomal short arm and 5'-terminus of this base sequence : 2930156
  Distance between 3'-terminus of neighbour sequence of sequence listing upward to telomere on chrosomal short arm and 5'-terminus of this base sequence : 20205
tttaagttggtagatgtaggtcataataggactataattttatttatttattgatggtctgattttaagcccttagaatattaatgtctaggaacatttgagaaagaataacagaaaaatcgtgtgtgtgtgtgtgtgtgtgtgtgtgtgtggagaatgtctctttggcccagataaactcttcgagctttgacatcttaaaaactctatgattaccatatttttatacatagtcagatacatataggttcatagtcctgagaactggttaaactgagttgtcttattgccagggtctgaggaaatttgaaagagagcatcatagaagacagtgtgttgaacactgttaggctagtaac

SEQ ID NO: 4574 - DNA, 426 bp, Homo sapiens
  chr3.fa.O7frz.1980144
  Located on chromosome 3
  Distance between a terminus base of telomere on chromosomal short arm and 5'-terminus of this base sequence : 3021138
  Distance between 3'-terminus of neighbour sequence of sequence listing upward to telomere on chrosomal short arm and 5'-terminus of this base sequence : 90623
ctgcctctagttcttaagtaggacacttgacctctctagaattacttttctgttttattttttttctgtaaattaggtaaacatttctctaagtattttttctattttaaaattttgtgacttgacaggaagtttaaagaaaattggtaaaagataaatacgtgtggtaaggggagggagaaggaagaaagaagggaagtgaagggaagggaaggaaagggaaggaaaaaggaaagaaaaaaaaaaggcttaactctttatagaacctgcattccaagaaagatattaagtgagtttagtctagcttaagctctacaggttaaagagtatgagtttgaaaaactaaggtagaagcttggtaatagaagaaaaataaagccagggagggtagagcttttatagtactgaaagtatgcagaactcaag

SEQ ID NO: 4575 - DNA, 293 bp, Homo sapiens
  AC026206.2_93560
  Located on chromosome 3
  Distance between a terminus base of telomere on chromosomal short arm and 5'-terminus of this base sequence : 3119071
  Distance between 3'-terminus of neighbour sequence of sequence listing upward to telomere on chrosomal short arm and 5'-terminus of this base sequence : 97507
cttctgtcagtactgactcacatataattattttagactttgggttgtaattctgtgctactttgtttattttgctgctcaaattgttttagcttttgccattgggagacttttaagttggatcttgtgccctttgttatgcactcatcaatgtatggggtgttttgtgtgtgtgtgtgtgtgtgtgtgtgtgtgtgtgtgcacctgttagcactttcttatttactggcattaaagatgttccaggttcatcttgtatgtttcatgccctagtcatagaagcagtcatgtct

SEQ ID NO: 4576 - DNA, 241 bp, Homo sapiens
  D3S1307
  Located on chromosome 3
  Distance between a terminus base of telomere on chromosomal short arm and 5'-terminus of this base sequence : 3119211
  Distance between 3'-terminus of neighbour sequence of sequence listing upward to telomere on chrosomal short arm and 5'-terminus of this base sequence : -153
gcactcatcaatgtatggggtgttttgtgtgtgtgtgtgtgtgtgtgtgtgtgtgtgtgtgcacctgttagcactttcttatttactggcattaaagatgttccaggttcatcttgtatgtttcatgccctagtcatagaagcagtcatgtctccaaggatagggtcttgttattgaagaatgacatcagaaaccaatatctgggtactaggtgtgcttgttgctgctggagtgtcattta

SEQ ID NO: 4577 - DNA, 464 bp, Homo sapiens
  AC034192.3_74003
  Located on chromosome 3
  Distance between a terminus base of telomere on chromosomal short arm and 5'-terminus of this base sequence : 3143314
  Distance between 3'-terminus of neighbour sequence of sequence listing upward to telomere on chrosomal short arm and 5'-terminus of this base sequence : 23862
aaatacagcatctatgcttctgtttgtgtcagactattgccttttttatagtcttatcgtgggacttccaaacagattgaggtaaaaaattagagtagtgataagaaagagagaaagaaaggaaggaaaaaaggaaggaaggaaggaaggaaggaaggaaggaaggagggagggaaggaaggaagagaaagagggggaaagaaagaaagagagagaggaagcaggaagggcaagaagggtcactgctgtttactatagacgtggtgtgatatagtaaaaagatttcagcccccaccctgttgagagcctgactttggcaaagtcatttgtcttctatagaacttcatatgtaaaatgaattagaggtacttcattttcctaaaaaaggagagaaagtcaaatggtttcttcaagcctgttcaggcccaaggttgattatttcttctacatctttggtctgaacc

SEQ ID NO: 4578 - DNA, 474 bp, Homo sapiens
  AC018833.3_38561
  Located on chromosome 3
  Distance between a terminus base of telomere on chromosomal short arm and 5'-terminus of this base sequence : 3295802
  Distance between 3'-terminus of neighbour sequence of sequence listing upward to telomere on chrosomal short arm and 5'-terminus of this base sequence : 152024
taatgttatctttcatgtccatttttatttctatgttatacattctaccacagggaatctgtttcaacaggcatatacatttttaacctaaagaaaaaataagttaaattcttaggttttattttcaaaattgccaaaggcttttgagaaaaaggagagtactaaataaatgatacacacacacatacacacacacacacattgatagatgatagatagatagatagatagatagatagatagatagacagatagacagacagacataactgaaactgaacagatcctaaaactgtgaactgatgttgcccaagctggtctggaactcctgtgctctatatactatagagggtaggatcttataatatccagtactaccttggggccaagtatttgataagacagagtatgaagtcaggaatatctgaacgaatctaaattttggctcttccactaactagttgcctgatttgg

SEQ ID NO: 4579 - DNA, 238 bp, Homo sapiens
  Z67022
  Located on chromosome 3
  Distance between a terminus base of telomere on chromosomal short arm and 5'-terminus of this base sequence : 3327898
  Distance between 3'-terminus of neighbour sequence of sequence listing upward to telomere on chrosomal short arm and 5'-terminus of this base sequence : 31622
tgatgtaaatgcaactgaaagggatgtaatctttattcatgtcttgcaaagtacatattctctctctctgtgtgtgtgtgtgtgtgtgtgtgtttagggagtgtaattattaaagtaaacaatatagcaacaaaatcatcccaagttttagcatatatacacaacatatcagtgttagatatatagcaattgcatagtctaataattacccaataggatacctttactctaggagatg

SEQ ID NO: 4580 - DNA, 400 bp, Homo sapiens
  AC068074.2_95650
  Located on chromosome 3
  Distance between a terminus base of telomere on chromosomal short arm and 5'-terminus of this base sequence : 3434030
  Distance between 3'-terminus of neighbour sequence of sequence listing upward to telomere on chrosomal short arm and 5'-terminus of this base sequence : 105894
aaatttacctcttcctggtttaacaaaagagacagtgtgtaactaccataataaccagctatttaaactaattatttccattttgttcatgtggaacttttattgactggactgctttaggaaaacaggtcttctgcaagtggattgtaaaaccatggcagtttttgttgctagtgaaggtggcattcagcaggtggtaaaaaaaaaaaaaaaattgaggatgttgcttggagaaatacttattttgcttgttttagcgtgtttgtgatttttatttccatccagagtgtgtgtgtgtgtgtgtgtgtgtatatatatatatatatatatatatatatatatatatatatatagaattgagtatttgttaatatctatcttcctcatgaaataaacatga

SEQ ID NO: 4581 - DNA, 187 bp, Homo sapiens
  chr3.fa.O7frz.2933420
  Located on chromosome 3
  Distance between a terminus base of telomere on chromosomal short arm and 5'-terminus of this base sequence : 3657840
  Distance between 3'-terminus of neighbour sequence of sequence listing upward to telomere on chrosomal short arm and 5'-terminus of this base sequence : 223410
gctagaatgattcatgtgatactagatcagtttgagacatcagtatgaactcacattgacttaatataagtatagatggaaacatacacacacacacacacacacacacacacacacacttgccaattgaaagggcctggaatctaccacaccctagcagcaacaatgaacctaagattttggtttc

SEQ ID NO: 4582 - DNA, 416 bp, Homo sapiens
  AC018497.4_35069
  Located on chromosome 3
  Distance between a terminus base of telomere on chromosomal short arm and 5'-terminus of this base sequence : 3782280
  Distance between 3'-terminus of neighbour sequence of sequence listing upward to telomere on chrosomal short arm and 5'-terminus of this base sequence : 124253
gtatgacttggcaagaatgtagggacagtttcttgacgctcaaaaagacaaaagcacacaacagcagtggctggtaagcatcaggagggacaactgtgctagtaacatatgacaatccatagtgatccagtgctgtgctacgaaaagtgtggtctgcagaatagcagcagtacatcaactggcagcttgttagaaattaaaacatacacacacacacacacacacacacacacaatgaaaacttagaccctactagatacctatggaatcagaatctgcatttgaacaggatccccaggggagttgatgggaagaatattttgcagtgtatctacccttttgggatgactgcttttaaaatgcctccaaagtgggcactagagtcaaagtccagggtctatgcaaggttcaaagtg

SEQ ID NO: 4583 - DNA, 464 bp, Homo sapiens
  AC024216.16_89596
  Located on chromosome 3
  Distance between a terminus base of telomere on chromosomal short arm and 5'-terminus of this base sequence : 3800471
  Distance between 3'-terminus of neighbour sequence of sequence listing upward to telomere on chrosomal short arm and 5'-terminus of this base sequence : 17775
gttctaggcttcaacgtaaataactgctgtctgccaacaatccatgtgctttccataaaacaagaccaagagataaatgtgacagcaattaagatatttattagattttaggttacactatgtgaatcactgaaccttctaattgatttattctttgttgcctataacttactttaacatacttcagcacaggctgtgcgtgtgtgtgtgtgtgtgtgtgtgtgtgtgtgtgtgtgtgtgtgtgtgtgttttcttctgaacctagaggtagttatccaaatgagaaatatagtcaccaggtgtttagctaatatttaaaaggcctcatccagtcaaaagttacacaccagaggtagacagctataagcagtattttacatcccctcaccatattaattagcattaagggtgtcagtggtggcctttcgttggttaaactggtagaattcaacttaagtggattg

SEQ ID NO: 4584 - DNA, 219 bp, Homo sapiens
  D3S1297
  Located on chromosome 3
  Distance between a terminus base of telomere on chromosomal short arm and 5'-terminus of this base sequence : 3807728
  Distance between 3'-terminus of neighbour sequence of sequence listing upward to telomere on chrosomal short arm and 5'-terminus of this base sequence : 6793
cataatttgctgctttggataatcaaatgaattctgatattcttcttactttggttttatacatatatgtgtgtgtgtgtgtgtgtgtgtacatgggtgtgggtgtgtgttatagaaatatatttggtgatatatatatcatcaaatatgttatatacagtatcatataaaatttgagataacttatttgctaaaataaacctgttcctttaatgtgca

SEQ ID NO: 4585 - DNA, 435 bp, Homo sapiens
  chr3.fa.O7frz.3319913
  Located on chromosome 3
  Distance between a terminus base of telomere on chromosomal short arm and 5'-terminus of this base sequence : 4002397
  Distance between 3'-terminus of neighbour sequence of sequence listing upward to telomere on chrosomal short arm and 5'-terminus of this base sequence : 194450
gccattcttagtaattgtcctctatgtcccttttgggctgctttgaccagagacctctcaaacctcccttctgtactcatgtggtgccgccactaggttgatccctctcttccatgacacctctagcccgtaaatatttaacttttttttattagctagtcatactgggcaattcaggtcttccaagttcaggccccaactgcctacaactgaactggaaagtgagtgaggttatctatttaacaaaattctatgtatatatatatatatacacacacacacacatacacacacatatatatttattatactttaagttctagggtacatgtgcacaacatgaggtttgttacatatgtatgcatgtgccatgttggtgtgctgcacccattaacttgtcatttacattaggtatatctcctaatgctatgcctc

SEQ ID NO: 4586 - DNA, 139 bp, Homo sapiens
  D3S3525
  Located on chromosome 3
  Distance between a terminus base of telomere on chromosomal short arm and 5'-terminus of this base sequence : 4137373
  Distance between 3'-terminus of neighbour sequence of sequence listing upward to telomere on chrosomal short arm and 5'-terminus of this base sequence : 134541
gattttgggacttgtcagcctccttaattgtgtgagccaattccttctaataaatttacacacacacacacacacacacacacacacacaatcttactgattctgtttctctggagaactctgctacaggagattacac

SEQ ID NO: 4587 - DNA, 426 bp, Homo sapiens
  AC022376.1_56292
  Located on chromosome 3
  Distance between a terminus base of telomere on chromosomal short arm and 5'-terminus of this base sequence : 4195605
  Distance between 3'-terminus of neighbour sequence of sequence listing upward to telomere on chrosomal short arm and 5'-terminus of this base sequence : 58093
cttctatgacacctgaataggactctcacatctcccatgctcttagcccagctattcaggcagctctcacatgtaaatttgtccctggctcctacaccagtaacaactcaatgtgtgcgtgtgtgtgtgtgtgtgtgtgtgtgtgttcatgttacctctacattatatccttggtttctaagtagaaggactaatttttacctatctttttttaacctatttttgcagatttttcttttttgttagtgcactgccttaagcaatattcttttttaaaacattggtttcatatagccccttctacagtggttgacgttcaaactcatttggcttgaaagtcattgttggttttactgcctccattcagatcctccttttctctcttgcttcgcctcttactcttccttcctaactggtctattctgg

SEQ ID NO: 4588 - DNA, 275 bp, Homo sapiens
  AC026882.3_90004
  Located on chromosome 3
  Distance between a terminus base of telomere on chromosomal short arm and 5'-terminus of this base sequence : 4216342
  Distance between 3'-terminus of neighbour sequence of sequence listing upward to telomere on chrosomal short arm and 5'-terminus of this base sequence : 20311
ctatagtacaagatgagcctggagcaactttggcactaaaaagttagaaagtcctcaaaaagtaagagtgcatgtcaaaggacataggcactgacatgaaagaacccccaatgaccaaagctgcaaaattggagcaacccaattaataactatagttatttatttaacccatagaataaaatagatatatgcgaacccatactgttatagataggtagatagatagatagatagatagatagatagatagatagataggagtcaaggatcagctc

SEQ ID NO: 4589 - DNA, 302 bp, Homo sapiens
  chr3.fa.O7frz.3656067
  Located on chromosome 3
  Distance between a terminus base of telomere on chromosomal short arm and 5'-terminus of this base sequence : 4338300
  Distance between 3'-terminus of neighbour sequence of sequence listing upward to telomere on chrosomal short arm and 5'-terminus of this base sequence : 121683
ccttagaagtggtcgttaaaagctgccattttactcttgaggactggcacaccaaatgagggaacaatgtatgctgctgctgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcggtgtaaaaggtcaaagccttgcttcatccgtaaagcaccttctttacataatagcgagcattg

SEQ ID NO: 4590 - DNA, 426 bp, Homo sapiens
  AC022386.2_57711
  Located on chromosome 3
  Distance between a terminus base of telomere on chromosomal short arm and 5'-terminus of this base sequence : 4441495
  Distance between 3'-terminus of neighbour sequence of sequence listing upward to telomere on chrosomal short arm and 5'-terminus of this base sequence : 102893
gttacctattggcttgacaagcccaatacattcccatttcttattagtacacgaatcataaataatactgagaaactataacttaatattgttaaatcttcttctctgtaattatagtaaaatttgagaggaattagtatggtatatccctatctgtttattaagggagtgtgtgtgtgtgtgtgtgtgtgtgtgtgtactatatgtttaataaaatcttaggaatactaggatttgttgagtagcgttcttatttaaaaaatgtgtaaaatttaaaattatgtaaatattcataatacagaagtcttcttagctttaaagatttacctgggtgaagacaggcattgtctgtacttgatcaagtaaattttcagttcattcaaaatgtttattttgcttgcatcttaccaaacctcaacttatagt

SEQ ID NO: 4591 - DNA, 182 bp, Homo sapiens
  D3S3630
  Located on chromosome 3
  Distance between a terminus base of telomere on chromosomal short arm and 5'-terminus of this base sequence : 4469831
  Distance between 3'-terminus of neighbour sequence of sequence listing upward to telomere on chrosomal short arm and 5'-terminus of this base sequence : 27910
aagggataagctgcaaatcatgaatccataagaataaatacctacttgcatttttttatgtggacatgcaaataacacacccacacacacaaacagacacacacacacacacacacacacacacacacacacacacacacagaactaacctaatatttcaggtctcatgaattgtatttggt

SEQ ID NO: 4592 - DNA, 113 bp, Homo sapiens
  DISO7_10000275
  Located on chromosome 3
  Distance between a terminus base of telomere on chromosomal short arm and 5'-terminus of this base sequence : 4572377
  Distance between 3'-terminus of neighbour sequence of sequence listing upward to telomere on chrosomal short arm and 5'-terminus of this base sequence : 102364
aaatatgcctggtaagtgtaacctgtgtgtgtgtgtgtgtgtgtgtgtgtgtgtgtgtatttgaacaggttttcacctagtcacatgtagatgtacattaacatgtgaatgct

SEQ ID NO: 4593 - DNA, 130 bp, Homo sapiens
  DISO7_10000276
  Located on chromosome 3
  Distance between a terminus base of telomere on chromosomal short arm and 5'-terminus of this base sequence : 4593399
  Distance between 3'-terminus of neighbour sequence of sequence listing upward to telomere on chrosomal short arm and 5'-terminus of this base sequence : 20909
cccataactgattcctaccttcttattctgtgtgtgtgtgtgtgtgtgtgtgtgtgtgtgtgtgtgtgtgtgtgtgtgttttaatgggaaggaaaccacagtttctaaatggtcccaccttccttattaa

SEQ ID NO: 4594 - DNA, 340 bp, Homo sapiens
  AC046132.11_54661
  Located on chromosome 3
  Distance between a terminus base of telomere on chromosomal short arm and 5'-terminus of this base sequence : 4994694
  Distance between 3'-terminus of neighbour sequence of sequence listing upward to telomere on chrosomal short arm and 5'-terminus of this base sequence : 401165
gtgtggtaatttgagtatttgaattatacgattgccagccagcatttggcaattgaagaatacatataccaatattgatttcctgcttctctttaaaactgggaagatttggcaaccatgagtcagattcatgcatgggaacaatgatctccgactaaataacaatgcctggtttagatggggcagcccctgttggtcacagaagccaaccagccagtgtgtgtgtgtgtgtgtgtgtgtgtgtgtgtgtgtgtgtgtgtgtgtgtgttacctgccttgatctggcctgcatttgtgtgtgcaaccacatgtatgagtgtgtagcaagtgatagagcaac

SEQ ID NO: 4595 - DNA, 362 bp, Homo sapiens
  AC046132.11_142149
  Located on chromosome 3
  Distance between a terminus base of telomere on chromosomal short arm and 5'-terminus of this base sequence : 5035308
  Distance between 3'-terminus of neighbour sequence of sequence listing upward to telomere on chrosomal short arm and 5'-terminus of this base sequence : 40274
atttcttagcctccataatcacatgagccaatcacttataataaatcctccccctctccatatagatagatagggatggagatataggtacatatatatacctatatgtgtacctatatgtgtacacatacacacagatatatacatatacacactatatacatatatatgtgtgcatatatatatgtgtacatatatatatgtgtgcatatatatatgtgtatatatatatgtgtgtgtgtgtgtatgtatgtgtatatatatatatatatataaaataacctattggttctgtttctctggagaaccctgactaatacagacactaaatggcattgaagcaatagactgaatcagatagt

SEQ ID NO: 4596 - DNA, 297 bp, Homo sapiens
  AC046132.11_144574
  Located on chromosome 3
  Distance between a terminus base of telomere on chromosomal short arm and 5'-terminus of this base sequence : 5037843
  Distance between 3'-terminus of neighbour sequence of sequence listing upward to telomere on chrosomal short arm and 5'-terminus of this base sequence : 2173
aggtatggaccaaagtttgtagaatttcagaccaaactgcctgtgcgttctccaacaataagaattgaggctcagaatccagacatcacacctgcttaattgcatgtggtcaattgcatgtcattatagaaatacatatataggcgtgtgtgtgtgtgtgtgtgtgtgtgtgtatatatatatatatatatatatatattttttttttttttttttttttttttttgagacaggatctggctctgttgcccacactggagtgcaatggtgtgatcttggttaactggaacctctgcc

SEQ ID NO: 4597 - DNA, 440 bp, Homo sapiens
  AC034195.6_5432
  Located on chromosome 3
  Distance between a terminus base of telomere on chromosomal short arm and 5'-terminus of this base sequence : 5167424
  Distance between 3'-terminus of neighbour sequence of sequence listing upward to telomere on chrosomal short arm and 5'-terminus of this base sequence : 129284
agctttctgttctaaagctgagagtgaacaaaaatggaatttgtggcagctaccttagctctaatagtattaagtaccaagtaatttctgatttttaaatacaaaaaattatgcatagaatccctgcaggaaatgaagaaatagtaacagtagggttttcagcccaacaactgcactgacacatggatattttgaaggaagatgcctcatctctgattttcacaggatgtcagagtctttggtaattaatgttcactactccagcaattaggttcttgtcagttaatcatccatacacacacacacacacacacacacacacacacacacacacacacacacacatttctttgccagaaaagccagtctttctatggttatattggcattgcttttgttccccagtggagaagattagagaacactcagagcagtttatg

SEQ ID NO: 4598 - DNA, 445 bp, Homo sapiens
  AC026188.4_68157
  Located on chromosome 3
  Distance between a terminus base of telomere on chromosomal short arm and 5'-terminus of this base sequence : 5178139
  Distance between 3'-terminus of neighbour sequence of sequence listing upward to telomere on chrosomal short arm and 5'-terminus of this base sequence : 10275
acataactaggcaacatagcacatgcctgtaatcctagctactcaggaggccaaggcaggaggatcctttgagctcaggagtttaaggttgtagtgtgtcatgattgtgccaccacatccagcctggacaatagaatgagactctgtctcaaatatatacatatatgttttttgatatacatatgtgtatatgtgtgtgtgtgtgtgtgtgtgtgtgtgtgtgtgtatagatatatttttttattttttctccatgcatcctattggtagtgtgcgtaaatttgcggtcctgtttcaaacttggttaactttcatatcacagactcacagaaaggagacttggaagcaaactcagcagttatctatgccaatgtcctcattttgcagatgatcaaaataagacaagacaatgttaaatgacgtggagcagtagaatagtacattt

SEQ ID NO: 4599 - DNA, 261 bp, Homo sapiens
  chr3.fa.O7frz.5261172
  Located on chromosome 3
  Distance between a terminus base of telomere on chromosomal short arm and 5'-terminus of this base sequence : 5182307
  Distance between 3'-terminus of neighbour sequence of sequence listing upward to telomere on chrosomal short arm and 5'-terminus of this base sequence : 3723
tcaaactgtacaaaatacctacaagtgattttccaattattcaaagactaccattgtctttccctagagacaaccagttttacatatcttgcttactccctccagaaattttctgatatatacaagcagatatatgtgtttatatgtgtgtatctatctatctatctatctatctatctatctatcatctatctatcatctatctacctacctacctatttatcatctcccctattttaacagattataaattgaagcaca

SEQ ID NO: 4600 - DNA, 253 bp, Homo sapiens
  D3S1620
  Located on chromosome 3
  Distance between a terminus base of telomere on chromosomal short arm and 5'-terminus of this base sequence : 5268603
  Distance between 3'-terminus of neighbour sequence of sequence listing upward to telomere on chrosomal short arm and 5'-terminus of this base sequence : 86035
gatcaaatgatgaagtgtatcagttagtgtttgtgtgtgtgtgtgtgtgtgtgtgtgtgtgtgtgtgtgttgggggggaatttttatatattatctggtaaagttggtaaacattaatgatttaatttctgtagaactctaatgattttttttagaaaatataatggtcattttattcttaaaacttggtttaagatttggggtagtaattctgatttcatactttaattggggaggggacctcctaccaagg

SEQ ID NO: 4601 - DNA, 358 bp, Homo sapiens
  chr3.fa.O7frz.5692530
  Located on chromosome 3
  Distance between a terminus base of telomere on chromosomal short arm and 5'-terminus of this base sequence : 5573536
  Distance between 3'-terminus of neighbour sequence of sequence listing upward to telomere on chrosomal short arm and 5'-terminus of this base sequence : 304680
gaggcatagcaggattaagtacttgcccaaagctggaaaactaaagtcaaaaatcaaatccagatctgccttccttgacatgtcatgcccttaacacttgactttcttgtaaaagagccattccttttctaaagacatcaatctaactgttaaatagctgcataataaacacatacacacacacacacacacacacacacacacgaacagcttttcccaaaagaataaatgtcaatatatcttaacccacttttctcgtaacgagttgatccagcaataacaagaatattcctcgggtaatgcctttttattaagaacaaatatgagttacgagacacgatacagtatccaatctcag

SEQ ID NO: 4602 - DNA, 251 bp, Homo sapiens
  D3S1560
  Located on chromosome 3
  Distance between a terminus base of telomere on chromosomal short arm and 5'-terminus of this base sequence : 5818266
  Distance between 3'-terminus of neighbour sequence of sequence listing upward to telomere on chrosomal short arm and 5'-terminus of this base sequence : 244372
gcatctacagggggtgtctttgtgtctcggaggattgttgcaaaagagttcataaatgtgcagttccctatcttccccaacccttcaaagatgggaaagaacttcatttagatgttccatcctaccccgtttttttactgatctgggcaataccaggtccccttaacacacacacacacacacacacacacacacacacacacacacacacacacacacttcctgcaatatattgtgctgaaaatcagcct

SEQ ID NO: 4603 - DNA, 416 bp, Homo sapiens
  AC069264.5_83785
  Located on chromosome 3
  Distance between a terminus base of telomere on chromosomal short arm and 5'-terminus of this base sequence : 5930506
  Distance between 3'-terminus of neighbour sequence of sequence listing upward to telomere on chrosomal short arm and 5'-terminus of this base sequence : 111989
cttactaattcttcaaggccttactgaaatgtcacattgtctatgaagccatgcagggaaaattcttcttcagtgttcccaatatcctgatatcctgtgttgttatctcctgcagcattgtgagtcaggctttggatctctagcaagaggccacacacacatacacaaacacacacacacacacacacacaaaccaccaagttctcatgtatttagcttgtagtaagtacaaaacttaacagaagtagctgcacagagtacaggcacatgcaggaagttttccttggtccttggttccccacagtttgtgcagctgccactgacactgtccatttaggtagggtacagccatgtttgagaaaaaagttgcaatattgttacactatcactcctttatacttgaacttacagcatca

SEQ ID NO: 4604 - DNA, 422 bp, Homo sapiens
  AC034191.3_167895
  Located on chromosome 3
  Distance between a terminus base of telomere on chromosomal short arm and 5'-terminus of this base sequence : 6032135
  Distance between 3'-terminus of neighbour sequence of sequence listing upward to telomere on chrosomal short arm and 5'-terminus of this base sequence : 101213
cctaccattacactcaccaagaaacatgtgctgatgccatagacacatatgccaatgcagcagcagtactaagatgaacaacacatgttccttgccttcttagagctagttagagacatgtggacactgatggatggaggtgttttaagttgccatgaatcttaacagtcataatgtagccaaaagtgcaacttttcatgtacttaaaagcagcaaatgctttgggtttggttttttggggtgtgtgtgtgtgtgtgtgtgtgtgtgtgtgtgtgtgttttgtgttttcttaatgcacagatgctaaacatatataagcaaagatccataacctgatgtccatagttctgaaagccctgtcccatttcccagtgattagacaacattcttatcatcatctaattcaagatccattacaatgt

SEQ ID NO: 4605 - DNA, 357 bp, Homo sapiens
  AC034191.3_151342
  Located on chromosome 3
  Distance between a terminus base of telomere on chromosomal short arm and 5'-terminus of this base sequence : 6063209
  Distance between 3'-terminus of neighbour sequence of sequence listing upward to telomere on chrosomal short arm and 5'-terminus of this base sequence : 30652
cataagtgtcatttctaggacaaccaaatcttctgaaaagtcaacaagaaagtagcaaatagttctgagggacattttggattcgctccaaatacacacatgcgcacacacacacacacacacacacacaccccactggctgtttaaaacatttgtacaacttgcctacattgtctattatcccaaaatataaaaataaaataatctctaaatagattcaccgtttgagactgctgaactttcaaatattgaaaaatcaaaccctgagtggcaaaagtagggaatgaaggcaaccaagctcattaccagcctgcctttttgccatttttacacgtacaatgaacttaaaggtctcag

SEQ ID NO: 4606 - DNA, 408 bp, Homo sapiens
  AC034191.4_65349
  Located on chromosome 3
  Distance between a terminus base of telomere on chromosomal short arm and 5'-terminus of this base sequence : 6082366
  Distance between 3'-terminus of neighbour sequence of sequence listing upward to telomere on chrosomal short arm and 5'-terminus of this base sequence : 18800
catgaggtatccttgactgaatgtttaaaaatctactctattcaaatgttttatactatctatagatagatagatagatagatagatagatagatagatagatagatagatagatacagagaggatctcaacattgcccaggctggaatgcagtggcgtgatggcatctcactgcagtcttgaaatcccaggctcaagtgattctcccgcctcagtctcccaagtagctgggactccaggagcatgccagcatgcccagctaattaattttattttgtagagacaggggtctcactctgttgcccaggctactctcaaactcctagcctcaagctatcctcctaccttggtctcccaaagtgctgggattacaagaatgagccaacctggtctatgccatcaatttaa

SEQ ID NO: 4607 - DNA, 375 bp, Homo sapiens
  AC034191.3_50738
  Located on chromosome 3
  Distance between a terminus base of telomere on chromosomal short arm and 5'-terminus of this base sequence : 6091606
  Distance between 3'-terminus of neighbour sequence of sequence listing upward to telomere on chrosomal short arm and 5'-terminus of this base sequence : 8832
atttaccgtctaactattctggaggttagaagtccaacatcaaggtgcgtgctgggctctgttccctctgagggtggctagagaagagcctgttccaggcctccctcctagtgtctggtagttccttggattatggcagtataactccaatcttcaaatggcattcaccgtgtgtgtgtgtgtgtgtgtgtgtgtgtgtgtgtgtgtgtgtgtgtgtgtgtgtgtgttctgtgtccaaacttctttttttgataagggcacagtcatgttggattagggcccatcctaataatttcatcttaacctgatcacctgcaaagaccctatttccaaataaggtcacattcacaagtactaggagttaggacttcaaca

SEQ ID NO: 4608 - DNA, 375 bp, Homo sapiens; identical to SEQ ID NO: 4607
  AC024636.3_118139
  Located on chromosome 3
  Distance between a terminus base of telomere on chromosomal short arm and 5'-terminus of this base sequence : 6091606
  Distance between 3'-terminus of neighbour sequence of sequence listing upward to telomere on chrosomal short arm and 5'-terminus of this base sequence : -375

SEQ ID NO: 4609 - DNA, 146 bp, Homo sapiens
  Z67192
  Located on chromosome 3
  Distance between a terminus base of telomere on chromosomal short arm and 5'-terminus of this base sequence : 6091733
  Distance between 3'-terminus of neighbour sequence of sequence listing upward to telomere on chrosomal short arm and 5'-terminus of this base sequence : -248
ggattatggcagtataactccaatcttcaaatggcattcaccgtgtgtgtgtgtgtgtgtgtgtgtgtgtgtgtgtgtgtgtgtgtgtgtgtgtgtgtgttctgtgtccaaacttctttttttgataagggcacagtcatgttgga

SEQ ID NO: 4610 - DNA, 167 bp, Homo sapiens
  Z67067
  Located on chromosome 3
  Distance between a terminus base of telomere on chromosomal short arm and 5'-terminus of this base sequence : 6279323
  Distance between 3'-terminus of neighbour sequence of sequence listing upward to telomere on chrosomal short arm and 5'-terminus of this base sequence : 187444
tttgtttttaggcttttaggagtaataatggtatttgtggctatattttttaaaagaatcccctcactgaggtacacacacactcactgaggtatacacacacacacacacacacacacacatatatatatatggataaaaatataggcagtcaaagatttgcttcc

SEQ ID NO: 4611 - DNA, 391 bp, Homo sapiens
  AC015541.21_107503
  Located on chromosome 3
  Distance between a terminus base of telomere on chromosomal short arm and 5'-terminus of this base sequence : 6641876
  Distance between 3'-terminus of neighbour sequence of sequence listing upward to telomere on chrosomal short arm and 5'-terminus of this base sequence : 362386
ccatcgtttaggtggtaaacgtaaaactctacctgagcagactttctctgaggaggtgattgattactcggtagtctttcttagaacagcctcttcttttgaacctgggaagaaaaaaaaataccccacttctcagaatgattcgcatttgcatcatacaatccaacttcctcctccgtctgtctgtctttgtctctctctctctctctctctctctcacacacacacacacacacacactcactccctctctctgtctctctccctctttccagtcaaggacatttcaagaggttggtcagtaccacccccatatctaaaacttcagtgtttgccttcgcagggacttttccaactttacctagaaaagaactaaccagaaccttagcac

SEQ ID NO: 4612 - DNA, 449 bp, Homo sapiens
  AC026162.4_97010
  Located on chromosome 3
  Distance between a terminus base of telomere on chromosomal short arm and 5'-terminus of this base sequence : 6667915
  Distance between 3'-terminus of neighbour sequence of sequence listing upward to telomere on chrosomal short arm and 5'-terminus of this base sequence : 25648
gattaggacatgaacatctttaagggggccgctattctgcctaccacatttgcttaggcaaaatctagacaggttaaagacgagaaaaacaaatcacatatttcttttcaactctgacggatttgaatacaattaggaaggtcacattttctcatggtccaaacaggctgaacaaatcagttcattaacatgatcgtatacactgataaagctataaatgattgcccaagagactgttgcttccttttacattcactattgctattcttggacaaccagaaacaactataaaaagatgtttgcttttttagacacacacacacacacacacacacacgcacccccgattagagactttcttcctcaggtttcatttgctaggatttgcactttaaaagatccagtgaggaacaaagaaaataaaagtagatcataaacttctcaaccag

SEQ ID NO: 4613 - DNA, 266 bp, Homo sapiens
  AC018501.7_61205
  Located on chromosome 3
  Distance between a terminus base of telomere on chromosomal short arm and 5'-terminus of this base sequence : 6670531
  Distance between 3'-terminus of neighbour sequence of sequence listing upward to telomere on chrosomal short arm and 5'-terminus of this base sequence : 2167
atgctcaacattgctaatcatcatggaaatacaaatcaaaaccacgagatatcacctcacacctgttaggatggctattatttgaaagcaacaacaacaacaacaaaacccaggatataacaagtgttcgtggggatgtagagaaatgaaagcgcttgtgccctgttggcggaaatgtaaaatcatacaactgctatggagcatagcataattttcctaaaaaattaaaagtagagctactatatgatctagcaatctcatttctg

SEQ ID NO: 4614 - DNA, 123 bp, Homo sapiens
  DISO7_10001068
  Located on chromosome 3
  Distance between a terminus base of telomere on chromosomal short arm and 5'-terminus of this base sequence : 6738702
  Distance between 3'-terminus of neighbour sequence of sequence listing upward to telomere on chrosomal short arm and 5'-terminus of this base sequence : 67905
actctatgttcaattgagctggattgtgtgtgtgtgtgtgtgtgtgtgtgtgtgtgtgtgtgtgagagagagagaggaagagaaagagagagagattttcagaatcactaagaaacctggtga

SEQ ID NO: 4615 - DNA, 414 bp, Homo sapiens
  AC060757.2_64286
  Located on chromosome 3
  Distance between a terminus base of telomere on chromosomal short arm and 5'-terminus of this base sequence : 6874639
  Distance between 3'-terminus of neighbour sequence of sequence listing upward to telomere on chrosomal short arm and 5'-terminus of this base sequence : 135814
tgagcttggattgtgctactgcacttcagcctgggtaatagagccacactttgtctcagatagacagacagatagatagatgatagatagatagatagatagatagatagatagatagatagatagatagatgaaaaatgttgagaacaaacgtaagacaaataaataaataaatgagaaaaatgtgcagagagagcaccggagttgatgagaattagggtggagcagtggttctcaaagagtagtccagagacccttaaaggtgcttgaaaccctttcaggggatccagaagatcaaaacagttttcacattcatataaagatatcttgccttttatccttcttgctctctcatgagtgtacagaacatgaaaagctcatgtttatagtttctgatttcacattgtaacaagc

SEQ ID NO: 4616 - DNA, 205 bp, Homo sapiens
  D3S2397
  Located on chromosome 3
  Distance between a terminus base of telomere on chromosomal short arm and 5'-terminus of this base sequence : 6874675
  Distance between 3'-terminus of neighbour sequence of sequence listing upward to telomere on chrosomal short arm and 5'-terminus of this base sequence : -378
aatagagccacactttgtctcagatagacagacagatagatagatgatagatagatagatagatagatagatagatagatagatagatagatagatgaaaaatgttgagaacaaacgtaagacaaataaataaataaatgagaaaaatgtgcagagagagcaccggagttgatgagaattagggtggagcagtggttctcaaaga

SEQ ID NO: 4617 - DNA, 240 bp, Homo sapiens
  AC026202.5_57341
  Located on chromosome 3
  Distance between a terminus base of telomere on chromosomal short arm and 5'-terminus of this base sequence : 7061971
  Distance between 3'-terminus of neighbour sequence of sequence listing upward to telomere on chrosomal short arm and 5'-terminus of this base sequence : 187091
ggaaatgtatgaatattggcagggagaagctccacaactgtttcctggtgctggaggaggtgtgtcctctttcggtttgttttgtgcctgcctgcctgcctgcctgcctggggacaagcagaataccatggaattcattttttcttcaaactgtattctttggttctttggttattattgaagcgagctgtatatggaggggctggtattttcagacagtcattgtatgtgccaagattc

SEQ ID NO: 4618 - DNA, 140 bp, Homo sapiens
  DISO7_10001070
  Located on chromosome 3
  Distance between a terminus base of telomere on chromosomal short arm and 5'-terminus of this base sequence : 7133947
  Distance between 3'-terminus of neighbour sequence of sequence listing upward to telomere on chrosomal short arm and 5'-terminus of this base sequence : 71736
ctatgagcaagccagtgtgcctggaagaaaacaaagaaggaaaagttaaacacacacacacacacacacacacacacacacacacacacacacacacacacaaatcccttatgatttttacggtagtggctcagttacac

SEQ ID NO: 4619 - DNA, 429 bp, Homo sapiens
  chr3.fa.O7frz.8116106
  Located on chromosome 3
  Distance between a terminus base of telomere on chromosomal short arm and 5'-terminus of this base sequence : 7468720
  Distance between 3'-terminus of neighbour sequence of sequence listing upward to telomere on chrosomal short arm and 5'-terminus of this base sequence : 334633
ttatttccttgtaagatggagagagtaatatttaccccacagggctatgatgggtatggagtgaagtaaataaaatgatatacttaaagggccagatatcatcctttgacaaagttggtactcttgaaatgcctatatatatatatatatatatatatgcacacaatacacacccacagagttactagaaggatatgaatatttaacctgttatttctttataagaagactgcatttgttggaatgcatccacatatgaatgtgcatttatacataaagggtcactggcttagtctgtaggggaagttgttagtctttgatacagaatataggcattttctctttccctgaagtgggagaacattaagaaattatgtttctgaagaacaggactgtattggtttcctactgttgctgtaacaaatgata

SEQ ID NO: 4620 - DNA, 294 bp, Homo sapiens
  chr3.fa.O7frz.8270370
  Located on chromosome 3
  Distance between a terminus base of telomere on chromosomal short arm and 5'-terminus of this base sequence : 7687461
  Distance between 3'-terminus of neighbour sequence of sequence listing upward to telomere on chrosomal short arm and 5'-terminus of this base sequence : 218312
cttactcagataacatgttccattattattttaagggaagggtattaattgggattcttctgagaaacaagaaaaaccgataaggtgtatgtgtgtgtgtgtgtgtgtgtgtgtgtgtgtgtgtaataagtatgtatatttataaagaaatgtattctaagaaattggctcacataagtaagaaggcaagtaagtccaaatcagcagaatgattcaacaagcaggagacgcaggagagctgacagtgttaagttccagtgctaagactggcagtatcaagacctaggaagcatt

SEQ ID NO: 4621 - DNA, 340 bp, Homo sapiens
  AC067948.3_23916
  Located on chromosome 3
  Distance between a terminus base of telomere on chromosomal short arm and 5'-terminus of this base sequence : 7896696
  Distance between 3'-terminus of neighbour sequence of sequence listing upward to telomere on chrosomal short arm and 5'-terminus of this base sequence : 208941
ccgtgaggttaagaacattagagaaaagtcttatacaaatggtgctgtcagaacaaattttggcagatcctaaagtacagtattttcaaagaaaaaaagtgttagattttttagctcagaagaaagaactacgaaaaagttgataatgaaaatagtattaatctccatttataaggggaatatttaatgtgtgtgtatgtgtatgtgtgtgtgtgtgtgtgtgtgtgtatatatatatatatgcaacatgcaaacgtgtaatacgtaaggactatcccagcttcttttccaatttctggacccctctagcaacagaaagtagtgatattgaccatcaacg

SEQ ID NO: 4622 - DNA, 424 bp, Homo sapiens
  AC055760.9_25750
  Located on chromosome 3
  Distance between a terminus base of telomere on chromosomal short arm and 5'-terminus of this base sequence : 7953423
  Distance between 3'-terminus of neighbour sequence of sequence listing upward to telomere on chrosomal short arm and 5'-terminus of this base sequence : 56387
gtcactttgagtgctatgtcacaatcaaatgtcttttgaaggcattataaaagtacactcatataggtatcatatatatatatatatatatatatacacacgttatgacacacacacatatataaaatatatatacataaaaaaagatatatatatatataatatgataccccaccaccaacactcctcccagactagattgctttttatatcctgtacatcgaggcttgacagaataatgcagaggaagccatcagctctgtaaattactagaagaatattacagcattttcattcatcactaagtcattttcatactttattcattacatgattggcataattcaatgtaatttccacttccaagagtttgaaatattagctactttctattttcattcccttcctacagaagcatcaatta

SEQ ID NO: 4623 - DNA, 425 bp, Homo sapiens
  AC055760.9_35260
  Located on chromosome 3
  Distance between a terminus base of telomere on chromosomal short arm and 5'-terminus of this base sequence : 8053600
  Distance between 3'-terminus of neighbour sequence of sequence listing upward to telomere on chrosomal short arm and 5'-terminus of this base sequence : 99753
ttccgtgactaacttagacctaagaatgaataaaagtactccagggagcactgagaaacaacagcccctccttaaactcaaatttccacgtgtgtgagtacacacacacacacacacacacacacacacgcacgcacacatcccccaagggaacaattctgtttttctgatttttagagtagtgcttatcaatctgttcaaaaaccccttattattattattttattattattttaaattttcaacctgttgcagatgcctctaaaatataataaacataacataatagaacaatgaaattaaaaggtatgtaaaatacaagcctacactttgtattgttatgacaagggacatacaattactctgtcaaattgctatggaagtttctaaacatgcccagtttctgtccttaacttgtcatgaag

SEQ ID NO: 4624 - DNA, 465 bp, Homo sapiens
  AC026197.3_221
  Located on chromosome 3
  Distance between a terminus base of telomere on chromosomal short arm and 5'-terminus of this base sequence : 8370730
  Distance between 3'-terminus of neighbour sequence of sequence listing upward to telomere on chrosomal short arm and 5'-terminus of this base sequence : 316705
cagatgtcaccaaagtttaaactgctactgggtataaaatttaaaataaattgcctttggaaaactctaaaaactaaaaacaaaaacaaaaacaaaaaaaaactaggtttggcttagttggaccccaaatgggtttttaaaacatcagttgaaaaatagacttctcgtcttagtgctgttattgtatgtgttttaatagcttcttttaaaaaatttcctctggaataatattcattaactttcacactgaatttttacaaattattatttttattactttggcatgtgtctatactttagttaggatgagttgctatcatcagtcaggcttcttcaaagaaacagaaccaatataataagtgtgtgtgtgtgtgtgtgtgtgtgtacatgtgtgtgtgtgtatatatatacgcatatataaagagatttattacaaggaattgctttagaaggattctgaaagct

SEQ ID NO: 4625 - DNA, 453 bp, Homo sapiens
  AC026181.2_132416
  Located on chromosome 3
  Distance between a terminus base of telomere on chromosomal short arm and 5'-terminus of this base sequence : 8370889
  Distance between 3'-terminus of neighbour sequence of sequence listing upward to telomere on chrosomal short arm and 5'-terminus of this base sequence : -306
acttctcgtcttagtgctgttattgtatgtgttttaatagcttcttttaaaaaatttcctctggaataatattcattaactttcacactgaatttttacaaattattatttttattactttggcatgtgtctatactttagttaggatgagttgctatcatcagtcaggcttcttcaaagaaacagaaccaatataataagtgtgtgtgtgtgtgtgtgtgtgtgtacatgtgtgtgtgtgtatatatatacgcatatataaagagatttattacaaggaattgctttagaaggattctgaaagctagcaaattaaaaatctgcaaagtaggctggaaggctagagacccaggagaggcaatactgcagctctaatgtgaagactgtcaggctcgaggcctaggatggcaaatgccgcagtttgaatctgtaggctatctgctagagaattct

SEQ ID NO: 4626 - DNA, 359 bp, Homo sapiens
  AC024154.2_121328
  Located on chromosome 3
  Distance between a terminus base of telomere on chromosomal short arm and 5'-terminus of this base sequence : 8448473
  Distance between 3'-terminus of neighbour sequence of sequence listing upward to telomere on chrosomal short arm and 5'-terminus of this base sequence : 77131
ttgccactcttcactttaaactcagagtgtttttgtctttggaatattctttcttatccctttttagataactattcatactctgtaatttcactaagacattctcttcttgcctccaaaaattcttcacaggctggatagttgtgttaatattttgtttgcctctctgacacctgggcacataactatcactataattaccacagcatgtgtgtagctttaatgtgtgtgtgtgtgtgtgtgtgtgtgagagagagagagagagagagacagagagatttcacttgacagtgaacttcttgagagtaagacctatgttactgatttttctatcactagtatcaagcacaaggtctgag

SEQ ID NO: 4627 - DNA, 259 bp, Homo sapiens
  AC026179.5_38122
  Located on chromosome 3
  Distance between a terminus base of telomere on chromosomal short arm and 5'-terminus of this base sequence : 8497005
  Distance between 3'-terminus of neighbour sequence of sequence listing upward to telomere on chrosomal short arm and 5'-terminus of this base sequence : 48173
aaaccatatgcattagactgtaagtctgagttaagcttttcagtagtaagccacacacagtgtcagcatgaaataattatatatatatatgaattatatataaagaactagttttagaaatatatatatatatatatatatatatatatatatatatatataaagaactagttttagctggtgactctgagcttggaagacacctagttctgataactggggataaacagaataatagtttgtattagcactcaactgg

SEQ ID NO: 4628 - DNA, 477 bp, Homo sapiens
  chr3.fa.O7frz.9231890
  Located on chromosome 3
  Distance between a terminus base of telomere on chromosomal short arm and 5'-terminus of this base sequence : 8532818
  Distance between 3'-terminus of neighbour sequence of sequence listing upward to telomere on chrosomal short arm and 5'-terminus of this base sequence : 35554
ttagctgaaactatgattcagaaggataattcaatccccaaaattatggtgcttcaaaggtggcaactgaaataaaagtgactacctgtatttttatacaagttacttgtggccagctgttttttctatgcagatatggggttctcatttcacagcagatccatattacaggcagaaacaaaaatgacagaatcataaacctttgagattatccagtctagtggtttccctctgtgctacatatttcttgggaggcttccttgatgtttaggggaagatagagtggaatgagttccgtgaatccgctctgcttcaatcacagatccaatttaaccaattgtttgtgtgtgtgtgcatgtgtgtgtgtatgtgtgtgtgtgtgcatgtattagaatgttctcatgctgctaataaagacataccagagactgggtaatttgtaaagaaaaaatggtttaaattgactcaatctacgtg

SEQ ID NO: 4629 - DNA, 270 bp, Homo sapiens
  AC011327.17_137684
  Located on chromosome 3
  Distance between a terminus base of telomere on chromosomal short arm and 5'-terminus of this base sequence : 8633381
  Distance between 3'-terminus of neighbour sequence of sequence listing upward to telomere on chrosomal short arm and 5'-terminus of this base sequence : 100086
aggatcctgtttcatgtcttagcagatattggttcaccttcctcaggggaatagatacatctagatccttccccttagaagttgagctttatatctaaagcctatagcttttttgtggtctcatacagtattgtctccgcaaaataaatacaaaggcatagatcgatagattacttagacagataggtagatagatagatagatagatagatagatagatagattacaagtttttgtagtaaaaaatggaaagcctatgtacaagccatg

SEQ ID NO: 4630 - DNA, 253 bp, Homo sapiens
  D3S2450
  Located on chromosome 3
  Distance between a terminus base of telomere on chromosomal short arm and 5'-terminus of this base sequence : 8633416
  Distance between 3'-terminus of neighbour sequence of sequence listing upward to telomere on chrosomal short arm and 5'-terminus of this base sequence : -235
accttcctcaggggaatagatacatctagatccttccccttagaagttgagctttatatctaaagcctatagcttttttgtggtctcatacagtattgtctccgcaaaataaatacaaaggcatagatcgatagattacttagacagataggtagatagatagatagatagatagatagatagatagattacaagtttttgtagtaaaaaatggaaagcctatgtacaagccatgggagattgtttgcaaatt

SEQ ID NO: 4631 - DNA, 371 bp, Homo sapiens
  AC067736.7_136236
  Located on chromosome 3
  Distance between a terminus base of telomere on chromosomal short arm and 5'-terminus of this base sequence : 8646751
  Distance between 3'-terminus of neighbour sequence of sequence listing upward to telomere on chrosomal short arm and 5'-terminus of this base sequence : 13082
ctcttgatgtcaggagtttgagactagcctggccaacatggtgaaaccccatctctgctaaaaatacaaaaattagccaggtatggtggcacatgcctgtaatcccagctactcgggaggccgaggcacaagaattgcttgaacctaggaggcagcagaggttgcagtgagttgagattgcaccactgcacgtcagcctaggtgacagagcaagactctgtctcaaaacaaacaaaagaaagaaagaaagaagaaagaaagaaagaaagaaagaaagaaagaaagaaagaagaaataatttgatagcttgaagaaaaactttgtatgagttgaggcgtgaattctttctagcactgaataggtttaaccag

SEQ ID NO: 4632 - DNA, 363 bp, Homo sapiens
  AC023485.3_102262
  Located on chromosome 3
  Distance between a terminus base of telomere on chromosomal short arm and 5'-terminus of this base sequence : 8688544
  Distance between 3'-terminus of neighbour sequence of sequence listing upward to telomere on chrosomal short arm and 5'-terminus of this base sequence : 41422
tagtaaccatatcactggctaaaccagtggtttttcaaattcgctctttgataggcccatgaggtagattgacattccgcttgtatgagtagaaaatggtgttcgtttataattcatcgggaagaaaataggccactggatataatttcctcaattaaaaaattttcatatagatggacatgaaaaattttaaattgaggatatatatacacatatacctacacagatatcacacacacacacacacacacacacacacacacacacacacacatatgacttctgctagtaaattacaaatgaaattgttagtagctctgtatacacataagcaggaaagtagctgatcagatttaactcaat

SEQ ID NO: 4633 - DNA, 304 bp, Homo sapiens
  AC067736.7_72156
  Located on chromosome 3
  Distance between a terminus base of telomere on chromosomal short arm and 5'-terminus of this base sequence : 8713691
  Distance between 3'-terminus of neighbour sequence of sequence listing upward to telomere on chrosomal short arm and 5'-terminus of this base sequence : 24784
caagcagtgtctacttgtttattcttgaccttcaatttgacttgctcaagagtcgttaagagtgtagtaaggtatagtatgtacccttgagtttattaaacaacacgatcacaaacagactcctacacacacacacacacacacacacacacacacccctactctagagaatggaattttaagggttagaactttttatatgttttggatacagatggactattatttacttggcatgctaactaatgattctaaaacaattaaaaaccagcctctatcttaaaagctgatttctatttgcttt

SEQ ID NO: 4634 - DNA, 361 bp, Homo sapiens
  AC067736.7_17671
  Located on chromosome 3
  Distance between a terminus base of telomere on chromosomal short arm and 5'-terminus of this base sequence : 8738370
  Distance between 3'-terminus of neighbour sequence of sequence listing upward to telomere on chrosomal short arm and 5'-terminus of this base sequence : 24375
tgacagagctagactcttgtcagaaaagaaagaagaaagagaagaaagaaagagagagagaaagaaagaaagaaagaaagaaagaaagaaagaaagaaagaaagaaagaaagaagagaaaagaaagaaagaaatctagtagttaaattaggaaaattattaaatacagaaaaatttagaaaaaaatatactttagagagaataaatatcatcattgctattttttccactattacatgcatttatgttcatatgcatatgtaaatctactcattttatacacagtttaataatgttaagatatgctgtttatgtcatttttatctatattacattttcaattaacatcataacatggccat

SEQ ID NO: 4635 - DNA, 462 bp, Homo sapiens
  chr3.fa.O7frz.9585191
  Located on chromosome 3
  Distance between a terminus base of telomere on chromosomal short arm and 5'-terminus of this base sequence : 8886395
  Distance between 3'-terminus of neighbour sequence of sequence listing upward to telomere on chrosomal short arm and 5'-terminus of this base sequence : 147664
tcaactccacgtggataagttccttttcaactcttttcactatccaaaacttcttgcttctcagatgtgtgtgtgtgtgtgtgtgtgtgtgtgtgtgtgtgtgtgtgtgtgtgtttggagatggagtctcactctgtcgcccaggctggagtggcatgatctcagcttactgcagcctccggctcctgggttcaagcgattcttgtgcctcaacctcctgagtagctgggattacaggtgcccgccaccatgcccagccaatttttgtatttttagtagagacagggtttcaccatgttggccaggctggtttcgaactcctgacctcaggtgatctgcccgcctcagcctgccaaagtgctgggattacaggcctgagccactgtgcctggctagatgtacatatatttgtcataggatattctagaaggaatctttcatagaatattctggttcaaatgc

SEQ ID NO: 4636 - DNA, 455 bp, Homo sapiens
  AC026204.3_68068
  Located on chromosome 3
  Distance between a terminus base of telomere on chromosomal short arm and 5'-terminus of this base sequence : 9102167
  Distance between 3'-terminus of neighbour sequence of sequence listing upward to telomere on chrosomal short arm and 5'-terminus of this base sequence : 215310
aagatcatttaggacaatgtacagttgcaaataagagaaaactgactgccgcgagctgacacgaaaaggtgtttcattttctcccatatcagaaagtaggtgggtgctaacagtatttattctgctcagtgatgcatgacatcagggactctggttctctctctttttctggtttaccacttttaaggagtaggtcatccttttgctgtggcctagtggtgccaagaggacagtaatagtgcagacatcacagtacagacagggttagaggaaaagtcatgccagctctctctctctctctctctctctctctctctctctctctctctctctctctctctctctctctcaatccctccgtctgtctatttttaccaagggagtaaaacttttcccagaactgacttcaggggatttctgcctgttttgtgtgtcacgtgattatttgtacttga

SEQ ID NO: 4637 - DNA, 317 bp, Homo sapiens
  chr3.fa.O7frz.9901702
  Located on chromosome 3
  Distance between a terminus base of telomere on chromosomal short arm and 5'-terminus of this base sequence : 9162886
  Distance between 3'-terminus of neighbour sequence of sequence listing upward to telomere on chrosomal short arm and 5'-terminus of this base sequence : 60264
attactggcttctcattctgtagcttgtgaatggcctatcatgggactttgcttttgcgattatgtgagccaattccccctgataaatatattcattcagtcattcgttcattctctctctctctcacacacacacacacaccacacacacacacacacacacacacacacacacacacacacactcatattctattttgtctgtctggagaaccctgactaatatttggggtttctggaattgattttataatctgattagacctaacatataaaaggttctactttttatagtactgagagcactgatagttcat

SEQ ID NO: 4638 - DNA, 400 bp, Homo sapiens
  AC026204.3_117592
  Located on chromosome 3
  Distance between a terminus base of telomere on chromosomal short arm and 5'-terminus of this base sequence : 9167787
  Distance between 3'-terminus of neighbour sequence of sequence listing upward to telomere on chrosomal short arm and 5'-terminus of this base sequence : 4584
gaacttcgatttagctatgctactgactttcccaaaaccaccctactggcttctctcatcctccagcttgtagacagcctatcatggaactttgcctttttgatcacacacacacacacacacacacacacacacacacacacacacagttatatgtaatatacttcaaatgtgacatattttatatatcatataatatatatttgatataaattgtataatatatatgttcattttcatatatataatattgtttctatccctctagagaaccctgacttatacactgtccaaggaagcaaacataaataacaaaaaaattattaaatggcaactaggactataaaggttctgttttctagcataagcatttgtataatctaaactccaagacaaatcc

SEQ ID NO: 4639 - DNA, 344 bp, Homo sapiens
  AC018504.4_147667
  Located on chromosome 3
  Distance between a terminus base of telomere on chromosomal short arm and 5'-terminus of this base sequence : 9236964
  Distance between 3'-terminus of neighbour sequence of sequence listing upward to telomere on chrosomal short arm and 5'-terminus of this base sequence : 68777
tactgagctttaagaggcactaaaagtatagattggtgctatttttaacatgtaaaactaattcctcaacatttaagacatttcagtggccatatcatacgttctttctttctttctttctttttctttttcttttttttttgagatggagttttgctcttgtttcccaggctggaatgcaatggtgcgatctcggctcaccacaacctctgtctcccgggttcaagtgattctcttgcctcagcctcccgagtagctgggattacaggcatgcgccaccacgccctgctaattttgtatttttagtagagacagggtttctctatgttggtcaggtttctaca

SEQ ID NO: 4640 - DNA, 300 bp, Homo sapiens
  AC018504.4_84858
  Located on chromosome 3
  Distance between a terminus base of telomere on chromosomal short arm and 5'-terminus of this base sequence : 9299806
  Distance between 3'-terminus of neighbour sequence of sequence listing upward to telomere on chrosomal short arm and 5'-terminus of this base sequence : 62498
aaaccactgatctagtaaggtcttatttatttatttatttatttatttatttttggaagaagacactactacatagactgtgtatcaaatgacactttttacatagatggtgacagggtgatagatgtcactaataccaacaccgtccacaacaagtagtaattcttacttaactctttttggttatctgccctgtgcaggtgttgctttgaatacttcaactggttaaattcatttaataaccactctgtgagggagatacatctaccctcctcagagtattaaagtgcctctatggat

SEQ ID NO: 4641 - DNA, 366 bp, Homo sapiens
  AC018504.4_898
  Located on chromosome 3
  Distance between a terminus base of telomere on chromosomal short arm and 5'-terminus of this base sequence : 9383662
  Distance between 3'-terminus of neighbour sequence of sequence listing upward to telomere on chrosomal short arm and 5'-terminus of this base sequence : 83556
gtgcctgtagtcctagctactcaggaggctgaggcaggagaatggtgtgaacctggaaggcggagcttgcagtgagccgagattgtgccactgcaccccagcctgggcgacagagtgagactctatctcaaatatatatatatatatatatatatatatatatatatatatatatatatatatatataaataatctttctacctataataattctttctatgtggagtacatttaaaaaaggttgacttttataagttttgaataagtggaatctgaattggcaatgttttttattgtaatatagtccctaaattctgttcgctgtctagtcatgctacttaatgttcagaaatagaggctgagtt

SEQ ID NO: 4642 - DNA, 425 bp, Homo sapiens
  AC026165.4_102181
  Located on chromosome 3
  Distance between a terminus base of telomere on chromosomal short arm and 5'-terminus of this base sequence : 9530487
  Distance between 3'-terminus of neighbour sequence of sequence listing upward to telomere on chrosomal short arm and 5'-terminus of this base sequence : 146459
tcatgttgaaatggtaacctacagctgggcgcggtggctcatgcctgtaatcccagcactttgggaggccgaggctggcggatcatgaggtcaggagatcgagaccatcctggctaacacagtgaaaccccatctctactaaaagtgcaaaaaattagcctggcgtggtggcaggcacatgtagtcccagctactcgggaggctgagacaggagaatggcataaacctgagaggcggagcttgcagtgagccaagattgcaccactgggcaacacacacacacacacacacacacacacacacacacacacacacacagaaatgataacctacaaaaggagttcagcctataaaacaaggacttccagttgagtttttatacggtcacccttctgaatttcattgtctcatacagatgactagct

SEQ ID NO: 4643 - DNA, 412 bp, Homo sapiens
  AC026165.4_109015
  Located on chromosome 3
  Distance between a terminus base of telomere on chromosomal short arm and 5'-terminus of this base sequence : 9537303
  Distance between 3'-terminus of neighbour sequence of sequence listing upward to telomere on chrosomal short arm and 5'-terminus of this base sequence : 6391
gagacggtcactgtcatctacctatatcttgttgttaaaaataactaatttactttcaatataaaaagatagcattatagaaaatgtagcttaaaaagtaaaatgtacaaagtaaaatgtaaaaaacatttaattcaactaccctaatagagctttataaatcatttctccctacattttattttgaaaagtttaaaacttacgaatacattgaaatgaggaccaacaatatgtaatcaccactcactaacatgttgccatattcattttctccgtctctctctccctctatatatatatatatatatatatatatatatatatatatatatatatatataggttttccccattagctgtttataagcaagttgcacacatcatgactgtaatactcctgaataattcagca

SEQ ID NO: 4644 - DNA, 192 bp, Homo sapiens
  chr3.fa.O7frz.10388766
  Located on chromosome 3
  Distance between a terminus base of telomere on chromosomal short arm and 5'-terminus of this base sequence : 9649885
  Distance between 3'-terminus of neighbour sequence of sequence listing upward to telomere on chrosomal short arm and 5'-terminus of this base sequence : 112170
ctatgaccaattcgatgttaacaaatttgaaaaccaaaaaaagacataatctatttaacaaaaccaaattaaaaaggaaaacacaatctcaacagttcatctgttacaaaaattgaacaaatatttaaacatcttcactacacacacacacacacacacgcccagattgtttcataggcaagttctaatgaa

SEQ ID NO: 4645 - DNA, 381 bp, Homo sapiens
  AC026177.2_34474
  Located on chromosome 3
  Distance between a terminus base of telomere on chromosomal short arm and 5'-terminus of this base sequence : 9775252
  Distance between 3'-terminus of neighbour sequence of sequence listing upward to telomere on chrosomal short arm and 5'-terminus of this base sequence : 125175
ctgttaactaggccaacataataccttattgaggggaatatttaagaacatcagattcacagactagttcatattaacctggccctgtttggtgtcccaccttctgaagtctccattgtacattttcttcccctaactactgccaccctttttttccttcaggtcttctaatttaccatgttctcctctgcctcaagctctcagctgctatcatccctccctgccataaacacacacacacacacacacacacacacacagagagagagagagagagagagagaggagagagcaagagacctttggctggtctcagctttctgagctcagctctgttaacatttcttcagggaaaccatctccagtctttctaagcaaatc

SEQ ID NO: 4646 - DNA, 360 bp, Homo sapiens
  AC024146.7_139031
  Located on chromosome 3
  Distance between a terminus base of telomere on chromosomal short arm and 5'-terminus of this base sequence : 9896745
  Distance between 3'-terminus of neighbour sequence of sequence listing upward to telomere on chrosomal short arm and 5'-terminus of this base sequence : 121112
ttctattgcatctggagtagagggtcccagacaacgggctataaactctttagagtttttggagttataccaagagatacctaattcacacacacataagtattttctcaataaaaaatgaaaaatataaataagataatgtatacacagggaaagtgtatgagtatatgagatgacatataaagacatacacatacatataaatgtgtgtgtgtattttatatatatatatatatagagagagagagagagagagacagagagagagacagagagagagagaaggagggagggatatccttaaatgtaaaacagctatgaatcattgatttagggctttaccatagctattcaatcttg

SEQ ID NO: 4647 - DNA, 148 bp, Homo sapiens
  D3S3591
  Located on chromosome 3
  Distance between a terminus base of telomere on chromosomal short arm and 5'-terminus of this base sequence : 9955081
  Distance between 3'-terminus of neighbour sequence of sequence listing upward to telomere on chrosomal short arm and 5'-terminus of this base sequence : 57976
ccatctatgttttgggtctgtgctcatctgtcttctgcctaaagcatgtacatcctgggattattgtctgcaactaagacacacacacacacacacacatgcacatgctctctctctctctcaagcaagcatcatctaactgggcaca

SEQ ID NO: 4648 - DNA, 384 bp, Homo sapiens
  AC024219.11_50444
  Located on chromosome 3
  Distance between a terminus base of telomere on chromosomal short arm and 5'-terminus of this base sequence : 10044764
  Distance between 3'-terminus of neighbour sequence of sequence listing upward to telomere on chrosomal short arm and 5'-terminus of this base sequence : 89535
tggtatattgaggcataaacacagttctttgggacacaattgaaagatgaaagaaggaattttaatgcttggctgatgccaattttgccttccaatgtgtacattcatgcctgcatgcacacatacacatataaacacacacacacacacacacacacacacacacccctctgtattctaatacccttttaatcaaaagggagatggagtagaaatatacaaataccaacataagtccatgaaaattatgaccaaataaaacagtcaactcaagctgtgaagaaagatttgtcacatcattgtcacctcaagtgcagcattagatttgtggccacagttctcatttattgtttgtaagctagctattgtttcagtttcgatcag

SEQ ID NO: 4649 - DNA, 303 bp, Homo sapiens
  chr3.fa.O7frz.11010307
  Located on chromosome 3
  Distance between a terminus base of telomere on chromosomal short arm and 5'-terminus of this base sequence : 10122362
  Distance between 3'-terminus of neighbour sequence of sequence listing upward to telomere on chrosomal short arm and 5'-terminus of this base sequence : 77214
ggcacttaccataatttctaactactgtatatattgttgactttatatttttaatgtctgtctttgccacccttcctctaaaatataaatttcgtaatagtaagtctatagttattgcgcataacattacacaataccctggcagatagcaggcactcaataaatatttatgggaggaaggagaaaaagaataaaggaagaaatggaaggaaggaaggaaggaaggaaggaaggaaggaaggaaaactatgattaataggcaaaatataaaaaacagaactatcattgatagtggtagcctta

SEQ ID NO: 4650 - DNA, 388 bp, Homo sapiens
  AC018355.14_16756
  Located on chromosome 3
  Distance between a terminus base of telomere on chromosomal short arm and 5'-terminus of this base sequence : 10286815
  Distance between 3'-terminus of neighbour sequence of sequence listing upward to telomere on chrosomal short arm and 5'-terminus of this base sequence : 164150
gctgcaggactataacagtgacccaaagaggctcagtccctgtcttcagtgagctcatggccccctgagcttatcacaaaagagcctccatttcctcatctataatatgggaatgagaacagtccctaccacagaatattttttcagggattcaaagacaatgcatgtgagatgatgatgatgatgacgacgaaacattgccatgtgccaggaactgttagaagccctttaattcacttgattcattcatcaaacttatgagacagtttttatcatttgtctcattctacagatgaaaaaattgaggcacaacgagttcatgattaactaaagaaaacagaaggacagagttgggatctgaactctagaaatcaagatcctgagtctg

SEQ ID NO: 4651 - DNA, 419 bp, Homo sapiens
  AC018355.14_93201
  Located on chromosome 3
  Distance between a terminus base of telomere on chromosomal short arm and 5'-terminus of this base sequence : 10350646
  Distance between 3'-terminus of neighbour sequence of sequence listing upward to telomere on chrosomal short arm and 5'-terminus of this base sequence : 63443
agtgattaatgctggctcataaaaccacatggctgtaaagaacccctctgtctgctcttcatctgggcgtccagggcaagtcccatttctgagattggacaactcccccttcccactcaccttcccaacatttttattattattattattattattattattattattattattattgtactttaagttctagggtacatgtgcacaacgtgcaggtttgttacatatgtatacatgtgccatgttggcgtgctgcacccattaactcatcatttacattaggtattctcctaatgctatccctcccccaggcccccaccccaccacaggccccagtgtgtgatgttccccatcctgtgtccaagtgttcttattgttcaatgcagccataaaaaaggatgagttcatatcctttgtag

SEQ ID NO: 4652 - DNA, 183 bp, Homo sapiens
  DISO7_10001074
  Located on chromosome 3
  Distance between a terminus base of telomere on chromosomal short arm and 5'-terminus of this base sequence : 10448779
  Distance between 3'-terminus of neighbour sequence of sequence listing upward to telomere on chrosomal short arm and 5'-terminus of this base sequence : 97714
acttccagctgaactgccccatctcctagagcttgtttgtttgtttgtttgtttgtttgtttgtttggtgggaggaacctatttaaagcccgtagtagctctctcccttcacaaaagtaaaaataatataccctgtcccttcaagtttaataaaaacaaaaaccagacaatagaagcttcgtt

SEQ ID NO: 4653 - DNA, 187 bp, Homo sapiens
  DISO7_10001073
  Located on chromosome 3
  Distance between a terminus base of telomere on chromosomal short arm and 5'-terminus of this base sequence : 10548965
  Distance between 3'-terminus of neighbour sequence of sequence listing upward to telomere on chrosomal short arm and 5'-terminus of this base sequence : 100003
tagggccacctcactgacagcatgctctctctctctgctctctcttctctctctctcctctttcttctctctctctctctcctctgtcttctctctctccctctctctcctctctctctcttctctctctatctccctttcttgactcacacataggcccccagggccctaaagcagtgatgcttga

SEQ ID NO: 4654 - DNA, 258 bp, Homo sapiens
  D3S3691
  Located on chromosome 3
  Distance between a terminus base of telomere on chromosomal short arm and 5'-terminus of this base sequence : 10609812
  Distance between 3'-terminus of neighbour sequence of sequence listing upward to telomere on chrosomal short arm and 5'-terminus of this base sequence : 60660
ttgaaaccagggtgacaaatacatctactcctatggaccaaatcaaatttattgcctggtacattgtgttgaggatagggaggactcatccagtctcaacaagaaagaatgcttacagatggattagcaatttctgccctggctgccgtgtgtgtgtgtgtgtgtgtgtttgtgtgtgtgtgtgtgtgtgtgtgtggatagcggtagtctacagtgccagaatgcaaattgcatgcctgatgtttgctattgctgaga

SEQ ID NO: 4655 - DNA, 432 bp, Homo sapiens
  AC024169.2_147991
  Located on chromosome 3
  Distance between a terminus base of telomere on chromosomal short arm and 5'-terminus of this base sequence : 10612767
  Distance between 3'-terminus of neighbour sequence of sequence listing upward to telomere on chrosomal short arm and 5'-terminus of this base sequence : 2697
caagtaacctgtgctaacttaaagataagtattataatctctagaacagccattaaaaagaacataaacaggtacaactaaaatgtcaatataggagataaaatcaggtacagctaaaatgtcaatataggagataaaatcaaatacaagacacacacacacacacacacacacacacacacacaatttgcccaaaggaaggaagggaaaaaatagaggaaagcagaataaataaggcaaaaagaaaataaataccaatataggagacttaaaatcaactatatatcataatatacatatacatatacatatacatatacatatacatacacatatatttaatcctttttgtacaaaaggattaaaactcccaccatgactgagtggggtttgtcccagtaatgcaaagttggtttaatatttgacaatcag

SEQ ID NO: 4656 - DNA, 209 bp, Homo sapiens
  HUMUT5872
  Located on chromosome 3
  Distance between a terminus base of telomere on chromosomal short arm and 5'-terminus of this base sequence : 10672146
  Distance between 3'-terminus of neighbour sequence of sequence listing upward to telomere on chrosomal short arm and 5'-terminus of this base sequence : 58947
tctcagcccccataatcaagcaagccaattccttataatgaatctcagcatctaactatctatctgtctgtctgtctatctatctatctctctatctatctgtctatcatctacctatctatctatctatgcatccatccatccatctatcctatttgttccatttctctggagaaccctgactaataaactctcccacctggaaaaaa

SEQ ID NO: 4657 - DNA, 250 bp, Homo sapiens
  AC008151.1_143036
  Located on chromosome 3
  Distance between a terminus base of telomere on chromosomal short arm and 5'-terminus of this base sequence : 10679030
  Distance between 3'-terminus of neighbour sequence of sequence listing upward to telomere on chrosomal short arm and 5'-terminus of this base sequence : 6675
ggaaagttgaaagcagtatctaaatccaaggcattaaagtggccacgctatcaaaatctttggcccactaagttcacttttaagaatttgtcttacagattcacacacacagaaagacacacacacacacacacacacacacacacacaatgtgcatacatatatatacatatgtatattttagctatatttataatagaaaaagattggaaatctaaaaatatctcagtaggaaactggttcaaacaat

SEQ ID NO: 4658 - DNA, 195 bp, Homo sapiens
  DISO7_10585102
  Located on chromosome 3
  Distance between a terminus base of telomere on chromosomal short arm and 5'-terminus of this base sequence : 10882596
  Distance between 3'-terminus of neighbour sequence of sequence listing upward to telomere on chrosomal short arm and 5'-terminus of this base sequence : 203316
ccagatcatgaagtccacacagaggaaaacaaaccagaagtgggagagagactgattctcaaaggtggatggatggatggatggatggatggatggatggatggatggatggattggaaagagtggggaaggaaggtaggaagagaaggaaggagggaaaagggtaaaatgggggaggcatagttctactgcctc

SEQ ID NO: 4659 - DNA, 109 bp, Homo sapiens
  D3S2405
  Located on chromosome 3
  Distance between a terminus base of telomere on chromosomal short arm and 5'-terminus of this base sequence : 10882625
  Distance between 3'-terminus of neighbour sequence of sequence listing upward to telomere on chrosomal short arm and 5'-terminus of this base sequence : -166
caaaccagaagtgggagagagactgattctcaaaggtggatggatggatggatggatggatggatggatggatggatggatggattggaaagagtggggaaggaaggta

SEQ ID NO: 4660 - DNA, 408 bp, Homo sapiens
  AC066583.2_118097
  Located on chromosome 3
  Distance between a terminus base of telomere on chromosomal short arm and 5'-terminus of this base sequence : 10952404
  Distance between 3'-terminus of neighbour sequence of sequence listing upward to telomere on chrosomal short arm and 5'-terminus of this base sequence : 69670
tacatcaggctgagtgatttatgtttctgaaaaccacgttaagttattacccatgacctcatcctggcaactttgcaaattcttgccaattgatttttggaaaagagagaaagaaacaagaaggatctgacttcaggggtgtgtgtgtgtgtgtgtgtgtgtgtgtgtgtgtgtgtgtgtgtgtgtgttcttttctttttaaccttgtaagactctgcaaagattttcaaagcaaatttcaatccattccacaacagggactgagattagattttccaggaggtcagccagcagggcctggttgtttgaatgagcttcatttttatggtgcacatcaagcaacccctttcggtcatcactatcaattcctgttgtcagctggtcaagtttccaaataaactcttcagg

SEQ ID NO: 4661 - DNA, 97 bp, Homo sapiens
  DISO7_10565125
  Located on chromosome 3
  Distance between a terminus base of telomere on chromosomal short arm and 5'-terminus of this base sequence : 11105642
  Distance between 3'-terminus of neighbour sequence of sequence listing upward to telomere on chrosomal short arm and 5'-terminus of this base sequence : 152830
gttgcattgaaattgctattgaagctttcgtgtgtgtgtgtgtgtgtgtgtgtgtgtgtgtgtgtgtgtgtgtgtttgggagggcatccttctcctc

SEQ ID NO: 4662 - DNA, 166 bp, Homo sapiens
  D3S1597
  Located on chromosome 3
  Distance between a terminus base of telomere on chromosomal short arm and 5'-terminus of this base sequence : 11134766
  Distance between 3'-terminus of neighbour sequence of sequence listing upward to telomere on chrosomal short arm and 5'-terminus of this base sequence : 29027
agtacaaatacacacaaatgtctctccctgtgtatctaacacacacacacacacacacacacacttattcatatatgcataccactgaaaaaaaggtttaaattatgataaaagaaaaacttcagcggaattaaatttaaaagagtttgagcaatgaacgatttgc

SEQ ID NO: 4663 - DNA, 112 bp, Homo sapiens
  DID22N_0019914
  Located on chromosome 3
  Distance between a terminus base of telomere on chromosomal short arm and 5'-terminus of this base sequence : 11224596
  Distance between 3'-terminus of neighbour sequence of sequence listing upward to telomere on chrosomal short arm and 5'-terminus of this base sequence : 89664
tctagcttcttcgggtggggggaggcggggtgtgtgtgtgtgtgtgtgtgtgtgtgtgtgtgtgtattatttatttatttttttaagttaattggcctcttccagcaaagag

SEQ ID NO: 4664 - DNA, 198 bp, Homo sapiens
  chr3.fa.O7frz.13809964
  Located on chromosome 3
  Distance between a terminus base of telomere on chromosomal short arm and 5'-terminus of this base sequence : 11528513
  Distance between 3'-terminus of neighbour sequence of sequence listing upward to telomere on chrosomal short arm and 5'-terminus of this base sequence : 303805
tgagtggatagatccatatgagaatagacaagggaatgaatggaatggagagggctggctagccggatggataaaataatactgttgtatagatgggtggaaaatgaagaaaaatggcaagtagacaagtgggtggatggatggatggatggatggactgatggatggatgagtgggtaagtggatagctgcataaga

SEQ ID NO: 4665 - DNA, 358 bp, Homo sapiens
  AC026196.3_20799
  Located on chromosome 3
  Distance between a terminus base of telomere on chromosomal short arm and 5'-terminus of this base sequence : 11750057
  Distance between 3'-terminus of neighbour sequence of sequence listing upward to telomere on chrosomal short arm and 5'-terminus of this base sequence : 221346
cagtgagctatgatcatgtcattgcctgggaaacagagcgagaccctgtcactaaaaataaataaataaataaataaataaataaataaataaataaataaaaggtctgtaaaatctaattgttccacaagaggaaattggttaagtaaatgtcagttttatgacaaaatattatgtcattaaaattaattttcttctccaaaaatgtttactgatatgcagagcagaaaatattatcttgttttttttgtttttttgtcttttttattgatcattcttgggtgtttctcccagagggggatttggcagggtcataggacaatagtggagggaaggtcagcagataaacaagtgaaca

SEQ ID NO: 4666 - DNA, 168 bp, Homo sapiens
  DISD22_0002506
  Located on chromosome 3
  Distance between a terminus base of telomere on chromosomal short arm and 5'-terminus of this base sequence : 12002967
  Distance between 3'-terminus of neighbour sequence of sequence listing upward to telomere on chrosomal short arm and 5'-terminus of this base sequence : 252552
tcaggtctagcttgagttgggagtgtgtgtgtgtgtgtgtgtgtgtgtgtgtgtgtgtgttgtgtgttgtgtgtgactgtgtatggcctggagggccaaacccagggattaggagggaaaggaaaagagagggcgcggaaagctgtgtttgtccctgatagagccagc

SEQ ID NO: 4667 - DNA, 226 bp, Homo sapiens
  DISO7_00000024
  Located on chromosome 3
  Distance between a terminus base of telomere on chromosomal short arm and 5'-terminus of this base sequence : 12166634
  Distance between 3'-terminus of neighbour sequence of sequence listing upward to telomere on chrosomal short arm and 5'-terminus of this base sequence : 163499
atgaccatgctgtcaacagaaaatgccaggaacccagctctgccccctcaggccctgggcatggggagctctcatccttgtcctcgtctgctcatcctcttgacttagaactacttgtcctttcctttgtgcgtgtgtgtgtgtgtgtgtgtgtgtgtgtgtgtgtggcaaccaggcaaaggccctgaggcagggaggcagaaaacctgttctaatctgggttcac

SEQ ID NO: 4668 - DNA, 135 bp, Homo sapiens
  DISD22_0002528
  Located on chromosome 3
  Distance between a terminus base of telomere on chromosomal short arm and 5'-terminus of this base sequence : 12555728
  Distance between 3'-terminus of neighbour sequence of sequence listing upward to telomere on chrosomal short arm and 5'-terminus of this base sequence : 388868
gaagcttgttcagttacgtccttttcattttcccacaaaagaaaacatgcagtagagagaggggagagggggagagagagagaaagagagacagagagagaggagagagtgtttctagaatggagaggagtttgg

SEQ ID NO: 4669 - DNA, 468 bp, Homo sapiens
  AC012600.10_140290
  Located on chromosome 3
  Distance between a terminus base of telomere on chromosomal short arm and 5'-terminus of this base sequence : 12662191
  Distance between 3'-terminus of neighbour sequence of sequence listing upward to telomere on chrosomal short arm and 5'-terminus of this base sequence : 106328
agcataagatttggtcaaactaaccttgctttgccacccactagctgagcgactcagtttctctgtctgtagaatggggatttcaccatcaagtgcctagaactgttgcagggatttaatgagatgacaatctgtttttcaaacagcagccaggtgtgtgtgcgtgcgtgtgtgtgtgtgtgtgtgtgtgtgtgtgtgtgtgtctcagccctgcataagatgctcctatgtcaggatcagccccaaattccacagggtgatctacaaagcaccaaaagatcaggcccctctctacttcttccacatcatctacctctctccccttcacacattttgctgcagtcacaacagctggagtctttaaacgtgcccagtatgttctcacctcaggatcttcgcactggctgactcctttgctgggactgctcttccccagatggtggcatcttgaacatcacctactagcaa

SEQ ID NO: 4670 - DNA, 468 bp, Homo sapiens; identical to SEQ ID NO: 4669
  AC008000.7_12346
  Located on chromosome 3
  Distance between a terminus base of telomere on chromosomal short arm and 5'-terminus of this base sequence : 12662191
  Distance between 3'-terminus of neighbour sequence of sequence listing upward to telomere on chrosomal short arm and 5'-terminus of this base sequence : -468

SEQ ID NO: 4671 - DNA, 271 bp, Homo sapiens
  D3S3594
  Located on chromosome 3
  Distance between a terminus base of telomere on chromosomal short arm and 5'-terminus of this base sequence : 12785990
  Distance between 3'-terminus of neighbour sequence of sequence listing upward to telomere on chrosomal short arm and 5'-terminus of this base sequence : 123331
caatgggctcatcgcagccctggaaaaatcctgactcagtctgaccattcctggttcctttgctccttcctgtttctctttttgtcttcttgtgcttctcatacacatatacatatacacacatacacacacacacacacacacacacacatatatacacatatatgcataaatatatatatacatgtatatatatatatatatgacaggaaaaaatatatatcgtgtgtgtgtgtgtaaaatttttttttatctggcccactattccaag

SEQ ID NO: 4672 - DNA, 257 bp, Homo sapiens
  D3S3601
  Located on chromosome 3
  Distance between a terminus base of telomere on chromosomal short arm and 5'-terminus of this base sequence : 12802876
  Distance between 3'-terminus of neighbour sequence of sequence listing upward to telomere on chrosomal short arm and 5'-terminus of this base sequence : 16615
cagttaccttgatagactggtagtgagacacacacacacacacacacacacacacacacacacacacacacacacacacttttcatttaccaatgagacactgaggcaaacataaatgacactgcccaggagtccagggcctgggcttctcattttgcttttgaaactcactccccagactcggatgagttgtctcccttctctgggcctccatttccccatgtgtaaaacaagagtgggtgagtcaactaattctc

SEQ ID NO: 4673 - DNA, 295 bp, Homo sapiens
  AC018499.2_99764
  Located on chromosome 3
  Distance between a terminus base of telomere on chromosomal short arm and 5'-terminus of this base sequence : 12819081
  Distance between 3'-terminus of neighbour sequence of sequence listing upward to telomere on chrosomal short arm and 5'-terminus of this base sequence : 15948
agatgcttaaatacgcactcacacaacaacaacaacaacaacaacagcaaggcaaagatgaggcatgtcacaaggacgcaaacgccagcttgtaaggactcccagtggccaaatctgggatgatgtgagcaccaaaataattaatacggtaattaactataagtctctggggaacaaaaccctgaattcatgagttcacatagaagagtggatgcatctgtggatccatgggagagaacggagagctcttgcttgaaggagcatgcagaggcctgtttgataaacgtggaatgct

SEQ ID NO: 4674 - DNA, 295 bp, Homo sapiens; identical to SEQ ID NO: 4673
  AC018502.4_22922
  Located on chromosome 3
  Distance between a terminus base of telomere on chromosomal short arm and 5'-terminus of this base sequence : 12819081
  Distance between 3'-terminus of neighbour sequence of sequence listing upward to telomere on chrosomal short arm and 5'-terminus of this base sequence : -295

SEQ ID NO: 4675 - DNA, 475 bp, Homo sapiens
  AC025266.1_119037
  Located on chromosome 3
  Distance between a terminus base of telomere on chromosomal short arm and 5'-terminus of this base sequence : 12907748
  Distance between 3'-terminus of neighbour sequence of sequence listing upward to telomere on chrosomal short arm and 5'-terminus of this base sequence : 88372
agtaacagatgacaaattatccacaacaaattgataaaggataatagctttaaagagcagataaaaataagtaagaaacactaagacatcctcactagaaaaatgagcaaaggctatgtgaacaaaagaggcattataaatggcttgtatatacttgaaaaaaaaatttaaaacttgatagtagtgaaacatgttagaaatttaaagcaatgagaaaccagttttaccaagcaaattgataaagatttaataacaaataataggaactttttcttttggccacagtggagtaacagtgaccagcttctttctctctctctctctcgctctctcttacacacacacacacacacacacacacacccccccacccacacacacatcaccttaaaaaagaaaaacagacaaaattatataaaacaatggtttccagttattggacaacaggagcacagtacagtgatctctgagtgga

SEQ ID NO: 4676 - DNA, 241 bp, Homo sapiens
  D3S3589
  Located on chromosome 3
  Distance between a terminus base of telomere on chromosomal short arm and 5'-terminus of this base sequence : 12983769
  Distance between 3'-terminus of neighbour sequence of sequence listing upward to telomere on chrosomal short arm and 5'-terminus of this base sequence : 75546
tctgagccaccagcacatagcacattgcttggcacatggtagacacacaatagtcattgctggttttaggggcaactgggggcttgctctgagatgaaggtattagattaccaggaaaatttcttttaaagttcccccattattgtgtgtgtgtctgtgtgtgtgtgtgtgtgtgtgtgtgtgtgtgtgtgtgtgtgtgtgtgatgggtcacaataaagaaagtggtagaaaatattgctt

SEQ ID NO: 4677 - DNA, 262 bp, Homo sapiens
  AC023471.3_158257
  Located on chromosome 3
  Distance between a terminus base of telomere on chromosomal short arm and 5'-terminus of this base sequence : 13063210
  Distance between 3'-terminus of neighbour sequence of sequence listing upward to telomere on chrosomal short arm and 5'-terminus of this base sequence : 79200
tgataggtggacagatggatagatgaatgataaatggataatgaatgggcagatggatagatagatgcatggatggatgatgaatggatggatggttaatgaatggatgatggatgataaatggatgatggatggatggatggatggatggatggatggatggatggtggatgccatatagtgattcagataaaggaacatagacaatcagagaagaacaacattattttcagtcacatgtcctggaaaagactttatgaaa

SEQ ID NO: 4678 - DNA, 314 bp, Homo sapiens
  AC022379.1_58038
  Located on chromosome 3
  Distance between a terminus base of telomere on chromosomal short arm and 5'-terminus of this base sequence : 13206605
  Distance between 3'-terminus of neighbour sequence of sequence listing upward to telomere on chrosomal short arm and 5'-terminus of this base sequence : 143133
cgacagttgagctgagacttaaatgatgagaaagagccagccagagaaagatctggggaaagagagcagagtaggtgcaaaagccctgaggcatttgagggacgagggaagccagagtggtggaggcagagggagtgaggcagtgggtgggagacgaagaaccagcccatgcggaccttgcaggccaagacatttgggtgggatgggatgggatgggatgggatgggatgggattggatggcatgggattggattagatctctctctgcttatttatgtgttatattattgtctcatttaagtcctgaaaggtt

SEQ ID NO: 4679 - DNA, 411 bp, Homo sapiens
  AC024910.1_107185
  Located on chromosome 3
  Distance between a terminus base of telomere on chromosomal short arm and 5'-terminus of this base sequence : 13241403
  Distance between 3'-terminus of neighbour sequence of sequence listing upward to telomere on chrosomal short arm and 5'-terminus of this base sequence : 34484
agaactcctaacctcatgatctgccccctttggcctcccaaagtgctgggattacaagcatgatccactgtgcctggccgggaaattttttaaagaatttccatttgcagtttgaaggagcccaactgggaaagggaaacaccctgactgttttggtgtggacactttgggggcttgtttgttgctgtagtagttggattgtgttctggtgattgtgtgtgtgtgtgtgtgtgtgtgtgtgtgtcatgggaaattagacttcagtaaacttgatattcttttgaaatactttcggccccaatattgtttgaaatgtggagtttgctgttgaatgggagagtgagatggagtccatgtatccaggcttttgtgctgctgttctaagtagggttggtcttggttagtatgtga

SEQ ID NO: 4680 - DNA, 429 bp, Homo sapiens
  chr3.fa.O7frz.16405594
  Located on chromosome 3
  Distance between a terminus base of telomere on chromosomal short arm and 5'-terminus of this base sequence : 13295000
  Distance between 3'-terminus of neighbour sequence of sequence listing upward to telomere on chrosomal short arm and 5'-terminus of this base sequence : 53186
cattctgcctatcacagtatcttttcctttgctcattctttatttcttttattttgtatttatttatttatttatttatttatttatttatttatttattttttgagatggagtctcactctgtcgtccaggctggagtgcagtggcgcaatctcagctcactgcaagctccgcctcccaggttcacgccattctcctgcctcagcctcctgagtagctgggactacaggcacccgccacatgcccggctaattttttgtatttttagtagagacggggtttcactgtgttagccaggatggtctcgatctcctgacctcgtgatccgcccgcctcggcctcccaaagtgctgggattacaggcgtgagccatcgcgcccggcctcctttgctccattctttcaacaagtatccattagctttgtagca

SEQ ID NO: 4681 - DNA, 460 bp, Homo sapiens
  AC026194.2_129783
  Located on chromosome 3
  Distance between a terminus base of telomere on chromosomal short arm and 5'-terminus of this base sequence : 13356730
  Distance between 3'-terminus of neighbour sequence of sequence listing upward to telomere on chrosomal short arm and 5'-terminus of this base sequence : 61301
tggaatcctacaatatgtaatgtctgtgagtggtttttgtcacttagcataatgtttttaaggttgatctacaccgtagcatgtgttggtactttacttgtatttattgctgaataatatttcattgtatagataaaccacattttggttatttattcatcagttgacagatatttggattgtttctactttttggctattataaataatgctgctatgaacaagtttctgtgtggacatacacttctctcaggcatacacacacacacacacacacacacacacacacacacacacacacacacacacggccaggcgcagaggttcatgcctgtaatctcagcactttgggaggctgaggcaggaggatagcttgagcccaggagttcaagaccagcctgggcaatatggcaaaatcccatctgtacaaaaagtacaaaaattagctaggcctagtggc

SEQ ID NO: 4682 - DNA, 460 bp, Homo sapiens; identical to SEQ ID NO: 4681
  AC024166.2_58021
  Located on chromosome 3
  Distance between a terminus base of telomere on chromosomal short arm and 5'-terminus of this base sequence : 13356730
  Distance between 3'-terminus of neighbour sequence of sequence listing upward to telomere on chrosomal short arm and 5'-terminus of this base sequence : -460

SEQ ID NO: 4683 - DNA, 273 bp, Homo sapiens
  chr3.fa.O7frz.16549975
  Located on chromosome 3
  Distance between a terminus base of telomere on chromosomal short arm and 5'-terminus of this base sequence : 13414039
  Distance between 3'-terminus of neighbour sequence of sequence listing upward to telomere on chrosomal short arm and 5'-terminus of this base sequence : 56849
ggtcagaaagtaagagataactgagctgggcttttaatgctgcctttgtttgtttgtttgtttgtttgtttgtttgttttgccatttagtgataatatccttcagtttccctttcctgcacttagctttaaaaatcccagcctgtcacaccagggctgggggttgtggggagcagacaaacaatcaaacaagttcaatctcttaaaccaaattataaaatgagaaagatcacagatgtgcgggaggaaagggtttgatgtagctcagtcattc

SEQ ID NO: 4684 - DNA, 447 bp, Homo sapiens
  chr3.fa.O7frz.16827497
  Located on chromosome 3
  Distance between a terminus base of telomere on chromosomal short arm and 5'-terminus of this base sequence : 13606865
  Distance between 3'-terminus of neighbour sequence of sequence listing upward to telomere on chrosomal short arm and 5'-terminus of this base sequence : 192553
acagttacctgaagtcaacataatgttttttaataatagctttattgagttataattcacataccataaaacacaccattttggctgggcgcagtggctcacgcctgtaatcccagcacttttgggaggccgaggtgggtggatcacttgaggtcaggagtttgagaccagcctagccaacatggcgaaaccttgtctctactaaaaatacaaaattagctgggtgtggtggcatgtgcctgtaatcccagctactcgggaggctgaggcaggagaatcacttgaacccgggaggtggaggctgcagtgagctgagattgtgctgttgcactccagcctgcaagggcggggggaaaaaaacaaccacacacaacacacacacacctttttaaagtgtgcagttcagtggtttttagtatattcacagagttgtgcaaccattaccac

SEQ ID NO: 4685 - DNA, 456 bp, Homo sapiens
  AC026185.2_87331
  Located on chromosome 3
  Distance between a terminus base of telomere on chromosomal short arm and 5'-terminus of this base sequence : 13651557
  Distance between 3'-terminus of neighbour sequence of sequence listing upward to telomere on chrosomal short arm and 5'-terminus of this base sequence : 44245
attcctatacctgctaggtcagttttaagctaaaatgatcttgcaaaacctgttgacccattgataccctgtaccctaagtaggcagttggtattatttcttaactttggttcgtctatgtccatctctctgtctctgagacacacacacacacacacacacacacacacacacacacaccccctcccagagtccgagcattctagagtttcctaacagtgcagttgtcctgtctgaaatgtttacattggggaaaaaatgaacccctgctgtgattttatttccccacaggctctaggggtcttttcatagccgcaaggcatcatcacagcttcccaaggactagggtgtttatgtgtgcacagaaaccacactgcaaagggtcaggtcctctcctttgtaccctaaggtgtagagaaagctggacctcaaaactgatgtcacctgtaagaacag

SEQ ID NO: 4686 - DNA, 231 bp, Homo sapiens
  D3S1263
  Located on chromosome 3
  Distance between a terminus base of telomere on chromosomal short arm and 5'-terminus of this base sequence : 13651606
  Distance between 3'-terminus of neighbour sequence of sequence listing upward to telomere on chrosomal short arm and 5'-terminus of this base sequence : -407
ctgttgacccattgataccctgtaccctaagtaggcagttggtattatttcttaactttggttcgtctatgtccatctctctgtctctgagacacacacacacacacacacacacacacacacacacacaccccctcccagagtccgagcattctagagtttcctaacagtgcagttgtcctgtctgaaatgtttacattggggaaaaaatgaacccctgctgtgatttta

SEQ ID NO: 4687 - DNA, 283 bp, Homo sapiens
  AC026051.4_11754
  Located on chromosome 3
  Distance between a terminus base of telomere on chromosomal short arm and 5'-terminus of this base sequence : 13837059
  Distance between 3'-terminus of neighbour sequence of sequence listing upward to telomere on chrosomal short arm and 5'-terminus of this base sequence : 185222
cactcagcaggctggtaacgcagaaagaacgatccacattgaaaactgagtcatcatgagaaaggctccatcacagacaatgcaaataaggtacaggacaaaggaaggaaaggaatattgccaagaaaaggtcaatgaagacacaccagacagccagagagattatgctggaaagaattggaaagttatgaaccaacatttttccttttatttatttatttatttatttatttatctatttatttatttatttatttttgagaggaagtcttattctattgcc

SEQ ID NO: 4688 - DNA, 126 bp, Homo sapiens
  D3S3680
  Located on chromosome 3
  Distance between a terminus base of telomere on chromosomal short arm and 5'-terminus of this base sequence : 13860502
  Distance between 3'-terminus of neighbour sequence of sequence listing upward to telomere on chrosomal short arm and 5'-terminus of this base sequence : 23160
gcctggtccctaacataactttcttccaaataactggccaactgtttcaacctttttctgtgtgtgtgtgtgtgtgtgtgtgtgtaaacagaaaagtaaaatttctattttcatttgcaattcctt

SEQ ID NO: 4689 - DNA, 392 bp, Homo sapiens
  AC026051.4_72899
  Located on chromosome 3
  Distance between a terminus base of telomere on chromosomal short arm and 5'-terminus of this base sequence : 13912988
  Distance between 3'-terminus of neighbour sequence of sequence listing upward to telomere on chrosomal short arm and 5'-terminus of this base sequence : 52360
gcttaccttaaccagagaccactcctgttgtctataacccagaaccctggcttaatcttaagtaatttccagacacccacccccacctgccccccgcattaaagaacagaaattcctgttggcttacattattattattattattattattattattattattattatcattattattttgagacagagtttcactcttgttgcccaggctggagtgcaatggcacgatctcggctcactgcatcctccgcctcccaggttcaagcgattctccttcctcagcctccagagtagctgggattacaggcacccaccaccacgcccagctaattttgtatttttagtagagatggggtttctccatgttggtcaggttggtctcgaactcctga

SEQ ID NO: 4690 - DNA, 289 bp, Homo sapiens
  AC026051.4_111821
  Located on chromosome 3
  Distance between a terminus base of telomere on chromosomal short arm and 5'-terminus of this base sequence : 13957510
  Distance between 3'-terminus of neighbour sequence of sequence listing upward to telomere on chrosomal short arm and 5'-terminus of this base sequence : 44130
agccaagatcataccactacactccagcctgggtgaaaaagtgggactccatctcaaaataataataataataataataataataataataataataataatcatacaaataagagacccaggtttttgtcccagtcgtcaacaaattggtgtgaccttggaagtcacagcctgcctgggttgactcatcccaccggtaaggtgaaggagtttagatggttttaaagtttcctattaattctgacatatcatgcatgtatcatctcttctgatgtagctcattctagga

SEQ ID NO: 4691 - DNA, 369 bp, Homo sapiens
  chr3.fa.O7frz.17995255
  Located on chromosome 3
  Distance between a terminus base of telomere on chromosomal short arm and 5'-terminus of this base sequence : 14034846
  Distance between 3'-terminus of neighbour sequence of sequence listing upward to telomere on chrosomal short arm and 5'-terminus of this base sequence : 77047
tttacttcgctgatgtatttcttcttcacgcatacacacgcacacacacacacacacacacacacacacacacacagtttaaaatctaagccagattttaaagactgtataactcataataattttctaaatgaatttttttaatttacaaaaatagaaacaaaaatttttaagacatatgattctatttacatgacattttagaaaagtccattacatgactataaagggacagatggcagcttttcggtttgccagaaatggtggttacataactgtataaatttgccaaaacttattgaaagacatacttgtaaataatacattttattgtatataaattatgtcgataaacttaatgttttcaaa

SEQ ID NO: 4692 - DNA, 399 bp, Homo sapiens
  chr3.fa.O7frz.17480827
  Located on chromosome 3
  Distance between a terminus base of telomere on chromosomal short arm and 5'-terminus of this base sequence : 14363537
  Distance between 3'-terminus of neighbour sequence of sequence listing upward to telomere on chrosomal short arm and 5'-terminus of this base sequence : 328322
ctgctagaaatcaccttcaatcaggtctcctcctacagatattttgtgatgggatttggtttttttttgttagtttgtttttggtttttgtgtgtgtgtgtgtgtgtgtgtttggttaaaggagtggttagggttcactggagaagggaggaaagagggaagtgaaagtctaaagtttagctagaaattcaacccccttccctttcttcctgggaagtggcactacggcagagtcactgtcccttctctagtcttgtactagcttaaggttttggtttgtttattttaaaccctgtctcccactcttttttccattccttttctttgtgtgtgtttctttctttgtaaaaaaaaatttttaatctttctgcctctgactcacagttcagagtatgcaat

SEQ ID NO: 4693 - DNA, 338 bp, Homo sapiens
  chr3.fa.O7frz.17912969
  Located on chromosome 3
  Distance between a terminus base of telomere on chromosomal short arm and 5'-terminus of this base sequence : 14439395
  Distance between 3'-terminus of neighbour sequence of sequence listing upward to telomere on chrosomal short arm and 5'-terminus of this base sequence : 75459
ctccagcactacaatggaccgtcttgagtttggcttgggaattaaacaaattctctctctctctctctctctctctctctctctctctctcacacacacaccccatgattagactctacatgtttgaccctgactcagttctgtttcctttcccagcatccttgaacttggcaaagtggcaaaggtggggaagagctgagtcaccaaagataaagtataattcaagtaacccatcagtaaatcataaagatttagttgtatgttaaattgttactaggcccaaagagtcagactttgagaaaagattttgagctgttatactttggatcattcagaaa

SEQ ID NO: 4694 - DNA, 266 bp, Homo sapiens
  AC027126.3_156268
  Located on chromosome 3
  Distance between a terminus base of telomere on chromosomal short arm and 5'-terminus of this base sequence : 14538340
  Distance between 3'-terminus of neighbour sequence of sequence listing upward to telomere on chrosomal short arm and 5'-terminus of this base sequence : 98607
gagtgagctaagataatgccactgtactccagcctgggcaacagagtgagacttcgtctcaaaaataaataaataaataaataaataaataaataaaacgaacaacaacaacaaaatacagtcatgtcatctgtaagtaatgttagttttagttttatttcttcttttccaattattctttgtctttttcctttgttgcattggatggatttccagtacagtggtgagtagaagtaatgatagtatcattaccttgttgctgatct

SEQ ID NO: 4695 - DNA, 394 bp, Homo sapiens
  AC027126.3_144330
  Located on chromosome 3
  Distance between a terminus base of telomere on chromosomal short arm and 5'-terminus of this base sequence : 14657484
  Distance between 3'-terminus of neighbour sequence of sequence listing upward to telomere on chrosomal short arm and 5'-terminus of this base sequence : 118878
ctcctttaggcaggagttatagtgctgttggctgcgagttcagtgttgatgaatcaacatatgtaaggtgtctttaaacagaaacacatgaagtgaggttatatattgaccagttgatgaaaatgctgtgaccagagactcacagacacctaaccttgtatcttgtatttctcctggaaacatggttcagtatttactaattcagtgtttgtggcaactttatagaacagaattacctcaaataatgagaatgaactacacagttgatatatgtgtgtgtgtgtgtgtgtgtctgcgtatatatatatatatatatgtagatgcagatgtattgtaataaaattaagtccttatctattagagatacctactgaaatatcatggatgaagttat

SEQ ID NO: 4696 - DNA, 436 bp, Homo sapiens
  AC034198.4_105708
  Located on chromosome 3
  Distance between a terminus base of telomere on chromosomal short arm and 5'-terminus of this base sequence : 14955069
  Distance between 3'-terminus of neighbour sequence of sequence listing upward to telomere on chrosomal short arm and 5'-terminus of this base sequence : 297191
catagacctaaatgcgaaacataaaactataaaatatgtagaggaaaatataagagaaaatcaacgtgagcttggatttggcgatgagtttttagacacaacattaaaagcatgattcatgaaagaaaaaataagttggactttatttcttttgtttgtttatttatttatttatttattgagacggagtctcgctctgttgacagactggagtgcagtggcacgagctcgactcactgcaacctctgcctcctgggttcaagtgattctcctgcctcagcctcccgagtagctgggactacaggcatgcgccatcatgcccagctaatttttgtatttttagtagagacgaggtttcaccatgttggccaggatggtctcgacctcttgacctcatgatccgcctgcctttgcctcctaaagtgctggaattaca

SEQ ID NO: 4697 - DNA, 261 bp, Homo sapiens
  D3S3693
  Located on chromosome 3
  Distance between a terminus base of telomere on chromosomal short arm and 5'-terminus of this base sequence : 14959094
  Distance between 3'-terminus of neighbour sequence of sequence listing upward to telomere on chrosomal short arm and 5'-terminus of this base sequence : 3589
agcaatgacaccccagtaggaacaattatatctagcagccaaaacttgatttctaatactattctccagtaaaaggaaccagggatacttggagaaatggctgatcttcaggaaatacgcaagatgagcctgaagcatcttctaatgccagtaaataaggaagtgctcaaacacacacacacacacacacacacacacacacacacacacacacacatgatcagggtatgtcaaaggaacacaggaaccaactgaaagagt

SEQ ID NO: 4698 - DNA, 277 bp, Homo sapiens
  AC018836.2_63120
  Located on chromosome 3
  Distance between a terminus base of telomere on chromosomal short arm and 5'-terminus of this base sequence : 14962986
  Distance between 3'-terminus of neighbour sequence of sequence listing upward to telomere on chrosomal short arm and 5'-terminus of this base sequence : 3631
aaggaacatagaagccaacttgaaggagctctcaatgggcaaaccaagagcaatttgagcaacaaaataaatcgtatgttattggattgtaacccaaagtacagaatgaatatacaggagaccatatgtttatttattgatttttaatttattattattattattattattattattattattattattattattatacctctgaactttttattggcctcctgctccccaaagggtaccctgcttctgctggcttaatgtctcagaactttggtgt

SEQ ID NO: 4699 - DNA, 251 bp, Homo sapiens
  D3S3610
  Located on chromosome 3
  Distance between a terminus base of telomere on chromosomal short arm and 5'-terminus of this base sequence : 15140027
  Distance between 3'-terminus of neighbour sequence of sequence listing upward to telomere on chrosomal short arm and 5'-terminus of this base sequence : 176764
ccagattctctaaggccatgccaattaattcttcaagagccttaatggcctctaaactcattacaatttgcttttgaggacaaacaataaatcacattcaacagcatttgagcatactccccctacacacacacacacacacacacacacatgcttccatgggagatctctcccaaggcctccggtggtgtttgagcccatctgggctgtgcatcatcttgcccctgtgcttactgggcggatattccaca

SEQ ID NO: 4700 - DNA, 461 bp, Homo sapiens
  AC022377.1_60399
  Located on chromosome 3
  Distance between a terminus base of telomere on chromosomal short arm and 5'-terminus of this base sequence : 15140065
  Distance between 3'-terminus of neighbour sequence of sequence listing upward to telomere on chrosomal short arm and 5'-terminus of this base sequence : -213
gccttaatggcctctaaactcattacaatttgcttttgaggacaaacaataaatcacattcaacagcatttgagcatactccccctacacacacacacacacacacacacacatgcttccatgggagatctctcccaaggcctccggtggtgtttgagcccatctgggctgtgcatcatcttgcccctgtgcttactgggcggatattccacatgtcatcataattcaaaggaaatttacaaaacaggaagcaagaaaatccagcgggtcattggtgcctgggaagagcagagtgctgacctggacaaacatggcatttgactggagtcccgaggatggccagctgtgcagtggccttcagacatccacattctcagagcactccatgaagcagtgttatcattccctttcacagaaggggaaacaggcttggaggggtgtggtaacttgcatacactcac

SEQ ID NO: 4701 - DNA, 299 bp, Homo sapiens
  AC011599.8_156889
  Located on chromosome 3
  Distance between a terminus base of telomere on chromosomal short arm and 5'-terminus of this base sequence : 15200094
  Distance between 3'-terminus of neighbour sequence of sequence listing upward to telomere on chrosomal short arm and 5'-terminus of this base sequence : 59568
tcatccatggattcattaatccattcacatatccatctatcatcttccttcctatcatccattcatttatcccctcatccacccatccatccatctgttccctcacccgcacatacacccatccatcactccatccatccatccatccatccatccatccatccatccatccatccacccatttatccacccacccatccactcatccacccatctgtccatccatccacccatccatccatctgtccatccattcacccatccacatatcatacgttgtctgcatatcattgtaaatt

SEQ ID NO: 4702 - DNA, 417 bp, Homo sapiens
  chr3.fa.O7frz.19188271
  Located on chromosome 3
  Distance between a terminus base of telomere on chromosomal short arm and 5'-terminus of this base sequence : 15213805
  Distance between 3'-terminus of neighbour sequence of sequence listing upward to telomere on chrosomal short arm and 5'-terminus of this base sequence : 13412
gtacttaatgccactgaattgtacaatggttaagatggtggattttaattctatgtgtattttaccacaagtaaaacttttaaaaaagcaacttgcaatttataatactatgatctaaagtttaaaaacatgtaaaaccatcttttgttttagcaacgctgtaaaaatatgcatggcaacagatgaatggataaagaaaacttggtatatatatgaatatatatataagtatatataagtatgtataaaaatatatagaaatatataaggatatataaatatacaagtatatatatgtgtgtgtgtgtgtatatatatatatatatatatatatatatatatataaaatgaagtactattcagccataaatgatatccagccatttgcaaccacatggatggaactggaggtcatga

SEQ ID NO: 4703 - DNA, 256 bp, Homo sapiens
  D3S2403
  Located on chromosome 3
  Distance between a terminus base of telomere on chromosomal short arm and 5'-terminus of this base sequence : 15306754
  Distance between 3'-terminus of neighbour sequence of sequence listing upward to telomere on chrosomal short arm and 5'-terminus of this base sequence : 92532
acagaatgagaccatgtgtcaaaaaaaaaaaagaaaaataagcaataaaggaaggaaggagggaaagaaggaaagaaagagagagagaaagaaaagaaggagggaaggaaggaacggaagggaaggaaggaaggaaaggaaggaaggaaggaaggaaggaaggagggagggaaggtgaaatctcaaaccataattttgtatttgtctatttctctttgctgtcctgtcaattttgccttcatgtattttgagtgtg

SEQ ID NO: 4704 - DNA, 244 bp, Homo sapiens
  chr3.fa.O7frz.19643740
  Located on chromosome 3
  Distance between a terminus base of telomere on chromosomal short arm and 5'-terminus of this base sequence : 15526239
  Distance between 3'-terminus of neighbour sequence of sequence listing upward to telomere on chrosomal short arm and 5'-terminus of this base sequence : 219229
caatacattacctaaaatgtccagtttccaacaattataggacatgaaaaaacaaaacaaaacaaaacaaaacaaaacaaaacaaaacaaaaaacaaaacaaaacaggaaaacatgacccgtactccagaaaaaaggcagatgacagaaactgtctgtgagggccaccagagatcagattcaccaggcaaagccttccaaccaaacaacgatgaagggagtaaaggaagatttgataacaatct

SEQ ID NO: 4705 - DNA, 330 bp, Homo sapiens
  AC066597.3_155286
  Located on chromosome 3
  Distance between a terminus base of telomere on chromosomal short arm and 5'-terminus of this base sequence : 15625796
  Distance between 3'-terminus of neighbour sequence of sequence listing upward to telomere on chrosomal short arm and 5'-terminus of this base sequence : 99313
agatttgagcagatattcactatgaaaattacatgggtgacatcctggctaacacggtgaaaccttgtctctactaaaaataaaataaaataaaataaaataaaataaaataaattagccaggtgtggcgggcacctgtagttccagctacttaggaggctgaggaaggagaatggcgtgaacccgggaggtggagattgcagtgaacctagatcgcgccactgcactccagcctgggcgacagagcgaggctccgtctcaaaaaaaagaaaatcacatgggtgacatgaaaagatactcaacatcattagtcatcaaagaaatgcaaat

SEQ ID NO: 4706 - DNA, 209 bp, Homo sapiens
  AC068319.3_58952
  Located on chromosome 3
  Distance between a terminus base of telomere on chromosomal short arm and 5'-terminus of this base sequence : 15625796
  Distance between 3'-terminus of neighbour sequence of sequence listing upward to telomere on chrosomal short arm and 5'-terminus of this base sequence : -330
agatttgagcagatattcactatgaaaattacatgggtgacatcctggctaacacggtgaaaccttgtctctactaaaaataaaataaaataaaataaaataaaataaaataaattagccaggtgtggcgggcacctgtagttccagctacttaggaggctgaggaaggagaatggcgtgaacccgggaggtggagattgcagtgaacc

SEQ ID NO: 4707 - DNA, 350 bp, Homo sapiens
  HUMUT442
  Located on chromosome 3
  Distance between a terminus base of telomere on chromosomal short arm and 5'-terminus of this base sequence : 15788027
  Distance between 3'-terminus of neighbour sequence of sequence listing upward to telomere on chrosomal short arm and 5'-terminus of this base sequence : 162022
aggaccctgttgacagggtctagaaacgtttagaatccccttttctgtctttatgtttgaccctggactagttctcttttcttttcttttttcttttattttccttttcttttcttttattttcctttctttctttctttctttctttctttctttctttctttctttcttttctttctttttctttctgtctgtctgtctctctgtctgtctgtctgtctttctttcttgacggagtctcgctctgtcacccaggctggagtgcagtgatgccatctcagctcactgcaagctccgcctcccaggttcatgccattctcctgcctcagcctcccgagtaggtgggacta

SEQ ID NO: 4708 - DNA, 149 bp, Homo sapiens
  chr3.fa.O7frz.19786170
  Located on chromosome 3
  Distance between a terminus base of telomere on chromosomal short arm and 5'-terminus of this base sequence : 15811169
  Distance between 3'-terminus of neighbour sequence of sequence listing upward to telomere on chrosomal short arm and 5'-terminus of this base sequence : 22792
atcctcaaagtttctcaagaacccatttctaagaccttttgtcctccagggtgcctgtgggttacacacacacacacacacacacacccacacacacccctaccccacccctgcttctctgagctttcgtgaatggtatctattcatat

SEQ ID NO: 4709 - DNA, 455 bp, Homo sapiens
  chr3.fa.O7frz.21424039
  Located on chromosome 3
  Distance between a terminus base of telomere on chromosomal short arm and 5'-terminus of this base sequence : 15993231
  Distance between 3'-terminus of neighbour sequence of sequence listing upward to telomere on chrosomal short arm and 5'-terminus of this base sequence : 181913
aagtcacgtgactacactcaagtccctaagaagatacagtacacacacacacacacacacacacacacacacacacacacacacacaccggaaatgcaaacggacacatattagaacacccccagcctgctggaggacagctttctaggctgaggctctgggtgtagctggacccaaagcaaagtggcctcacttgaacctctctctgctgcttggccttgggagcaggatatccaggaagccccgctgggcccggctgctcatcggcccctcaccccatctgctttgggtcacctcacctgaggactacatctcaccttccaggacacgcaggcaatggctagtgtcttggtgaggtgtggggctccctgaactggcctctgctgcaggatgacggtcaagtccctgtgaggggcacgatgaccacccaccacagtgactcatttcgaagctac

SEQ ID NO: 4710 - DNA, 126 bp, Homo sapiens
  D3S3602
  Located on chromosome 3
  Distance between a terminus base of telomere on chromosomal short arm and 5'-terminus of this base sequence : 16060415
  Distance between 3'-terminus of neighbour sequence of sequence listing upward to telomere on chrosomal short arm and 5'-terminus of this base sequence : 66729
atcagaaaataacagagggcattatgcataaggttccaactgtgtgtgtgcgtgtgtgtgtgtgtgtgtgtgtgtgtgtgtgtgtgtattggatgtgtatgtgtatacattttgggttaggatttt

SEQ ID NO: 4711 - DNA, 128 bp, Homo sapiens
  D3S1585
  Located on chromosome 3
  Distance between a terminus base of telomere on chromosomal short arm and 5'-terminus of this base sequence : 16076078
  Distance between 3'-terminus of neighbour sequence of sequence listing upward to telomere on chrosomal short arm and 5'-terminus of this base sequence : 15537
ttggactgctgaggggcactgtgtgtgtgtgtgtgtgtgtgtgtgtgtgtgtgtgtgtctaggcatgctctcaacacttggagaggcagttcatgaccctgtcttagattttacttctggctcgtgca

SEQ ID NO: 4712 - DNA, 442 bp, Homo sapiens
  chr3.fa.O7frz.21771689
  Located on chromosome 3
  Distance between a terminus base of telomere on chromosomal short arm and 5'-terminus of this base sequence : 16408980
  Distance between 3'-terminus of neighbour sequence of sequence listing upward to telomere on chrosomal short arm and 5'-terminus of this base sequence : 332774
cctttaatcctagcactttgagaagccgaggcaggcggattgcctgagctcaggagttcgagaccagcctgggcaacatggtaaaacccccgtttctattaaaaatacaaaaaattagctgggtgtggtggtgcatgcctgtaatcccagctacatgggaggctgaggcacaagaatgtcttgaacccaggaggcaaaggttgtagtgagctgagatcatgccactgcactcctgccttagtgacagatgagactctgtctcataaaagaaagaaaaagaaagaaagaaagaaagaaagaaagaaagaagaaagaaagaaagaaagaaagaaagaaagaaagaaagaaagaaagaaagaaagaaagaaagaaagaaaagggcagtgatgggcagaccatgtctgtcctgttcttcacaatgtcattataacctaacatggtc

SEQ ID NO: 4713 - DNA, 131 bp, Homo sapiens
  D3S1554
  Located on chromosome 3
  Distance between a terminus base of telomere on chromosomal short arm and 5'-terminus of this base sequence : 16502152
  Distance between 3'-terminus of neighbour sequence of sequence listing upward to telomere on chrosomal short arm and 5'-terminus of this base sequence : 92730
ggcaaaccaaagactgggaaacaatattgactctgcgtgtgtgtgtgtgtgtgtgtgtgtgtgtgtgtgtgtcacaaagggtttatttgagaacatataaataactacaaatgaacagtaacaagatgaat

SEQ ID NO: 4714 - DNA, 168 bp, Homo sapiens
  DISO7_10009466
  Located on chromosome 3
  Distance between a terminus base of telomere on chromosomal short arm and 5'-terminus of this base sequence : 16578860
  Distance between 3'-terminus of neighbour sequence of sequence listing upward to telomere on chrosomal short arm and 5'-terminus of this base sequence : 76577
agagtcgcctgctcagtcccgctggcggggctgttattgtttccccggcaaaagggctccggctcttggtgcgggcggcaggagagtgtgtgtgtgtgtgtgtgtgtgtgtgtgtgtgtgtgtgtgtgtgtggcatatctgtgtgcctgtctccgtcaggatgcctac

SEQ ID NO: 4715 - DNA, 270 bp, Homo sapiens
  D3S3595
  Located on chromosome 3
  Distance between a terminus base of telomere on chromosomal short arm and 5'-terminus of this base sequence : 16776724
  Distance between 3'-terminus of neighbour sequence of sequence listing upward to telomere on chrosomal short arm and 5'-terminus of this base sequence : 197696
aaattcaaatgtggggcacctcctggcattgaggaaggcattggccttctctcaagagatgtgttcagtgtgggcaaagccattgttggtgtcacaagactctcatgcctcatacatgtcacacacatgccttgtacacacccacatgcatctcaaacatgccacccacatagacacaccatccacccgcctcacccatctctctctctcacacacacacacacacacacacacgaacacacacacgaggcagggggtgtcaagagcaag

SEQ ID NO: 4716 - DNA, 309 bp, Homo sapiens
  AC011320.11_36260
  Located on chromosome 3
  Distance between a terminus base of telomere on chromosomal short arm and 5'-terminus of this base sequence : 16872044
  Distance between 3'-terminus of neighbour sequence of sequence listing upward to telomere on chrosomal short arm and 5'-terminus of this base sequence : 95050
aggcttgcaaatactatcctataactcattattttaagctgataacaacttcacactgtttgcataaacaaagaaacaagcaaagagaaaactaataaaactctacaccttaacttcatccccccacattttaactttttgttgtttctatttatatcttattgtacgatatcttgaaaagttgttgtgctatcattattattattattattattattattattattattttgagacggagtcacgctctgtcactcaggctgcagtgcggtggcacgtctcggctgactgcaacctctttctactgag

SEQ ID NO: 4717 - DNA, 281 bp, Homo sapiens
  AC011320.11_85268
  Located on chromosome 3
  Distance between a terminus base of telomere on chromosomal short arm and 5'-terminus of this base sequence : 16896219
  Distance between 3'-terminus of neighbour sequence of sequence listing upward to telomere on chrosomal short arm and 5'-terminus of this base sequence : 23866
gacttggcaagtcatagttcagtgctttcagggtgctggagggaactagtctccagactgcagggtgtgaggaagaaactcaaaaggaagttaagcgtagacccctgggcaagcaactggaatagtagaaagaaatggaaggagcaaagcagagagtggttgttgttgttgttgttgttgttgttgttgttgttgttgttgttgttgtttttggttcagaggcatcctgggggtatttgtagataaggggatattgtaggtcaaggacattgaagactgag

SEQ ID NO: 4718 - DNA, 393 bp, Homo sapiens
  AC025163.15_92176
  Located on chromosome 3
  Distance between a terminus base of telomere on chromosomal short arm and 5'-terminus of this base sequence : 17037524
  Distance between 3'-terminus of neighbour sequence of sequence listing upward to telomere on chrosomal short arm and 5'-terminus of this base sequence : 141024
tctgactcatggaaaccaccccctgcttggcttgaggcagagcccccaggttctgtgatgcccagcagcgtctgatgctggggagaccacagcagcagcagcaggagctgagggtgcccaccttgccctccccaggtcccgcaggcttgctggacaggctgagctcttggggccaaatcccagcagccctggaatgcccctgaagaagttaagccaggggacagcatgatcagattgggttttgagatggtcattatggccactgggtggagaacagattgggtgacagccagggtgaagtcagagagctcaggaaggcaccagttacaaatgttcaggcaggaggtggcctggccagcagaggctgtgctagagatgctagatgtatggttg

SEQ ID NO: 4719 - DNA, 422 bp, Homo sapiens
  chr3.fa.O7frz.22438525
  Located on chromosome 3
  Distance between a terminus base of telomere on chromosomal short arm and 5'-terminus of this base sequence : 17159036
  Distance between 3'-terminus of neighbour sequence of sequence listing upward to telomere on chrosomal short arm and 5'-terminus of this base sequence : 121119
attacgctgtagtgctatcaaatattagatcttatttattgtatctaactatattttgtacccattaaccatccccgccactacccttcctagcctcggataaccatcattccattctctatctccatgagttcgattgtcagatgctctttttttttatgatctgagatgatcatatgatttctcttttttgatcaggtaatgtgaattagcttgactttgtaatattaaacccatcttgtattctgcagttaatctcaacttgataggttaatctggattatactctttatacacacacacacacacacacacacacacacacattcttagtttgctaacattttgtttagggattttgcatctgtgttcatgagtgagattaacttttaatttttcttaaatttatgctagcctcataa

SEQ ID NO: 4720 - DNA, 297 bp, Homo sapiens
  chr3.fa.O7frz.22628737
  Located on chromosome 3
  Distance between a terminus base of telomere on chromosomal short arm and 5'-terminus of this base sequence : 17213014
  Distance between 3'-terminus of neighbour sequence of sequence listing upward to telomere on chrosomal short arm and 5'-terminus of this base sequence : 53556
agttaagatttgttcacaaatgagctttagttttgttttttgttgtgttattgttttttgtttgtgtgtgtgtgtgtgtgtgtgtgtgtgtgtttttgttttttgtagagacagagtctcatgatgttgctcaagctggtctcaaactcctggcctcaagcaggcctcctgccttggcctcccgaaatattgggactagagaggcacgagccaccacaactggccagttttatttttaactgagtataatactaatactgccagtaaaatattgtcatgaggattaaatgaaataac

SEQ ID NO: 4721 - DNA, 364 bp, Homo sapiens
  AC024185.4_57570
  Located on chromosome 3
  Distance between a terminus base of telomere on chromosomal short arm and 5'-terminus of this base sequence : 17371313
  Distance between 3'-terminus of neighbour sequence of sequence listing upward to telomere on chrosomal short arm and 5'-terminus of this base sequence : 158002
atgaagctggaaaccataattctcagcaaactaacacaggaacagaaaaccaaacactgcatgttctcattcataaggtggagttgaataatgtgaatacatggacacagggtggggaacatcatacaccagggcctgttgcggggtggggggctaggggaaggagagcattaggagaaatacctaatgtagacgacgggttgatgggtacacccaaccaccatggcacatgtatacctatgtagcaaacctgcacattctgcacatgtatatcccagaacttaaagtataataaaataaataaataaataaataataaaaacacaaaaaatcataatggatggttactctgctcactacctag

SEQ ID NO: 4722 - DNA, 224 bp, Homo sapiens
  Z67446
  Located on chromosome 3
  Distance between a terminus base of telomere on chromosomal short arm and 5'-terminus of this base sequence : 17472062
  Distance between 3'-terminus of neighbour sequence of sequence listing upward to telomere on chrosomal short arm and 5'-terminus of this base sequence : 100385
aagatggggctcctggaggatacagaccaactgtatactccacagtggccactgcagacaaaggggagatgcttttctttgccaatcccctgacctgctataatcctcccacagtctcactccatacctcaaatggggaaatcatatacacacacacacacacacacacacacacccctatccaggtcagtaacaaagattctacttttgctcaaaacagccca

SEQ ID NO: 4723 - DNA, 385 bp, Homo sapiens
  AC027125.3_125501
  Located on chromosome 3
  Distance between a terminus base of telomere on chromosomal short arm and 5'-terminus of this base sequence : 17498733
  Distance between 3'-terminus of neighbour sequence of sequence listing upward to telomere on chrosomal short arm and 5'-terminus of this base sequence : 26447
agtagctcacgcctgtaatactagcactttgggaggctgcagtaggcgaatcatttgaggtcaggagttgaccagcctgaccaacatggcaaaacccggtctctaccaaaaacacaaaaattagccgggtgtggtggcacatgcctgtaatcccagctactcgggaggctaaggcacgaaaatcgcttgaacctgggaggcagtggttgcagtggcagagatcacatcattgcactccggtttttgagaccctgtctcaaataaataaataaataaataaataaataaataaataaagcagggctcactcagggaaactaattttcacattacagcaggcaggccacagcgcaacgccctgctgatccagtgactacaaagtcca

SEQ ID NO: 4724 - DNA, 457 bp, Homo sapiens
  chr3.fa.O7frz.22987193
  Located on chromosome 3
  Distance between a terminus base of telomere on chromosomal short arm and 5'-terminus of this base sequence : 17575269
  Distance between 3'-terminus of neighbour sequence of sequence listing upward to telomere on chrosomal short arm and 5'-terminus of this base sequence : 76151
tcttactcaaggtccaagaatcctcttggggtctggattgggatccctttccggtaacaattgtgccactgcactccagcctgggtgacgggagtgagatggtgtctcacagaaagaaaaagagagagagagagttccaggagaaattgtgtgtgtgtgtgtgtgtgtgtgtgtgtgtgtgtgttggaggctggggcggggggcggttggggggtagtcctagaagtgttagatgttagggaatcattaaataaatagttcaagtaagtaaatttccccaaactaaagaataaacatttccaaaatcatagcagccatggagagtgcagcccaaaaggtgaaaatatccccatccaaggtacctcaccatgacattcagggaccaggggactggaatgttggggctcagaacaccaccccaaaatatgactgtggaagacgagaattaatgtcacct

SEQ ID NO: 4725 - DNA, 447 bp, Homo sapiens
  chr3.fa.O7frz.23110132
  Located on chromosome 3
  Distance between a terminus base of telomere on chromosomal short arm and 5'-terminus of this base sequence : 17686512
  Distance between 3'-terminus of neighbour sequence of sequence listing upward to telomere on chrosomal short arm and 5'-terminus of this base sequence : 110786
gtagagactgtagtgagccgtgattgccacagcactccagcctggtgacagagtgagacaaggagggaaggggacaggatgggaggggacaggatgggaggggacaggaggggaggggaacagaggggaggggaggggaatggaggggaggggaggggagaaagagaccaagagagaggaagggaggaagggaggaagggagggagagaggaaggaaagaaggaaggaaggaaggaaggaaggaaaccaaaacaaagatcacatggccaagatctctcagctaatgggttacggagactcactcaaatccagagctgtgtgaatgggaactccatgccttttactctcacataatgggttctcagtgccaatgctcagaagagaaatacacgccaagaccccttctttgtgtgggtgctaattctgtaaatttgcaaatagcatgtt

SEQ ID NO: 4726 - DNA, 455 bp, Homo sapiens
  chr3.fa.O7frz.23333136
  Located on chromosome 3
  Distance between a terminus base of telomere on chromosomal short arm and 5'-terminus of this base sequence : 17903140
  Distance between 3'-terminus of neighbour sequence of sequence listing upward to telomere on chrosomal short arm and 5'-terminus of this base sequence : 216181
ttctagatgccattaagaacatacctggccaggtgcggtgcctcacgcctgtaatcccagcactttgggaggccaatcacctgaggtcagcagttcgagaccagcctggccaacatggtgaaaccctgtctctactaaaagtacaaaaattagccaggtgtggtggcgggtgcctgtaatcccagctacttgggaggctgaggcaggagaatcacttgaacacaggaggcagaggctgcagtgagccaagatcacaccactgcactccagcctgggcaacaaagcgaaactctgtcaaaaaaaaaaaaaaaaaaaaaaaaaagaaagaaagaaagaacatttctgattcatgggaggaggtcaaagtattattattaacaggagtttggaagaagttgattccaaccctcatggatgactgagggattcaagacttcagcgaaggaaataactac

SEQ ID NO: 4727 - DNA, 339 bp, Homo sapiens
  chr3.fa.O7frz.23529447
  Located on chromosome 3
  Distance between a terminus base of telomere on chromosomal short arm and 5'-terminus of this base sequence : 18064750
  Distance between 3'-terminus of neighbour sequence of sequence listing upward to telomere on chrosomal short arm and 5'-terminus of this base sequence : 161155
aattacgtagtgagctcactagattatttactgttggagaacaatgactgtgttactgttttactttttaagaccagcaaccattttatagtggggacacaatgaatgttgattggatatgaaattctaaatgccaatattttatcccagatctgactccaaagcccaagttcctgtgcacacatacatgctctcttctttctctctctcttgctctctctctctctctcattctctctcttactcttttactttctcacactctctctgctgtatgtgtgtgtgtgtgtgtgtgtgtgtctatagtgtatgtgtttctacagtggacatgctattgac

SEQ ID NO: 4728 - DNA, 258 bp, Homo sapiens
  chr3.fa.O7frz.23623706
  Located on chromosome 3
  Distance between a terminus base of telomere on chromosomal short arm and 5'-terminus of this base sequence : 18122073
  Distance between 3'-terminus of neighbour sequence of sequence listing upward to telomere on chrosomal short arm and 5'-terminus of this base sequence : 56984
ttacaactcaataaaggctcagatgattgttagcatgtttttagcaataaagtatttttaagttaagctatatactttttttagacataatgctatcgcacatttaatagactatggtattatatatatatatatatatatatatatatatatatacatgtatagtgtaaacataacttttatatgcactgggaaaataacaaatttgtatgactcactttattgtgatatttgctttaatagagtgatctggacttg

SEQ ID NO: 4729 - DNA, 383 bp, Homo sapiens
  AC027445.3_87981
  Located on chromosome 3
  Distance between a terminus base of telomere on chromosomal short arm and 5'-terminus of this base sequence : 18313042
  Distance between 3'-terminus of neighbour sequence of sequence listing upward to telomere on chrosomal short arm and 5'-terminus of this base sequence : 190711
actgctatggactgaactaaaatacatatcttgaagccctaacctctgatgtaatggtattatgagacagagcctttggaagatgaggaggtttagatgaggtcataagggtgaggccttcatgatgggattagtgcccttataagaagagacacaccaaataccagatctctctctctctctctctctctctccctccccccccataccccactgtctagcacgtgaggacacaagaagaaggcatctgtttacacaccaggaggagagacctcacaagaacccaatcatgatggcactttgatcttagaccgccagcctccagaacagtgagaaaataaatttctgttgtttatgctgtcctgtttaatggtattctgtta

SEQ ID NO: 4730 - DNA, 444 bp, Homo sapiens
  AC027445.3_125717
  Located on chromosome 3
  Distance between a terminus base of telomere on chromosomal short arm and 5'-terminus of this base sequence : 18327470
  Distance between 3'-terminus of neighbour sequence of sequence listing upward to telomere on chrosomal short arm and 5'-terminus of this base sequence : 14045
gtgaagacaataactttccagaagctacttaaccagttctcatagtgatgtaaggacatatctctgtaacaaatctttaaaaaatgtgtctatgtatctatctatctatctatctatctatctatctatatctatctgtatctatctatcatctatctatctatatctatctatctatctatctatctatctatctatctatctatctatcatctatctatcatctatcatctcccagtggctctgcttctatggttgaatcctgacccctggctggtacaggtaccctgccaccttctgggagcctagccattggcatcttcctccttctgtgttgcagaaaatgccagatgttggccaattccctaggtgctgcctctgtgaacactgccattcaaattgtaagctccttcggacagtctctattctatgtgcaggtggaag

SEQ ID NO: 4731 - DNA, 328 bp, Homo sapiens
  AC027445.3_163734
  Located on chromosome 3
  Distance between a terminus base of telomere on chromosomal short arm and 5'-terminus of this base sequence : 18361471
  Distance between 3'-terminus of neighbour sequence of sequence listing upward to telomere on chrosomal short arm and 5'-terminus of this base sequence : 33557
accttaaggaatcagcgtagacagtgcagaatgtgtggaggaactgatggatcgcatgtttttcaaataaccttccatcattgtccctttatgactctgaatccagaacattctgctcgcactgtagtccaagatggtgatagacagacagatagatagatagatagatagatagatagatagatagatagatgatagattatagcaatatactatcagctatttgccgtgtaactttaaacaggtcatttaagctctctgggctctagtttcctcatcttaaaaatgggaaagtgtgtccatgatctagtgctgtataacgcacctt

SEQ ID NO: 4732 - DNA, 278 bp, Homo sapiens
  Z66782
  Located on chromosome 3
  Distance between a terminus base of telomere on chromosomal short arm and 5'-terminus of this base sequence : 18379256
  Distance between 3'-terminus of neighbour sequence of sequence listing upward to telomere on chrosomal short arm and 5'-terminus of this base sequence : 17457
ccctgggaagccctttgtgattaagagacattctagtttcctgtgcccttcccctctcctcttttcctctcctgtctgtctctgcctctctacctctctcacggtctttgtctctctctgtctcttggtcactcattctctctctctctctctctctctcacacacacacacacacacacacacacacacacacacacacacacagtgggcctctgatcctggtgtgttactggcttgccttcctctttgggttccatctcttctgcgtgatgtgacc

SEQ ID NO: 4733 - DNA, 414 bp, Homo sapiens
  chr3.fa.O7frz.23961246
  Located on chromosome 3
  Distance between a terminus base of telomere on chromosomal short arm and 5'-terminus of this base sequence : 18508357
  Distance between 3'-terminus of neighbour sequence of sequence listing upward to telomere on chrosomal short arm and 5'-terminus of this base sequence : 128823
ttctgatacctacattatctccacggttcccaggttgcatgtgacagagatggggaactagggatcttaccacgccacgttaggattttaaaccagtaccctggttttctgctctgcagttcacatcccccaacctcccatcccatggtgatttatgctttgaaaaccaaagcttttcttgggttctgcaagaaacaaatggcacccttctcgtccaggttgtagcttccttcattttgctaaattagttagattcctctatctactttccatctatctaaaaatttgttgaaatcactcatcttctactttatcttcttctaatctttttgttcttgtgggcatcgatttatctacctacctacctacctacaattgaacctcattattcttggtagctatgttctgtaaagt

SEQ ID NO: 4734 - DNA, 417 bp, Homo sapiens
  AC061706.7_34177
  Located on chromosome 3
  Distance between a terminus base of telomere on chromosomal short arm and 5'-terminus of this base sequence : 18521449
  Distance between 3'-terminus of neighbour sequence of sequence listing upward to telomere on chrosomal short arm and 5'-terminus of this base sequence : 12678
tgactgcttgaacaggaacgtccatcttctgcccttgttgctcctggttctcagggcttgggacctggactggagtccacaccatcagctgctagctctcaggcctctgaaccataccactggctttcctgggtctccagcttgcagatagcagactgtgggactcctcagcctccataatcacatgagccaaaaccttataataaatctctgtgtgtgtgtgtgtgtgtgtgtgtgtgtgcgcgcgcgcgtgcgcgcacgcgcacatgtgcatgtgtatgtgtataatctcctactggttctgttttactggagaaccctaatacacttctttcttgttgttctgtggcatacactgaatattttaaaccgcatttgtcacaggattttgaaaacgtgatcatttgtttcatcctc

SEQ ID NO: 4735 - DNA, 385 bp, Homo sapiens
  chr3.fa.O7frz.24038215
  Located on chromosome 3
  Distance between a terminus base of telomere on chromosomal short arm and 5'-terminus of this base sequence : 18585772
  Distance between 3'-terminus of neighbour sequence of sequence listing upward to telomere on chrosomal short arm and 5'-terminus of this base sequence : 63906
ggtctggaactcctgatctcaggtgatccgcccgccttggcctcccaaagtgctgggattacagacatgagccactgtgcccagacgcagaatatttttttttttttttaaaaagaatcattgggtctttaatgaagccccagattctttcccgaaagtaacgtcaaaaaggcactgatgaaaaatggtttatggaaactactcaagtaatatatacatatccacatcatagtaagacctctaagatgtagcatcatgtaaaacacatcattatagaatgatgggtttggtacaatacagcttacatgttatacacacacacacacacacacacacacacacacacacacacacacacaaactctcactccagtaatgtctatgt

SEQ ID NO: 4736 - DNA, 391 bp, Homo sapiens
  AC010727.3_160916
  Located on chromosome 3
  Distance between a terminus base of telomere on chromosomal short arm and 5'-terminus of this base sequence : 18602378
  Distance between 3'-terminus of neighbour sequence of sequence listing upward to telomere on chrosomal short arm and 5'-terminus of this base sequence : 16221
taacataatgcatttgtacttcacttatggtccgcaaagatttcctttctttgaaggccatcctttgaatgtcttttaaaagaaaaagaagagtgaaaaataatggacatctattcttgtggcaaatcactgttattttggcaatgaaaggatcgtgtgtgtgtgtgtgtgtgtgtgtgtgtgtgtgtgtgtctgttccattacttgaggtctgtgctatgtggctgcattattaagatatacttttggtactgataaatacgtaaaccaaagacagatctatctcataatgaatttatggtcctttagtaaaagattgtagcaaaattccagggcatggttttatcccactcaattcatgcaaaatctattgagcaatatctattcaagg

SEQ ID NO: 4737 - DNA, 349 bp, Homo sapiens
  AC010727.3_30456
  Located on chromosome 3
  Distance between a terminus base of telomere on chromosomal short arm and 5'-terminus of this base sequence : 18656754
  Distance between 3'-terminus of neighbour sequence of sequence listing upward to telomere on chrosomal short arm and 5'-terminus of this base sequence : 53985
tttgctttgacagataacagtcatcagcaaggaatttcattttactgaaggcaggcttagttgctgaaatttactgcttgggttacacacatatgcacatgcacacacacacacagacacacacacacacacacacacacacacacacctgagcccattttcatacaagactgagtagtgttgcttcttggtctggatttagagtagctgggaaaacagcatgaagagtttttacattcagaaaggaatgcaaaggaatgtaaagaatgccttccttccttttaaatctaatcttattactcccattagtgaatatttaacaataacactaacgctaatagcagacttg

SEQ ID NO: 4738 - DNA, 316 bp, Homo sapiens
  AC010139.4_83494
  Located on chromosome 3
  Distance between a terminus base of telomere on chromosomal short arm and 5'-terminus of this base sequence : 18785335
  Distance between 3'-terminus of neighbour sequence of sequence listing upward to telomere on chrosomal short arm and 5'-terminus of this base sequence : 128232
cagtgaaaggtatctgagtacattagaatcatgtggggaactttaaaaaatttatatgcccatgcctcgccccaaaccaattaaatcagctgagggcaaggctcataagtcagtgtgtgtgtgtgtgtgtgtgtatatatatatatatatatatatatataaatgtttctctagttactccagtatgcagccatatttgaaaatcggtgctatagagccttgctactcaaagtgtgatcctcagatcagcagcttcacatcacgtgagtgctgtagaatctcaggccccaccctaaacctactgaatcagaatctg

SEQ ID NO: 4739 - DNA, 437 bp, Homo sapiens
  AC010139.4_115357
  Located on chromosome 3
  Distance between a terminus base of telomere on chromosomal short arm and 5'-terminus of this base sequence : 18817119
  Distance between 3'-terminus of neighbour sequence of sequence listing upward to telomere on chrosomal short arm and 5'-terminus of this base sequence : 31468
tcctgtatcagtgagcttagactgccataacaaaataccatagactgggtggtttaaacaacagaaatttattttttcagagttctgaaggctggaagtctgagatcaggatgccagcatggtagggttctggtgaaggctgtcttccaggttgcagatggctgctttcctgctgtgttcttatatgtcagagagtgagagacagagagagacagagagagagagagagagagagagagagagagacagagagagaaagttcacaagttctctgatgtctcttcttgcaagtatactaatcctatcatgagggtctcgtcctcatgaccttgtctgaatctgaatatctctcaaaggcccaccttcaaataccattatattaggggttgaggcttcaacatgagaattttgggaggtcataattctgtccatagcac

SEQ ID NO: 4740 - DNA, 485 bp, Homo sapiens
  AC010139.4_118033
  Located on chromosome 3
  Distance between a terminus base of telomere on chromosomal short arm and 5'-terminus of this base sequence : 18819869
  Distance between 3'-terminus of neighbour sequence of sequence listing upward to telomere on chrosomal short arm and 5'-terminus of this base sequence : 2313
acttggaaaggatttataccatcggctctttgggtttccagcttgctgatcacagatcttgggacttgttagccttcataatcatgtgagccaatttcttataatacacctctctctctttctctttgtctctctccaaacacacacacacacacacacacacacacacacacacacacacacacacgcacacacaccttatattgcttctgtttctctggagaaccctaatacgtaactcctccatgcatatcctgtgagtacctttataaagtgtcaacttggcaaggctaaactacattttccacagatttcttccctgtatgtttaaggtgggccgcaagagatatttggcctaggatttggaagcagtggcaatattgcttttatgtgcagggggcagagtcaggggttgcaggggtggttgttgtagaggcaccaggtgctggttgcagctcacacatcttgtcactatctgttggctc

SEQ ID NO: 4741 - DNA, 200 bp, Homo sapiens
  chr3.fa.O7frz.24425719
  Located on chromosome 3
  Distance between a terminus base of telomere on chromosomal short arm and 5'-terminus of this base sequence : 18898176
  Distance between 3'-terminus of neighbour sequence of sequence listing upward to telomere on chrosomal short arm and 5'-terminus of this base sequence : 77822
cgttttcaaacagctattaactagaggaagaattgccaaaattagaaaaaatacatatataatacgtatttacacacacacacacacacacacacacacacacacacacacatatatgtatatatatatggtgcccagtttatactaaaaaaaaacctgtccattgtttatctctaattaaagtttaactgagtgtccag

SEQ ID NO: 4742 - DNA, 183 bp, Homo sapiens
  D3S2338
  Located on chromosome 3
  Distance between a terminus base of telomere on chromosomal short arm and 5'-terminus of this base sequence : 18983770
  Distance between 3'-terminus of neighbour sequence of sequence listing upward to telomere on chrosomal short arm and 5'-terminus of this base sequence : 85394
ctgtattgttttccaggataaggaatatggtgtgtgtgtgtgtgtgtgtgtgtgtgtgtgtgtgtgtgtgtgtgttgtgttgttatagttacccttttaagatacaggagaagatggccacagttcaccacaatgagactgacacttcttaggatttgggaattttgagaaactgctggcttc

SEQ ID NO: 4743 - DNA, 406 bp, Homo sapiens
  D3S2393
  Located on chromosome 3
  Distance between a terminus base of telomere on chromosomal short arm and 5'-terminus of this base sequence : 19035228
  Distance between 3'-terminus of neighbour sequence of sequence listing upward to telomere on chrosomal short arm and 5'-terminus of this base sequence : 51275
aatgtacatgcacacataaatgctattatataacataatatacctaatatattatacaaacttataattatgtatcatatataattatatattattatatattccatacatatatacacactgattttatatatctataaaatatatctgattttatatatttatctatagatatgatatatctatatctatctatctatctatctatctatctatctatctatctatctatctatctacctatcatcgagagagagaggagagagaaatgtttgccaggaaaataaaggggagaccagagggcagctagtaaagcattttgggtatttgggagagcgaaggggtttcaactagttgaatctaacaagcaaagtattgtattcagacactccacaatagaacccct

SEQ ID NO: 4744 - DNA, 471 bp, Homo sapiens
  chr3.fa.O7frz.24839987
  Located on chromosome 3
  Distance between a terminus base of telomere on chromosomal short arm and 5'-terminus of this base sequence : 19399380
  Distance between 3'-terminus of neighbour sequence of sequence listing upward to telomere on chrosomal short arm and 5'-terminus of this base sequence : 363746
cactagaagcatcgtaagttaaacccagatttgtccaaacttaaaagactacgctggcggggtgcggtggctcacacctgtaatcccaacactttgggaggccaaggctggtggatcacctgaggtcagaagttcatgaccagcttggctgacatggcgaaaccccatctctacaaaaaatatataaattagctgggcatggtggtgcgtgcctgtagtcccagctactcgagcagagtcaggagaatcacttgaaccctgtagtcccagctacttgggaagaagcaggagaaccctggaggcagaggttgcagtgagctgagatcgcaccactgccttccagcctgggtaacaacagagcaagactctgtctcaaaaaaacaaaacaaaacaaaacaaaacaaaacaaacaaacaaagaaaaaaagactatgccaatatatataattaaatttaaatttctgaatcctgc

SEQ ID NO: 4745 - DNA, 418 bp, Homo sapiens
  chr3.fa.O7frz.25013182
  Located on chromosome 3
  Distance between a terminus base of telomere on chromosomal short arm and 5'-terminus of this base sequence : 19555595
  Distance between 3'-terminus of neighbour sequence of sequence listing upward to telomere on chrosomal short arm and 5'-terminus of this base sequence : 155744
tacacctgtatgacaaaggtattaaaattatgatttaaattaaagattataaattaggcacactaagattaacaacaattaataagaatagaacaattataacaatatagtgtaacaatattatgtgattgtggtttctctctctctctctctcaaaatatcttattgtaccatactcaactgtttttgaatgatggttgactgcaggtaactgaaaccacagaaagtgaaactgcaggtaagggcgaactactgtactgtactgtactgcaggtaagaatggacactgtacagctgtgactgtgtatgtgtgtgtgtgtgtgtgtgtgtgtgtgtgtgtgtgtgtgtgtgtatacacatccagatcctaccacaggcccagcacaaataaggtactcactacatattgactgaatga

SEQ ID NO: 4746 - DNA, 123 bp, Homo sapiens
  DISO7_10001082
  Located on chromosome 3
  Distance between a terminus base of telomere on chromosomal short arm and 5'-terminus of this base sequence : 21408644
  Distance between 3'-terminus of neighbour sequence of sequence listing upward to telomere on chrosomal short arm and 5'-terminus of this base sequence : 1852631
ttcatggccttgttatgggaaaagcactgtctgtctgtctgtatttatttatttatttatttatttatttatttatgtttttgctttatggttacaaaatgaatctgaggaagacgttagaaa

SEQ ID NO: 4747 - DNA, 122 bp, Homo sapiens
  HUMUT2094
  Located on chromosome 3
  Distance between a terminus base of telomere on chromosomal short arm and 5'-terminus of this base sequence : 21454401
  Distance between 3'-terminus of neighbour sequence of sequence listing upward to telomere on chrosomal short arm and 5'-terminus of this base sequence : 45634
ctttgactggaccatctcctatctatctatctatctatctatctatctatctatctatctatctatctatctatcatcagtcatctttttaaaagctccccttgggatactaacatgtaggc

SEQ ID NO: 4748 - DNA, 471 bp, Homo sapiens
  chr3.fa.O7frz.25291262
  Located on chromosome 3
  Distance between a terminus base of telomere on chromosomal short arm and 5'-terminus of this base sequence : 21472183
  Distance between 3'-terminus of neighbour sequence of sequence listing upward to telomere on chrosomal short arm and 5'-terminus of this base sequence : 17660
tgctcagtccaactagctatagtttataacccttataaatctgggtttccacctggctcagtctggaagccacatcttgttcaagggtcatattttcaaagccaaagttattaaaaaggaattctcttctctatttgaattttggaaatctgcagtaagaccaaaatacaacagtccatagcagctcttttcaatcaaccctctcattttacaatcattccggtgcctctcacctcaaatcacttagaaattcctctacctccaacatcttcctctctctctctctctctctctctctctctctctcgctttcagtactttgttatttaaattgcctttagtcatttttctttcttttttttttcttcttcttgcttatcttttctctactccccccgcccagttcttcatccaaaaagctcagggaactagttgggggaagatgaactcttcacagaaggtgtttaaaca

SEQ ID NO: 4749 - DNA, 466 bp, Homo sapiens
  AC055718.15_130542
  Located on chromosome 3
  Distance between a terminus base of telomere on chromosomal short arm and 5'-terminus of this base sequence : 21766005
  Distance between 3'-terminus of neighbour sequence of sequence listing upward to telomere on chrosomal short arm and 5'-terminus of this base sequence : 293351
ctcaccttgttagaagtcatacagcctcacttacacaacattctgttgtttacagctgatacttcccagattcaaggagaagagaattggacctcagcacctgattggaagaatgtccaagaacttgtagccattataatcttctgtatcattattattattattattattattattattatcattaccatttattgtggccagcttgttctggctgtggaagttcaccatatgtttgttgaattaacacaattgtgtatacatcaccccgttatcaattccattccagtcagttgccaagtcttatcttttctagccacaaatgttcctaatgtatacacaatgtctctagatatgttcaattttctcccttgttattggcccaaatcttgtgattcgtgcctgcattatttttcacctgcactcttgttatagatgctaactagtctcctgatttctaccttct

SEQ ID NO: 4750 - DNA, 277 bp, Homo sapiens
  AC055718.15_30326
  Located on chromosome 3
  Distance between a terminus base of telomere on chromosomal short arm and 5'-terminus of this base sequence : 21795377
  Distance between 3'-terminus of neighbour sequence of sequence listing upward to telomere on chrosomal short arm and 5'-terminus of this base sequence : 28906
ccaggaactatgtcagaaagtaagatggaggaaaccattaccaatttctattatatttttcaatgcacatcaagattcacacacacacacacacacacacacacaaacacacacacacacacacacaccctggtgagtacagaccctagccctctgccattccccagttcactaggcaaaccacttctgctttttccatttcaatgattactctttgtaaagctttctctttcaaaaaaaaaaaacccgatatgtacagatgttaagtgttgctctt

SEQ ID NO: 4751 - DNA, 369 bp, Homo sapiens
  AC055718.15_7589
  Located on chromosome 3
  Distance between a terminus base of telomere on chromosomal short arm and 5'-terminus of this base sequence : 21818092
  Distance between 3'-terminus of neighbour sequence of sequence listing upward to telomere on chrosomal short arm and 5'-terminus of this base sequence : 22438
gtgcaaactgaatggtatacagggggtctcaaacatttgtgttcttaaaaatcttgcctagctcattttgatacccctacccctctcccagcacacacacacacacacacacacacacacacacacaccccacaatcccttaggagttattgcataaaaagttaagttgttctgacccagatatttctagtcatttcaaatttgctacaaagatttactaaccaagttattacaagtcattatagtttgtctgatttttgaaaccaattggcacattagctgacaatagttgataaaactgctccaaatttccagtcactttggcacttctggaatgaatacgcacatctaatgaatacgactacatgg

SEQ ID NO: 4752 - DNA, 457 bp, Homo sapiens
  AC055826.2_110061
  Located on chromosome 3
  Distance between a terminus base of telomere on chromosomal short arm and 5'-terminus of this base sequence : 22017199
  Distance between 3'-terminus of neighbour sequence of sequence listing upward to telomere on chrosomal short arm and 5'-terminus of this base sequence : 198738
caagaaacatttctgtgaagacatgaaggaggtgaaacagtagaaaagcattatgaagtgctgccttaagcactcttaaaaaaagaaatttgttttcatagggaaatttgcatttatcttttacttaaattgctgaattattttgattagtcaaaattccaaattcacattaccccagcattgttccctaaaatatactgaagttattttacatcaatgtctacttcttttggaataatttatatcaatatatttgttcatgcctatctcagaatccaaaatgtaggtgcccctcttttaaaaagaaattatatatatatatatatatatatatatatatatatatatatatgtatgtatgtatgtatataaacaaaccaggtatcatacttctaaaaagataaatgcatcttcactcacatctcaacctgcactgtatttgaaatcataaagcttt

SEQ ID NO: 4753 - DNA, 408 bp, Homo sapiens
  chr3.fa.O7frz.26056217
  Located on chromosome 3
  Distance between a terminus base of telomere on chromosomal short arm and 5'-terminus of this base sequence : 22107500
  Distance between 3'-terminus of neighbour sequence of sequence listing upward to telomere on chrosomal short arm and 5'-terminus of this base sequence : 89844
actctgaaatgtacttacatggacacggttgtgatatctctattatggatcaaattcaagcacgtttagagaaatataaattctacatgttagtttcagcaaagggcatgagatattttggagacacacacacacacacacacacacacacacacacacagacacgcacatacagatacacacaagataacatgaatgtgaatatttctaagaataataccttgagtttttagtgacattttctgccttgtttacaagatgtattcttacaatataaatgtacaggaggttttctttaaaaattttgactttcttatgtagtgcttctgttgttgacagtaactccaactgcctcttgtttgtaactgaagttcatacaacagactatgagccaaagttagtgattaa

SEQ ID NO: 4754 - DNA, 475 bp, Homo sapiens
  AC061958.11_34697
  Located on chromosome 3
  Distance between a terminus base of telomere on chromosomal short arm and 5'-terminus of this base sequence : 22272112
  Distance between 3'-terminus of neighbour sequence of sequence listing upward to telomere on chrosomal short arm and 5'-terminus of this base sequence : 164204
gcttggtactacagatggaatatacagcttgatgatataaaataagctagatttataaacaaatatgggtgaaaattaggtatattataagctagtgttttgtatcaatggacaataaacaatacaaaaacaaccagcttttaaaaagtaagctggattctaactcacctcttcaaccaagatacaaatcccagaagaatcaaagatttagatgtgaaacacacacacacacacacacacacacacacacacacactctctctctctctctctctctctttctctctctctcataaaatccttgagtaaataattttttttttttgagacagagtgtcactctgtcacccaggctggagtgcagtggcgcaatctcagctcactgcaacctctgcctcccaggttgacacaagtctcatgtctcagcctcctgagtaggtggaattacaggcatgtacctccatactcagctaat

SEQ ID NO: 4755 - DNA, 177 bp, Homo sapiens
  chr3.fa.O7frz.27068713
  Located on chromosome 3
  Distance between a terminus base of telomere on chromosomal short arm and 5'-terminus of this base sequence : 22307827
  Distance between 3'-terminus of neighbour sequence of sequence listing upward to telomere on chrosomal short arm and 5'-terminus of this base sequence : 35240
gacaacattgaagactgaagatacggcatttgaaataagagaatggatgaaagttcaacttgttgtaaaaacagggagagagagagagagagagagaaagacacaaacagtaaatatgggtcatattagagacatgcctcagagatattttcagtctaactccagaccactacaata

SEQ ID NO: 4756 - DNA, 421 bp, Homo sapiens
  AC061958.11_137935
  Located on chromosome 3
  Distance between a terminus base of telomere on chromosomal short arm and 5'-terminus of this base sequence : 22375446
  Distance between 3'-terminus of neighbour sequence of sequence listing upward to telomere on chrosomal short arm and 5'-terminus of this base sequence : 67442
tcaagatctgtcataaactagctcttactgacctttgcagtcaactatatttatctttttgtccagcttaccaaactatttactttgccctagacatgcatatatagattggataaatagaggatagatagatagatagatagatagatatagatggatgatatagatgatatagaaaatgtgatacccatatacaccaaatgtgatacacacacacacacacaatacacacactgagagagatatatacagatatacagacaaaggaatatagatgtgtatatatatatatagtgtgtgtgtgtataaatttttctgccacaaaacaaaaaaccaaagcacctggaccacggattttataaaaatagaaacactggtatatgcagccccttattctctttcactaggaagtttactctgg

SEQ ID NO: 4757 - DNA, 422 bp, Homo sapiens
  chr3.fa.O7frz.26741573
  Located on chromosome 3
  Distance between a terminus base of telomere on chromosomal short arm and 5'-terminus of this base sequence : 22438726
  Distance between 3'-terminus of neighbour sequence of sequence listing upward to telomere on chrosomal short arm and 5'-terminus of this base sequence : 62859
ggaatccttatgaagataacctatatagcaatgccaataaaagcttgactggtgggaaagtttttaacacagagaggcagataggaagcattcctggcaagggaaatgcaatgaacaaaaaagcacaaaaacaggatgccatggagcatggacaggcatcatggaaaatatattaaaccacactttaaactcttggtctttattgattaaaccacccttttcaaatgtgaaattatcgtctaccaggccacaacaaaactattgtggcaatatgaaatgcagacatgtatagaattcttgagctgtgattgacgtcatgctgaccaaacacacacacacacacacacacacaaaccaaaaaaaaaaaaacaaaaaacaaaagaatgctttattgcccattgttgtactaatggcactcaaac

SEQ ID NO: 4758 - DNA, 478 bp, Homo sapiens
  AC023882.4_53672
  Located on chromosome 3
  Distance between a terminus base of telomere on chromosomal short arm and 5'-terminus of this base sequence : 22625859
  Distance between 3'-terminus of neighbour sequence of sequence listing upward to telomere on chrosomal short arm and 5'-terminus of this base sequence : 186711
agatcaggccacttcactccagcctggacgaaagagcaaaactccgtctcaaaaaaagaaagaaagagagaaagagagaaagagagagagagagagagagagagagagagagagagagagagagagagagagagagagagagagagagagagagagagagaaagaaagaaagaaagaaagaaagaaagaaagaaagaaagaaaaagaaagttctgtgtgagatagagaattgtgggaattttttgtatattgtatatttctgtatagctttcattttataaaagtatctatcactttagtaatgattaaaattaagttattttaaagtattaagtgtattttaaatgttgtaggtccatatttattgctatctacatattatttaagtaaaaaatttaaaatatatagagcaggctccctaaaagcatggagagtattatcccatttatttaatgattaatgatttaatggctgaatg

SEQ ID NO: 4759 - DNA, 474 bp, Homo sapiens
  chr3.fa.O7frz.27291287
  Located on chromosome 3
  Distance between a terminus base of telomere on chromosomal short arm and 5'-terminus of this base sequence : 22824575
  Distance between 3'-terminus of neighbour sequence of sequence listing upward to telomere on chrosomal short arm and 5'-terminus of this base sequence : 198238
gctaggaatcttagtgcaaattttgtacccagttcctatagctcttttcttttctttgtctgaacttatttgattcataattttgcctttccccctttttattaacttttgtcttttattgtactaatgggtttttttgggtggttaggagataggagtgggaggtagaattatatttttaaaatttggtagatattaaatttggggatattaactttaaaaagaataataggaaagagagagagagagagagagagaaagagagtgggggaagagagagaatatgaacagctggattccccacagccattagcaggcactggaccactttaggcatccaggtgacaacttgttgacatggctgtgaggtttgagtcattcagctcgaaccctggcaggttcatagtgtttagagcttctttggaaaaagatcttagttgaagaaaaacaaggtctgcctgactacagctatta

SEQ ID NO: 4760 - DNA, 453 bp, Homo sapiens
  AC031986.2_29847
  Located on chromosome 3
  Distance between a terminus base of telomere on chromosomal short arm and 5'-terminus of this base sequence : 22984201
  Distance between 3'-terminus of neighbour sequence of sequence listing upward to telomere on chrosomal short arm and 5'-terminus of this base sequence : 159152
aagttggagtaacaaatgtatgacccttgattggattctgaaactccaaagaaaattttggagaaaataagcaatgtttgaatgggatctgtggattagatggtagtgttagataaatgttgatttcataattttgattttggaactgtaaatatgtgccaaatattaagagattttgtctgcaacttattttcaagtggcacagggggaaaaacctacagtgatgtgatgtgatgtgatgtgtgtgtgtgtgtgtgtgtgtgtgtgtgtgtgtgtgtgtgtgtgtagaggaagagagaaagaggatgcaaatatggacaatgctaacaactgggaaatctggctgaaggatataaacagctctttggccctttgtactacttttggcacttttctgtaaatttcaaattgttttaaaacaaaaaaggtaaacaatgtaacataaatcaaaca

SEQ ID NO: 4761 - DNA, 333 bp, Homo sapiens
  chr3.fa.O7frz.28029049
  Located on chromosome 3
  Distance between a terminus base of telomere on chromosomal short arm and 5'-terminus of this base sequence : 23076099
  Distance between 3'-terminus of neighbour sequence of sequence listing upward to telomere on chrosomal short arm and 5'-terminus of this base sequence : 91445
tctagccattgtcatttacaatagctgagatttctgttgcaaaaataaagataatagtaactaggataattctgaaagagggtgcaagatcatatatatatatatatatatatatatatatatataaaatcatacatagactatgcaagattatatggagtttatatatagcatattatacatatagcacatatcaggaactcaataagtggtaaaaccaagccttactcccttttcctacttgcaggctaacaataaaagctaatgttaattaaatacatcttatatgccaaataattcacctttatttcacgtattgctcagcatagttat

SEQ ID NO: 4762 - DNA, 414 bp, Homo sapiens
  chr3.fa.O7frz.28149018
  Located on chromosome 3
  Distance between a terminus base of telomere on chromosomal short arm and 5'-terminus of this base sequence : 23199435
  Distance between 3'-terminus of neighbour sequence of sequence listing upward to telomere on chrosomal short arm and 5'-terminus of this base sequence : 123003
tgagctagtggaattgttagacctactcctttgtactactcccctctgggggttctttttcgagtcttgggtaatcttttctcccattgcagatatccatatttacctaaataccccagcggtccatcttcagattttcagctctctctctctctctctctctctccccccactatttttctttctctccagctccctagtctccagtacttcaccctacaagttctggccaacttggccttgccaaactccaaaatctgtttcctcaattgagtgatatttccagactttgtttgggtacatctcactctgctgtgccttaaaaattgcctttcaggtagtaagttggtacaaccataggctcacattgttgctttgtcttttcttagggattatagtcctgcattacatacg

SEQ ID NO: 4763 - DNA, 403 bp, Homo sapiens
  chr3.fa.O7frz.28255610
  Located on chromosome 3
  Distance between a terminus base of telomere on chromosomal short arm and 5'-terminus of this base sequence : 23279911
  Distance between 3'-terminus of neighbour sequence of sequence listing upward to telomere on chrosomal short arm and 5'-terminus of this base sequence : 80062
tcaaacatactttgcttctgtctgaaatgctcttcctttcctcctttttaaaattaataccgcttcagagctcatctcaaacattgtttcctgtagaaagccttttatgactttcccaaccttgcagtgtcactgtgtaggctgttaagccatacacttctgctctttatagtcctttttaaaaagtaatttagataattatgtaattgctttttaaatgtctatctcttccactaaaatatcactttcatgagggaacagactgtatatttttcactgctgttttctaagcatttctttgtacgtttgaagcattcagtaatattttggatggatgtggatggatggatggatggatggatggataagtgagtgaagagtaactcactagttgatatctgcc

SEQ ID NO: 4764 - DNA, 160 bp, Homo sapiens
  DISD22_0002591
  Located on chromosome 3
  Distance between a terminus base of telomere on chromosomal short arm and 5'-terminus of this base sequence : 23550023
  Distance between 3'-terminus of neighbour sequence of sequence listing upward to telomere on chrosomal short arm and 5'-terminus of this base sequence : 269709
cacttctccagacctttgtgaacacacacacacacacacacacacacacacacacacacacacacacaccacttaatttttaaaagtataatcatgatgttgcaaaataccaactgggggacaacacacatgccaagtgggggaagagggatgcatactg

SEQ ID NO: 4765 - DNA, 289 bp, Homo sapiens
  D3S3510
  Located on chromosome 3
  Distance between a terminus base of telomere on chromosomal short arm and 5'-terminus of this base sequence : 23644959
  Distance between 3'-terminus of neighbour sequence of sequence listing upward to telomere on chrosomal short arm and 5'-terminus of this base sequence : 94776
gggaaatgaacaaatcacatataaataaagaaacaaatctttgaaagcaagagagaccttcttttcagttcatttctgtgtgtatccttttcttgttttgcttatgaaatgataaacaatataactatttggggtgtgtgtgtgtgtgtgtgtgtgtgtgtgtgtgtgtgtaactaattcatcacttcagaattctaatctttctctctgatctgtaatttctcatgacctctataataaaatcaatcaactcagtatgtcttaactatgccatactttgtgatagtcc

SEQ ID NO: 4766 - DNA, 316 bp, Homo sapiens
  AC025292.17_69047
  Located on chromosome 3
  Distance between a terminus base of telomere on chromosomal short arm and 5'-terminus of this base sequence : 23974713
  Distance between 3'-terminus of neighbour sequence of sequence listing upward to telomere on chrosomal short arm and 5'-terminus of this base sequence : 329465
ctcctagttcacattaagtctgatgagtcttgttctctacaaccattgtctcagtgctacttaatgataaaataacaggcttgccagtttttagaaattagtccagagaaaatacatacatgtatacacacacacacacacacacacacacacacacacacatatacatattggggtgggagtggggaaagagctgcaggtgagtaaacaaggctgctatgaattgtggctgggtgaagggacactcatttcttcagcagaaagagtggggcagtaattcagtcctaactgaatctaccagaaagctccaagttac

SEQ ID NO: 4767 - DNA, 357 bp, Homo sapiens
  AC080134.13_133029
  Located on chromosome 3
  Distance between a terminus base of telomere on chromosomal short arm and 5'-terminus of this base sequence : 24067427
  Distance between 3'-terminus of neighbour sequence of sequence listing upward to telomere on chrosomal short arm and 5'-terminus of this base sequence : 92398
gatactaggcttaatacctggatgatgaaataatctgcacaacaacccgtgcccctgcctgccatgacacatttacctatgtaacaagcctgcacatgtacccctgaacttacaatgaaagttaaatatatatatatatatatatatatataataaatgattatgatttattttggaggtaatggtgttgatattaactagacatgaccagagccaaggctctgcaaaatcatgaagtgtctctggtactttttaaactcctttttctgagtcaggcttaggtaaaatcattcccttcattctgtgccaaatgttggtattctattgattgtcaactaattcctgctaagcagctat

SEQ ID NO: 4768 - DNA, 106 bp, Homo sapiens
  DISD22_0002601
  Located on chromosome 3
  Distance between a terminus base of telomere on chromosomal short arm and 5'-terminus of this base sequence : 24213353
  Distance between 3'-terminus of neighbour sequence of sequence listing upward to telomere on chrosomal short arm and 5'-terminus of this base sequence : 145569
ttattggaatttaatcacttcattcgtgtgtgtgtgtgtgtgtgtgtgtgtgtgtgtgtgtgtgtgtgtgtgtgtgttaatgtccacagaataacagaatgttaga

SEQ ID NO: 4769 - DNA, 190 bp, Homo sapiens
  DISD22_0002604
  Located on chromosome 3
  Distance between a terminus base of telomere on chromosomal short arm and 5'-terminus of this base sequence : 24304672
  Distance between 3'-terminus of neighbour sequence of sequence listing upward to telomere on chrosomal short arm and 5'-terminus of this base sequence : 91213
ggacagctctaattgggcaaagaaacaaacgtgatgtagcaaaataattctcaacagtgactataataattcaatattttcaaccaaaagctaaactttattgtaccaaattgcctgataaagctcacaaaacacacacacacacacacacacacacacacacacagacagctgtggctataagtcctca

SEQ ID NO: 4770 - DNA, 163 bp, Homo sapiens
  DISD22_0002608
  Located on chromosome 3
  Distance between a terminus base of telomere on chromosomal short arm and 5'-terminus of this base sequence : 24398785
  Distance between 3'-terminus of neighbour sequence of sequence listing upward to telomere on chrosomal short arm and 5'-terminus of this base sequence : 93923
agtacagtccagcctgggcaacagagggagacgggagagggagagggagagggagagggagagggagagggagagggagagggagggggagagggaaagggagagggagaaaaatattttaaaagcctctttatttcatttgtaatagcagcattccaattga

SEQ ID NO: 4771 - DNA, 440 bp, Homo sapiens
  AC024550.2_108017
  Located on chromosome 3
  Distance between a terminus base of telomere on chromosomal short arm and 5'-terminus of this base sequence : 24492786
  Distance between 3'-terminus of neighbour sequence of sequence listing upward to telomere on chrosomal short arm and 5'-terminus of this base sequence : 93838
catataatttgtccttgatttcagatttagattcttcattctcttaagcatcctaatgtaaattttcaaatttcatcttctgaatgatcacacgggagatcatgtaaggtcaaagttttcctcatttgatttatcctgtctcatatatatatatatatatatatatatatacacacacacacacatatacacacacacatatacatatatatatgtatgtacatatatacatatatacacacatatatatatatgtaagtatataaaagcttaagtccttgttccctaaagaaaatgacagaatggaaaagccaatcaactaatatttgtagaacaatgaagtcatacaaaatgttgcctaaatagtatcaatggcaatgtaattctaacagtaagataatcatataggctgcctcctgtttacctaattatgccaatac

SEQ ID NO: 4772 - DNA, 271 bp, Homo sapiens
  chr3.fa.O7frz.27586629
  Located on chromosome 3
  Distance between a terminus base of telomere on chromosomal short arm and 5'-terminus of this base sequence : 24611742
  Distance between 3'-terminus of neighbour sequence of sequence listing upward to telomere on chrosomal short arm and 5'-terminus of this base sequence : 118516
agtaattgaaatcagcaattacacatggggctttcagggaattttgttacaaaggaaaacaatgaaccaactggaagaggaggtggggtccagaaaagcttttcaaaaaaattttaagactatatatatatctgtatatatattatacagatatatataaacacatatatgtatatacacacatattaatatgtatatatgatatatgtagatgtgtgtgtgtgtgtgtgtgtgtgtgtgtgtgtgtgtgtgttcgtgttagcagtagaag

SEQ ID NO: 4773 - DNA, 211 bp, Homo sapiens
  chr3.fa.O7frz.27784809
  Located on chromosome 3
  Distance between a terminus base of telomere on chromosomal short arm and 5'-terminus of this base sequence : 24748136
  Distance between 3'-terminus of neighbour sequence of sequence listing upward to telomere on chrosomal short arm and 5'-terminus of this base sequence : 136123
tctaaggtcagaaccacatctagttaaataatataacaacaggtgtgtgtgtataaagtttttctcaggtagtatcctaatttatacacacacacacacacacacacacacaccacacaactcatttgatccttacaagaacttcatgaaagaaatattattacctcaactttaactatgaagttcagtaatttgtccaaagttagtcatc

SEQ ID NO: 4774 - DNA, 371 bp, Homo sapiens
  chr3.fa.O7frz.27914388
  Located on chromosome 3
  Distance between a terminus base of telomere on chromosomal short arm and 5'-terminus of this base sequence : 24952733
  Distance between 3'-terminus of neighbour sequence of sequence listing upward to telomere on chrosomal short arm and 5'-terminus of this base sequence : 204386
aaatgctgtaagcataactcagataaataactgcttattgtttacttgaaatttgtgaagacagtagatcttaagtgtcctcactacacacacacacacacacacacacacacacacacacaatgggaactatgtgtggagaaagatgtgttaatttgattgtggtaatcatttcataatatatacatatataaaatcctgttgtataccttgactatgtacaacttttatttgtcaattaacttttagttgtcaattataccccattaaagctagaaacaaaaaagtgagagaaacaagtccttcaactttcccaattcccagtcttccccactggctactttgagctacattgaactcatcctacctta

SEQ ID NO: 4775 - DNA, 132 bp, Homo sapiens
  DISD22_0002618
  Located on chromosome 3
  Distance between a terminus base of telomere on chromosomal short arm and 5'-terminus of this base sequence : 25154174
  Distance between 3'-terminus of neighbour sequence of sequence listing upward to telomere on chrosomal short arm and 5'-terminus of this base sequence : 201070
aattgttgaatttgcttctataggaaaggaatttttcctgaaactctgtgtgtgtgtgtgtgtgtgtgtgtgtgtgtgtagtatataatctttgtatgattttttagctgtaaatagtgtcagtggtatcca

SEQ ID NO: 4776 - DNA, 222 bp, Homo sapiens
  DISD22_0002621
  Located on chromosome 3
  Distance between a terminus base of telomere on chromosomal short arm and 5'-terminus of this base sequence : 25269183
  Distance between 3'-terminus of neighbour sequence of sequence listing upward to telomere on chrosomal short arm and 5'-terminus of this base sequence : 114877
gtgccttcttgttctgttaatcttttttatatatgtgtcttttctatcccagggaaagttctacatttttactgctgaggagtagaaaagtgtttttgtattcctagaagattttatatatatatatatgtgtgtgtgtgtgtgtgtgtgtgtgtgtgtgtgtctgtgtgtgtgtgtatgtgtatatatatagatatgagaggaataatacacattgatgac

SEQ ID NO: 4777 - DNA, 240 bp, Homo sapiens
  Z67159
  Located on chromosome 3
  Distance between a terminus base of telomere on chromosomal short arm and 5'-terminus of this base sequence : 25349276
  Distance between 3'-terminus of neighbour sequence of sequence listing upward to telomere on chrosomal short arm and 5'-terminus of this base sequence : 79871
tattctggtcctttattatggagacttacagagtcatccctgaaaatgagtgtgtgtgtgtgtgtgtgtgtgtgtgtgtgtgtgtacattttgctcctgatatatatatatcaggaatatatatatatattcctgatatatatatcaggatatatatatatattcctgatatatatatatattccaaattgtttattttatctatggaagagatatggtataaaggaatatcaagttcta

SEQ ID NO: 4778 - DNA, 432 bp, Homo sapiens
  AC012089.13_111598
  Located on chromosome 3
  Distance between a terminus base of telomere on chromosomal short arm and 5'-terminus of this base sequence : 25356334
  Distance between 3'-terminus of neighbour sequence of sequence listing upward to telomere on chrosomal short arm and 5'-terminus of this base sequence : 6818
taagtacaagatgcctactttcagcacttccagtcaacatggaagtcctagccagagtattcagacaagagaaagaaatgaaaggcattcatattggaaaagaggaacacaaattgttcctctttgcagacaacatgaccttgtgtttagaaaaaacaaaagactccgtcaaaaaacttgtagaggtaacaaacaaattcagtcaagttgcaagatacaaaatcaacatacaaaaatcagctgcatttctttatatttatctatttatttatttatttatttatttatttattattattatttagacagagtctcactctgtcaccagcctggagtgcagtggcacaatctcggctcactgcaacctctacctcccagattcaagtgattctcctacctcagcctcctgagtagctaggattttacaggtgc

SEQ ID NO: 4779 - DNA, 336 bp, Homo sapiens
  AC012089.13_101281
  Located on chromosome 3
  Distance between a terminus base of telomere on chromosomal short arm and 5'-terminus of this base sequence : 25366635
  Distance between 3'-terminus of neighbour sequence of sequence listing upward to telomere on chrosomal short arm and 5'-terminus of this base sequence : 9869
attcgacagtgtctgtttgtagttttattgtgaagaacagccattttaaaatagccaaacatccagtttttgtgagagctgaatatttcatcatacattggataacactaaattttccccgactgaccactcttggtagtcgatttaaaatttgttgtaaaatttcagtgaattaaatattattagaagaaattattgactaagtttcatgtgctaggatataacttatttttctcacctaggcttttatttaataaaaattgctgtggatttacaaaacaaaacaaaacaaaacaaaacaaaacaaaaaaaagttcagttaggagaccttagttg

SEQ ID NO: 4780 - DNA, 379 bp, Homo sapiens
  AC026674.8_62208
  Located on chromosome 3
  Distance between a terminus base of telomere on chromosomal short arm and 5'-terminus of this base sequence : 25395429
  Distance between 3'-terminus of neighbour sequence of sequence listing upward to telomere on chrosomal short arm and 5'-terminus of this base sequence : 28458
gttctgtaaccaattgagcagatgggaattatgggaaagggaagtgagaattgaactgggtgccccaaaggccagagtacagaggctgggagttcataagtgtgtgtgcacacttatgagtgtatatgtctatgtgtatgcatgtgcatgtatggctatatgtgtatatctgtgtataagtgtgtgtgtgtgtgtgtgtgtgtgtgtgttgagaggttggaagatatcacaacttctatctggaaaccagagaaagagtggctgtttttgtacacagtacacatttggccaccccaaatcacaaaaatgtatgtctaagcagaaaaagtccccctgctctgaattcctcactcccgtctgctagagtggtatagctgta

SEQ ID NO: 4781 - DNA, 228 bp, Homo sapiens
  AC012089.13_22713
  Located on chromosome 3
  Distance between a terminus base of telomere on chromosomal short arm and 5'-terminus of this base sequence : 25445405
  Distance between 3'-terminus of neighbour sequence of sequence listing upward to telomere on chrosomal short arm and 5'-terminus of this base sequence : 49597
gtagatgttacagtgagccaacatcgtgccactgcactccagcctagcaagactctgtttcaaaaataaataaataaataaataaataaataaataaataaataaattttggcaggatacaactgagaaaaactatctgaccatcccccattaattgcaagtttgatggaagatgttacctttacctttttgaataaagggaataatagtgaacagaagttaccaatg

SEQ ID NO: 4782 - DNA, 363 bp, Homo sapiens
  AC021057.13_121004
  Located on chromosome 3
  Distance between a terminus base of telomere on chromosomal short arm and 5'-terminus of this base sequence : 25579844
  Distance between 3'-terminus of neighbour sequence of sequence listing upward to telomere on chrosomal short arm and 5'-terminus of this base sequence : 134211
gatgacattaatggtatttgctaggctatttgtttcaatgtctttacttggcaaaattaaatactggcaaccttatgctggttcaaagaggtgtagggtgtgtgtgtgtgtgtgtgtgtgtgtgtgtgtgtgtgtgtgaattactactggtttgtgaaggtcaaccactatgctatgggacaactaatgagaaagctcagcccagcctctgtactctaagacctccacatgcttcaatttacactgggtccagaaccttgttaagagtgatcctttattatgtcattttttaaataagagaagctgaacgttcataaggcgaaaaaagatgctgtgaaaatcaggtctattaatcagatcaag

SEQ ID NO: 4783 - DNA, 127 bp, Homo sapiens
  D3S2414
  Located on chromosome 3
  Distance between a terminus base of telomere on chromosomal short arm and 5'-terminus of this base sequence : 25680907
  Distance between 3'-terminus of neighbour sequence of sequence listing upward to telomere on chrosomal short arm and 5'-terminus of this base sequence : 100700
aaccaccatgtcacgtgtatacctatgtaacaaaactgcacgttctgcccatgtatcccagaacttaaagtataataataataataataataataataataataaaagcagacgtccacctaaaatg

SEQ ID NO: 4784 - DNA, 132 bp, Homo sapiens
  D3S1293
  Located on chromosome 3
  Distance between a terminus base of telomere on chromosomal short arm and 5'-terminus of this base sequence : 25837630
  Distance between 3'-terminus of neighbour sequence of sequence listing upward to telomere on chrosomal short arm and 5'-terminus of this base sequence : 156596
catggaaatagaacagggtgtgtctgtgtctgtgtgtgtgtgtgtgtgtgtgtgtgtgtgtgtgtgtagaaagaaagagagaccgatttatttaaagaaattggctcacacaactgtgaaggctctgtgagt

SEQ ID NO: 4785 - DNA, 346 bp, Homo sapiens
  AC023798.14_49762
  Located on chromosome 3
  Distance between a terminus base of telomere on chromosomal short arm and 5'-terminus of this base sequence : 25857525
  Distance between 3'-terminus of neighbour sequence of sequence listing upward to telomere on chrosomal short arm and 5'-terminus of this base sequence : 19763
aatttggacataaggcttaaaggtaggtggcatttcttttaatctcatacatggtcaaaggttattcaaggatcatctgtggtaatatatatatatatatatatattcagttcaacacactttttactattgattaaatgtctcaaacaaaataaagttacttgctaacctgacctttgtctgatagaggcagaaataaaaagttcatatatttgctttatatgtacctgacaattattttagttctggaaaatcgtattttaacaagatcaaaactacaaatgaaaactgttaattgttgttttaaaaaagattaaaaagactgaaccatgtagctggaatttat

SEQ ID NO: 4786 - DNA, 202 bp, Homo sapiens
  G08274
  Located on chromosome 3
  Distance between a terminus base of telomere on chromosomal short arm and 5'-terminus of this base sequence : 25859931
  Distance between 3'-terminus of neighbour sequence of sequence listing upward to telomere on chrosomal short arm and 5'-terminus of this base sequence : 2060
gataccatattcaacatgaagaggaaaatatgtttaaaacattactgatagtaactaggcaaaaaagttatttattttctctctatatctatatatctttctctctatatctatctatctatctatctatctatctatctatctatctatctatctatctatatatgtataaaggattctagggaacaggaaaagaaagatg

SEQ ID NO: 4787 - DNA, 454 bp, Homo sapiens
  chr3.fa.O7frz.29622103
  Located on chromosome 3
  Distance between a terminus base of telomere on chromosomal short arm and 5'-terminus of this base sequence : 26194319
  Distance between 3'-terminus of neighbour sequence of sequence listing upward to telomere on chrosomal short arm and 5'-terminus of this base sequence : 334186
cttacttgccgtatacaaacttacaatggaaaggctccccagccctctgtgaaaagctcagaattctcctgcctgtgactaggtaggtaaattcaattcagaaaagaaacggttgagggttgaaaaatccaatatggaacacagttgtaagtcattttatctaattcaaattttccttctgaataactgggctaccaacccactaacaaaaaatctaatacacctcaactgattccttctatttattatcagtttcaattaagattataagccatttacacacaaacacacacacacacacacacacacacagagatatccaagccaaccatcacataattaacaatttataaacttcatatttgctttagtgttttaaccctattgcaactcccacaatcattaatataaaatgaaagtatgtaaaatagtgtattttagttgacaaccaaac

SEQ ID NO: 4788 - DNA, 478 bp, Homo sapiens
  AC025364.2_5435
  Located on chromosome 3
  Distance between a terminus base of telomere on chromosomal short arm and 5'-terminus of this base sequence : 26364109
  Distance between 3'-terminus of neighbour sequence of sequence listing upward to telomere on chrosomal short arm and 5'-terminus of this base sequence : 169336
tctaaattacctggaatgcttattaattccccaactactgggctgtacccccagcatatttacattttaccacatccattaaaaaaaatgaacaagtgaaaagactattttgacttctctcttattgtctactttccacccattatttaagatccaactcaactctcttccttcatgatgccttcccagaagatagggatccctctttgcagtgaactaattgcatatattgtatatcagtcctgtgaaaattaatgacaaaccgttccatttggcctcttgtgttttgaagaatttttataggcacatgggtagggtggggtggggtgtgtgtgtgtgtgtgtgtgtgtgtgtgaaattacatgaccaggaagtatcataatccagtagaaaagaaaggttttggagtcagactggataaaatttcatctctactcactactgactgcaggattactaattcctcagagcttcagtc

SEQ ID NO: 4789 - DNA, 403 bp, Homo sapiens
  AC018547.9_133503
  Located on chromosome 3
  Distance between a terminus base of telomere on chromosomal short arm and 5'-terminus of this base sequence : 26463356
  Distance between 3'-terminus of neighbour sequence of sequence listing upward to telomere on chrosomal short arm and 5'-terminus of this base sequence : 98769
gaatgaaggtacctagatccttatgtagcaaataaatgtaaataagaggacatggtccagcactcaggaaccagtgtggagggcagcaggcttaaggcaacacctgtaaattttttcaatacacttgtaataaaaccaagcatgcaactcatccaacttatccaacttgtctcctgattggttttatggacatggtagttgagatatatatgcctatggaagttatgagctaggaaatatggacacaaacctatatgtatatatgtagtggtgtgtgtgtgtgtgtgtgtgtgtgtgtgtatatatgtacatatacaccactaccaacgtgtccacgtttcctatctcataactcccatagcacattttgcagtattttgttataatgttgaggcactttagg

SEQ ID NO: 4790 - DNA, 371 bp, Homo sapiens
  AC018455.10_150159
  Located on chromosome 3
  Distance between a terminus base of telomere on chromosomal short arm and 5'-terminus of this base sequence : 26524205
  Distance between 3'-terminus of neighbour sequence of sequence listing upward to telomere on chrosomal short arm and 5'-terminus of this base sequence : 60446
cagactcaagatggaactacaccacaggttctcctgggtctccagggtcttgccaattgcagattgttggattcctcagcctccataatcaaataaaccaatcccttatatagtaaatacacacacacacacacacacacacacacacacacacacacacacacacaatctcctattgcttctatttctctagagaaccggaatacactccttgcccaagctactgttaggtattataacctagaactgtacattcatctcctttaaaatattcaaggattttaagagtttcccaggaatgtgtagaagtttggggaaccgaaccagatttattatgagacaaaatttaagagttctacaaatcctcaagt

SEQ ID NO: 4791 - DNA, 134 bp, Homo sapiens
  D3S1599
  Located on chromosome 3
  Distance between a terminus base of telomere on chromosomal short arm and 5'-terminus of this base sequence : 26524614
  Distance between 3'-terminus of neighbour sequence of sequence listing upward to telomere on chrosomal short arm and 5'-terminus of this base sequence : 38
ggacgtagacaaagcaacctgattatgtgtgtgtgtgtgtgtgtgtgtgtctgtgtgtgtgtgtggtggtggtgagtgtgtgtgtgtgtgtgtgtgtgtgtttagagacagagttttgctatgttacttagggt

SEQ ID NO: 4792 - DNA, 433 bp, Homo sapiens
  chr3.fa.O7frz.30105480
  Located on chromosome 3
  Distance between a terminus base of telomere on chromosomal short arm and 5'-terminus of this base sequence : 26565721
  Distance between 3'-terminus of neighbour sequence of sequence listing upward to telomere on chrosomal short arm and 5'-terminus of this base sequence : 40973
catttcctcattatgctacctatataaggccaaacaagtttcagaaataaggcaatgcttcatggttttttttgttttttgttttgttttgttttgttttgtttgaaacaagagtctcactctgttgcccaggctggagtgcagtggcacgagcgatcttggctcactgcaacctccgcctcccaggttcaagcgattctcctgcctcagcctcccaagtagctgggattacaggcccatgctgccatcccagctaatttttgtatttttagtagagatggggtttcaccatgttggccaggctggtctcgaactcctggcctcatgtgatctgcctaccttggcctcccaaattgctgggattacaggtgtgagccactgcacatggccttatgtctttactcaccctgttcatgaaggatagtgtttaaca

SEQ ID NO: 4793 - DNA, 254 bp, Homo sapiens
  D3S3659
  Located on chromosome 3
  Distance between a terminus base of telomere on chromosomal short arm and 5'-terminus of this base sequence : 26938304
  Distance between 3'-terminus of neighbour sequence of sequence listing upward to telomere on chrosomal short arm and 5'-terminus of this base sequence : 372150
tacttcatgcaaagaatctaccatgagattacttatcaggtagtgaaaagatttgtacaataataaaagtgtaacaataaatatatatttcatatttacctttggaaaaaaaatacatcttagctcattagactaaattgtcagttatctgaagcttataaaaggatagcctggattcacactgtctcacacacacacacacacacacacacacacacacacacacactactattgcttccctgattaacttcg

SEQ ID NO: 4794 - DNA, 363 bp, Homo sapiens
  chr3.fa.O7frz.30624047
  Located on chromosome 3
  Distance between a terminus base of telomere on chromosomal short arm and 5'-terminus of this base sequence : 27113125
  Distance between 3'-terminus of neighbour sequence of sequence listing upward to telomere on chrosomal short arm and 5'-terminus of this base sequence : 174567
gctactggactactttggctacaagcccagagagctgaaagttcttaggatttcacatctaatccactctccgcaattgcacttgcctccacaacacacacacacacacacacacagccatccttagccaatgactgatagaagtgggaacacaaaagcccagctcttttgtctcaagccagggcaaactgaaatattactctttcttggtgtgttctcttattctgtcctactcccccaacaccctttccatttctcctgggagctcttccttaataggccctatgtacacattcctcctttcagggcttgcctcggggaactcatgcaaaccccaatgactagaaggaatttagttgcctg

SEQ ID NO: 4795 - DNA, 214 bp, Homo sapiens
  AC020564.8_54032
  Located on chromosome 3
  Distance between a terminus base of telomere on chromosomal short arm and 5'-terminus of this base sequence : 27124827
  Distance between 3'-terminus of neighbour sequence of sequence listing upward to telomere on chrosomal short arm and 5'-terminus of this base sequence : 11339
ctaatgtcctagcatggaaatatgtctaactatattgttaggagtaggggggaacataatacacacacacacacacacacacacacacacacacacacacacacaccaaaatatagattgtatgagattattcacgtagacagaaaaattatgaaaaaaatcaaggtatcatatatcttctctgggtgagtacatgtacacataggtacatgct

SEQ ID NO: 4796 - DNA, 480 bp, Homo sapiens
  AC023506.13_67215
  Located on chromosome 3
  Distance between a terminus base of telomere on chromosomal short arm and 5'-terminus of this base sequence : 27196494
  Distance between 3'-terminus of neighbour sequence of sequence listing upward to telomere on chrosomal short arm and 5'-terminus of this base sequence : 71453
tctcaccaaactattctttaacagtatttcaatccagccagaacaaaattccaagagaaggaatgtgactccaagccagaagcttatctttttatagaacagaatagaatccacagctatttgacttgtactgtatatagcgcatagccaatgtcatgtgcacgaaagcttaataagacaatttcatgatgaaataccctgggcaagaaagccacaagaaaattccacagaaagcagcagggccaaattctgcaacaaatgtaatttagcccaccaaattgcaacatgtaattgaaagtagcagtgaacaacaacaacaacaaaaaaaaaaaaacagcacaaaattaatccttaagcactgtgctcatgatattcaattaaaacatggaaaatacatataataaaatatgccagaagattaaactgttagccttttcaacacctattgtgcttatcctaatatgcttagtaaggcatcag

SEQ ID NO: 4797 - DNA, 168 bp, Homo sapiens
  DISO7_10001083
  Located on chromosome 3
  Distance between a terminus base of telomere on chromosomal short arm and 5'-terminus of this base sequence : 27344730
  Distance between 3'-terminus of neighbour sequence of sequence listing upward to telomere on chrosomal short arm and 5'-terminus of this base sequence : 147756
tggcatctagaagtgatttcccaggtaactaaatactactccttttctcaaacaaaaacatcacctgataaatttcctagagagatatccatagctgcacacacacacacacacacacacacacacacacacacacacacaccccactggctgccaggaagctcaaag

SEQ ID NO: 4798 - DNA, 346 bp, Homo sapiens
  chr3.fa.O7frz.31223875
  Located on chromosome 3
  Distance between a terminus base of telomere on chromosomal short arm and 5'-terminus of this base sequence : 27548935
  Distance between 3'-terminus of neighbour sequence of sequence listing upward to telomere on chrosomal short arm and 5'-terminus of this base sequence : 204037
aagccactaagtctgtaacagtagcaacaggaaactaatatagtgcacacgtgtgtgtgtgtgtgtgtgtgtgtgtgtctgtgtgtctgtgtgtatctgtatctcccagctgtctcattactttctcttaaaaggtacttaaaaatgaagctgtgctatttctgtacttcacagaatcatctctccttaaaaataattctagaaagagttaacattctttatgttgactaaagcataaaagaacacagtagcattcttggataactaactttgcaactctgagcctctctttcctaacaaaacaagaggcttagattatttctaaggcttattctagttccatgat

SEQ ID NO: 4799 - DNA, 434 bp, Homo sapiens
  AC026127.13_127901
  Located on chromosome 3
  Distance between a terminus base of telomere on chromosomal short arm and 5'-terminus of this base sequence : 27558396
  Distance between 3'-terminus of neighbour sequence of sequence listing upward to telomere on chrosomal short arm and 5'-terminus of this base sequence : 9115
ttctgtagcttgataaacctatcttctctctccttcctattgaaattctatcatccatcatggaccagctaaataatacttccttgagaaagccttccctgccactctgtttgttcaacaacagtgctccaaatgttaggtatttacatgtgtgtgcacacctgcaggaggaaatatctcctatttcactttgcttttcattgtttttcaacttattaaaaaaattcaaacctatagtaaacagactcaccaactgttaacagcttgctaaatctgctttatctctctctctatacatatgtatgtatctctctctctatatatatgtacacacacacacacacacacacacacacacacaccccaagtttattttgtccctacaactatttgagagtaagcttcagaaaacatgaaggtcagttctttagtac

SEQ ID NO: 4800 - DNA, 480 bp, Homo sapiens
  AC026127.13_55941
  Located on chromosome 3
  Distance between a terminus base of telomere on chromosomal short arm and 5'-terminus of this base sequence : 27665995
  Distance between 3'-terminus of neighbour sequence of sequence listing upward to telomere on chrosomal short arm and 5'-terminus of this base sequence : 107165
gaaacaggactattacagaatcagaaatctttgggaaacagaattttttatatttcctatattattggtaactatttcccagaagggtaagcagaggcagaggtaacagacctcaaagttttaggttttatttgagatgtacagaggtttaggagtaaaacggcataaagcctgggattttctctgaaatactacacacacacacacacacacacacacacacacacacacacacatgcacgcatgcacacacaaacacacacacatgcactcctcccaaaacaaacatacaaaccataaaaagtagagggaggggcgcagaggagataaaggatgtagcaaatgttgacggtagtgaaagaagagggatgagtacgggagcaggggatcaattctttacatttgtgtatgtttgaacattttcagaattaaaagtttaaaatatttcagaaaaaaccctccaattaatcaagatgtcaa

SEQ ID NO: 4801 - DNA, 372 bp, Homo sapiens
  chr3.fa.O7frz.31341312
  Located on chromosome 3
  Distance between a terminus base of telomere on chromosomal short arm and 5'-terminus of this base sequence : 27767448
  Distance between 3'-terminus of neighbour sequence of sequence listing upward to telomere on chrosomal short arm and 5'-terminus of this base sequence : 100973
agacatatcacctcaggttgtaaaactctctttttgtgaacctctatcttgtctccttgagaccagctttgaacctggagagcaaatgtctgcgtagaccatgcaagcaaggtcttcgccaggttcctggataccacagggagacttgaggactagacccttatgttttgaaggttgttttgtttgtttgtttgtttgtttgttgaaatgtaaaaccagagctagctacaggtctctcctgccttttttttttttgcatttgatactttttaatctaaaatattcattgtgggccgagtgcagtggctcacgcctgtaatcccagcactttgggaggccgaggcaggcagatcacttgatgtcaggagttcg

SEQ ID NO: 4802 - DNA, 398 bp, Homo sapiens
  chr3.fa.O7frz.31418419
  Located on chromosome 3
  Distance between a terminus base of telomere on chromosomal short arm and 5'-terminus of this base sequence : 27844664
  Distance between 3'-terminus of neighbour sequence of sequence listing upward to telomere on chrosomal short arm and 5'-terminus of this base sequence : 76844
acctttagatcctcgtactcagttcccaaatccagaggctaaacctgaaatgacaatgccagatgttttcacacacacacacacacacacacacacacgatattttgctcttcttaaaataaacaaggaaatttaggcacacgaggcagaatcggatcccagctattacatagccttgtttgtggagcaaatgaaaaaatcattacatgttttattacccttcagaatctatttacaaccatgtagtcattctgagtttggattttcctttgaaataaaaagccctgtaacaaaaaataaaagagagggatactgtgttggaagactggcgatgaaactataagaaaatcaaaataaattataccattgttattgtttaagattcgttcaatattcac

SEQ ID NO: 4803 - DNA, 389 bp, Homo sapiens
  chr3.fa.O7frz.31596618
  Located on chromosome 3
  Distance between a terminus base of telomere on chromosomal short arm and 5'-terminus of this base sequence : 27947111
  Distance between 3'-terminus of neighbour sequence of sequence listing upward to telomere on chrosomal short arm and 5'-terminus of this base sequence : 102049
acctgtagtctcagctactcaagaggctgaggcaggagaacccaggaggcagaggttgcagtgaggcaagattgcaccactgcactccagcctgggcaacagagcaagactctgtctcaaaaataaataaataaataaataaataaataaataaataaataaatgttatcatttgaataccattagtgcttagtaactctccaatcccccataactctttggtgaactgacattaagtttctaaatatataaaatgtaatttacattcttaattctgatatgtgtcatgtttggcttgtacagaaaaataaagatcctgttgcatcttgaaaaaaatgttcatactaatttttttcctagaaacactgtaatttcagataatgccatat

SEQ ID NO: 4804 - DNA, 426 bp, Homo sapiens
  AC046128.7_114950
  Located on chromosome 3
  Distance between a terminus base of telomere on chromosomal short arm and 5'-terminus of this base sequence : 28098020
  Distance between 3'-terminus of neighbour sequence of sequence listing upward to telomere on chrosomal short arm and 5'-terminus of this base sequence : 150520
catagttcagtctgaatccaaaggcctgagaatcagagaaggcaactgggtaactcccagcccaagtctgggagtgaggcgggcattggtatcagtcccagagtctgaaggctcaagaaccgggagctctaacgtccaagggcaggagaaggagaatgttccagtgagagagagaggagagacacacacacacacacacacacagagaggagagagagagagaaagaaacacacacacacacacacagagaggagagagagagagaaagacacacacacacacacacacacacacacagagagagagagagagagagagaattgccgttctttctttcatctttttgttctatcagggttctcaatggattggatgatgcccacctcagtggctcttctttactcagtctactgattctaatgctt

SEQ ID NO: 4805 - DNA, 472 bp, Homo sapiens
  AC046128.7_65760
  Located on chromosome 3
  Distance between a terminus base of telomere on chromosomal short arm and 5'-terminus of this base sequence : 28144009
  Distance between 3'-terminus of neighbour sequence of sequence listing upward to telomere on chrosomal short arm and 5'-terminus of this base sequence : 45563
gatggtatgactaggtgagtaagtgtttgtgctctggatccagtttggctgggtttgaatccagctacaccacgtgtgtgtgtgtgtgtgtgtgtgtgtgtgtgtgtgtgtgagggagatagagagagagagagacggagttttgcccttgttgcccaggctggagtgcaacggcgcaatctcagctaactgcaacctctgcctcccaggttcaagtgattctcctgcctcagcctcccaagtagctgagattacaggcatgtgccaccatacttggctaattttgtatttttagtagagatgggatttctccatggtggtcaggctggtctcaaactcctgacctcaggtgatccacccacctcagcctcccaaactgttgggattacaggtgtgagccaccgcacctggcctaaaccacttattagctttgcaatcttggctaaagttattgaatttctctaagcttcag

SEQ ID NO: 4806 - DNA, 424 bp, Homo sapiens
  AC018451.11_51301
  Located on chromosome 3
  Distance between a terminus base of telomere on chromosomal short arm and 5'-terminus of this base sequence : 28367942
  Distance between 3'-terminus of neighbour sequence of sequence listing upward to telomere on chrosomal short arm and 5'-terminus of this base sequence : 223461
ggcttatgcctataattccaacactttgggatgccatagcaggaggatcgcttgagcccgggagttcaagaccagcctgggcaacacagcgagatctcttctctacaaataataattttaaaaattagccagatgtggtggcccgcacttgtggtctcagctgctctcaaggctgaggtgggagtatcactagagcccaggaggttgaggcaacagtgagtagtgatcgcaccactgcactctagtctgggtgacagagtaagactctctctcaaaacaacaacaacaacaacaacaacaaacaaaaacaaacaaacaaacaaaaaaaccaaccaaaaaccctctcaaagccccccagaaaaccaaataaaatttccctatataccatgtttgttaagtgcctgcaggattttgtcttagttct

SEQ ID NO: 4807 - DNA, 475 bp, Homo sapiens
  AC012087.10_113759
  Located on chromosome 3
  Distance between a terminus base of telomere on chromosomal short arm and 5'-terminus of this base sequence : 28612147
  Distance between 3'-terminus of neighbour sequence of sequence listing upward to telomere on chrosomal short arm and 5'-terminus of this base sequence : 243781
ctttgataatctcagtacagttgagagtcaatacaccttgagttggtagtttgggaaagatggggctttaacatattttcagcagttttgtatgtgtgtgtgtgtgtgtgtgtgtgtgtgtgtgtgtttatttactttgtggattcttattatctttaatttgctaatttgttttgcaaatctctaagttgaaaatgctttagaatgcagtgattcccaagctttggatcagaaagtccctttttataccttaaacatccttaggaaactagtgagttccacagacactgctgaactcacacaatttatagacatttgacttgcctccttgagaaaacaggcagtaatatgctatctgtgactgttaccagttagcttttgctgcataacaaaaccactccaaaaattagtagcttaaaatggaaatcacttgtttttcatgaatctgtaagtgagctagacagttcattaattt

SEQ ID NO: 4808 - DNA, 245 bp, Homo sapiens
  D3S1567
  Located on chromosome 3
  Distance between a terminus base of telomere on chromosomal short arm and 5'-terminus of this base sequence : 28620588
  Distance between 3'-terminus of neighbour sequence of sequence listing upward to telomere on chrosomal short arm and 5'-terminus of this base sequence : 7966
gctagggtcactgtggatctagacaataaacaaacactttaaaaatctttgctatgtgaatcataaataatatgactgcacagatttgtaacattcccaaagaaaagtattcaagaattttattcatatctgggaacaaactcagttcatttattggtgttctccataaagcatgcacacacacacacacacacacacacacacacacaaactctctctctctctcatgctcacaaacagacacg

SEQ ID NO: 4809 - DNA, 376 bp, Homo sapiens
  AC012087.10_90311
  Located on chromosome 3
  Distance between a terminus base of telomere on chromosomal short arm and 5'-terminus of this base sequence : 28635637
  Distance between 3'-terminus of neighbour sequence of sequence listing upward to telomere on chrosomal short arm and 5'-terminus of this base sequence : 14804
cttcacgagcttacagtttaagaggaagagttaatctgtctccctctctctctttgtctctgtctgtctgtctgtctgtctgtctctctctctctctacacacacacacacacacacacacacacacacacacacaagcatttactatgtgtcaatatctgttctaggttctgaggagcttcagaaagatagaagaacattaaaacattctcgtctttttaggagttacattctgctaggagaagacgaacaatgaacacggtatttgaagaattcttcaaatatatatttataatttttacataaatatagatatataaatgtagttacatgtgtttaaagtgtgcttctggtaaataggatgtagctggatctt

SEQ ID NO: 4810 - DNA, 241 bp, Homo sapiens
  AC069214.5_236353
  Located on chromosome 3
  Distance between a terminus base of telomere on chromosomal short arm and 5'-terminus of this base sequence : 28635637
  Distance between 3'-terminus of neighbour sequence of sequence listing upward to telomere on chrosomal short arm and 5'-terminus of this base sequence : -376
cttcacgagcttacagtttaagaggaagagttaatctgtctccctctctctctttgtctctgtctgtctgtctgtctgtctgtctctctctctctctacacacacacacacacacacacacacacacacacacacaagcatttactatgtgtcaatatctgttctaggttctgaggagcttcagaaagatagaagaacattaaaacattctcgtctttttaggagttacattctgctagga

SEQ ID NO: 4811 - DNA, 418 bp, Homo sapiens
  AC012087.10_57763
  Located on chromosome 3
  Distance between a terminus base of telomere on chromosomal short arm and 5'-terminus of this base sequence : 28668081
  Distance between 3'-terminus of neighbour sequence of sequence listing upward to telomere on chrosomal short arm and 5'-terminus of this base sequence : 32203
ttgatctatagcaattctttgtaattttgtataataaagtgtgtggtaatcttaatctaatacaaattaatattttcatagttttccagtgttgataataaacaacacaaatatgttctacctcttatattctgaagtttgagacagggttttgttttgttttgttttgttttgttttgttttgttttgagatggagtctcgctgtcgccaggctggagtgcagtggcgtgatcttggctcacttcaacctccgcctcccgggttcaagtgactgagagagttttaaaccaaaaaagttaccttcttagtggccaatgattatctttataaattcttacagccaggtcttgccttcttataatcaccaataagaacatagacttaggagctgggtactgttacttaaccatgagtgaa

SEQ ID NO: 4812 - DNA, 193 bp, Homo sapiens
  DISD22_0002628
  Located on chromosome 3
  Distance between a terminus base of telomere on chromosomal short arm and 5'-terminus of this base sequence : 28836738
  Distance between 3'-terminus of neighbour sequence of sequence listing upward to telomere on chrosomal short arm and 5'-terminus of this base sequence : 168239
tgaattcatctccttaccaccccagcgcacacacacatacacacacacacacacacacacacacacacacacacacacccctcaccattttcccataccttcagaaaacccaagtagccccttcatgacagtctctctcttgtgccaatagggggcccccagggggtatttttagagtaagaagggaggctcc

SEQ ID NO: 4813 - DNA, 95 bp, Homo sapiens
  D3S2336
  Located on chromosome 3
  Distance between a terminus base of telomere on chromosomal short arm and 5'-terminus of this base sequence : 28981927
  Distance between 3'-terminus of neighbour sequence of sequence listing upward to telomere on chrosomal short arm and 5'-terminus of this base sequence : 144996
tttacttgggcatgtttgaagccagactttcaacaatcattgtgtgtgtgtgtgtgtgtgtgtgtgtgtgtgtgtgtgtttaaaccactaaagga

SEQ ID NO: 4814 - DNA, 329 bp, Homo sapiens
  chr3.fa.O7frz.32429360
  Located on chromosome 3
  Distance between a terminus base of telomere on chromosomal short arm and 5'-terminus of this base sequence : 29090272
  Distance between 3'-terminus of neighbour sequence of sequence listing upward to telomere on chrosomal short arm and 5'-terminus of this base sequence : 108250
gaaatctgcaatttaacaagatacccaggtaattcgtgtgcacagccaagtttgagaagcactgagatagaccatgacatttctcctatgacaaagtcgatcagctgtgctcttggttgtccattccttttcaccattcttttgttgttttggtgatttgagggtacacacacacacacacacacacacacacacacacacattctctcggcacttgtaccttggtcaatgcatgctcacttgcacatacatcaatagaacatccctcagcctagggcttggcacaagtagatcctcaataaatgtttattgagtgaaataaaacagcc

SEQ ID NO: 4815 - DNA, 468 bp, Homo sapiens
  AC026285.4_91662
  Located on chromosome 3
  Distance between a terminus base of telomere on chromosomal short arm and 5'-terminus of this base sequence : 29256270
  Distance between 3'-terminus of neighbour sequence of sequence listing upward to telomere on chrosomal short arm and 5'-terminus of this base sequence : 165669
tccagtgacttgttaccataagggaaggtaggtagagtaaagccatgtcctccaacttgtcaagaaaaacagtaaacaccatcttttaaaaaatgtttaatatctctagttataaactttaaccagttaaatgtaaaacactgtatgggtcagtactatcagccaaaaagaaatataaatatatatataaaaatctctctctctctctctctctctctctctctctctcgatatgcctattagagtataattttctgaatgtgcagttcaaccacttcatactggaggtaagttatatattgttaactaaagtctaaaattttgtcagtcaaaaatggatcttaatgatatccagaatttgggaaaatggctgaagatgacccagcaaattccatgaagatgaatgacctacggagacttcataagcaatatgaggctttttgtcttaaagatttagatcaggaatcc

SEQ ID NO: 4816 - DNA, 389 bp, Homo sapiens
  HUMUT6375
  Located on chromosome 3
  Distance between a terminus base of telomere on chromosomal short arm and 5'-terminus of this base sequence : 29296816
  Distance between 3'-terminus of neighbour sequence of sequence listing upward to telomere on chrosomal short arm and 5'-terminus of this base sequence : 40078
caccccaaattctgcttccatcacatcaccttctcctcttctataatcaaatctccctttgcctccctcttgtaagaatccctgtaattacactgggctaccagataatccagtatcatctcctttttgttgttgttgttgttgttgttggagatggagtcttgctccgtcgcccaggctagagtgcagtggcccaatctcggctcactacaacctctgtttcctgggttcaagcgattctcctgcctcagcctcctgagtagctgggattacaggcacccaccaccatgcccagctaattattattattattattattattattattattattattttgtatttttagtagagacagggtttcgctatgtttgccaggttgctctgaa

SEQ ID NO: 4817 - DNA, 443 bp, Homo sapiens
  AC026285.4_130121
  Located on chromosome 3
  Distance between a terminus base of telomere on chromosomal short arm and 5'-terminus of this base sequence : 29322549
  Distance between 3'-terminus of neighbour sequence of sequence listing upward to telomere on chrosomal short arm and 5'-terminus of this base sequence : 25344
cacgaacatggatagatcatagaaagataatgaatggaaatgaatgaaatgataatgaatgaaaaactctttaagtgcacatatagggtgccaacatttttataaattgtagaaaagaaatgatttttttcctcacccatctctagattcatgactgagacacctataacaaaagacagattaacatcagaaaaaacatacaaatttgtttaatgtaagttatatatgcttgggaaccttcagaaatgaagacccaaagaaaaaggtaagcctgtgtgtgtgtgtgtgtgtgtgtgtgtgtgtgtgtgtgtgtgtgtgtgtgtgtgttttcctgctaagtttgatgaagagtagccagtcatatcagtcacacgatggaacaaaggaagtaggatttaatggtaataccctgaggggtgcttctcaaaaccagtttgcttaga

SEQ ID NO: 4818 - DNA, 412 bp, Homo sapiens
  AC023205.3_170094
  Located on chromosome 3
  Distance between a terminus base of telomere on chromosomal short arm and 5'-terminus of this base sequence : 29481630
  Distance between 3'-terminus of neighbour sequence of sequence listing upward to telomere on chrosomal short arm and 5'-terminus of this base sequence : 158638
gtagaggttgtagccttgaaagatttgtgatggagcccagtgctgctttgtggtgagtatcagaaaaagagatgccagagctcatggtttaagaggggggaggggaaaagtattcataacacagtgtggctgatttcctgtttacattttgcaagtactttgtgtgtgtgtgtgtgtgtgtgtgtgtgtgtgtgtgtgtgtgtgtgtgtaatgctgaggcagtagttagaatatgagggttttaggtgcagttttaaaggttctgcatggagggaaagacctgaacacaaagtggctactctacaaactcttgtggatacaggtttcaaagcacttctaccatcttctgctcttctctctgctcttctactctaggctatgagaatcttggaggtaagaaccatgtcttgtt

SEQ ID NO: 4819 - DNA, 319 bp, Homo sapiens
  AC011323.18_39759
  Located on chromosome 3
  Distance between a terminus base of telomere on chromosomal short arm and 5'-terminus of this base sequence : 29581472
  Distance between 3'-terminus of neighbour sequence of sequence listing upward to telomere on chrosomal short arm and 5'-terminus of this base sequence : 99430
ctttggtgatctgacagactataccactgattttttttttttttttttttttttgccttgcattgttctcagtgttataggccacatagaggaaataaaagaccactgaccatcaattctgagggtgatatttgaatatatatatatatatatatatagagagagagagagagagagagagagagagagagagtcaaatacttaattttttactaccagtgggaaaatttttccaaagatgattttttttggggatcgtacataacgtttttccctttctgtttttgtggcatttgtagcattcaaattatgttcattt

SEQ ID NO: 4820 - DNA, 149 bp, Homo sapiens
  D3S1583
  Located on chromosome 3
  Distance between a terminus base of telomere on chromosomal short arm and 5'-terminus of this base sequence : 29637119
  Distance between 3'-terminus of neighbour sequence of sequence listing upward to telomere on chrosomal short arm and 5'-terminus of this base sequence : 55328
agcttgtaaataggtcctaacagagatttactttctctcaaaactacacacacacacacacacacacacatttcatcaaatcgatcatttcttaaggtgcactattattttgtataccactaaaagggaaaacggtgcctattaaacca

SEQ ID NO: 4821 - DNA, 426 bp, Homo sapiens
  AC024247.3_14424
  Located on chromosome 3
  Distance between a terminus base of telomere on chromosomal short arm and 5'-terminus of this base sequence : 29857785
  Distance between 3'-terminus of neighbour sequence of sequence listing upward to telomere on chrosomal short arm and 5'-terminus of this base sequence : 220517
aatcattatcactgattggattaatgtgctctgccctgttctaactgcctgctacagcaaaattcactgcttattttttaatttatgaaaaaaacccacatgtatagagttaaaaatttcaatactatcaaaggggtataaaacaaaaattgaacctttcatcttggaactccagttcctcctctcagaagtagtcattgttaataacttcctgtgccttgcttcagaaatttcctcacatggacgtgtgtgtgtgtgtgtgtgtgtgtgtgtgtgtgtgtgtgtgtgtgtgtgtatgtacatacataatacataaatatgagtctgtgtcatatccaaggcacagttacactgataaataagacaacacattttttgtcaggtactaccaatactgaaattttgtttcaaagaactttgaaatga

SEQ ID NO: 4822 - DNA, 407 bp, Homo sapiens
  AC024247.3_100547
  Located on chromosome 3
  Distance between a terminus base of telomere on chromosomal short arm and 5'-terminus of this base sequence : 29936139
  Distance between 3'-terminus of neighbour sequence of sequence listing upward to telomere on chrosomal short arm and 5'-terminus of this base sequence : 77928
tgaggtgtcttagcatgttaatctccatttcacagatgggggaatatgggacagttcctaagcaaatgccaatatatcctgttatgctaacaaaaatagtgcaaagttctctcctaatgggtggctacaaccagcatctactattaaacaagaaacatatttaaacacacacacacacacacacacacacacacacacacacacacaaagatacccttggatcaatgcttgtaatgctcagtgaggagaaaaggctcgctgcatgacttctctccagaagatttgtatattcaatgaacttgtaatgaagatggtgatttcatcccctctctactagatttctgcctttagaatccccattttcctccttgccttcttctactcttctaattcagtttatccatcaa

SEQ ID NO: 4823 - DNA, 465 bp, Homo sapiens
  chr3.fa.O7frz.33576500
  Located on chromosome 3
  Distance between a terminus base of telomere on chromosomal short arm and 5'-terminus of this base sequence : 30157444
  Distance between 3'-terminus of neighbour sequence of sequence listing upward to telomere on chrosomal short arm and 5'-terminus of this base sequence : 220898
ccgattcatagtaacaaggtaactagaaatacttctaataacgttgtgcaagatcttgatggagaaaattacaaaatttattaaagggaataaacaagacctcaatatatgggaagacatattcatacatgaaaagaggccgtgtttatttgtaagtgcaaagcaattccaacaaacattacagtacattttgtgtgtaaatgtgtgtgtgtgtgtgtgtgtgtgtgtgtgtgtgtctggaggttgacaagtagttcttgtggatgaataaaaggccaagaatagcctatataattttattgtattttaattttttcttttttgtttgttattatatttttcttttttaaattatactttaagttctagggtacatgtgcacaatgtgcaggtgtgttacatatgtatacatgtgccatgttggtgtgctgcacccattaactcgtcatttacattaggtatttc

SEQ ID NO: 4824 - DNA, 459 bp, Homo sapiens
  chr3.fa.O7frz.34309384
  Located on chromosome 3
  Distance between a terminus base of telomere on chromosomal short arm and 5'-terminus of this base sequence : 30326005
  Distance between 3'-terminus of neighbour sequence of sequence listing upward to telomere on chrosomal short arm and 5'-terminus of this base sequence : 168096
tcctatgaagcagtcatagaagataatttaatgtttttgtgaagacaatggatatgataagcgcaaacttaaaatcttagtttatctgagggctatgtggcagcctctctcatactcactttgtattgattgattgccactttatctttgggggtaaacgttcttgtatttgtttcctagaaacagagattccaggaaggttttactgacatggctagttctttcatctgcaacatttacattcacacacacacacacacacacacacacacacacacacacacctcaagctgagttccagtagcaaggtcataagcattaggctttctacttttcaggtctctgctatttctgttcttgtccttttgcacctttactgacaacttccattccctaaatgatgagctcctctctggaggcagaggatatacattttagatccagctatcactaagttcc

SEQ ID NO: 4825 - DNA, 303 bp, Homo sapiens
  AC024130.6_108451
  Located on chromosome 3
  Distance between a terminus base of telomere on chromosomal short arm and 5'-terminus of this base sequence : 30399210
  Distance between 3'-terminus of neighbour sequence of sequence listing upward to telomere on chrosomal short arm and 5'-terminus of this base sequence : 72746
tttaagataagcaaactaaggattagggatgccaagagatatgcctaaggctatgtgtgtagaaggtagtaatatctgcatcttaaagccaagtgctctggcctatgtcttcgttgacccctctgccacacacacacacacacacacacacacacacacactcgtattaatgttggttgctcatgtcagagaaataaaaatggaataaggtcacacccacatcaacttgtacaagtttctgggggaggatctatgcattgctattttttaaagtgtcccaggtaattctaaagtgcaagcaga

SEQ ID NO: 4826 - DNA, 389 bp, Homo sapiens
  chr3.fa.O7frz.34424431
  Located on chromosome 3
  Distance between a terminus base of telomere on chromosomal short arm and 5'-terminus of this base sequence : 30427667
  Distance between 3'-terminus of neighbour sequence of sequence listing upward to telomere on chrosomal short arm and 5'-terminus of this base sequence : 28154
gttgaacttaatggacttaatgacttacttttaaaggagaaaatgtggctggagtggcggtgtatggcttctaagactagatcacagaatatggtgctgctttctttctctccctctctctctctctctctctctctctctcacacacacacacacacacacacacacacacacttttctctctctctcatatcacctgctctgagaaaaatcagttgccatgttataaggatgctcaaactaccccatctatggagaagtccacacgtggggaatactaaagcctgacaacagccatgtaagtgagctattatgaaagtggacactgaagcctcggccaagcctccagatgactgcagccctggctgttatcttgaccacaacctgta

SEQ ID NO: 4827 - DNA, 343 bp, Homo sapiens
  AC016958.15_103941
  Located on chromosome 3
  Distance between a terminus base of telomere on chromosomal short arm and 5'-terminus of this base sequence : 30562739
  Distance between 3'-terminus of neighbour sequence of sequence listing upward to telomere on chrosomal short arm and 5'-terminus of this base sequence : 134683
cctaatgtagatgacaggttgatgggtgccgcaaaccaccatggcacgtgtatacctatataaaaaatcttcatgttctgcatgtatatcccagaacttaaagtataattttaaaaaaagaaaagaaagaaagaaagaaagaaagaaagaaagaaagaaagaaagaaagaaagaaagaaagaaagaaaaagactctaagaatatcaaaatgccccaaccacatgaagctacactccaaagccagagagttgcaagctactagaggctagctcaggctttcaacaggggcccatattagggatttatttatgttaccttatttaatctccatgacagtgagttt

SEQ ID NO: 4828 - DNA, 281 bp, Homo sapiens
  DISO7_00001200
  Located on chromosome 3
  Distance between a terminus base of telomere on chromosomal short arm and 5'-terminus of this base sequence : 30671743
  Distance between 3'-terminus of neighbour sequence of sequence listing upward to telomere on chrosomal short arm and 5'-terminus of this base sequence : 108661
ccaatgcaaggaagattatgtcctccttgaagtgtggggtggggtgtgtatgcgtgcgtgtgtttctctgtgtgtgtgtgtgtgtgtgtgtgtgtgtgtgtgtgtgtgtgtgtatgttgtgtaggaagcgggggcaggaaggacaagcataggaagtagaagaggccaaagaattttagcggcaattctcccacttactcatatccggaacaaagaacacggccaagtgagaaagctcttcctcctcacgcatgcactttaggggcaagcagatttggaat

SEQ ID NO: 4829 - DNA, 436 bp, Homo sapiens
  chr3.fa.O7frz.34811346
  Located on chromosome 3
  Distance between a terminus base of telomere on chromosomal short arm and 5'-terminus of this base sequence : 30826137
  Distance between 3'-terminus of neighbour sequence of sequence listing upward to telomere on chrosomal short arm and 5'-terminus of this base sequence : 154113
tgagtaggttcagcttacaaacccttcagttaatttaaaaattaaatgaaaatgtgaagccgtgtttgcgctaatacggcaaaaaagttggcatgttttggatttcttcctacgtattctatggattctgtctctttctcttacacacacacacacacacacacacacacacacacagttgatactatcatatgagcaattctaaacttaattcaaagtctcaggaataaaaatatgctttcaccaagtatgaccagcagaaatttaagtttgtgttttaattgttctgcaatttgacaatcaaatctgttcagagatatatgattacttgacacttttatgatcaaattttattgtttattttataaaaacagtacacagtgaaacaaaagaaaattattcttctctcagaaagtaacgagtaggtcagccttac

SEQ ID NO: 4830 - DNA, 231 bp, Homo sapiens
  chr3.fa.O7frz.35065579
  Located on chromosome 3
  Distance between a terminus base of telomere on chromosomal short arm and 5'-terminus of this base sequence : 30930929
  Distance between 3'-terminus of neighbour sequence of sequence listing upward to telomere on chrosomal short arm and 5'-terminus of this base sequence : 104356
tcctaactacagcataaaggtaacaaatctgcatgtaagtagatattcaggatcacctcaacaagaagataaaaccacttcccaaaatttataaatactttagcccaatggtctagaacaagaaaaggctattcacacacacacacacacacacacacacacacaatctaagtggaggaatgagaatgatcttgtagactgaaagcagaaggctgagtacaatttgaagta

SEQ ID NO: 4831 - DNA, 430 bp, Homo sapiens
  AC024936.10_169864
  Located on chromosome 3
  Distance between a terminus base of telomere on chromosomal short arm and 5'-terminus of this base sequence : 31024870
  Distance between 3'-terminus of neighbour sequence of sequence listing upward to telomere on chrosomal short arm and 5'-terminus of this base sequence : 93710
ttgaatgtggagctaatgtaatgaaaacagaacaaaaaaacaaaattatctttatttgcagatgatgtgacagtgtacctagaatgacagattcatccaattagcacacacacacacacacacacacacacaaaacacattcatttggccaggcgtggtggctcacacctgtaatcccagctacttgggagactgtggcagggagaattgcttgaacccagaaggcggaggttgcagtgagccaagaccacgccactgcactccaacctgagtgacgaagcgagacactgtctcaaaaaaaaacaaaaacaaaacaaaacaaacaaacagattcatttgaaggcagccaattacaagataaattaaaaccaatagcttttctttaagcagtaacaggccaggaatggtgataatcctacaactttggtag

SEQ ID NO: 4832 - DNA, 425 bp, Homo sapiens
  chr3.fa.O7frz.35137353
  Located on chromosome 3
  Distance between a terminus base of telomere on chromosomal short arm and 5'-terminus of this base sequence : 31128064
  Distance between 3'-terminus of neighbour sequence of sequence listing upward to telomere on chrosomal short arm and 5'-terminus of this base sequence : 102764
actttgtgacaaatctacttcaactactccagaatgtgaaaaacggataagatagatgctgggtcactttaaaaaggcaaaggaatgttccaatataaaaaatatggtactcgtgggctagtttgttcaaacacaccggagtgactttctaggcttcgatccaattgtatgatgcattcagaaaccctgtgcctactcataaaaatatctcagatgaaagattttgaaatttgtttatgagtttaactgaactgaaaactgcaatgttggccatttctttttgtgaccagagggaggaacttctattcagtattgaacctaatacaccaatggctatattttccctaattccagaagacagcacacacacacacacacacacacacacacacacacacacacttcctataaggacaagtaacctc

SEQ ID NO: 4833 - DNA, 389 bp, Homo sapiens
  AC025612.12_98445
  Located on chromosome 3
  Distance between a terminus base of telomere on chromosomal short arm and 5'-terminus of this base sequence : 31185851
  Distance between 3'-terminus of neighbour sequence of sequence listing upward to telomere on chrosomal short arm and 5'-terminus of this base sequence : 57362
aggccaatgtccataactccagggggatcaaatcccctttcaaaagcacatcaatcatatttacttgcattaatagttaacgccctgacaatgtagagcctgggtcctctctttgacagcaacagttcatgcagatattgcagagaaagagggccaacaggcttgactgtctgaaagagagtacatgatatacaggttttaaagttcaatggaccaacaaattggccattgacttctttctcctcttccctggtcaggagaatcttgtataggctctcttcttgaacacacacacacacacacacacacacacgcatgcacacacgcacaccaaatttgttgcagcccaccaaatttctccctcactagttaccatgcaggactctaga

SEQ ID NO: 4834 - DNA, 218 bp, Homo sapiens
  chr3.fa.O7frz.35566189
  Located on chromosome 3
  Distance between a terminus base of telomere on chromosomal short arm and 5'-terminus of this base sequence : 31433905
  Distance between 3'-terminus of neighbour sequence of sequence listing upward to telomere on chrosomal short arm and 5'-terminus of this base sequence : 247665
attaatgcaatgtctaaagatgacagaatcttatttaagaatggctagatacaggaaacttatacaatgccattgacttttttttctctcactctctgtctctctgtttttctctctccctcacacacacacacacacacacacacacacccctacctgttttcctctatgtacttattttaggatagaaaagatggtgctgtaatgtcactctaagc

SEQ ID NO: 4835 - DNA, 293 bp, Homo sapiens
  D3S1266
  Located on chromosome 3
  Distance between a terminus base of telomere on chromosomal short arm and 5'-terminus of this base sequence : 31520400
  Distance between 3'-terminus of neighbour sequence of sequence listing upward to telomere on chrosomal short arm and 5'-terminus of this base sequence : 86277
aagcatcttaatggatggaaaatacgtatgtgtctgtggggtgtgtgtgtgtgtgtgtgtgtgtgtgtgtaaggttctagccctccttagggactttagtctcccaaagacactcccataaaggtatagattaaaaattgagagaacttaactctgctgctaaatatggtggttatggggttgggggaaacattctggaagaaaaaggcttggctaggacatggggatgacaatgaacaggggactatcccttgtgactgggattccccttcctccaacattacccctcatct

SEQ ID NO: 4836 - DNA, 255 bp, Homo sapiens
  Z67015
  Located on chromosome 3
  Distance between a terminus base of telomere on chromosomal short arm and 5'-terminus of this base sequence : 31650665
  Distance between 3'-terminus of neighbour sequence of sequence listing upward to telomere on chrosomal short arm and 5'-terminus of this base sequence : 129972
acctgactcctgagcttatgctcttaacaaatatattcttcaggctccatttaaatacttttgtgagagagagagagagagagagtgtgtgtgtgtgtgtgtgtgtgtgtgtgtgtgtgtgtgtccaatatgtatatgagtgggtttctggaagggaggtgcaggaggtgacacaagggcaaaaagaaatagaagaagaaagatattcttctccaagaagagccttggagcaactcttcacggacacacttttcg

SEQ ID NO: 4837 - DNA, 166 bp, Homo sapiens
  D3S2335
  Located on chromosome 3
  Distance between a terminus base of telomere on chromosomal short arm and 5'-terminus of this base sequence : 31885138
  Distance between 3'-terminus of neighbour sequence of sequence listing upward to telomere on chrosomal short arm and 5'-terminus of this base sequence : 234218
gctgaatgcttctgaatgtattcaatgtaatagaaatgtaattataatgtaatcaatcacccatgtatatacacacacacacacacacacacacacacacagttttactttgatttcccaattacttgctggagacagaaaaggttagaaaagcaccccatctctt

SEQ ID NO: 4838 - DNA, 421 bp, Homo sapiens
  AC026860.2_113879
  Located on chromosome 3
  Distance between a terminus base of telomere on chromosomal short arm and 5'-terminus of this base sequence : 31885324
  Distance between 3'-terminus of neighbour sequence of sequence listing upward to telomere on chrosomal short arm and 5'-terminus of this base sequence : 20
ctaagcttgatctattgttcaaagaataaaaatatgcttcacaaggatgtaccatgagctcaagaacaggattcactttttacaaatacattactaaacatttaaagtgcccctgcctcaagattttacagaattgaaatataaacagaattaagttaaagaattataagaaatctatgttgattgccaattatatgttttaaaatatatatataattaaaccacattttccaaaacaaatgcttttattttttaaagccatacttggcatagccagttgaccaaatacacacacacacacacacacacacacacacacacacacacacacatacacacacacacacggaatttaaaaagatgctactatacaaccaaaacagaggctgggagaagactctcagcttctgttcaattgtag

SEQ ID NO: 4839 - DNA, 127 bp, Homo sapiens
  D3S2337
  Located on chromosome 3
  Distance between a terminus base of telomere on chromosomal short arm and 5'-terminus of this base sequence : 31885585
  Distance between 3'-terminus of neighbour sequence of sequence listing upward to telomere on chrosomal short arm and 5'-terminus of this base sequence : -160
tacttggcatagccagttgaccaaatacacacacacacacacacacacacacacacacacacacacacacatacacacacacacacggaatttaaaaagatgctactatacaaccaaaacagaggct

SEQ ID NO: 4840 - DNA, 430 bp, Homo sapiens
  AC026860.2_152622
  Located on chromosome 3
  Distance between a terminus base of telomere on chromosomal short arm and 5'-terminus of this base sequence : 31924196
  Distance between 3'-terminus of neighbour sequence of sequence listing upward to telomere on chrosomal short arm and 5'-terminus of this base sequence : 38484
atctgattgttaagcttatgtcacatgtctgagtccttcctaaaagagtgaataggaaactacgttctccaattttaagtttgtacagtaagaagtgggctctgaaaccttccaataacagaaagaaggaggagctgctgggaagtcagaaagagaaaagagagagagagagagagagagagagagaaaaagagaaagagagagaaaagaaaaagacaaatatccactacaagtttttaccagagacaacaaacagttttaaccctttgaaaaatggaaggagataacgtatcatttaaaaaaaaaaacttagaaaacttaagttttactcagatgaatattgaagcaagctgagaaaagctaagaggcctattatatcacagtagtggaatattacgtggtttgtttctgttaccagtagagcttgcta

SEQ ID NO: 4841 - DNA, 435 bp, Homo sapiens
  AC053519.2_297546
  Located on chromosome 3
  Distance between a terminus base of telomere on chromosomal short arm and 5'-terminus of this base sequence : 31989724
  Distance between 3'-terminus of neighbour sequence of sequence listing upward to telomere on chrosomal short arm and 5'-terminus of this base sequence : 65098
aataaggttgtattacctagctcaggtcgccataaaaaaataccatggactggatgccttaaacaacagaaatattttttctcacagttctggaagctgcaaagtccaagatcaagattcaacaatgttcatttctggtgaaggctctctttctggactgcagatgactgcaatctctcaatgtcatcacatggcagagagagagagagagagagaaagcgctctcttcttctcttcctcttcttataaggccatagtcctattgaatcagaagctcacccttatgacctcatttatccttgattacctcctaagaccctatcatcagatatagtcccactgagggttagggctttatcatattaattttgggtaacacagtccaatctatagcacacatctagctgctgatactcaggtaacgtttcttgagta

SEQ ID NO: 4842 - DNA, 465 bp, Homo sapiens
  AC053519.2_45255
  Located on chromosome 3
  Distance between a terminus base of telomere on chromosomal short arm and 5'-terminus of this base sequence : 32060363
  Distance between 3'-terminus of neighbour sequence of sequence listing upward to telomere on chrosomal short arm and 5'-terminus of this base sequence : 70204
cgttcattgtacttcagaattatctaggaattaaaacaaaacaaaataatagtgcacatgtttctctccacagagagataattgcattttttttcccaaagctttcaaggtgatttgaatgtgcatccaaggttgagaaataatggattagccaaaggaacagaatgtctccttaaagcagcccatagcaacaaaccatatagattttgctcatttgtgtatcttaaagttacataatttattatctaaagcactcttctatataagccataagtttttggctgtttttgttgttagatttctgtgtgtgtgtgtgtgtgtgtgttggctatttcttgacctttacttcccttacttccatcttggaggttaaaagccaaattatctaggctaggtgtcaggttcttttccagtaggccaaggattcttagcaaactcttagggaataagaaagtatgctctggc

SEQ ID NO: 4843 - DNA, 459 bp, Homo sapiens
  AC021117.3_154237
  Located on chromosome 3
  Distance between a terminus base of telomere on chromosomal short arm and 5'-terminus of this base sequence : 32155920
  Distance between 3'-terminus of neighbour sequence of sequence listing upward to telomere on chrosomal short arm and 5'-terminus of this base sequence : 95092
agtgagtcctgcatatttgacctctgaaacatatgcagaatgagtccacttttttcaaagctctgttcccacccaaggccaaaacattatctttttccacaagtctattctctacctaataatgtgctatgtttaaaatatatatactttgttgaactttaccaaatatatatatatttggtatatatatatatatatatatatatatatatatatatttggtatatatatatatatatatatttggtatatatatatatatatatatttggtatatatatatatatatatttggtgtatatatatatatatatatatatatatatacagaaaagtaaaacaattattaatttaagtctttactgaattctcttgaaaggatggcagatggggaagtacttcatttaatagaaaataaaattccttactcatttgtcctcctcaaagttccaaactatg

SEQ ID NO: 4844 - DNA, 464 bp, Homo sapiens
  chr3.fa.O7frz.36021880
  Located on chromosome 3
  Distance between a terminus base of telomere on chromosomal short arm and 5'-terminus of this base sequence : 32218237
  Distance between 3'-terminus of neighbour sequence of sequence listing upward to telomere on chrosomal short arm and 5'-terminus of this base sequence : 61858
agagctccatccttaatattctattcctctggaaccactcctggtaccaaaatctatattagtcagggttctctagagggatggaactaataggatatataggtatatatcctattatatacctatcatatatatatatatatatatttgagtttattaagtattaactcaccacttgggttacagagtgaggccctaacattattagtctaaaagctagtatatgtaactttggtttatagctccacattttgttttctgcataacttaagatactgatgcactgcaaagaattattagtttatatttttgggcaaacaacatataaagatgaaatttcgtgacaacaactgaaaggggtggggatgaagctgttaagggagcagaatttgtgtatgttggggaagataagctggtataaattcaaattaaagtgttataactttaggatgtaatcctcgtgt

SEQ ID NO: 4845 - DNA, 369 bp, Homo sapiens
  AC021117.3_165073
  Located on chromosome 3
  Distance between a terminus base of telomere on chromosomal short arm and 5'-terminus of this base sequence : 32262786
  Distance between 3'-terminus of neighbour sequence of sequence listing upward to telomere on chrosomal short arm and 5'-terminus of this base sequence : 44085
ttcctagtattccaaagatcaagatctctctctttctttctctctctttcacacacacacgcgcgcacacacacacacacacacacacacacacacacacaccccatgtctactagctaaaatggaagtgaatatttgttgattatctgttatcttcagacattgttttaggagttttaattaagtagattatattatttaaatctcacaatattctagtgaggtaatcatttttactcctggacctaattaaatgaaagagcttttgtacaacaaaggaaactatcaacagagtaaatagcctacagaatgggagaaaatattcgcaaactctgcatctgaaaaaggtctgatgtccagcatttataa

SEQ ID NO: 4846 - DNA, 416 bp, Homo sapiens
  chr3.fa.O7frz.37977633
  Located on chromosome 3
  Distance between a terminus base of telomere on chromosomal short arm and 5'-terminus of this base sequence : 32384418
  Distance between 3'-terminus of neighbour sequence of sequence listing upward to telomere on chrosomal short arm and 5'-terminus of this base sequence : 121263
tacaatatggaatctatgccatacaaaatacaaagttttatccaagcaagacaaggccagactgggaattgtacaactgcaatatttcagtgtagggatccaggaaaaatgaaacatgaccttcggaagcatggtgggtgctagttaaaaaataaataaataaataaataaagttcctacaggaaagaaaaacgagctccagggaaatgatctcggactcttggattctgccttcggctttggcttccagagaagctccaccaatggcttcggatgggaagggggtacctgtgcgggtctggggcagctgggaccccaaagcatgcattccagcacatgcaaacaaggaattcccagtcaccaaggagccacagcaagcctcgaacccgacaatgacaatgcatagttgctcagta

SEQ ID NO: 4847 - DNA, 443 bp, Homo sapiens
  chr3.fa.O7frz.38087026
  Located on chromosome 3
  Distance between a terminus base of telomere on chromosomal short arm and 5'-terminus of this base sequence : 32493902
  Distance between 3'-terminus of neighbour sequence of sequence listing upward to telomere on chrosomal short arm and 5'-terminus of this base sequence : 109068
caagaccttcatctcaaacagaagggaaggggaggggaggggaggggaggggaggaaagaaggaaggaaggaaggaagggagggagggagggagggagggagggagggagggaacagagagagacaagaaaaaagaaagaaagaaagaaagaaagagaaagataaagaaagaaagaaagagaaagaaaggaagaaagaaagggaaaggaaaggaagggaaaggaaaggaaaggaaaggaaaggaaaggaaaggaaaggaaaggaaaggaaaggaaaggaaaggaaaggaaaggaaaggaaaggaaaggaaaaagaaaaagaaagaaaggaaggtaggtgatggctcctaaagctgtgctggaaagtcaaatacatcacttctgctgacacttcaatgtcaatggagcagagaaatataatcctcctacaggaagtaacctagc

SEQ ID NO: 4848 - DNA, 453 bp, Homo sapiens
  chr3.fa.O7frz.38211214
  Located on chromosome 3
  Distance between a terminus base of telomere on chromosomal short arm and 5'-terminus of this base sequence : 32616278
  Distance between 3'-terminus of neighbour sequence of sequence listing upward to telomere on chrosomal short arm and 5'-terminus of this base sequence : 121933
ggaatagttacaattgttacgaacaattggtttgcttcaaataactactggtacttggtttaaaaataaatatatggccccacgatatagcatctcagattatgctttttttttttcgatttctctttaccgaggctctgtatcatgactcagctcttgcttcccttttgattttgctctaagtctttctatgtaatgtgtctgtaatttgtgaatagttataagtttttctcaacacattttggaggaaagcaaggtatatctattaatcaatgttctaaatgatgactaacaagatagttttgagtgcttgtgcaagttacagaatttacctctgggtattctgatcttgaatctgaactagaaatgtgtgtgtgtgtgtgtgtttgtgtgtgtgtgtgtgtatacacatgacaccattagtcacccagttagaaatgctttcaagtttta

SEQ ID NO: 4849 - DNA, 419 bp, Homo sapiens
  AC024107.14_198601
  Located on chromosome 3
  Distance between a terminus base of telomere on chromosomal short arm and 5'-terminus of this base sequence : 32628308
  Distance between 3'-terminus of neighbour sequence of sequence listing upward to telomere on chrosomal short arm and 5'-terminus of this base sequence : 11577
tcagtgacataaagatgttcctctgtaaaaattaaaatatgttgttggtttaagcgctaaacaattgctgtggttatagttgaattttaaccatatatatccgtgtgtgtgtgtgtgtgtgtgtgtgtgtgtgtgtgtgtgtgtgtgtatgtgtgcgtcattttttgtgcagctgaaaaggataccacagcccgggtaatttatattgaacagaaacgtattgtatcacagttttgaaggctgggcagtccgagatcaatgggctggcatcttgcaaaagccttcatgttatattgtcccatggcaaaagggcaaagagaggacgagagagagaataaaagggtaccaaactcttccttctataacaaacccattcccatgataatgaactcacttttgccataatggtattaatctac

SEQ ID NO: 4850 - DNA, 396 bp, Homo sapiens
  AC024107.14_14249
  Located on chromosome 3
  Distance between a terminus base of telomere on chromosomal short arm and 5'-terminus of this base sequence : 32643703
  Distance between 3'-terminus of neighbour sequence of sequence listing upward to telomere on chrosomal short arm and 5'-terminus of this base sequence : 14976
agatttactgtaagatccaacagtcccacttttgggtatatatccaaaggaaagatgaaatcagtattccaaaaagatattttcactcctatgttcattacagcattattcacagtagaaaaaaatatgacatcaacctaaatgtccattgacagatgaatggatgaatggataaacacacacacacacacacacacacacacacacacacacacacatttctatgcacaatgaaatattattcaggctttaaaaagaagaaaatcctgttatatgtaaccacatgaatgaaactggaagacactgtactaagtgaaaaaatctaagtacagaaagacaatgttgttagttttattttagccatacttgtaggtatttaatgatatttcatcgtgg

SEQ ID NO: 4851 - DNA, 349 bp, Homo sapiens
  AC024107.14_94671
  Located on chromosome 3
  Distance between a terminus base of telomere on chromosomal short arm and 5'-terminus of this base sequence : 32667996
  Distance between 3'-terminus of neighbour sequence of sequence listing upward to telomere on chrosomal short arm and 5'-terminus of this base sequence : 23897
cctgaactggtatctgcagtttgcatggatccttgaagccatcttcctgaaggctgtcattgctactggttgtgcaatctctgcacgagggttgtttaagggatagctctgtgtgtgtgtgtgtctgtatgtgagagagagagagagagagagagagaaagagagagagagacagagagcgagcttgggtgtccacatatcacaaggcccctcttgatgtaggatggagcaggcaggggggaggaaggcaaattgattaccagggctcaggatgatgtctctctttaaaccacccatttctgtggaaggactatgaacattgtaggagttctaaagttgtacctggtct

SEQ ID NO: 4852 - DNA, 126 bp, Homo sapiens
  D3S3727
  Located on chromosome 3
  Distance between a terminus base of telomere on chromosomal short arm and 5'-terminus of this base sequence : 32690725
  Distance between 3'-terminus of neighbour sequence of sequence listing upward to telomere on chrosomal short arm and 5'-terminus of this base sequence : 22380
ggtaggtagtttcagtgtgaaaatatatatgtatgtgtgtgtgtgtgtgtgtgtgtgtgtgtgtgtgtgtgtgtgtgtatagtactgggattacaggcgtgagccaccgcacccggcccgtactag

SEQ ID NO: 4853 - DNA, 469 bp, Homo sapiens
  AC024107.14_156023
  Located on chromosome 3
  Distance between a terminus base of telomere on chromosomal short arm and 5'-terminus of this base sequence : 32758380
  Distance between 3'-terminus of neighbour sequence of sequence listing upward to telomere on chrosomal short arm and 5'-terminus of this base sequence : 67529
gtgcactttcatcttaatacatttgtatgccttttctcctgttaatctgtctattatcagtttatttcagccgactcaattatcaaaccttcagaagagaagtgtaagcttccctgcacacataatatgtaccatattatcttttggaaagttctccaaaattctagctttccaaacctatcttattctagggatttgagataaggcttgggatatatatatatatatatatatatgaattagaaagtttctttttcatggtatttcttcatgtgcccattacagggacagaaaagataatttttcctctacccttgtaaattctcagctggggcctcaatataaaaagacagattaacaaaagaaaaacaaatagaagtttattaacatgtatacagtgactttttctgtaacctctgcctccccccctcccaccatgtttatagacccctgcatttaaaccatctgg

SEQ ID NO: 4854 - DNA, 459 bp, Homo sapiens
  chr3.fa.O7frz.38521035
  Located on chromosome 3
  Distance between a terminus base of telomere on chromosomal short arm and 5'-terminus of this base sequence : 32924368
  Distance between 3'-terminus of neighbour sequence of sequence listing upward to telomere on chrosomal short arm and 5'-terminus of this base sequence : 165519
gacaaattcataggaattggtcatgatgacatagagacaagattcatgccatggacattcatgacagaaaaagcaacatggactaaggcagaaaagtgtgtgtgtgtgtgtgtgtgtgtgtgtgtgtgtgtgtccaagaaactcaagtacttctgtttgtccaaggggcagggtctgtaaatgagggaaggagcttttgagaaagaggcaaggagaccaaccttgcagggacttcagtagaaactgaggagttcagctgttacttactgagtgggcaataggaggccactgaaagctgttgatgggataagaagactgccttagaaagatgaagcgggactggtgtaaagtttaggtgtgaaaccaagaattgaaggaagagagaaatgatggcaataatccaggccagggagagggaggaaatgaactaaatagtagacaggatggtaggtttacatt

SEQ ID NO: 4855 - DNA, 309 bp, Homo sapiens
  AC025478.13_129650
  Located on chromosome 3
  Distance between a terminus base of telomere on chromosomal short arm and 5'-terminus of this base sequence : 32953064
  Distance between 3'-terminus of neighbour sequence of sequence listing upward to telomere on chrosomal short arm and 5'-terminus of this base sequence : 28237
gactcctgttagtcttccaaacaggaaagtaaaaggaaaggggaaaggggagaaagtggcatctggcagttgattcagaccctttaaataactttcccagtggttttgttcaacaacatctatttaatatagacacttcctctcaagagaggctgggaagtgtgtgtgtgtgtgtgtgtgtgtgtgtgtgtgtgtgtgtgtgtgtgtgtgtgtgaatatgggcactttgggggttctgctattgaggaaaaggagaatggagattgggtagacagccagtaatatctgctatagttacagatttgatcc

SEQ ID NO: 4856 - DNA, 418 bp, Homo sapiens
  chr3.fa.O7frz.38612092
  Located on chromosome 3
  Distance between a terminus base of telomere on chromosomal short arm and 5'-terminus of this base sequence : 33003257
  Distance between 3'-terminus of neighbour sequence of sequence listing upward to telomere on chrosomal short arm and 5'-terminus of this base sequence : 49884
ttctgcttctagtacatcaatcttatttttttcaagttactttattcagcctgtgtgtgtgtgtgtgtgtgcgcgcgcgtgcgcgtgtgtgtgtgtatgcaggttgtttaccaaaagttcattctttccttcatctataaaacaatattattcaggagagatatttatcctgttgaaagtctatattttccaacctcccttgtagctagatatattcatatgagcatgttctggccaacgaagtgttttgtagggcttctggggaacctgcttaaagggagttgacacaaataaaggctagcccttttacccttctgccctttttccttccttactgcttggaattggacatggtatctggagctctagtcattcctcttatatttaaggcattgttatttctggtcaatgattacat

SEQ ID NO: 4857 - DNA, 203 bp, Homo sapiens
  chr3.fa.O7frz.39040979
  Located on chromosome 3
  Distance between a terminus base of telomere on chromosomal short arm and 5'-terminus of this base sequence : 33175087
  Distance between 3'-terminus of neighbour sequence of sequence listing upward to telomere on chrosomal short arm and 5'-terminus of this base sequence : 171412
atcaagcttactttaggctcaggtcaaaaagtatatatattgtcctttcagttttgattctctttgatcatttttgtacacacacacacacacacacacacacacatcactctttattcaaacctccctaagatgtgtattcttatgtttcttattttacttttgatccttttgattcagtatcaacattgtaatccagttgt

SEQ ID NO: 4858 - DNA, 314 bp, Homo sapiens
  AC020625.12_10020
  Located on chromosome 3
  Distance between a terminus base of telomere on chromosomal short arm and 5'-terminus of this base sequence : 33491705
  Distance between 3'-terminus of neighbour sequence of sequence listing upward to telomere on chrosomal short arm and 5'-terminus of this base sequence : 316415
gctggtacagtactttcaagtattacagaatggccatttgagtcctacatccataagatctgaaaaacactgccagaacttaaagacaattctatggcttactcacttgctctgtttcttacacacacacacacacacacacacacacacacccctttccctctagttgctcacatccatcatcagtaccaaaaaaaattttaaatttacaattatttagcacacagtaagcccctgcaatgcatagagccataagccatctacaaaactcaattcaaattacaaaagggatacaagaactcatcgattaactc

SEQ ID NO: 4859 - DNA, 382 bp, Homo sapiens
  chr3.fa.O7frz.39361191
  Located on chromosome 3
  Distance between a terminus base of telomere on chromosomal short arm and 5'-terminus of this base sequence : 33534566
  Distance between 3'-terminus of neighbour sequence of sequence listing upward to telomere on chrosomal short arm and 5'-terminus of this base sequence : 42547
aatatcagctgaaagcatgagtgagtgagtgaatgaatgaatgaatgaatgaatatacaaaggagagcacccaggcatctctttgagagctgggaaggggctgttctcctcccttcggacaggtaagaagattggtctcaatgccactatgagatggatccatttgaacaaaaacaatgtatacacccaatctaagtgacagccagtgggactttaaaattagcaagtgaaaaaggaggtacaataccatttctggggataagtaggaccaggtttgggttttttttcttgctctatcaagactgagaagttcagtagtcaggggacaaggtttcatattttccttgtatacctcccagggtttagttgatcatggtcacag

SEQ ID NO: 4860 - DNA, 307 bp, Homo sapiens
  G08282
  Located on chromosome 3
  Distance between a terminus base of telomere on chromosomal short arm and 5'-terminus of this base sequence : 33688430
  Distance between 3'-terminus of neighbour sequence of sequence listing upward to telomere on chrosomal short arm and 5'-terminus of this base sequence : 153482
ttctcaaaatgcgggagtcgaaagacagacagacagatagatagatagatagatatgcaggagttgaaaaataggcaggcaggtagatagacagagagatagatatgcaggaattgaaagatagatagatagatagatagatagatagatagatagatagatagacagacagataagacccatgcctgactatgcttgtgtagtgttacagaaagcagctgagacatggagagtgccagcagtgtggccgcaggtccccaactatgacctgttcacatgcaaaccacctttgtggactgtagtcagt

SEQ ID NO: 4861 - DNA, 133 bp, Homo sapiens
  D3S2432
  Located on chromosome 3
  Distance between a terminus base of telomere on chromosomal short arm and 5'-terminus of this base sequence : 33688503
  Distance between 3'-terminus of neighbour sequence of sequence listing upward to telomere on chrosomal short arm and 5'-terminus of this base sequence : -234
ggcaggcaggtagatagacagagagatagatatgcaggaattgaaagatagatagatagatagatagatagatagatagatagatagatagacagacagataagacccatgcctgactatgcttgtgtagtgt

SEQ ID NO: 4862 - DNA, 281 bp, Homo sapiens
  chr3.fa.O7frz.39865282
  Located on chromosome 3
  Distance between a terminus base of telomere on chromosomal short arm and 5'-terminus of this base sequence : 33896683
  Distance between 3'-terminus of neighbour sequence of sequence listing upward to telomere on chrosomal short arm and 5'-terminus of this base sequence : 208047
ttcctattcagtgcatctacagtttcacttttacaagatgaaaaagttctagagatcttctgcacagcagtgtgcagtcaacactactgtgtatttaaaaatgattaaggtattaaatgttacgttcttttgaccacacgcgcacacacacacacacacaagtaagtcatgaataaaaaggaaaaaaaagcaacaccttaattgtgaggcaactgtaaaataaatgagaattcaagcaaattttggatggaaaagttgaaatcctacagaagcatagtaca

SEQ ID NO: 4863 - DNA, 475 bp, Homo sapiens
  chr3.fa.O7frz.40064283
  Located on chromosome 3
  Distance between a terminus base of telomere on chromosomal short arm and 5'-terminus of this base sequence : 33950927
  Distance between 3'-terminus of neighbour sequence of sequence listing upward to telomere on chrosomal short arm and 5'-terminus of this base sequence : 53963
tggtttacggaacctaataaactttttaaaaattcactggaggccaggcgcggtggctcacacctgtaatcccagcactttgggaggccgaggcggacggatcacaaggtcaggagattgagaccatcctggctaacacggtgaaaccccgtctctactaaaaattcaaaaaattagctgggcatggtgtcgggtgcctgtagtcccagctactcaggaggctgaggcaggagaatggcatgaacccaggaggcggagcttgcagtgaggcgagatcgcgccactgcactccagcttgggcgacagagtgagactccatctcaaaaataaataaataaataaataaataaataaataaataaacaaacaaataaagaaattcactggaaaaggattttaaaggctgatattggaagagtttcatggacacctgatgcctttgtctgcctggcatagctcagacttcctaacaaaa

SEQ ID NO: 4864 - DNA, 355 bp, Homo sapiens
  AC010742.3_125628
  Located on chromosome 3
  Distance between a terminus base of telomere on chromosomal short arm and 5'-terminus of this base sequence : 34156632
  Distance between 3'-terminus of neighbour sequence of sequence listing upward to telomere on chrosomal short arm and 5'-terminus of this base sequence : 205230
ctaattgctgatggtcaaatacatcaaagttataaaattgcaaaaaaaaaacaacctaatttattagttaagtaatcagaagaatgtaaaactggtttataggcggttatgagaggggtgtgtgtgtgtgtgtgtgtgtgtgtgtgtgtgtgtgtgtattcagtgaaagaaaaaaaataatgctaagataagattgctaggttaaatccaaaactggtttatggtttaccggaaaataaaattgttatctttgtgatgaactctaacacagataaatcatttttatctccctctaacaaaaataatttgcaatttaccaattttctataattaataccttaattatggaatctgg

SEQ ID NO: 4865 - DNA, 355 bp, Homo sapiens; identical to SEQ ID NO: 4864
  AC046140.9_73794
  Located on chromosome 3
  Distance between a terminus base of telomere on chromosomal short arm and 5'-terminus of this base sequence : 34156632
  Distance between 3'-terminus of neighbour sequence of sequence listing upward to telomere on chrosomal short arm and 5'-terminus of this base sequence : -355

SEQ ID NO: 4866 - DNA, 387 bp, Homo sapiens
  AC046140.9_123741
  Located on chromosome 3
  Distance between a terminus base of telomere on chromosomal short arm and 5'-terminus of this base sequence : 34174822
  Distance between 3'-terminus of neighbour sequence of sequence listing upward to telomere on chrosomal short arm and 5'-terminus of this base sequence : 17835
catggctgtatttcagatctaaaagttttgagattttcaaaatcaaaaattactttcttatgcaaaatggcaatgcaaacagcaatcctacataatgtagaataatttttcttctgtacggctccttctaaaaaatgggtaaccacacacacacacacacacacacacgacataaatttagtccatctgaagaagcactccagctttctaattccacttttgaaggaaaaggcagaggcatgtttacattatcccagaaaacagaataaatggctttatttggtatcttcaagaagcttctccttccgtaggagatgtaggtgttgtgggagaaactgtaactggttttcgtgtaattctgtctagttctgcatgaacatctaagac

SEQ ID NO: 4867 - DNA, 201 bp, Homo sapiens
  D3S2423
  Located on chromosome 3
  Distance between a terminus base of telomere on chromosomal short arm and 5'-terminus of this base sequence : 34360542
  Distance between 3'-terminus of neighbour sequence of sequence listing upward to telomere on chrosomal short arm and 5'-terminus of this base sequence : 185333
tgggatcctgtctcaaaaaaaaatctatatatctctatctctatctctgtctctatctctatctctatctatctatcatctatctatctatctatctatctatctatctatcatctatctatctatctatctatctatctatctatctatctatctatgtctgtatatataaaggctccatatatcatgtttagccagaga

SEQ ID NO: 4868 - DNA, 453 bp, Homo sapiens
  AC026314.9_79205
  Located on chromosome 3
  Distance between a terminus base of telomere on chromosomal short arm and 5'-terminus of this base sequence : 34540822
  Distance between 3'-terminus of neighbour sequence of sequence listing upward to telomere on chrosomal short arm and 5'-terminus of this base sequence : 180079
gctaagatctggactctagatgtactcactgttagtgatatgtcactgctccccagacctctcagtgggcagagctagggagtgtgtgtgtgtgtgtgtgtgtgtgtgtgtgtgtgtgtgtgtgtagagatttacatctctgtttccatatctatcaaaaaccatgtttttacactagtagttccattctggcaccaaggaaattctaatttccagattgataacccacttttctgacagaaacctagctttcgttatctttaatatgtttaccaatttgatcagtcctctgtatgctaccagtttttctgctatctctgctattacctccttacttgcacagatctactcctcatcctgctaggctttgccattccatcctcactcaaaaccatgaatgcccttcttattccactttggctccagcagcttacacctgattaccactctatg

SEQ ID NO: 4869 - DNA, 269 bp, Homo sapiens
  chr3.fa.O7frz.40732636
  Located on chromosome 3
  Distance between a terminus base of telomere on chromosomal short arm and 5'-terminus of this base sequence : 34556367
  Distance between 3'-terminus of neighbour sequence of sequence listing upward to telomere on chrosomal short arm and 5'-terminus of this base sequence : 15092
gtaagaaacttacctaactgcctaccatcccccatgctcagtagccttgatgatggtggcccatatttgtggtgtagcttgctggtgccaggagggacatggaccttgttctcaaaaaattgtggttatgttttgttgttgttgttgttgttgttgttgttgttgttgttgtttttatctctggcattccctgagaggctggcacagagactagcctttgtttcacctcccatcaggctgaagtggcttcctaagtggagtctattgaa

SEQ ID NO: 4870 - DNA, 171 bp, Homo sapiens
  chr3.fa.O7frz.40854399
  Located on chromosome 3
  Distance between a terminus base of telomere on chromosomal short arm and 5'-terminus of this base sequence : 34673498
  Distance between 3'-terminus of neighbour sequence of sequence listing upward to telomere on chrosomal short arm and 5'-terminus of this base sequence : 116862
ttctgagccagtctaaatgtagtaagaggttaggctcatagttttttccttttcagtttattttctgaaagctgatgcaactgaggatatgttgttattccattaactaactaactaactaactaactaactaaactattccagactttaaaaggaagcaaacctgatttt

SEQ ID NO: 4871 - DNA, 101 bp, Homo sapiens
  DISD22_0002639
  Located on chromosome 3
  Distance between a terminus base of telomere on chromosomal short arm and 5'-terminus of this base sequence : 34900656
  Distance between 3'-terminus of neighbour sequence of sequence listing upward to telomere on chrosomal short arm and 5'-terminus of this base sequence : 226987
tgcaagtggtagggattgcaaacacacacacacacacacacacacacacacacacacacacacacagcattgtggaaggaagatgagcttaaaggtcagaa

SEQ ID NO: 4872 - DNA, 413 bp, Homo sapiens
  chr3.fa.O7frz.41314204
  Located on chromosome 3
  Distance between a terminus base of telomere on chromosomal short arm and 5'-terminus of this base sequence : 35053021
  Distance between 3'-terminus of neighbour sequence of sequence listing upward to telomere on chrosomal short arm and 5'-terminus of this base sequence : 152264
cctatgtagcaaacctgtacattctgcacatgtatcccagaacttaaagttaaaaaaatatatatatatatatatatatatatatgaaaatcaactgactgttaatcagagagtttatgtctagactctaaattctatctgattgaactatatgacacctttgtggtagtaccaggctatattgatggctatagctttgtagaaacttttgaaattggctccacctactttgttctttttaaaggttgttttggctactctaagtcccttgacttttagaatcagtttgtcaatttctgcaaagaagtcatctgggactttaatgaagattacattgaatcttgtagatcgatttagggaatatttattgccatcttagacaaatagtcttctaatctatgaacatggcatgt

SEQ ID NO: 4873 - DNA, 156 bp, Homo sapiens
  DISD22_0002654
  Located on chromosome 3
  Distance between a terminus base of telomere on chromosomal short arm and 5'-terminus of this base sequence : 35252546
  Distance between 3'-terminus of neighbour sequence of sequence listing upward to telomere on chrosomal short arm and 5'-terminus of this base sequence : 199112
gcaggattcacaacaatatctagagtatgatagcttttgtgttaaaaaaaaaaagcaggacatatcaccacacacacacacacacacacacacacacacacacacacacacacacacaattattttcccaaaagacatattggaaggataagccac

SEQ ID NO: 4874 - DNA, 398 bp, Homo sapiens
  AC018359.7_157736
  Located on chromosome 3
  Distance between a terminus base of telomere on chromosomal short arm and 5'-terminus of this base sequence : 35411840
  Distance between 3'-terminus of neighbour sequence of sequence listing upward to telomere on chrosomal short arm and 5'-terminus of this base sequence : 159138
gcttaggtgtacctaaccttctgtgtatacctaaccttattttttcccttccttttttccttccttccttccttttctttctttctttctttttctcttccttcttccttccctcccacaaatattcattgagggtttatcatataccagtatgtgttttgagtactgagtatgatggtaaacaaaaccaacaacattttttaccttaaaaaatctgcattctctgtggagatatagatgatacacaaacaaatgaatacacacacacacacacacacacactcgcacacactaatgaatgccaggcagtgacatgtgtaatgaagaaaactgtcagagctcagggtaaagagacaaagagttaaggaggtgatggtaggaaagcacttaaccataaa

SEQ ID NO: 4875 - DNA, 433 bp, Homo sapiens
  AC018359.7_100526
  Located on chromosome 3
  Distance between a terminus base of telomere on chromosomal short arm and 5'-terminus of this base sequence : 35469159
  Distance between 3'-terminus of neighbour sequence of sequence listing upward to telomere on chrosomal short arm and 5'-terminus of this base sequence : 56921
caactccttctaggtcttcattatgattctttttcttaaggttagagtgcccaaagctcaatccttggacctcttttcttgctttattgacattttctaggcgatttgagcccagtgaaatactgataactcccaaccaaccaaccaaccaaccaaccaaccaaccaaccaactcagctctttatttgctcaaacttgacactcatatgcccacctgctctctacttggaggtttgaaagacccctcaaactcaatgtcccattttcctcctactcctcagctttccccctcttagattatgacaattacatctttcaacctgctcaggccccatacccttcaagccactttttctcacaatctgcatccaatccagttagcactaccttcaaaatatccagactatatctagaattggtccttctttacttc

SEQ ID NO: 4876 - DNA, 447 bp, Homo sapiens
  AC068761.5_44441
  Located on chromosome 3
  Distance between a terminus base of telomere on chromosomal short arm and 5'-terminus of this base sequence : 35476962
  Distance between 3'-terminus of neighbour sequence of sequence listing upward to telomere on chrosomal short arm and 5'-terminus of this base sequence : 7370
tctatgaacatgaagctcctaggatagagggaagaaaagatgctagacagtggatctgctgcctcccagcatgataatggtggctgcaccaacttctttgttttttaaggcatgaaaacaccagtcttgtgtgtgtgtgtgtgtgtgtgtgtgttggtggtggtggtgaggggtgtttgagggtggggcggtcagcttctatagatcagtaaatatctccagatctcatcctgcttagtcaaggcttctttcccttccatctgcctttgccaagacactgaaatgtaaagcaatggcatgtatagttagtcctctctatttgcagatttcacatatgtagattcaaccaactatggattgaaaatatttggaaagtaattagatctttagtgaacatgtacaggctttttttctgtcattattctctaaacaatatggtttaactgc

SEQ ID NO: 4877 - DNA, 218 bp, Homo sapiens
  D3S1612
  Located on chromosome 3
  Distance between a terminus base of telomere on chromosomal short arm and 5'-terminus of this base sequence : 35478605
  Distance between 3'-terminus of neighbour sequence of sequence listing upward to telomere on chrosomal short arm and 5'-terminus of this base sequence : 1196
cccattaagaaatgttactctacattgtgtgtgtgtgtgtgtgtgtgtgtgtgtgtgtgtgtgtggcagaattttccactgaggagagcacctggaaatcttaaaacatctaacattccagggatgttgggatctgttggtatgtaaatggcctcagccatcacctccttcacttcttgctcttagaatacaatttgacataactgctgactaaaaga

SEQ ID NO: 4878 - DNA, 135 bp, Homo sapiens
  D3S3512
  Located on chromosome 3
  Distance between a terminus base of telomere on chromosomal short arm and 5'-terminus of this base sequence : 35483230
  Distance between 3'-terminus of neighbour sequence of sequence listing upward to telomere on chrosomal short arm and 5'-terminus of this base sequence : 4407
accaagtttttaaggccaatgcacttcttgtccacaagtggtagaggtaaaagatgaatttagggtgtgcgtgtgtgtgtgtgtgtgtgtgtgtgtgtgtgtgtgtgtgtattgcaggaggcaggtgtgggatct

SEQ ID NO: 4879 - DNA, 384 bp, Homo sapiens
  AC018359.7_56348
  Located on chromosome 3
  Distance between a terminus base of telomere on chromosomal short arm and 5'-terminus of this base sequence : 35513390
  Distance between 3'-terminus of neighbour sequence of sequence listing upward to telomere on chrosomal short arm and 5'-terminus of this base sequence : 30025
acagtgcctcaagtgtcacagaagaatgtgtttggtagtgacatgtgcttactgcatatttgtgctggttgctgccaaagattagatagatagatagatagatagatagatagatagatatacagacagatgacagatagatggataaaacagtgcattttaattgtactagaatcatgtagttatacaattattgacattctgattgtaccaaaataacttagatttttatccaacagcaaatcacagtggaaggtgatgtgataaaagccttagcagtgcatttctatttttcttttttttttctctaaaagtggatagtaaaatcaatgaaagcaagtgactatatcctttacttaataatgcttctagcattaagtcatg

SEQ ID NO: 4880 - DNA, 185 bp, Homo sapiens
  D3S1768
  Located on chromosome 3
  Distance between a terminus base of telomere on chromosomal short arm and 5'-terminus of this base sequence : 35513456
  Distance between 3'-terminus of neighbour sequence of sequence listing upward to telomere on chrosomal short arm and 5'-terminus of this base sequence : -318
ggttgctgccaaagattagatagatagatagatagatagatagatagatagatatacagacagatgacagatagatggataaaacagtgcattttaattgtactagaatcatgtagttatacaattattgacattctgattgtaccaaaataacttagatttttatccaacagcaaatcacagtg

SEQ ID NO: 4881 - DNA, 263 bp, Homo sapiens
  D3S1277
  Located on chromosome 3
  Distance between a terminus base of telomere on chromosomal short arm and 5'-terminus of this base sequence : 35544885
  Distance between 3'-terminus of neighbour sequence of sequence listing upward to telomere on chrosomal short arm and 5'-terminus of this base sequence : 31244
attaggtgatctgagccaggccaagttctgtagaattacccagttactcaacagatacaagagcactaataaaatgttgtatgaagccatgcattttgggtgctcattatgcagcaagatacaaccgatacatgagacaagaactacttttatctattgacaagtctctacctttcttcccaaacaccacacacacacacacacacacacacacacacacacagagttgtgtgtggtggtgggggaggcagaagaatgtttct

SEQ ID NO: 4882 - DNA, 338 bp, Homo sapiens
  AC068761.5_77808
  Located on chromosome 3
  Distance between a terminus base of telomere on chromosomal short arm and 5'-terminus of this base sequence : 35544902
  Distance between 3'-terminus of neighbour sequence of sequence listing upward to telomere on chrosomal short arm and 5'-terminus of this base sequence : -246
aggccaagttctgtagaattacccagttactcaacagatacaagagcactaataaaatgttgtatgaagccatgcattttgggtgctcattatgcagcaagatacaaccgatacatgagacaagaactacttttatctattgacaagtctctacctttcttcccaaacaccacacacacacacacacacacacacacacacacacagagttgtgtgtggtggtgggggaggcagaagaatgtttctaactgagctgcacttagaaactctacactgcagttctcaatcaaatgaatggcagttccagcacctttatgaacttgccagtaaccattagt

SEQ ID NO: 4883 - DNA, 444 bp, Homo sapiens
  chr3.fa.O7frz.42095535
  Located on chromosome 3
  Distance between a terminus base of telomere on chromosomal short arm and 5'-terminus of this base sequence : 35774581
  Distance between 3'-terminus of neighbour sequence of sequence listing upward to telomere on chrosomal short arm and 5'-terminus of this base sequence : 229341
gatagcaatttcatttaatttcagattcccagtcacactttatggtaatgacagaaaaagagaagaaagggagggagagacaaaagaaaagagtggggtgggaaataagagaggaacaatgaaactaagagaatttgaacaggtgttttaattcttatcggagtcaatataagcaatgccacacacacacacacacacacacacacacacacacacacacaactagacactgaagctaatagaaatataattttaatttgttggtgaagtgcagctatacaacacatttttaagaaattaaagcagcatgttcacatctcctaaatatgctgagtccacagttagtggagctggcacattcgaagcttagttgtttctatggtaacatgggcaaaggcatgggtgatagagggaagtctgctgagatttaatgtgaataaagga

SEQ ID NO: 4884 - DNA, 446 bp, Homo sapiens
  AC022225.19_18901
  Located on chromosome 3
  Distance between a terminus base of telomere on chromosomal short arm and 5'-terminus of this base sequence : 35960828
  Distance between 3'-terminus of neighbour sequence of sequence listing upward to telomere on chrosomal short arm and 5'-terminus of this base sequence : 185803
taggtattaacaaacctagcagaatccctttgaattcagctgggattcaggaagatactctaggacaaagaaacacttttgtgtacttgatcagaaataaaagaaaaagactaacaataattcaataatacaaaccataaatcaccaccaaagtatattagaatataacagcaacaatttataaaataacaattatagctgtcatttactgagttcctgtactgtgtcattggacctggtaatggatgttttttatacgatgtatgccacacacacacacacacacacacacacacacacactcatacacaggactttaaattttttaaactctgtaattaatatcttgatatttgaatattgccaaaaaagtacatctgagatcatataactttgttaaaagcacacagctaataaattccaggtctacctggctctattaggag

SEQ ID NO: 4885 - DNA, 454 bp, Homo sapiens
  AC074275.5_160853
  Located on chromosome 3
  Distance between a terminus base of telomere on chromosomal short arm and 5'-terminus of this base sequence : 36241142
  Distance between 3'-terminus of neighbour sequence of sequence listing upward to telomere on chrosomal short arm and 5'-terminus of this base sequence : 279868
agtaacatgctatgcagttgagttatattctagaattgctgcctgtactcaaattcttttgacctacaaattgtcaaagaagagataacacactgcctacactattgattttattcatcataatttttgctttaacatcccaaatgcccaacacattataaatcatttattgtgcctgatactaatcaatatgccatggacaaaagttaaaaaatagtatcattggtgacacagtgatgatggtgatgatgatgatgatgatgatgatgatgatgatgatgataatgatgactatgaagatcagcttatgttatgaaaagggctttctgcaagggatcagtctagttaccaagtgtttctagaaattgagcatgcaccaaagaatttagcaagttaccaaagaaaaaaatctggtgtagaaatggtataagttgcagtacaatttatgtaatga

SEQ ID NO: 4886 - DNA, 131 bp, Homo sapiens
  chr3.fa.O7frz.42742861
  Located on chromosome 3
  Distance between a terminus base of telomere on chromosomal short arm and 5'-terminus of this base sequence : 36241321
  Distance between 3'-terminus of neighbour sequence of sequence listing upward to telomere on chrosomal short arm and 5'-terminus of this base sequence : -275
tactaatcaatatgccatggacaaaagttaaaaaatagtatcattggtgacacagtgatgatggtgatgatgatgatgatgatgatgatgatgatgatgatgataatgatgactatgaagatcagcttatg

SEQ ID NO: 4887 - DNA, 460 bp, Homo sapiens
  AC019329.3_162262
  Located on chromosome 3
  Distance between a terminus base of telomere on chromosomal short arm and 5'-terminus of this base sequence : 36318466
  Distance between 3'-terminus of neighbour sequence of sequence listing upward to telomere on chrosomal short arm and 5'-terminus of this base sequence : 77014
ttgctacttcacatttatggagaagctttattggttctgtgaccttgggcacgttacttaacccctctgacttttcgtataaagcagagttattaatgactttcaaacagagctgttgtcaggattacaatacatttttaaagatgtaaaagacttgctacctaaaaaggtaactcacctgaattatctcagtttatccttacaatctcagtgggtggagaataggttgtgtgtgtgtgtgtgtgtgtgtgtgtgtaaactcacaagaggattcgagttcagagaaatggagtaaactgtttaatgccacaaggctggtaggctgcaaaaatagatttccctctggcaattttgacactcatagcacgttggacctacatgtgtttcctgagaccaaaacctgaccttttccaggaatctcctattgactctcaataagtttcaagaaatgagacattca

SEQ ID NO: 4888 - DNA, 387 bp, Homo sapiens
  chr3.fa.O7frz.42860997
  Located on chromosome 3
  Distance between a terminus base of telomere on chromosomal short arm and 5'-terminus of this base sequence : 36453874
  Distance between 3'-terminus of neighbour sequence of sequence listing upward to telomere on chrosomal short arm and 5'-terminus of this base sequence : 134948
cactttaatggcctctagtttcatacatgtttctgcaaatgatatggtttcattatcttcttggctgaatagtaatccattatttgtgtgtgtgtgtatatatataaatatatatataaatatatatatatcacattttctttattcactcatgtactgatgggcacttagcttgattccgtattttggctattgtgaatagtgtgctgtaataaatatgggattgcagattatgtctttgaaatattgattttcttgattttctttcttttaggtatatacccagtggtggaattgctggataatatagcagttctatttttagttttctagggaacctccatactattctctatagtggctgtactaatttacatttccatcagc

SEQ ID NO: 4889 - DNA, 434 bp, Homo sapiens
  AC019329.3_12730
  Located on chromosome 3
  Distance between a terminus base of telomere on chromosomal short arm and 5'-terminus of this base sequence : 36463485
  Distance between 3'-terminus of neighbour sequence of sequence listing upward to telomere on chrosomal short arm and 5'-terminus of this base sequence : 9224
gaattctagttgcttgactacctattaatgtcaatatttttatttttgtcattctagtgggtatatagtaatatctcattttggttttaatttgcatttccttgatgactaaaaatcttgagcaccttattatgcgtttgtcaaccagttggatattccttttggttttgaaatatttgctgtgttatcttttttcttattgtttgtttaatttagaaatattttctggataaaagttgtgtgcgtgtgtgtgtatatgtgtgtgtgtgtgtgtgtgtgtgtgtgatatgtgctctatattttcccagtttgtgttttgcctttttacttgatgacatcttttgatagataaaaatgtaaaattttgatatagtattacttatcatttcatcctttataattagtgctttatgtgtcctgattaaggaattctt

SEQ ID NO: 4890 - DNA, 467 bp, Homo sapiens
  chr3.fa.O7frz.87024419
  Located on chromosome 3
  Distance between a terminus base of telomere on chromosomal short arm and 5'-terminus of this base sequence : 36526482
  Distance between 3'-terminus of neighbour sequence of sequence listing upward to telomere on chrosomal short arm and 5'-terminus of this base sequence : 62563
attaaacctgaatttgagtccttgatccactattgactatctctttgcccttcagtaaattacttgacattttatatcctaatttgttcatctgtaacatggaattaataatagtaactgcaggccaggtgcagtggttcacacctgtaatcccagcactttgggaggccgaggcaggcaaatcacatgaggccaggagtttgagactaacctttccaacgtggtaaaaccctatctctactaaaaatacaaaaaaattagacaggtgtgatggcatacacatgtaatcccagctgttctggaggctgagacatgagaatcattgaaactgggaggtggaggttgcagtgagctgagattgtgtcactgcactccagcctgggtgacagagtgagaccctgtctcaataataataataataataataataataataataataatagtaactgcagtcaaagttcatt

SEQ ID NO: 4891 - DNA, 392 bp, Homo sapiens
  AC016945.10_66124
  Located on chromosome 3
  Distance between a terminus base of telomere on chromosomal short arm and 5'-terminus of this base sequence : 36543378
  Distance between 3'-terminus of neighbour sequence of sequence listing upward to telomere on chrosomal short arm and 5'-terminus of this base sequence : 16429
ctggtcttgaactcctaatttcgtgatctgcccacctcagcctcccaaagtgctgggataacaggtgtgagccaccgcaccgagctgattagataatttttgagatattcaactgtgattcatttcctcttcagtctctcccaacacacacacacacacacacacacacacacacacacacacacacacacacacacagttcaaactacacacccagggcttttatagtcctttgatttagggggaggatatttgggggaagacatcaactcctgctccccttttccctcatctctttcatttttcatagtggctgtcttaaaccatgtgaaattgttctaagaggcttctcagcccagtgatttactatgaagatactaactgtccaagcc

SEQ ID NO: 4892 - DNA, 450 bp, Homo sapiens
  chr3.fa.O7frz.87268293
  Located on chromosome 3
  Distance between a terminus base of telomere on chromosomal short arm and 5'-terminus of this base sequence : 36702165
  Distance between 3'-terminus of neighbour sequence of sequence listing upward to telomere on chrosomal short arm and 5'-terminus of this base sequence : 158395
gtctcaaactcttaacctcaagtgattcacctgcctcggcctcccaaagctctgggattacaggtgtgggccactgcgccccagccctctggtattattttaaagaaacctctctctctcgctctgtctctctctctctgtgtatatgtgtgtgtgtgtgtatatatatatatatatatgaaattataatatgtgatttatattctcctaaaactattttaatatttccttgattacactggtaaatctaggagataaaaactttccattatatttcagactcagttggatatcaggaacaacgttactcactcagattctcaccttggcaaaatatttcagtaaaattaagtttagctttttgcagctcacttaccctggaattgatgatgtctgttggatggtaaataaatgccaatgaccatgagctgagtgaacaaagtacgctac

SEQ ID NO: 4893 - DNA, 366 bp, Homo sapiens
  AC021751.20_63061
  Located on chromosome 3
  Distance between a terminus base of telomere on chromosomal short arm and 5'-terminus of this base sequence : 36860135
  Distance between 3'-terminus of neighbour sequence of sequence listing upward to telomere on chrosomal short arm and 5'-terminus of this base sequence : 157520
ctagaccagccaatctttagacatgtggccgagtctagcctagatcagcagagccacctaggcacctacctcagaggtatgactggtaaacacttattgttgcatgccattaaggttttgtggttgcttattatgcagcattattgtggcgatagataactaatacaaaaatatgaaacccaagaatgaatggagtacttaaatcactgaaaggagtacaagcagtatcaattcccattggttatcttatatatatcatatatatatatatatatatatatatatatatatatagtctgtagacttctctgaaacagtttaaaaacagatcctattgtgtgatcaataccaatagaaggactattg

SEQ ID NO: 4894 - DNA, 246 bp, Homo sapiens
  AC026350.10_59555
  Located on chromosome 3
  Distance between a terminus base of telomere on chromosomal short arm and 5'-terminus of this base sequence : 37004727
  Distance between 3'-terminus of neighbour sequence of sequence listing upward to telomere on chrosomal short arm and 5'-terminus of this base sequence : 144226
gcaaagcatacctctaagattaatatccaattaattgtcgaattattgggactagtctagaggtgaaaacctcagtatccatcgacagatgaatggataaagaaaatgtacacacacacacacacacacacacacacacacacacacacacacacacacactggatttctattcagccttaaaaacaaaggaaatcttatgctgtcatttaggacaacgtggaagtaactggaagacattatgcaa

SEQ ID NO: 4895 - DNA, 219 bp, Homo sapiens
  chr3.fa.O7frz.36516960
  Located on chromosome 3
  Distance between a terminus base of telomere on chromosomal short arm and 5'-terminus of this base sequence : 37007713
  Distance between 3'-terminus of neighbour sequence of sequence listing upward to telomere on chrosomal short arm and 5'-terminus of this base sequence : 2740
aggctacatatgtacattgcacattttcagaggcaccattcctgtatattagtgtgagtggaatccccagaatgggccaatatgcatgacatctctggagatgaagtccgttttcttgttggtgtaagggagaaaatacatttaaaaagcacacatacacacacacacacacacacacacacacacacacacacacagactaccatgcttcctatgatt

SEQ ID NO: 4896 - DNA, 150 bp, Homo sapiens
  D3S1283
  Located on chromosome 3
  Distance between a terminus base of telomere on chromosomal short arm and 5'-terminus of this base sequence : 37060066
  Distance between 3'-terminus of neighbour sequence of sequence listing upward to telomere on chrosomal short arm and 5'-terminus of this base sequence : 52134
gagtaacagaggcatcgtgtattctttattgaagtgtatgtgtgagcgtgtgtgtgtgtgtgtgtgtgtgtgtgtgtgtgttgatgaatatgaagttttccaaagtttgagacccaaggtactgggtccatttctacaggtggtactgcc

SEQ ID NO: 4897 - DNA, 402 bp, Homo sapiens
  chr3.fa.O7frz.36637927
  Located on chromosome 3
  Distance between a terminus base of telomere on chromosomal short arm and 5'-terminus of this base sequence : 37103834
  Distance between 3'-terminus of neighbour sequence of sequence listing upward to telomere on chrosomal short arm and 5'-terminus of this base sequence : 43618
tcagtaatacttcactctcctgagtccctccatcttctctggcttttcttttatttcttggaggcttgtctttttcattaggtatgttttgaagttcctcaagactgggcctgaggcatcttctcttctattttttctcttttacctttaggggaaaagaaaagtgataggtgatttatttatttatttatttatttatttatttatttattacctatcactaggttcatggctgtggttcttaaagattaataagagacaattatacagatttatttaatgtaagttttatatgacatgagaaccttcagaaatggggagccaaggaaacagggaaagctgtacatttttatgttaggtttgacaaagaagtcaatagtaatggataagtatgattggaca

SEQ ID NO: 4898 - DNA, 349 bp, Homo sapiens
  AC025543.4_58895
  Located on chromosome 3
  Distance between a terminus base of telomere on chromosomal short arm and 5'-terminus of this base sequence : 37162789
  Distance between 3'-terminus of neighbour sequence of sequence listing upward to telomere on chrosomal short arm and 5'-terminus of this base sequence : 58553
ctatagccaacatctgttcaattcttatgtctttagtgcataaaaatgagatctataggttatttgatgtgagaatgtacacctttggggaatgtgtgtgtgtgtgtgtgtgtgtgtgtgtgtgtgtgtgtgtgtgtggagggggagggtaataaagttcaggcaccttttatgagtaccattgtcagagactgaccttccatgctagatctgcctggcactagccaccctaatgaatcatcatgaagcccagagctagttttgctctgattggctctcatcattaaaaaggaggtattcttaaaaaatacataaataaaaaaattgagagtatgctttaggtgcatta

SEQ ID NO: 4899 - DNA, 305 bp, Homo sapiens
  AC025543.4_163994
  Located on chromosome 3
  Distance between a terminus base of telomere on chromosomal short arm and 5'-terminus of this base sequence : 37267441
  Distance between 3'-terminus of neighbour sequence of sequence listing upward to telomere on chrosomal short arm and 5'-terminus of this base sequence : 104303
tgaggttgacactccttagatatttattgactggtaaaattaatggtccctggacattccttagaataattttttaataatgtattttacacaatatgttcatgtgtgggttctgtgtctgtgtgtatatgtgtgtgtgtgtgtgtgtgtgtgtgtgtgtgtgtgtgcatgcacacagcagctaatcagtcacttaatggaaggagcactgcaaattgtctgtgtacccccaggaacaattccccactactgagttgccatatcactcagcagggttgagaccctagcagtggcgttaagtatta

SEQ ID NO: 4900 - DNA, 302 bp, Homo sapiens
  chr3.fa.O7frz.36880213
  Located on chromosome 3
  Distance between a terminus base of telomere on chromosomal short arm and 5'-terminus of this base sequence : 37351563
  Distance between 3'-terminus of neighbour sequence of sequence listing upward to telomere on chrosomal short arm and 5'-terminus of this base sequence : 83817
tgctgtcttcctttatgattaagagattttctctattggtatgctttcttttaaggtggggcattaaatttcttcactgacttactggttttcaaaagcatgttgtttacttcatatgtatttgtgaattttctggaattcctcctgttatttctggtttccatatataaatatatatatatatatatatatatatatatatatatattccatatattgtggtaggaaaagatacttgttataatttcagtcttcttaaatttgttaaggcatgttttgtgactgtctatctgaatctatcc

SEQ ID NO: 4901 - DNA, 442 bp, Homo sapiens
  AC067874.2_159832
  Located on chromosome 3
  Distance between a terminus base of telomere on chromosomal short arm and 5'-terminus of this base sequence : 37377567
  Distance between 3'-terminus of neighbour sequence of sequence listing upward to telomere on chrosomal short arm and 5'-terminus of this base sequence : 25702
ttaggatctaaagatgctcataagagtttgatgaatccatgatgatcttcaattagaatataaaagtggggaaggagggcaataatttgaacttaacctacgtggttattttatgaaaagttggatcagaatagttctccctttccccagcctacacgcacacacacacacacacacacacacacacacacacacacacacacttctctatgcagacacaaatacattagcactgaagcatggaaaacttgaaggccaggtggaggtgctcataaatattcatcagaatatcatattggtgtttcctggtattctgtcctcaaatatcattgcaatgtttcagaaccaagtatttttgctgttagattacaaattatctgaggacgcagagaaatctctatgcagttttaaaattacaaggtacattccatgatttagcaaa

SEQ ID NO: 4902 - DNA, 465 bp, Homo sapiens
  chr3.fa.O7frz.36956398
  Located on chromosome 3
  Distance between a terminus base of telomere on chromosomal short arm and 5'-terminus of this base sequence : 37427761
  Distance between 3'-terminus of neighbour sequence of sequence listing upward to telomere on chrosomal short arm and 5'-terminus of this base sequence : 49752
cactatggcagttaagatcaagagtcaaggccaggtgcggtggcttatgcctgtaatctagtgctttgggaggctgaggtgggaggatcgcttgaggccaggagtttgagaccagcctgagcaacatagtgagacctcatctctacaaaaggtaaaaaaacaaacaaacaaacaaacaaacaaacaaacaaacaaacaggagtcccaaagtctcaggggcctcacactcacactgttttctccaccacacagtgccaaacattcccagaaaacctcctaaaatgagctcagtacaacccatcctggtcataagtggatactgttctaaactcttaagaggtacaagcatttcatcacacttgctaaatgctaacctgagccttgccacatttttactaattggacagaacgtatttcttaacatttctgtttttgattcttgttaattggtgagtaccaaagtac

SEQ ID NO: 4903 - DNA, 355 bp, Homo sapiens
  AC012556.12_32583
  Located on chromosome 3
  Distance between a terminus base of telomere on chromosomal short arm and 5'-terminus of this base sequence : 37506022
  Distance between 3'-terminus of neighbour sequence of sequence listing upward to telomere on chrosomal short arm and 5'-terminus of this base sequence : 77796
ttatctgccagacttactcaagattaccttttgtatctttctccaatcccctcgtgcagtgttggcaggggcacagtcagaatttattcagcttcatgggtatgacctgatggctgaaaaaacctttggtaagagaccaatgcaggtcatttgtaaaaccttgcttgtttctctctctctctctctctctctctctctctctcgtagtgttggcctctcacagtgcttgttaccattttacattaacagtcttctaaagattaaaatcactttccattcctgtacctcatctcacactttaaaataatttcactcacacaacagataattttagtagatttaaatgaacttgcca

SEQ ID NO: 4904 - DNA, 452 bp, Homo sapiens
  chr3.fa.O7frz.37192767
  Located on chromosome 3
  Distance between a terminus base of telomere on chromosomal short arm and 5'-terminus of this base sequence : 37613955
  Distance between 3'-terminus of neighbour sequence of sequence listing upward to telomere on chrosomal short arm and 5'-terminus of this base sequence : 107578
ttgttcatccaacattgtaatatgagttcttcagattcctagagaaagctcaaaggctgtccaaatccccacagctatggccatctctagtcttttgattttaactatacaaggaaattcttattatgaaatctttttatgaattatttttaaacattttttaacatttgtaatgttagtttttccaaggaaaactttgttgttagcagcaaatttttccagaataaaacgctgacaaaaaaatcagtaactttttaaaaaggctttatttagtgctttatatgttgctggcactgtttgatgagacgggtttgtgtgtgtgtgtgtgtgtgtgtgtgtgtgtttcacatgaaatatgcacatacacatttattttttatttaatttagctactttagctcatttaatcttcatgacaaccctacaaggtgcatttgcttatcataaattat

SEQ ID NO: 4905 - DNA, 438 bp, Homo sapiens
  chr3.fa.O7frz.37286914
  Located on chromosome 3
  Distance between a terminus base of telomere on chromosomal short arm and 5'-terminus of this base sequence : 37708327
  Distance between 3'-terminus of neighbour sequence of sequence listing upward to telomere on chrosomal short arm and 5'-terminus of this base sequence : 93920
actaggatgactccagaaatctaaaatatctggataatctcatgcagtaaacattttattgacattttggttacacacacacacacacacacacacacacacccacacacacacgaaagacggaaagaaaacagcaaaaggtagaaagtttatctctggatgttaaaattgagcatatattacctgcataacaatgaggaaaatgattaagcttcggggatcattcttagacattttaaacaaacacaattctaaatttaacagaagataagcgaagtttgataatttaaaattctataggaccaagagcttgcttcactagttaatatttagaaacatcaattggtcagtctgttgtaaataaaatccctgggttcttgaaggatgatgtgttacacaaaataatttacactgaactatttgatcgtgcatagattc

SEQ ID NO: 4906 - DNA, 192 bp, Homo sapiens
  D3S2396
  Located on chromosome 3
  Distance between a terminus base of telomere on chromosomal short arm and 5'-terminus of this base sequence : 37815437
  Distance between 3'-terminus of neighbour sequence of sequence listing upward to telomere on chrosomal short arm and 5'-terminus of this base sequence : 106672
acctcttacttgtgttcttggggcagttatataaactctctgagcctcttttcctgacatctatctatctatctatctatctaggtaggtaggtaggtagatagatagatagatagatagatagatagatagatagatagatagatagatagatagatgtcaggtcactattatccaatactggcttggtca

SEQ ID NO: 4907 - DNA, 365 bp, Homo sapiens
  chr3.fa.O7frz.37468584
  Located on chromosome 3
  Distance between a terminus base of telomere on chromosomal short arm and 5'-terminus of this base sequence : 37872986
  Distance between 3'-terminus of neighbour sequence of sequence listing upward to telomere on chrosomal short arm and 5'-terminus of this base sequence : 57357
agttgctttaaacggtttaatcaataacacagcttaccacagtttaccatgctttctgggcaaagaatctgcgtgtacgtgtgtgtgtgtgtgtgtgtgtgtgtgtgtgtgtgtggcaaaattctgttgaaattcccagtgatatgtactgaatgagtttaattccctattctgaaactactactactagtattttttaaattatctgttctgtgtttgaataaggttagatttctaagtttaatcatgcattgcataacaacctcttggttaatgatggactgtgtatatgatggcggtctcatcgtattataatggagctgaaacatttctattgtctactaacactgaagtcatcctaatgt

SEQ ID NO: 4908 - DNA, 253 bp, Homo sapiens
  D3S1609
  Located on chromosome 3
  Distance between a terminus base of telomere on chromosomal short arm and 5'-terminus of this base sequence : 37966727
  Distance between 3'-terminus of neighbour sequence of sequence listing upward to telomere on chrosomal short arm and 5'-terminus of this base sequence : 93376
atatccgtgggcaaatggaatagattttcatttgaattacattagagggtctctgaatggctgatttcttaattgcctttccttggcatgaggctatgtgcaggttctgttcagtttttgttcttcctgcaggcctgcctggttgtaatgtgcgtgtgtgtgtgtgtgtgtgtgtgtgtgtgtgtttcctttttttttctaatcttggcctctgttccagccaagaccacccattaagccacagtgtagagca

SEQ ID NO: 4909 - DNA, 220 bp, Homo sapiens
  D3S3547
  Located on chromosome 3
  Distance between a terminus base of telomere on chromosomal short arm and 5'-terminus of this base sequence : 38256163
  Distance between 3'-terminus of neighbour sequence of sequence listing upward to telomere on chrosomal short arm and 5'-terminus of this base sequence : 289183
catgactggaaccctggaatgctgttccatttaaatgtggtttgaaatagcacacttatttccactaaatttacttttaatgcacctcatagaattatcatttgtgcataattcatgcagacacacacacacacacacacacacacacacgtaggacctaaatatagactctaagtataaattccatatttttcccttatagcattttctgattcgcaat

SEQ ID NO: 4910 - DNA, 388 bp, Homo sapiens
  chr3.fa.O7frz.37861029
  Located on chromosome 3
  Distance between a terminus base of telomere on chromosomal short arm and 5'-terminus of this base sequence : 38341986
  Distance between 3'-terminus of neighbour sequence of sequence listing upward to telomere on chrosomal short arm and 5'-terminus of this base sequence : 85603
tggtaagaacattaagaatgaaacaaaaccttgcttctgttagaagatagcaaaaagtaattagaataataataagaattttgaaagaatgaagaatgaaataaaaccaacaaaaacatctatcatcttgatcaccattgcacatgtgcacgcacacacacacacacacacacacacacacacatgcacacaccaagcgttttaacataaaaaggtaggatataatcttggaataacatagagtctctttcaaaaagaaatattgttggttacaccttggcatgtaaaagatacgttaataaaaagtgaagacaaaaattttaacataaaaatgtattgtctgatatggcattatatagaatcctttttggatacaaagttgtcagtc

SEQ ID NO: 4911 - DNA, 427 bp, Homo sapiens
  AC016943.7_29400
  Located on chromosome 3
  Distance between a terminus base of telomere on chromosomal short arm and 5'-terminus of this base sequence : 38470824
  Distance between 3'-terminus of neighbour sequence of sequence listing upward to telomere on chrosomal short arm and 5'-terminus of this base sequence : 128450
ggacatttaaacaattatgcaggaaattatatgatgctaaaattgaacatggacaggctgttcaatggcaggattcccactcgtgctgagctttgcaaaggggaagatttttttttcttttgctttctctccaagactgtaatttttgagcaggaaataattcagagtataaaacaaaagaaaaaattaaatatatgtagagtggaagcacagagaaacaaaaaggaggcagttgtaaaaaaaaattaagatgaaaaatgtgtgtgtgtgtgtgtgtgtgtgtgtgtgttcaaagtaagggagtgataaatgctggtgatggtttgggaagaaaaatgttcctctctgggatttcttttcagggtagtgcagactcaacaggatcatattcctgacacacaagcgtatcatgaggactcaataggtc

SEQ ID NO: 4912 - DNA, 440 bp, Homo sapiens
  chr3.fa.O7frz.43077854
  Located on chromosome 3
  Distance between a terminus base of telomere on chromosomal short arm and 5'-terminus of this base sequence : 38543475
  Distance between 3'-terminus of neighbour sequence of sequence listing upward to telomere on chrosomal short arm and 5'-terminus of this base sequence : 72224
cttatctgtagcagaaatatgcacaaactgggccagtcttgtgacaaggctgcccatcagctattgcattccatccagctctctcattcagattattgacatcctgatgtttgtattgttccaggaccatatccagggtaagctttgggaaaaaaattatagagttgtctttttcagtgaaatatgatgtctgttaccctttgttggtgaaagcacattggctgtacatgcattgattctggtggaggtgcaggtgttctctgaacattgcattttctctatctaacctttttattcttgccgtgtccacattggatagataaatagcaatgtatgtcaccaggtactgctaagatgaagatgatgatgatgatgatgatgatgatgatgatgatgatagcatttagtaggtactggtgtgagtcaagtactaaccatgg

SEQ ID NO: 4913 - DNA, 460 bp, Homo sapiens
  chr3.fa.O7frz.43162602
  Located on chromosome 3
  Distance between a terminus base of telomere on chromosomal short arm and 5'-terminus of this base sequence : 38627216
  Distance between 3'-terminus of neighbour sequence of sequence listing upward to telomere on chrosomal short arm and 5'-terminus of this base sequence : 83301
aagaagtcttccgcataagtagaaaaaacaaaagaattagtatctgccatttttttctttcatttttttattttcatttttttcctttcattttctctctctgtgtgtgtgtgtgtgtgtgtgtgtgtgtgtatgacttaaacaactgaaatttattttcccacagttgtggaggctaaaagatcataattaaagcattggcagatttgatttcttccgaagcgtttctcattgatttgccaatgtctgcccattctttttaaactgaagaattaaagaaaaatattaagtgtggaaaaccaatgtgctatgccaaagtgttcttataatatggccaacaaacactaacactttggattgttttaccaccagctagcattaaccaaaatagaaacagtgatcctgtgttcttcccatgtcgagccactcggttgttgtaagaattgcagtataccttcag

SEQ ID NO: 4914 - DNA, 353 bp, Homo sapiens
  AC024097.14_138543
  Located on chromosome 3
  Distance between a terminus base of telomere on chromosomal short arm and 5'-terminus of this base sequence : 38702753
  Distance between 3'-terminus of neighbour sequence of sequence listing upward to telomere on chrosomal short arm and 5'-terminus of this base sequence : 75077
tagttaaaccaggcatcagtattagaagaaggatagagaaagaggaggaggaggaggaagaggagaaggaggaagaggaggaggaggaggaggataatggaaagaagccattgacatcttgaagaacttgtttttataagatgcccaggttgattattctgctagactgtatcatctagtaattgttattctttttagcaaaagggaaagagtaggaagatacaataatactataagaatgtgaacagattagaaatcccattgtttttgtctgtgagatttcgcatgaaaaatggatgaagagccctcactgttggtaacttagaaaactgctacagtttgattctaagaat

SEQ ID NO: 4915 - DNA, 162 bp, Homo sapiens
  D3S3718
  Located on chromosome 3
  Distance between a terminus base of telomere on chromosomal short arm and 5'-terminus of this base sequence : 39016768
  Distance between 3'-terminus of neighbour sequence of sequence listing upward to telomere on chrosomal short arm and 5'-terminus of this base sequence : 313662
acttccagagtgcttagacaagagaaaaaagtaaagagcatccaaatggaaacaaagaagtaaaattggtgtgtgtgtgtgtgtgtgtgtgtgtgtgtgtgtgtgtgtgtgtgtactacatgatcttatatttagaaaaacctaaagaatctgccaaaaatg

SEQ ID NO: 4916 - DNA, 448 bp, Homo sapiens
  chr3.fa.O7frz.43645621
  Located on chromosome 3
  Distance between a terminus base of telomere on chromosomal short arm and 5'-terminus of this base sequence : 39133666
  Distance between 3'-terminus of neighbour sequence of sequence listing upward to telomere on chrosomal short arm and 5'-terminus of this base sequence : 116736
acagttctgagtcatgattcagcccacaagaatgaaagaatcctgacctgaaaaataccattccataggagggaggcccaaattcattctgcatatagtgttgtgttttctgcaaaattttatgtaatttttgttaatttcatgtattttaatttatagagtttttagaatttaatttccaaatttggtttttatataaacataagttttatatatatatatatatattttttagaaagagtttcgctcttgttgcccaggctggagtgcaatggcgtgatctcggctcactgcaacctctgcctcccgggttcaagtgattctcagccacccaggtagctaagattacaggtatgcgccaccgtgtccagctaattttgtatttttagtagagatggggtttcgccatgttggtcgggctggtcttgaactcctaacatcaggtaat

SEQ ID NO: 4917 - DNA, 198 bp, Homo sapiens
  G10233
  Located on chromosome 3
  Distance between a terminus base of telomere on chromosomal short arm and 5'-terminus of this base sequence : 39235415
  Distance between 3'-terminus of neighbour sequence of sequence listing upward to telomere on chrosomal short arm and 5'-terminus of this base sequence : 101301
aaaaacagatgcataaaatggagatagatgatagatagatagatagataatagatagatagatagatagatagatagatagatagatacataataggtagatagtcaatagtttctcaagcaaaggaatgtgactttttaaaatgtccttataataatgtaggaaaacaaaccttaaggtgtctgctcactcattcat

SEQ ID NO: 4918 - DNA, 252 bp, Homo sapiens
  D3S1561
  Located on chromosome 3
  Distance between a terminus base of telomere on chromosomal short arm and 5'-terminus of this base sequence : 39331138
  Distance between 3'-terminus of neighbour sequence of sequence listing upward to telomere on chrosomal short arm and 5'-terminus of this base sequence : 95525
taagtcccagaggcaaaggagaaatggtctagtttgtcatggccaaaacaagagggagggcagcaggaagagcagataaagtcaaaaggataatacaatatgtcctatgtcctacacacacacacacacacacacacacacacacacacacacacacacacacacacacacacacagaggttacttatccatatgcttcagacccaagcagacttgagagttcctggtttgtgtcctgtggatagtttagcg

SEQ ID NO: 4919 - DNA, 107 bp, Homo sapiens
  D3S2369
  Located on chromosome 3
  Distance between a terminus base of telomere on chromosomal short arm and 5'-terminus of this base sequence : 39344879
  Distance between 3'-terminus of neighbour sequence of sequence listing upward to telomere on chrosomal short arm and 5'-terminus of this base sequence : 13489
aaatagggccgtcctttgtaaatgtctgggactcagtgaaacaggcaggtgtgtgtgtgtgtgtgtgtgtgtgtgtctacattgtgacccacttattaaggatagag

SEQ ID NO: 4920 - DNA, 322 bp, Homo sapiens
  AC032001.2_18233
  Located on chromosome 3
  Distance between a terminus base of telomere on chromosomal short arm and 5'-terminus of this base sequence : 39596945
  Distance between 3'-terminus of neighbour sequence of sequence listing upward to telomere on chrosomal short arm and 5'-terminus of this base sequence : 251959
ccattaagttgacatagattattgatgtagttttattttaacttaatttgcaatgttattttgctttatgattattgattacaagggtaagaaatgtatacctagtattgtttgaaatatttaagtttcattgtataaaatgatttaattacttctaactggtcttcctctctctctctctctctctctctctctcgctgtctctctctctcactcacacacacagtattatttgttaaatgaattagtaagtaatatcaacacagagagtttgccagaatttctttcctctaaaaaagatccatacgtgactcagtattag

SEQ ID NO: 4921 - DNA, 444 bp, Homo sapiens
  chr3.fa.O7frz.44173143
  Located on chromosome 3
  Distance between a terminus base of telomere on chromosomal short arm and 5'-terminus of this base sequence : 39626351
  Distance between 3'-terminus of neighbour sequence of sequence listing upward to telomere on chrosomal short arm and 5'-terminus of this base sequence : 29084
gaagtcactgtaatgcactgtctttttaacccagtgtctggtcagaggtggccagcccagctgatgaaggaatggactttggactgtaggtgtttcctgaacttgatagcctcatatttcacagtacactttacttcaccacctagtcatccaatcagatgatcatctcaaattcaacatgccggaaactgatttcacctcgaccctgcttctctcccacagttccccaacccagagaatggctccatcatcacataaagatgctgtcatatctcccaacttaaaaaaaagacaacccttattttctctgcatccctctttagctactgtccattctatgatctccttcgtgcgtgcacacacacacacacacacacacacacacacacccttgaaagaggtgtctatacacactgtctacagtattccaccttccattctatc

SEQ ID NO: 4922 - DNA, 262 bp, Homo sapiens
  D3S1611
  Located on chromosome 3
  Distance between a terminus base of telomere on chromosomal short arm and 5'-terminus of this base sequence : 39808548
  Distance between 3'-terminus of neighbour sequence of sequence listing upward to telomere on chrosomal short arm and 5'-terminus of this base sequence : 181753
agctgagactacaggcatttgccaccatgcctggctagtgtgtgtgtgtgtgtgtgtgtgtgtgttgtgtgtaactcctagactcaagtgacccttccaccttggcctctcgaagtgctgggattacaggccaatgtacccggctggaaaaaattcttagaagtcatcttgctaggctgactcagaaatgagcaaactgaagtaacgtgtcccagttcacacggctaattagtgccacgatagtgcaagtgcagccttgggc

SEQ ID NO: 4923 - DNA, 335 bp, Homo sapiens
  chr3.fa.O7frz.44383187
  Located on chromosome 3
  Distance between a terminus base of telomere on chromosomal short arm and 5'-terminus of this base sequence : 39922536
  Distance between 3'-terminus of neighbour sequence of sequence listing upward to telomere on chrosomal short arm and 5'-terminus of this base sequence : 113726
gaggtcaggagttcgagaccagtctggccaacatggggaaaccctatttctactaaatatagaaagttagctgggcatggtgggattacagggcgcacgcctgtaatcccagctactcaggaagctgaagcaggagaatggcttgaattcgagagatggaggttgcagtgagccaagattgcgccactgcactccagcctgggtgacagagtgagactccatcacacacacacacacacacacacacacacacaaaagagacatactctttctagcttcaacttggatctactgctactgccagcattcccgagttaatcttggatcattgactg

SEQ ID NO: 4924 - DNA, 448 bp, Homo sapiens
  AC032001.2_87629
  Located on chromosome 3
  Distance between a terminus base of telomere on chromosomal short arm and 5'-terminus of this base sequence : 40010585
  Distance between 3'-terminus of neighbour sequence of sequence listing upward to telomere on chrosomal short arm and 5'-terminus of this base sequence : 87714
actggatgagcacctatgtacctcctgtctatctccccagtcaagggagtgaatcttcagggatagttcattttctaaaaatccatcatggtaaagaaactgtttttctgagtgccttagacattgacttcatttccttgcaatcagtgttaagcattcagaatgatgtttcggttctttgaggcctgctggggaaagggagagggccctataagcctctggtgttccctccttctactaacacacacacacacgcacgcacacacacacacacacacacacacacacacacacacacacacacacacacacactttggcctgaccattcttagccaaaaactcttgttctcctcacattctctctgcaacaaaaatccagtctttcaggaagaacaaactgacacgggagctagcagcaccctaagctctgtgctatcgcctcaata

SEQ ID NO: 4925 - DNA, 342 bp, Homo sapiens
  AC032001.2_87657
  Located on chromosome 3
  Distance between a terminus base of telomere on chromosomal short arm and 5'-terminus of this base sequence : 40010696
  Distance between 3'-terminus of neighbour sequence of sequence listing upward to telomere on chrosomal short arm and 5'-terminus of this base sequence : -337
gtgccttagacattgacttcatttccttgcaatcagtgttaagcattcagaatgatgtttcggttctttgaggcctgctggggaaagggagagggccctataagcctctggtgttccctccttctactaacacacacacacacgcacgcacacacacacacacacacacacacacacacacacacacacacacacacacacactttggcctgaccattcttagccaaaaactcttgttctcctcacattctctctgcaacaaaaatccagtctttcaggaagaacaaactgacacgggagctagcagcaccctaagctctgtgctatcgcctcaatacttta

SEQ ID NO: 4926 - DNA, 458 bp, Homo sapiens
  chr3.fa.O7frz.44267198
  Located on chromosome 3
  Distance between a terminus base of telomere on chromosomal short arm and 5'-terminus of this base sequence : 40032713
  Distance between 3'-terminus of neighbour sequence of sequence listing upward to telomere on chrosomal short arm and 5'-terminus of this base sequence : 21675
ttaaacaatacctggtgtcaactgggtgtggtggctcctgcctgtaatcccagcactttgggaggccaaggtgggcggatcacctgaggttaggagtttgagaccagcctggccaatatggtgaaaccccgtctctactaaaaatacaaaaattagccgggcgtggtggcgggcgcctatagtcccagctacttaggaggctgaggcaggagaatcgcttgaacctgggaggcagaggttgcagtgagcagagagagcgccactgcactcctgggcgacagatggagactgtgtctcaaaaacaacaacaacaacaacaacaacaacaacaacaacaacaacagcagcagcagcagcagcaacaacaaacaacaacaacaacaacaacaacaaaacctcccccaaacccaacaatacctggtgtcctgggctgctatgacaagaatactgtagactgg

SEQ ID NO: 4927 - DNA, 108 bp, Homo sapiens
  DISD22_0002663
  Located on chromosome 3
  Distance between a terminus base of telomere on chromosomal short arm and 5'-terminus of this base sequence : 40241377
  Distance between 3'-terminus of neighbour sequence of sequence listing upward to telomere on chrosomal short arm and 5'-terminus of this base sequence : 208206
tcacactagttcttggctgttctctgtgtgtgtgtgtgtgtgtgtgtgtgtgtgtgtgtgtgtgtgtatcaggataggagataggggtagctaattattaatgcagtg

SEQ ID NO: 4928 - DNA, 217 bp, Homo sapiens
  D3S3623
  Located on chromosome 3
  Distance between a terminus base of telomere on chromosomal short arm and 5'-terminus of this base sequence : 40387855
  Distance between 3'-terminus of neighbour sequence of sequence listing upward to telomere on chrosomal short arm and 5'-terminus of this base sequence : 146370
cccccatgttggttaaaggcaaggtcatcttgcaagttcttgcctgcaatcctctctctctctctctctctctgtgtatacacacacacacacacacacacacacacacacacatataacttttttcttacacaaaagttggcatactatttgcattgttctgtatcttgcttttctcacttaacaatatattcaggaggtcacttcagttcagaga

SEQ ID NO: 4929 - DNA, 354 bp, Homo sapiens
  AC009813.3_112939
  Located on chromosome 3
  Distance between a terminus base of telomere on chromosomal short arm and 5'-terminus of this base sequence : 40409551
  Distance between 3'-terminus of neighbour sequence of sequence listing upward to telomere on chrosomal short arm and 5'-terminus of this base sequence : 21479
aggtaccagacatgtgaatgaggctggcttaggccctccaaaaaagcccagccaccagctggctaccactgagtaacctcagctgatgccacatgaaacagaactgaattgcccagccaagccctgcccacattactgcccacagaagtgtaagatataataaagtaggactgaggtgggaggattgcttgagcccagaagttctagtccagcctgagcagtgcagcaagaatttctctctaaaaataaataaataaataaataaataaataaataaataaataaataatattaaagtagttgttttaagccactaagttctggggcagtttgttatgcggcaatagataactg

SEQ ID NO: 4930 - DNA, 268 bp, Homo sapiens
  AC009813.3_81783
  Located on chromosome 3
  Distance between a terminus base of telomere on chromosomal short arm and 5'-terminus of this base sequence : 40503560
  Distance between 3'-terminus of neighbour sequence of sequence listing upward to telomere on chrosomal short arm and 5'-terminus of this base sequence : 93655
cttatggcaagaagtttgaatagcttcatcctgccatcaactctccttgtttctgagcctttgatgctccatcatgctctaccatgttgatggggaaatgagtgaggagaaaattagaaacccagacatcttctgcctgattatagcagcagctagattgacttttgagagtgtacgcgtgtgtgtgtgtgtgtgtgtgtgtgtgtgtgtgtgtgtgtgtgtcttgggaggcatggaggcatatgtacctaatgtctaggtctgtttg

SEQ ID NO: 4931 - DNA, 244 bp, Homo sapiens
  chr3.fa.O7frz.45227061
  Located on chromosome 3
  Distance between a terminus base of telomere on chromosomal short arm and 5'-terminus of this base sequence : 40682767
  Distance between 3'-terminus of neighbour sequence of sequence listing upward to telomere on chrosomal short arm and 5'-terminus of this base sequence : 178939
  misc_feature (1)...(244): n = A,T,G or C
tcagacttgctgtattaccaacaggtaatgtacaggacagtcatgacctacacctggctaaatccagtagtcatttttcagtcttctttctggacccgtcagcatctattagtacaaataacggctacttctgttattattattattattattattattattattattattattatacttntaaggtccttaggggtacatgtgcacaacgtgcaggtttgttacataggnanacatgtgccat

SEQ ID NO: 4932 - DNA, 287 bp, Homo sapiens
  AC069073.7_55838
  Located on chromosome 3
  Distance between a terminus base of telomere on chromosomal short arm and 5'-terminus of this base sequence : 40745032
  Distance between 3'-terminus of neighbour sequence of sequence listing upward to telomere on chrosomal short arm and 5'-terminus of this base sequence : 62021
accttcctagatcaagatgtttacatacagcctctgaccagtcactggctgatcactaagctgtgctgatccaggacagcccctacaaaaccaggcttaaaaataaaaacaagtgataaatatatatatacatatatatatacccacacacacacacacacacacacatatacccacatacatatatatgcatacatgcaatatatattttgccagcagaaacatcagaggctacacactccaggaaaaacagactccagagactatgtctaggcaagtcactaaac

SEQ ID NO: 4933 - DNA, 442 bp, Homo sapiens
  AP000495.1_68459
  Located on chromosome 3
  Distance between a terminus base of telomere on chromosomal short arm and 5'-terminus of this base sequence : 40779131
  Distance between 3'-terminus of neighbour sequence of sequence listing upward to telomere on chrosomal short arm and 5'-terminus of this base sequence : 33812
tggtcagtttactctaaatcaaagtttccagtcgtcatgatgagtatgatcatcatcattattatttttaggcaacagaacccatttctaaattgaaatatgcttcagttgactcaggggtgaggttgcctggaactccctcttggtggcttccataccccctcactggacccgtgggctctaaagaagccactgctatggaaagttgtattctcagaaggttgcccagtccatcaaaggctttcactagatgctagttatacccccagtaactatgaacaagatgaaatttttaccctcaagacttccacagccccaaacaggtcaacacacacacacacacacacacacacacacacacacacacacacacgtgcacacacatcacacccctgcagcactgtatgcatacgtgcccagagtatctgtgctgaagaggtca

SEQ ID NO: 4934 - DNA, 314 bp, Homo sapiens
  chr3.fa.O7frz.45451750
  Located on chromosome 3
  Distance between a terminus base of telomere on chromosomal short arm and 5'-terminus of this base sequence : 40907380
  Distance between 3'-terminus of neighbour sequence of sequence listing upward to telomere on chrosomal short arm and 5'-terminus of this base sequence : 127807
  misc_feature (1)...(314): n = A,T,G or C
tctgcnagacttgttcgacccatgtcatagccatcttcaactttagagactgtattgcaggtcgtcggaggtgtatctgtctcctccccctagtttgagagttccctgaggacaggaacagttcctttttccttatgtaactgtttttttctcccagtacctagttcagcacctggaagatggtcgatataagaaacaaccctaactaccacacacacacacacacacacacacacacacactcacacaaacacaaacagtatatgcagcttttgtgctgatattgaactattatgactctttgaggtctatga

SEQ ID NO: 4935 - DNA, 205 bp, Homo sapiens
  D3S1298
  Located on chromosome 3
  Distance between a terminus base of telomere on chromosomal short arm and 5'-terminus of this base sequence : 40993154
  Distance between 3'-terminus of neighbour sequence of sequence listing upward to telomere on chrosomal short arm and 5'-terminus of this base sequence : 85460
  misc_feature (1)...(205): n = A,T,G or C
agctctcagtgccaccccacagagggtttatttctgttggtctctccagatacccctgccctactcaactatgtgcaaggaaggtggagagtgaggtgctagggctccagcactctaggacatggggacacacacacacacacacacacacttacacacacacacacacacacacacacacacactgcttcacagggnatttttc

SEQ ID NO: 4936 - DNA, 137 bp, Homo sapiens
  DISD22_0002665
  Located on chromosome 3
  Distance between a terminus base of telomere on chromosomal short arm and 5'-terminus of this base sequence : 40993261
  Distance between 3'-terminus of neighbour sequence of sequence listing upward to telomere on chrosomal short arm and 5'-terminus of this base sequence : -98
  misc_feature (1)...(137): n = A,T,G or C
cagcactctaggacatggggacacacacacacacacacacacacttacacacacacacacacacacacacacacacactgcttcacagggnatttttctggcatccangtaaaagagaccacaaggcttaatcttat

SEQ ID NO: 4937 - DNA, 184 bp, Homo sapiens
  D3S3639
  Located on chromosome 3
  Distance between a terminus base of telomere on chromosomal short arm and 5'-terminus of this base sequence : 41332524
  Distance between 3'-terminus of neighbour sequence of sequence listing upward to telomere on chrosomal short arm and 5'-terminus of this base sequence : 339126
aaaccatttgggcctggtgcttttggggcatggggtggctctggtcttccttcttagctggaaatgccagttttgttttgtgtgtgtgtgtgtgtgtgtgtgtgtgtgtgtgtgtgtgtgtgtgtgtgtttaagagacagaaccttgctctgttgcgcccaggctggagtgcagtggcaagatc

SEQ ID NO: 4938 - DNA, 293 bp, Homo sapiens
  AC055722.6_64353
  Located on chromosome 3
  Distance between a terminus base of telomere on chromosomal short arm and 5'-terminus of this base sequence : 41344355
  Distance between 3'-terminus of neighbour sequence of sequence listing upward to telomere on chrosomal short arm and 5'-terminus of this base sequence : 11647
aatgaatttgttgcagatacaggataaagtctggtcccaggcttgccttggtgcctgtgcacctcatttagaggagaagcttagcccaccagtaccatcatgctcagttgtggtaggtctcctttctggtgatgtggctcatttaagagctggcagctaccagggaagcactgtagcgcacacacacgcacacacacacacacacacacacacacactctgcacacacccttatttgttcctcacccacaggcatacccatgcagggtcttcagtttagcctaagatgtaagt

SEQ ID NO: 4939 - DNA, 265 bp, Homo sapiens
  D3S1260
  Located on chromosome 3
  Distance between a terminus base of telomere on chromosomal short arm and 5'-terminus of this base sequence : 41344509
  Distance between 3'-terminus of neighbour sequence of sequence listing upward to telomere on chrosomal short arm and 5'-terminus of this base sequence : -139
agctaccagggaagcactgtagcgcacacacacgcacacacacacacacacacacacacacactctgcacacacccttatttgttcctcacccacaggcatacccatgcagggtcttcagtttagcctaagatgtaagtcagtgtctggatcagtgccttgcacacagtaggtgctcaggtacatgccttatggtcagcgggactttggaaaattccactagaaatttattagaatagggataaaaatggcaggtgattgcatag

SEQ ID NO: 4940 - DNA, 303 bp, Homo sapiens
  chr3.fa.O7frz.46183595
  Located on chromosome 3
  Distance between a terminus base of telomere on chromosomal short arm and 5'-terminus of this base sequence : 41445581
  Distance between 3'-terminus of neighbour sequence of sequence listing upward to telomere on chrosomal short arm and 5'-terminus of this base sequence : 100807
tgatcagtctcacaagtaatcagggaaatgcagatccaaattgtgtaccatttcacactcaccaggtgaaccccaggtgggggctgtcatctgttgggaacttggattggcacatccactttggagaacagtttaacagtatttagtcagttgatgatctttagactctatgacctagccaagaaacgcccacacatgagtgcacacacacacgcacacacacaaatgtaaaaaagaattcatgatggcatggctgagatcaacaaacataaataacctgagtccagtaggtgagtggatact

SEQ ID NO: 4941 - DNA, 441 bp, Homo sapiens
  AB008681.1_50266
  Located on chromosome 3
  Distance between a terminus base of telomere on chromosomal short arm and 5'-terminus of this base sequence : 41466772
  Distance between 3'-terminus of neighbour sequence of sequence listing upward to telomere on chrosomal short arm and 5'-terminus of this base sequence : 20888
ggctcaaataagtactgtttgtataccaggatatgtgagatgtaaatgtagtaggtcacttttcacccttgtagctataaaataaaaattttgtagaacagaaatagcttgtactactgaattaaccaaagttatactaaagtatcatgtttaaaaaaaaatatatatatatatacagagttaagcttgttgctgttaccctgtctggatttgaaaagtgtgctgatttatatatatatattacacacacacacacacacacacacacacacacacacatacacctaaaatggcctaaagcagacatccatgtaattacagttgcaaaatgaaaacattttggaaagaacattgtatcatagttcattcatttgcagtggatctttgttcctttttactgtggtaattttagaaatgagtgtcaagtttgaaattagatct

SEQ ID NO: 4942 - DNA, 217 bp, Homo sapiens
  D3S3605
  Located on chromosome 3
  Distance between a terminus base of telomere on chromosomal short arm and 5'-terminus of this base sequence : 41928351
  Distance between 3'-terminus of neighbour sequence of sequence listing upward to telomere on chrosomal short arm and 5'-terminus of this base sequence : 461138
gcttgcatctgtgtgcctgtgtgtgtgtgtgtgtgtgtgtgtatgtgtgtgtgtgtacgccctacagcccgcacagcccgcacggccctggtatggtggctctgcttcctcctcctcctcctccagcacatccaaacaggcacgccactctgcacacaggcagggctgcgggcccttgctccaggctagccaggcactctggggaacaggctggctt

SEQ ID NO: 4943 - DNA, 244 bp, Homo sapiens
  AC055729.11_143595
  Located on chromosome 3
  Distance between a terminus base of telomere on chromosomal short arm and 5'-terminus of this base sequence : 41975760
  Distance between 3'-terminus of neighbour sequence of sequence listing upward to telomere on chrosomal short arm and 5'-terminus of this base sequence : 47192
tgccgtcttataattcaagactacaacatcaactcttccttggatcttcagcctgccagcctctctgcagattttgaacttgccatttcccataatctcatgagccaactccttaaagtctctctgtctctctcttacacacagacacaacaccactacgaccaccaccaccaccaccaccaccaccagtaggtatatgtcctattggttctttggagaactctgactaatgcaggttctaagc

SEQ ID NO: 4944 - DNA, 115 bp, Homo sapiens
  D3S3527
  Located on chromosome 3
  Distance between a terminus base of telomere on chromosomal short arm and 5'-terminus of this base sequence : 42038714
  Distance between 3'-terminus of neighbour sequence of sequence listing upward to telomere on chrosomal short arm and 5'-terminus of this base sequence : 62710
atcggccatatgttggtacacacacacacacacacacacacacacacacacacacacacacaactcaaaaagttttaaaaacttgtaatcacatcaagtatcttctcagaccaca

SEQ ID NO: 4945 - DNA, 219 bp, Homo sapiens
  D3S3593
  Located on chromosome 3
  Distance between a terminus base of telomere on chromosomal short arm and 5'-terminus of this base sequence : 42107105
  Distance between 3'-terminus of neighbour sequence of sequence listing upward to telomere on chrosomal short arm and 5'-terminus of this base sequence : 68276
ccctccaggatggtattcaagaacatccaggaggcgaggtcgagatagagagggcagcactgtgtgtgtgtgtgtgtgtgtgtgtgtgtgtgtgtgtgtgtgtgtgatggggataggggcaaggagaatagaagtgtgggcagggcatttctggttgccagccaagatggtggagaaggggtggcttttagagccttcccacactgctgttgctaggaa

SEQ ID NO: 4946 - DNA, 264 bp, Homo sapiens
  AC026309.15_49626
  Located on chromosome 3
  Distance between a terminus base of telomere on chromosomal short arm and 5'-terminus of this base sequence : 42231870
  Distance between 3'-terminus of neighbour sequence of sequence listing upward to telomere on chrosomal short arm and 5'-terminus of this base sequence : 124546
agatccaaagaacatcactatcacattctgccgcaaaaagggccatactgcacacacccctcccacccatacctataagtaccccagcctgtaagccgcgtgggctctggcattaagctggtcccctacctccgtaggtttttgcaatatgcctgtgtttgctgtagtgcctccactctctctccctctgtgtttcttttcttttcttttcttttcttttcttttttaatactttaagttctagggtacatgtgcacaacgtgg

SEQ ID NO: 4947 - DNA, 162 bp, Homo sapiens
  DISO7_10001086
  Located on chromosome 3
  Distance between a terminus base of telomere on chromosomal short arm and 5'-terminus of this base sequence : 42361662
  Distance between 3'-terminus of neighbour sequence of sequence listing upward to telomere on chrosomal short arm and 5'-terminus of this base sequence : 129528
ttcaagatggagtcgctgacataggtgggaggattgcttgaagctaggagttggagtccagcctgggtaacatattgagatcctgtctctacaaaaataaaataaaataaaataaaataaaataaaataaaaagttagaggttagtaagactaaattccagg

SEQ ID NO: 4948 - DNA, 101 bp, Homo sapiens
  DISO7_10001085
  Located on chromosome 3
  Distance between a terminus base of telomere on chromosomal short arm and 5'-terminus of this base sequence : 42366472
  Distance between 3'-terminus of neighbour sequence of sequence listing upward to telomere on chrosomal short arm and 5'-terminus of this base sequence : 4648
ttcatggacaagatgtctcactttacagttgacaaaatacatgtacacacacacacacacacacacacacaagtctggtacagtgtaagccaatttgccat

SEQ ID NO: 4949 - DNA, 488 bp, Homo sapiens
  AL136524.11_148919
  Located on chromosome 3
  Distance between a terminus base of telomere on chromosomal short arm and 5'-terminus of this base sequence : 42384140
  Distance between 3'-terminus of neighbour sequence of sequence listing upward to telomere on chrosomal short arm and 5'-terminus of this base sequence : 17567
cattaaccttgactatgcctttagttccagccacctttttaagaataaattgctgggcaggtcggggagggctagtcatggaacgaaactgtaagccagaccaggtgtgaggaggggaggtgataaaaggattatagggtggaggagcggaggctgaggaagaattgggacctagctcagcctggtgaggagcagcctggggaggagaggagaggtcagaagggtctgtagaaaaggaagattagaaagactcagtgacacctggggttgggactggggggacagatgggagggaaagaaggaagatttgggacgagttgcactgggcacagagactagggagggaccgatgtgtagaagaatgcctggacgtcaggcatctcagaccgtttgtccattttatgacaagaattatttagatcttgcaggatgaaaaaattgaaagtgctgttttctggctatttggaactactgttgagtttgtattg

SEQ ID NO: 4950 - DNA, 172 bp, Homo sapiens
  DISO7_10001089
  Located on chromosome 3
  Distance between a terminus base of telomere on chromosomal short arm and 5'-terminus of this base sequence : 42531404
  Distance between 3'-terminus of neighbour sequence of sequence listing upward to telomere on chrosomal short arm and 5'-terminus of this base sequence : 146776
ttctgttcacagtactgggagttaaaaagggtataaacaccagagactgggaaagtcttgagggccatcttaaaattctacccaccataatactatctatctatctatctatctatctatctatctatctatctatttattctaatctagataggtgtatagatggctaggc

SEQ ID NO: 4951 - DNA, 278 bp, Homo sapiens
  AC073469.5_46248
  Located on chromosome 3
  Distance between a terminus base of telomere on chromosomal short arm and 5'-terminus of this base sequence : 42608754
  Distance between 3'-terminus of neighbour sequence of sequence listing upward to telomere on chrosomal short arm and 5'-terminus of this base sequence : 77178
tagttcttcagatggaaggtaacaaattcaatacactgccacaacaggaaacaagttcaaaggttttttttttacttacagatcctgggcggggtgggtgcaatgagttgggagggtagtcctctctctgtacctggggtcacacgaggcaggtatgaagagtcacgcagagagagagagagagagagagagagagagagaaatatgtaacaactattagcatgtataagggaatagggtgtgtgggttactttgagtttacagttaaatgcctgaaa

SEQ ID NO: 4952 - DNA, 177 bp, Homo sapiens
  chr3.fa.O7frz.47305586
  Located on chromosome 3
  Distance between a terminus base of telomere on chromosomal short arm and 5'-terminus of this base sequence : 42709401
  Distance between 3'-terminus of neighbour sequence of sequence listing upward to telomere on chrosomal short arm and 5'-terminus of this base sequence : 100369
tactaagtcaccagcttagaacaggtcaggccagaaagtcctgagaaaaactcgtgtgtgtgtgtgtggtgtgtgtgtgtgtgtgtgtgcgcgtgcacgtacgcatatacatgcctatgtatctcatccatggatcatccaagtcagatagattggtcaataaatggtgttaggaca

SEQ ID NO: 4953 - DNA, 352 bp, Homo sapiens
  AC068355.2_72129
  Located on chromosome 3
  Distance between a terminus base of telomere on chromosomal short arm and 5'-terminus of this base sequence : 42911643
  Distance between 3'-terminus of neighbour sequence of sequence listing upward to telomere on chrosomal short arm and 5'-terminus of this base sequence : 202065
gtggttgtatgcacctgtaatcccagctactctggaggctgaggcaggagaatcgcttgaacctgggaggtggagattgcagtgagccgacattgcaccactgcactccagcctggcgacagagcaaaactcagtctcaaataaataaataaataaataaataaataaataaataaataagtaaatggaggtgaggtgatggggatatgagtggtgggggaagaaggtacgagacatttctcactgctgagcacactgtttgggtgcacactctacagggcactgtgcacgggatgttgcattcaaacatcccagcagttctggaactctgtattgatgaagacaaaggctg

SEQ ID NO: 4954 - DNA, 452 bp, Homo sapiens
  AC068355.2_97898
  Located on chromosome 3
  Distance between a terminus base of telomere on chromosomal short arm and 5'-terminus of this base sequence : 43015757
  Distance between 3'-terminus of neighbour sequence of sequence listing upward to telomere on chrosomal short arm and 5'-terminus of this base sequence : 103762
cttgaaattcctaatcaaatgtacacacacacacacacacacgcacacacatgcacacccacacaccctcttaatatatgcctggagatagctgtttgttttgcatttttggaaatgactgtaaaatgtcaataataatcccagatatttctttaggtcattttatctctgatctgtaagaagacacacacacacacacacacacacacacacacacacacaatgagagagacagagagagatacacacatccagaagagaaggggacagaatatttgatcagaaaaattgagaaagagaaggggacagaatatttgatcaggaagaatatgcatatgcctttattgtgaagaggttggtagcactagcttccctctgtgagtatgcatggatgattcagaatattcatgaagacccagggcactttgcttacagtgcaacactgtttatgt

SEQ ID NO: 4955 - DNA, 340 bp, Homo sapiens
  AC019204.2_23875
  Located on chromosome 3
  Distance between a terminus base of telomere on chromosomal short arm and 5'-terminus of this base sequence : 43143933
  Distance between 3'-terminus of neighbour sequence of sequence listing upward to telomere on chrosomal short arm and 5'-terminus of this base sequence : 127724
tatgattgccacttatgctttcttgccagatgcctttggagcaggtgctttctgggctggagctttttgacccttctgagcttttggagcaggcgctgctttctggcctgtggctttctgggcaggaaccttctgggctggagcctttttactcgcggcggtgatcttttttgctggaactttagcagcagcagcagcagcagcagcagcagcagtacccttagtaccaggtgcttttttgggagaagctttcaggagagctgccttttgaagcttcttaacttcattcttgattattctgttcctctgaaaattatcaatgtaagaaagcacttattgt

SEQ ID NO: 4956 - DNA, 176 bp, Homo sapiens
  Z66779
  Located on chromosome 3
  Distance between a terminus base of telomere on chromosomal short arm and 5'-terminus of this base sequence : 43220153
  Distance between 3'-terminus of neighbour sequence of sequence listing upward to telomere on chrosomal short arm and 5'-terminus of this base sequence : 75880
ctgagcccagagaggtgggccccaagcctgagttatgtgtgtgtgcctgtgtgtgtgtgtgtgtgtgtgtgtgtgtgtgtgtgtgtgtgcccgcgcgcaagagcaccatggtcattcacccagagttggatagaggtggaccccattgggggattgggacagggtctgcactgggg

SEQ ID NO: 4957 - DNA, 96 bp, Homo sapiens
  D3S3522
  Located on chromosome 3
  Distance between a terminus base of telomere on chromosomal short arm and 5'-terminus of this base sequence : 43482126
  Distance between 3'-terminus of neighbour sequence of sequence listing upward to telomere on chrosomal short arm and 5'-terminus of this base sequence : 261797
gtgcaaactgtgagatccagtttccttaaatttctccgttttctcatttgacgtgtgtgtgtgtgtgtacatcagagtcaagagtagggcaagtgt

SEQ ID NO: 4958 - DNA, 374 bp, Homo sapiens
  AC025681.3_99488
  Located on chromosome 3
  Distance between a terminus base of telomere on chromosomal short arm and 5'-terminus of this base sequence : 43529285
  Distance between 3'-terminus of neighbour sequence of sequence listing upward to telomere on chrosomal short arm and 5'-terminus of this base sequence : 47063
ggtggatattggatctaaagaggcaaataaaacacttccagcatgagacatcttgggggctctggacatccggatgacatggatccagcatataattaggccacaacactgggggtagaacctccttgactgtgaaatgcctgcttgggaagtgtccctttgctctgggacagcctcagggtcccactccgtgggtctgtgtttcttgggttttccttttctgtgtgtgtgtgtgtgtgtgtgtgtgtgtgtgtgtgtgtgtgtgtgtgtgtgtgtgtgtgtgtatgaagtctggcaaatccaaaatctgcagggtgggccggaaggctgtatgtagatccaggaagagctgatgtttcagttcaagactgaag

SEQ ID NO: 4959 - DNA, 114 bp, Homo sapiens
  D3S3658
  Located on chromosome 3
  Distance between a terminus base of telomere on chromosomal short arm and 5'-terminus of this base sequence : 43596426
  Distance between 3'-terminus of neighbour sequence of sequence listing upward to telomere on chrosomal short arm and 5'-terminus of this base sequence : 66767
ctggactaaatctaagttggttatgatgtattttctatatacatatatatggattgtgtgtgtgtgtgtgtgtgtgtgtgtgtgtgtatgataggattgtgtttgctaactttt

SEQ ID NO: 4960 - DNA, 452 bp, Homo sapiens
  chr3.fa.O7frz.48383103
  Located on chromosome 3
  Distance between a terminus base of telomere on chromosomal short arm and 5'-terminus of this base sequence : 43793515
  Distance between 3'-terminus of neighbour sequence of sequence listing upward to telomere on chrosomal short arm and 5'-terminus of this base sequence : 196975
ggaagttaacactcgcttagtccatttgtgttgctataaaggaatacctatgcctgggtaatttataaagaaaaaaagtttattcagctcacggttcctcaggctgtacaagaagcatggtgctggcatctacttctggtgagggcttcagtctgtttccactcatggtggaaggcgaaggggagccgtcatgtgtggagatcacatgctgagagaggaagagagagagaaaagaagaagaggaagaagaagaagaaggagaaggagaaggacaaggacaaggagaagaaggaggaggaggagggaggaggaggtggaggaggaggaggaggagggaggaggaggtggaggaggaggaggaagaggaaggagggaggaagagggaggagggaggaggctctttaacaaccagctctcactcctgagagaatgagagaatggctccaagtcat

SEQ ID NO: 4961 - DNA, 149 bp, Homo sapiens
  HUMUT2543
  Located on chromosome 3
  Distance between a terminus base of telomere on chromosomal short arm and 5'-terminus of this base sequence : 44025303
  Distance between 3'-terminus of neighbour sequence of sequence listing upward to telomere on chrosomal short arm and 5'-terminus of this base sequence : 231336
aaactgaccctaaccctgcatcttcttattaggtcaacttatgtatgtatgtatgtatgtatgtatgtatgtatgtatgtatgtatgtacgtatgtatgtatgtatgtgtgtgtgtgtgtatgtgtgacggagttttgctcttgttgcc

SEQ ID NO: 4962 - DNA, 464 bp, Homo sapiens
  AC024017.2_103791
  Located on chromosome 3
  Distance between a terminus base of telomere on chromosomal short arm and 5'-terminus of this base sequence : 44115609
  Distance between 3'-terminus of neighbour sequence of sequence listing upward to telomere on chrosomal short arm and 5'-terminus of this base sequence : 90157
cttcactataggtgcaattcacttcttgaattcctctaaaaacttacttcagtggaaaaccaaggcacacacatttgcagtggttctcaccaaagagggacaaccacttaggtgaaatatgagggaaagtaggtaagatggtctttaatttatatattatgatattggaaatataattccctagaaaatatgtgcttctgagagtaacagcatacattttatgttttaacagtcctatacaattatatttatttgatctaagtaaatatgtaataatatccagttcaattgattctacaaatgaaatgccccaaacacctgtatttggaaaatatggctacacacacacacacacacacacacactttatctatatacctattatgtatatatacacacacacacatacacttattgtgcgcagatatacttatatctgtatatgtctacaattttctatgcca

SEQ ID NO: 4963 - DNA, 466 bp, Homo sapiens
  chr3.fa.O7frz.48723857
  Located on chromosome 3
  Distance between a terminus base of telomere on chromosomal short arm and 5'-terminus of this base sequence : 44115888
  Distance between 3'-terminus of neighbour sequence of sequence listing upward to telomere on chrosomal short arm and 5'-terminus of this base sequence : -185
ccagttcaattgattctacaaatgaaatgccccaaacacctgtatttggaaaatatggctacacacacacacacacacacacacactttatctatatacctattatgtatatatacacacacacacatacacttattgtgcgcagatatacttatatctgtatatgtctacaattttctatgccattgtatattataccattgtagatatacacatgaatatacacaatatgcaaattgctttcatgtggacaatgtgggggaaatgtccatatgccacagttgagtcttctgtcccttctctctatgctgggagggtattcaatttcagtagatcatcagacctgtggtgctaatatacagttcccataaagggcttttgaatctgtttgatgtacctgccacagttcttaacatttctctcactctgtgctcagagagaactcttcaagctggtcttgtaagta

SEQ ID NO: 4964 - DNA, 477 bp, Homo sapiens
  AC024017.2_25388
  Located on chromosome 3
  Distance between a terminus base of telomere on chromosomal short arm and 5'-terminus of this base sequence : 44193503
  Distance between 3'-terminus of neighbour sequence of sequence listing upward to telomere on chrosomal short arm and 5'-terminus of this base sequence : 77149
ctttcgatacagaccaattaatattttaatttaccaatatatattcccacagccagcttccaactttgaagattggaaaagtaaaaacttgcatttcatttttttctcatttaattttcccttattactaatgaacttatgtgtttggtgaaattaacattgggcatttgtatttctgctgttgtgaattacctgcttaattcttttgaccacttttctcttgggggtatctctttctaaatgatttaagtgacttctctctctctctctctctctctctctctctgtatatatataatctccttacagatactatgtctcataatgaatttgttataagttgtggaactcaaaagaccatcagttattaccattctgcccaattctcacatcagtgagatgtataaatataatgttatactaaaattctggtgtgtttttacctggttctaatatctaaccttgagatttggttat

SEQ ID NO: 4965 - DNA, 389 bp, Homo sapiens
  AC025643.3_57512
  Located on chromosome 3
  Distance between a terminus base of telomere on chromosomal short arm and 5'-terminus of this base sequence : 44256058
  Distance between 3'-terminus of neighbour sequence of sequence listing upward to telomere on chrosomal short arm and 5'-terminus of this base sequence : 62078
cagtccttcactaatgaatcactttcttgtcctctatttcttaagcaagtgttttgttattttagaccacagttctccaaagcaatacactggagtgtgatttaaaatatatatatatatatatatatatatatatatatatatatgaacatgttttacaattatttttaccaaaaagataataactgaaactggtcttttcaccggacacatgcaccctcctgcctagcagaatgcgcattggcgggtatcctggagaaagagtaggggcagcacgactcaagacagccagagtgaacatcccatgagtttctgtaaaatttcagtatattgcacatatatacacatacatatgtacatatttgctataaagcagttcatgtacacct

SEQ ID NO: 4966 - DNA, 361 bp, Homo sapiens
  AC068826.2_147622
  Located on chromosome 3
  Distance between a terminus base of telomere on chromosomal short arm and 5'-terminus of this base sequence : 44565893
  Distance between 3'-terminus of neighbour sequence of sequence listing upward to telomere on chrosomal short arm and 5'-terminus of this base sequence : 309446
ggctcatacctgtaattccttccagcgctttgggaagccagggcaggaggatcacttaagccagtagttcaatacaagcctgggcaaaatggtaaaaccccatctctacaaaaaaatacaaatattagccaggcgtggtggcacacacctgtagtctcagctactcagaggctgaggtgggaaaattacttcagcccaggaggtcgaggctgcagtgaacagtgatcacaccactgcattccagcccaggtgagagagcaagaccctgtctcaaaaacaaacaaaacaaaacaaaacaaaacacaaaccaagggtgagagacatgttagatctttttgtcctcgttacagatgtaaatgat

SEQ ID NO: 4967 - DNA, 180 bp, Homo sapiens
  chr3.fa.O7frz.49813251
  Located on chromosome 3
  Distance between a terminus base of telomere on chromosomal short arm and 5'-terminus of this base sequence : 44773518
  Distance between 3'-terminus of neighbour sequence of sequence listing upward to telomere on chrosomal short arm and 5'-terminus of this base sequence : 207264
actcctaaactccactttaaagaggccagaactcacacaaccacaaagccatgcccgctgccctgccctcctcctcctcctcctcctcctctacccagctgtgtgatcctaggcaagatcactcccaaccttttccccctccatccctcttcccctcgctaaccattcttttcctgctag

SEQ ID NO: 4968 - DNA, 437 bp, Homo sapiens
  AC018358.11_86787
  Located on chromosome 3
  Distance between a terminus base of telomere on chromosomal short arm and 5'-terminus of this base sequence : 44798042
  Distance between 3'-terminus of neighbour sequence of sequence listing upward to telomere on chrosomal short arm and 5'-terminus of this base sequence : 24344
tgttacaaataggaggcatcagactctgtatttaaaaacagaactgtgcaatgagaatgctttaatcatcacccacacagacgagcggaagctacagacagagaaccactacggatggtgcctggaacagaggtgagaatggcccaaaactctgcctccgggaaaggtgccaagtttacaggacttatcgtggtgccctcaccagacccctcctcctcctcctcctcctcctcctcctccgtggccgctggcggctcctgcatctcctctggggaagcctgaggccggctcgggtaacttctgctgcctgagacagtcacacgtgcttgggacctctcacctgaggtctctgggtgctgaactggagtggaggtagctaggcgtgggagagaaatgtggtcacctgtgtcatcttcttcaaagtcgttaaggcagta

SEQ ID NO: 4969 - DNA, 232 bp, Homo sapiens
  D3S3563
  Located on chromosome 3
  Distance between a terminus base of telomere on chromosomal short arm and 5'-terminus of this base sequence : 44807418
  Distance between 3'-terminus of neighbour sequence of sequence listing upward to telomere on chrosomal short arm and 5'-terminus of this base sequence : 8939
ggaagaatcaattttattaagtcagaggaaaaggatgcacaaagtagacaatggtgtgtgtgtgtgtgtgtgtgtgtgtgtgtgtgtgtgtgtgtgtgtgtccgtctgtccgtccgtccgtccgtccgtccaggttctgcagggcttcaggacaaagaggaactgaccattcctgaggaaagcccagtcctgggcaccttggcccccctgcaccccaccctctgaaccttgt

SEQ ID NO: 4970 - DNA, 364 bp, Homo sapiens
  chr3.fa.O7frz.49941072
  Located on chromosome 3
  Distance between a terminus base of telomere on chromosomal short arm and 5'-terminus of this base sequence : 44941846
  Distance between 3'-terminus of neighbour sequence of sequence listing upward to telomere on chrosomal short arm and 5'-terminus of this base sequence : 134196
acagtgagtcacgaaataacataacataacataacataacataacataacataacataacataacataacataacacaacacaacacaacacaacacaacacaacaaaataaaaggaacaaattctaagccatggccctttgatgaagagtcctcccaggcagggctactcctgttagcagatttttcctaggcaattctcactcggtttacagcttctcctttacaccctggcccacctctgtgctctgagggcaggaccagtcctctctctgaccccaggaattaacataaaccccagtaaaaacctggccctgggtgcacgctgcttcaacacacaaaaataagtacgattgcctcagtaa

SEQ ID NO: 4971 - DNA, 212 bp, Homo sapiens
  D3S3564
  Located on chromosome 3
  Distance between a terminus base of telomere on chromosomal short arm and 5'-terminus of this base sequence : 45138319
  Distance between 3'-terminus of neighbour sequence of sequence listing upward to telomere on chrosomal short arm and 5'-terminus of this base sequence : 196109
cccacagagtgatagggaaaaacacaaaagcctaggtatgtagtgggttattccatctaggtttgtgtaaaggcactgtctgatatccacacgatgaaattaccagaacatgtttccatcattaagtgatgcatgactctctgtgtgtgtgtgtgtgtgtgtgtgtgtgtgtgtgtgtgtgtgtcactaatgcagttagactgtgtttagct

SEQ ID NO: 4972 - DNA, 107 bp, Homo sapiens
  D3S2373
  Located on chromosome 3
  Distance between a terminus base of telomere on chromosomal short arm and 5'-terminus of this base sequence : 45154102
  Distance between 3'-terminus of neighbour sequence of sequence listing upward to telomere on chrosomal short arm and 5'-terminus of this base sequence : 15571
agggacttggacaggctatgctgcaggatacacatggcaccagacgtgtgcgcgtgcacacacacacacacacacacacacacaaccaggccctcctggtggcagat

SEQ ID NO: 4973 - DNA, 406 bp, Homo sapiens
  AC034101.12_157566
  Located on chromosome 3
  Distance between a terminus base of telomere on chromosomal short arm and 5'-terminus of this base sequence : 45188382
  Distance between 3'-terminus of neighbour sequence of sequence listing upward to telomere on chrosomal short arm and 5'-terminus of this base sequence : 34173
catgagtacaggctgaatagaccctaaaagaaataaaggtgaaattaccagaagtatgaaacaacccagctctttgtgggtgtagtcccatggctgcagaatcatttaggagctttttacaaataaatattccagtgcatgggtgcaaccgcgtgtgcgtgcgcgtgcgcatgcgcacacacacacacacacacacacacacacacacacacacagagtcaccctaatgactcagtattgctgaggtagggcagggttacctgtattgtctcaaagtccctccagattcagccagcctagtctgagcccagagcttagaaactgttggcggggcccataaaatgtagcaatacatatggggagagagagaagaagagaaatgatcaattatctattgctcagagtc

SEQ ID NO: 4974 - DNA, 208 bp, Homo sapiens
  D3S3685
  Located on chromosome 3
  Distance between a terminus base of telomere on chromosomal short arm and 5'-terminus of this base sequence : 45188441
  Distance between 3'-terminus of neighbour sequence of sequence listing upward to telomere on chrosomal short arm and 5'-terminus of this base sequence : -347
aacaacccagctctttgtgggtgtagtcccatggctgcagaatcatttaggagctttttacaaataaatattccagtgcatgggtgcaaccgcgtgtgcgtgcgcgtgcgcatgcgcacacacacacacacacacacacacacacacacacacacagagtcaccctaatgactcagtattgctgaggtagggcagggttacctgtatt

SEQ ID NO: 4975 - DNA, 166 bp, Homo sapiens
  D3S3687
  Located on chromosome 3
  Distance between a terminus base of telomere on chromosomal short arm and 5'-terminus of this base sequence : 45338438
  Distance between 3'-terminus of neighbour sequence of sequence listing upward to telomere on chrosomal short arm and 5'-terminus of this base sequence : 149789
gtgtgactatgaatgaacagccaaaggcatctggtgatggaataattctgtatcttgattgcggtgatgattacaggaatctacacacgataaagtgacagtactacacacacacacacacacacacacacacacacactttataccaacatcaatttcctggagt

SEQ ID NO: 4976 - DNA, 413 bp, Homo sapiens
  chr3.fa.O7frz.50794488
  Located on chromosome 3
  Distance between a terminus base of telomere on chromosomal short arm and 5'-terminus of this base sequence : 45585789
  Distance between 3'-terminus of neighbour sequence of sequence listing upward to telomere on chrosomal short arm and 5'-terminus of this base sequence : 247185
aacatgaaatgtaattccacttacttaggtctactttaatttctttccatgatgttttacagtttttagtgtataggccttgcacttcatttgttaaatttattcctaggtatcttattttttctgatgttatcgtagatataatagttttcttaatttctttttagtttatagaaatacagttgctttttgtatattgatcttgtatcctgaatgttgctgagataacttgttagctctgatgtgtgtgtgtgtgtgtgtgtgtgcgtgtgtgtgtgtgtatttcttaggattttctatatacaaaatcatgtaatctgccaatagaggaaatttcagtgcttcctttccagtgcaaatgctttttatttttcttgcacaactgctctgactagaaatgccagtacaatgtc

SEQ ID NO: 4977 - DNA, 325 bp, Homo sapiens
  AC010192.9_18380
  Located on chromosome 3
  Distance between a terminus base of telomere on chromosomal short arm and 5'-terminus of this base sequence : 45644651
  Distance between 3'-terminus of neighbour sequence of sequence listing upward to telomere on chrosomal short arm and 5'-terminus of this base sequence : 58449
agaagttgcagttagctgagatcgcaccactgcactccattctagcctgggtggcagaggaaaactctgtctcaaaataaaataaaataaaataaaataaaataaaataaaataaaataaaataaaataaaaagaaaaagtcaatcttcctcagtggtgtgctggtaaattggcactgtaagaaaaaaaagtcttgattggtagagttggccagtttcatattgtaaatacattgcccctggccaatttcaggcacccatataaggtcactgaaggaggagttggaaagagatgtgcatcgtcagcatggagtcctgataagtaa

SEQ ID NO: 4978 - DNA, 403 bp, Homo sapiens
  AC068755.9_17835
  Located on chromosome 3
  Distance between a terminus base of telomere on chromosomal short arm and 5'-terminus of this base sequence : 45825329
  Distance between 3'-terminus of neighbour sequence of sequence listing upward to telomere on chrosomal short arm and 5'-terminus of this base sequence : 180353
aagttaactagtaatccaggtgaaggcactggcccggcagctggaagggtaggcaaactgagccacattctgagagcaggtttcctttacactgaaatggggcagaggtggccgcctaagaaaggaggggaaatctgcctggcagggttgcctggttttgtggtgtgtgtgtgtgtgtgtgtgtgtgtgtgtgtgtgtgtgtgtatgtagagtttctctttgaaaagaccaagccagactcttcctgtcagtgagcaaggccccagcttgcaccaagcccttttgtgtgctgatgtgaacaggtctgctcagcatagacagtgggggcacatgggcagatacggagtggcccctctcagcctgcccagtgcacagcagccacttgtagcactgtggcatagga

SEQ ID NO: 4979 - DNA, 415 bp, Homo sapiens
  chr3.fa.O7frz.51045129
  Located on chromosome 3
  Distance between a terminus base of telomere on chromosomal short arm and 5'-terminus of this base sequence : 45942754
  Distance between 3'-terminus of neighbour sequence of sequence listing upward to telomere on chrosomal short arm and 5'-terminus of this base sequence : 117022
tatcaaacgaacttaaattggaaataatctgttctacccctaagtctgatgatttggaggtaaccagtttgatgctgtccagaccttttaccaaggaagctcccaattttctttttctttctttctttctttctttctttctttctttctttctttctttctttctttctttctttctttctttcttctttctcgctctctctctttttttttcactctgtcgcccaggctggagtgcagtggtgcgatcttagctcactgcagcctctgccctccaagttcaagtgattctcctgccttagcctcccgagtagctgggattacaggtgcctgccaccgcacctggctaattttttgtatttttagtagagacggggtttcaccatcttggacaggctagtcttgaaatcctaac

SEQ ID NO: 4980 - DNA, 259 bp, Homo sapiens
  D3S3678
  Located on chromosome 3
  Distance between a terminus base of telomere on chromosomal short arm and 5'-terminus of this base sequence : 46151645
  Distance between 3'-terminus of neighbour sequence of sequence listing upward to telomere on chrosomal short arm and 5'-terminus of this base sequence : 208476
gggctcattctcatgcaaaggtttctcttccttggtaggaattcaggctgctccatggtgtctgagaaaacgggctttttgaaagttgtgtgtaggtgtgtacgtgtgtgtgtgtgtgtgtgtgtgtgtgtgtgtgtgtgtgtctccaaatcagctacctctgggaaggaggcagggagaatgagcaggggtcatgcctgggctgccctgacagctcctcagtcccagcaacccacatgcatccctggactctacaggt

SEQ ID NO: 4981 - DNA, 224 bp, Homo sapiens
  D3S3647
  Located on chromosome 3
  Distance between a terminus base of telomere on chromosomal short arm and 5'-terminus of this base sequence : 46302914
  Distance between 3'-terminus of neighbour sequence of sequence listing upward to telomere on chrosomal short arm and 5'-terminus of this base sequence : 151010
ggctcagagcaggcatactttataaaccacacacacacacacacacacacacacacacacacacacacacgtaactaatatacgtcagataggaagaaattttcttagaaagtaaccaatattcaaaaacctttcttttctgttcattgttcttaatatccttagaaatagtcgatttcagtaacataacataatgggactgggaacacattttattagttagg

SEQ ID NO: 4982 - DNA, 234 bp, Homo sapiens
  chr3.fa.O7frz.51525566
  Located on chromosome 3
  Distance between a terminus base of telomere on chromosomal short arm and 5'-terminus of this base sequence : 46411174
  Distance between 3'-terminus of neighbour sequence of sequence listing upward to telomere on chrosomal short arm and 5'-terminus of this base sequence : 108036
aactgttaaggtctggaagtctgccattggagtatgattcctttgatttatgggtccagtccagaagactggatgtattagtgtggattcttcaaagaaccagaaccaaaaagatatgtgtatatatgtgtgtgtgtgtgtgtgtgtgtgtgtgtgtgtgtgtgtattctatacccatagataaatagatagataagagatttattatgggaattgattcacatgattatggag

SEQ ID NO: 4983 - DNA, 363 bp, Homo sapiens
  AC006055.1_30098
  Located on chromosome 3
  Distance between a terminus base of telomere on chromosomal short arm and 5'-terminus of this base sequence : 46491467
  Distance between 3'-terminus of neighbour sequence of sequence listing upward to telomere on chrosomal short arm and 5'-terminus of this base sequence : 80059
gtcacctacagtggtaacttgtttcataacacaccatttattggctcacctcccttctgtaggtcacttccccacttccctaaggtgttactttcactgcccacataaaccacttacaccaatatctttgcctcaagattagcttcacaaggacccaaactaagacaagtacctagtggtgtcagcacatagtatgtgctcggctaacagttttgactgtgtgtgtgtgtgtgtgtgtgtgtgtgtgtgtgtgtgtgtatggcatgtttgtttagtgaaggacacagaaagaaattcttagctaatatgaaacagtgaggaggtatcagcagcatcaaaaatccaaggatgactatctagact

SEQ ID NO: 4984 - DNA, 483 bp, Homo sapiens
  AC006055.1_48006
  Located on chromosome 3
  Distance between a terminus base of telomere on chromosomal short arm and 5'-terminus of this base sequence : 46509401
  Distance between 3'-terminus of neighbour sequence of sequence listing upward to telomere on chrosomal short arm and 5'-terminus of this base sequence : 17571
aactgaatatgacagaatgctaacatttattaactctaggaatgggttatataattctacaattctctaaatttttctgtgtttaaaatatttttaaaagaatagaaaaatggagaaagtattgttttctgatatgtattcataaatgaatcacactaattctctctctttctctgtctctctctctctctcacacacacacacacacacacatttctacataggctaattgtccattcctgtctccttttcctctcatcactaaaataattttctctgtacatagaatttatataatcacagcagacttagtgctttttaaaaattcaatgagttttcttatcagtttaattatttcaacacattgttcaagttaattaactttcattgagttgatttacttttatagaaaaaaaggtttttaagctcagaaaagatttttagaagtcaacaatatagaaatgaatgtcgttgaaattctag

SEQ ID NO: 4985 - DNA, 497 bp, Homo sapiens
  AC006055.1_76722
  Located on chromosome 3
  Distance between a terminus base of telomere on chromosomal short arm and 5'-terminus of this base sequence : 46537932
  Distance between 3'-terminus of neighbour sequence of sequence listing upward to telomere on chrosomal short arm and 5'-terminus of this base sequence : 28048
aaatcttctggaccactgatatattttaaacaaaggccgggcacggtggctcacacctgtaatcccaacattttgggaggcagaggcgggcagatgacctggggtcagaagttcaagaccagcctgaccaacatggagaaaccccgtctctactaaaaatacaaaataattagccgggcgtggtggcacatgcctgtaatcccagctactcaggaggctgaagcaggagaattgcttgaacccaggacgcggaggttgtggtgagccaagatcgcaccattgccctccagcctgggtgacaagagcgaaaccccgtattgaatgaataaataaataaataaatagttttaaaaaaaatagtctaaaacacacacaaacacacacacacacacacacacacacacacacacacacacagagtgaattgagaatcctaaccctcaccttggagtctgcacattacagtggtagatgtattctgtcacagtatcgtcttc

SEQ ID NO: 4986 - DNA, 462 bp, Homo sapiens
  chr3.fa.O7frz.51981224
  Located on chromosome 3
  Distance between a terminus base of telomere on chromosomal short arm and 5'-terminus of this base sequence : 46753251
  Distance between 3'-terminus of neighbour sequence of sequence listing upward to telomere on chrosomal short arm and 5'-terminus of this base sequence : 214822
gatgccagttacttcaaatattacttttttctgtctccattaaaaaaatttaaaaaaagtatttacagatgacatattacaaaatagtaagtaaaaaagaaaatgaaaaaattattcccctccaaataaaaagaatgtaaaacttaaagaagacttataagactagtacaatgaatttcatatactctggacccagattgattactttataacttctctccctgtctccctttctctctctctctcttacacacacacacacacacacacacacacacacacacacacacacacacacaaatgtatgcgtatacatatatacacattctcccctaaaccatttgggaattagttttgtctttaaatatttcattatgtatttcctgagaacataaccaagcacaattatacaattcaggaaatttaacattggtataatattgtatcggttcaattgtatta

SEQ ID NO: 4987 - DNA, 269 bp, Homo sapiens
  D3S3597
  Located on chromosome 3
  Distance between a terminus base of telomere on chromosomal short arm and 5'-terminus of this base sequence : 46794465
  Distance between 3'-terminus of neighbour sequence of sequence listing upward to telomere on chrosomal short arm and 5'-terminus of this base sequence : 40752
gcaaatagtaggtgctcaataaacaccttttgaaaagtgaaggcatgactgggtagatggatgggtggttaatagcctagattctttttttctgctgggggaaatgctgcaccattttacatttccagcagtgatatatgagggttccaatttttctacatccttgttaacacttgttattcaaatatatatatatatgtgtgtgtgtgtgtgtgtgtgtgtgtgtgtgtacgtatatacatatacttatttccatcctaatgggtgtg

SEQ ID NO: 4988 - DNA, 467 bp, Homo sapiens
  AC024719.4_123182
  Located on chromosome 3
  Distance between a terminus base of telomere on chromosomal short arm and 5'-terminus of this base sequence : 46797953
  Distance between 3'-terminus of neighbour sequence of sequence listing upward to telomere on chrosomal short arm and 5'-terminus of this base sequence : 3219
ggtgctgactacatgctattctgctgggttatagaagtgactgggacctgaaactggccctcagttatcccaatattggatcataactcttttcccagtctcctcttttctgccccacatactgggggagccccacactgtcttctgggcaggaggaaaaacgaagggaatgggccggtctctccagcttggggtttcttctgttaatctgagagaagggaggatagagtccagcagaagccagtggagtgtgtgtgtgtgtgtgtgtgtgtgtgtgtgtgtgtgtgtgtgtgtgtgtgtgaaatgggtatttatcccttttaaatactactttgctagttttctgtatcctagatacaaaatggcctttgatggtattttaaacaatgcctttagaaagaattccactctgagaccccaaatcatacatacacagaggatttgtttagctaactttccttgttagg

SEQ ID NO: 4989 - DNA, 472 bp, Homo sapiens
  AC024188.4_77277
  Located on chromosome 3
  Distance between a terminus base of telomere on chromosomal short arm and 5'-terminus of this base sequence : 47105779
  Distance between 3'-terminus of neighbour sequence of sequence listing upward to telomere on chrosomal short arm and 5'-terminus of this base sequence : 307359
cactgcgttctttaaccactgctataaatactaccatttttatttctttgaaagttaattacatttagagtatttcacctgtggtggtacctggcacagagtaaatatttagtaaatattagttgaggtggatggatggatggatggatggatggatggatgttcttcatttatgtatctttataccttccaaagaggaaatggttgcaggttttgaaagaacgtgtgtgtgtgtgtgtgtgtgtgtgtgtttatactatgaaatttagcataaagtttagctcacacatgtggaccagcgcctgtgactacagtacgaatataagcatataaacaatgttaatatttaagaaaaatcatttcagaaaaaacgtgttgtcttcattttctttctcttttttttttctgagatggaatcttgctctgttgcccaggctggagtgcaatggcatgatctcagctcactgtaaac

SEQ ID NO: 4990 - DNA, 101 bp, Homo sapiens
  DISD22_0002685
  Located on chromosome 3
  Distance between a terminus base of telomere on chromosomal short arm and 5'-terminus of this base sequence : 47197732
  Distance between 3'-terminus of neighbour sequence of sequence listing upward to telomere on chrosomal short arm and 5'-terminus of this base sequence : 91481
ttcttctaaagaagaccatcgactttatttgaatcataagtcacacacacaaacacacacacacacacacacacacacacactcctgcagaacaatctgga

SEQ ID NO: 4991 - DNA, 393 bp, Homo sapiens
  AC069071.6_123060
  Located on chromosome 3
  Distance between a terminus base of telomere on chromosomal short arm and 5'-terminus of this base sequence : 47349020
  Distance between 3'-terminus of neighbour sequence of sequence listing upward to telomere on chrosomal short arm and 5'-terminus of this base sequence : 151187
ttcttaatctgttgatttaggaagcagggtacagttagcaaattcagaactagaatcagcatgtaggggaaagtccgtaccagtgggatatgactgcccaacccaatacctagatacacacacattcacacacatacacacacacacacactctctctcttttgcatacatacacacacacacacacacacacacacacacacacacacacacaaaatccattcgcattttgaggctgaagtaacagtagtaagacttccaggagtatatgtaaaagatatcagtaagacctctgtatgtgatattctatgatgagatggacttccatctttagaagcagctggtccagctggggaggggagaaagatcgtgcatactttaaggataattcaa

SEQ ID NO: 4992 - DNA, 152 bp, Homo sapiens
  D3S3624
  Located on chromosome 3
  Distance between a terminus base of telomere on chromosomal short arm and 5'-terminus of this base sequence : 47349104
  Distance between 3'-terminus of neighbour sequence of sequence listing upward to telomere on chrosomal short arm and 5'-terminus of this base sequence : -309
gggatatgactgcccaacccaatacctagatacacacacattcacacacatacacacacacacacactctctctcttttgcatacatacacacacacacacacacacacacacacacacacacacacacaaaatccattcgcattttgaggc

SEQ ID NO: 4993 - DNA, 235 bp, Homo sapiens
  AC027590.2_139298
  Located on chromosome 3
  Distance between a terminus base of telomere on chromosomal short arm and 5'-terminus of this base sequence : 47596157
  Distance between 3'-terminus of neighbour sequence of sequence listing upward to telomere on chrosomal short arm and 5'-terminus of this base sequence : 246901
cttgtccgtgtaatctattgatacttcagagagatgcactgatttcccactaaggtgttggtttttcagtttcattgcgatttttgtctaattttatatatatatatatatatatatatatatatatatatatatatatatataaaatagatacatacacatatggaaacacaacaagtcctcacttaacatccttataggttcttggaaactgactttaagtgaaacgatgtat

SEQ ID NO: 4994 - DNA, 213 bp, Homo sapiens
  AC027590.2_192991
  Located on chromosome 3
  Distance between a terminus base of telomere on chromosomal short arm and 5'-terminus of this base sequence : 47684919
  Distance between 3'-terminus of neighbour sequence of sequence listing upward to telomere on chrosomal short arm and 5'-terminus of this base sequence : 88527
aactaaagtaatggtttatggcagagaaaactggaaagatacctagatactttatagtgattttctctggagaaaggatctgggagtctgggatgggagagaaacttaatttttgtaatgggcatttattacttttgttttattattattattattattattattattattattattattattattatttgagatgaggtctcactctgtcac

SEQ ID NO: 4995 - DNA, 424 bp, Homo sapiens
  AC068625.2_82539
  Located on chromosome 3
  Distance between a terminus base of telomere on chromosomal short arm and 5'-terminus of this base sequence : 47764089
  Distance between 3'-terminus of neighbour sequence of sequence listing upward to telomere on chrosomal short arm and 5'-terminus of this base sequence : 78957
acggcaattataacagtctgagcaagccagttgatgtgaagccgagacccagtgaatttcagtagccctgaggacatcattacctaacacactccagtaggtgatgttcctggtaataactctaaataaatcattccagaagaaatggttgattattgtgcttaagggacaaacagctataatacccctcccctccccttccttccttccttccttccttccttccttccttccttccttccttctctctccctttctgttttaagatttccatcttaaccatccaaatgattaaagtgtgtttctacttggaaacaagtcacatttatctgggaagttacttacgtggaagggcttattcctcaacaaaaccatgcacatgaaacataactcttgtttagtcgaatcattgtcataaatacaa

SEQ ID NO: 4996 - DNA, 424 bp, Homo sapiens
  AC068625.2_175161
  Located on chromosome 3
  Distance between a terminus base of telomere on chromosomal short arm and 5'-terminus of this base sequence : 47850046
  Distance between 3'-terminus of neighbour sequence of sequence listing upward to telomere on chrosomal short arm and 5'-terminus of this base sequence : 85533
ctttcttatgttgcttaaagcattgtaccccatcccccaccctgaacaattgctttccgttttcctagcctcctccccagagtcactgcacagctatggcaccatccagttacaggagagttccttgggctcatgagtctctaaaccttcctctctgtctgactgctggctatggtggaagaatgggtgtgtgtgtgtgtgtgtgtgtgtgtgtgtgtgtgtgtgtgtgtgtgtgttttaagccatttaaaaataggtaaaaatttccactttaacccagtgtcaaaaaaaaaccagtggggcatgggtttgttgttgttgttgttattttgagacggagtttcactcttgttgaccaggctggagtgcagtggtgcgatctcagctcactgcaacctctgcctcaggttcaagtgattcttgt

SEQ ID NO: 4997 - DNA, 399 bp, Homo sapiens
  chr3.fa.O7frz.53140670
  Located on chromosome 3
  Distance between a terminus base of telomere on chromosomal short arm and 5'-terminus of this base sequence : 48102344
  Distance between 3'-terminus of neighbour sequence of sequence listing upward to telomere on chrosomal short arm and 5'-terminus of this base sequence : 251874
tacagagaactttgatttacatgactgacacaattttattttattttattttattttattttattttattttataactttttgagacagaatttcactcttgttgcaaggctggagtgcagcctggcaacctccacctcccgggttcaagcaattctcccacctcagcctcccaagtagctggaattacaggcgtgcaccaccaagcccagctaatttttgtatttttagtagagatggggtttcactatgttggccaggctgatctccaactcctgacctcaggtgatccacccacctcagcctcccaaagtgttgggattacaggtgtgagccaccacgcctggcctactgacacaaattttaagcttttcattaaagctaacattctcagaacttt

SEQ ID NO: 4998 - DNA, 236 bp, Homo sapiens
  D3S3582
  Located on chromosome 3
  Distance between a terminus base of telomere on chromosomal short arm and 5'-terminus of this base sequence : 48203604
  Distance between 3'-terminus of neighbour sequence of sequence listing upward to telomere on chrosomal short arm and 5'-terminus of this base sequence : 100861
agggcctgtttccctaagtggctctgtgtggtgaggggtgggtatacagaggaattggggcagagagtcagtggccctgtgtacaagagggagtgtgtgtctgtgtgtgtgtgtgtgtgtgtgtgtgtgtgtgtctttacacacagaaacctgtaggaatttgtgtatctctgaatatgagaaatacctggtgttttggaaagagagccttgagccaggagttcagagccacatcg

SEQ ID NO: 4999 - DNA, 345 bp, Homo sapiens
  AC006515.7_178970
  Located on chromosome 3
  Distance between a terminus base of telomere on chromosomal short arm and 5'-terminus of this base sequence : 48232380
  Distance between 3'-terminus of neighbour sequence of sequence listing upward to telomere on chrosomal short arm and 5'-terminus of this base sequence : 28540
tgtatctggaaactttgctaagttcttttatcagttctaggagctttctggaggagtccttagggttttcttttcttttcttttcttttcttttcttttcttttcttttcttttcttttgagacggagtttggctctgtcacccaggctggagtgcagtggagcaatcttggctcactacaacctccgcctcctgggttcaagcaattatctcctgccacagcctcccaagtaggtggggctacaggtgcccaccatcacacctggctaatttttgtatttttggtagagatggagtttcactgtattggccaggctggtctcaaactcctgaccttgtgattca

SEQ ID NO: 5000 - DNA, 461 bp, Homo sapiens
  AC063916.10_166014
  Located on chromosome 3
  Distance between a terminus base of telomere on chromosomal short arm and 5'-terminus of this base sequence : 48270840
  Distance between 3'-terminus of neighbour sequence of sequence listing upward to telomere on chrosomal short arm and 5'-terminus of this base sequence : 38115
tagctagtggtttgcaattaatttaaaaatattggctattttaggccaggctcagtggctcactcctgtaatcccagcactttgggaggccgaggcaggcagatcacttgaggccaggagttcaagaccagcctggccaacatagcaaaaccccatctctactaaaaatacaaaaattagccgggtgtgggggtatgtgcctgtaatcccagctactggggaggctcaggcaggaggatcacttgaacctgggaggtggaggttacagtgagccgagattgcaccattgcactccagcctgggcaacagagcaagactccatctcaaaaaaaaaaaaaatatatatatatatatagagagagagagagagggagagagagagagagagagagagagagagaggctattttagaaattagtgtaaatgatgtatagggcttagtccaaagccttacttttat

SEQ ID NO: 5001 - DNA, 137 bp, Homo sapiens
  D3S2354
  Located on chromosome 3
  Distance between a terminus base of telomere on chromosomal short arm and 5'-terminus of this base sequence : 48391192
  Distance between 3'-terminus of neighbour sequence of sequence listing upward to telomere on chrosomal short arm and 5'-terminus of this base sequence : 119891
gctcttggctgtgttaactgatggtggttacatgaaactacacatggttatgctaagttacacacacacacacacacacacccccacacccacatacacacacattagttattaaactgatggaatccaaataagct

SEQ ID NO: 5002 - DNA, 411 bp, Homo sapiens
  AJ297357.1_7586
  Located on chromosome 3
  Distance between a terminus base of telomere on chromosomal short arm and 5'-terminus of this base sequence : 48530514
  Distance between 3'-terminus of neighbour sequence of sequence listing upward to telomere on chrosomal short arm and 5'-terminus of this base sequence : 139185
ggtttgtctgcctattctttacccattttttatataggactgttacttgagttattttcatattagagttacatccttttctgtcatacagtatagatgtttgctctagtttgttattgccttttcgtttacggtgtttcacctaagagtgtgtgtgtgtgtgtgtgtgtgtgcgcatgtaaaacctactggaaggtactatgggaaataatccttatttacctgtcacccagaatgcacagacatttttacattatagttttggtttgatattttttataaaggaaattaaatatataaaaattgtgtgtgtattttaaaacctactggaaagtactataggaaataatccttatttacctatcacccagaatgcacagacatttttacattgtagctttgattctgtat

SEQ ID NO: 5003 - DNA, 475 bp, Homo sapiens
  AJ289880.1_13666
  Located on chromosome 3
  Distance between a terminus base of telomere on chromosomal short arm and 5'-terminus of this base sequence : 48591803
  Distance between 3'-terminus of neighbour sequence of sequence listing upward to telomere on chrosomal short arm and 5'-terminus of this base sequence : 60878
gtttaactctttgaggaaccaccatactgtttgccatagtggctgcaccattttgtattcccaccaacaatacaccagagttccagtttcttcatatccttgctgacaattgttgttttctggtgtgtgtgtgtgtgtgtgtgtgtgtgtgtgtgtgtgtgtgtttaatgatagccatcccaatgggtgtggagtagtgttgagttgatttacatttctctaatgatttgtgtgattttgagcatctttgcatgtgctcattggccatttgtgtatcttctttggagaaatgtctatgtaaatcctttcgctatttttaatcaggttgttttttgtttgagttgtagtcattctttatgaagtctggatatttatctcttagcagacaggtgctttacaaatattttctcccactctttaggttgattttttactcttgacaatgtccttggtatacaaattgtttaagtccagc

SEQ ID NO: 5004 - DNA, 475 bp, Homo sapiens; identical to SEQ ID NO: 5003
  AC062007.2_53209
  Located on chromosome 3
  Distance between a terminus base of telomere on chromosomal short arm and 5'-terminus of this base sequence : 48591803
  Distance between 3'-terminus of neighbour sequence of sequence listing upward to telomere on chrosomal short arm and 5'-terminus of this base sequence : -475

SEQ ID NO: 5005 - DNA, 434 bp, Homo sapiens
  AC005669.1_124202
  Located on chromosome 3
  Distance between a terminus base of telomere on chromosomal short arm and 5'-terminus of this base sequence : 48649802
  Distance between 3'-terminus of neighbour sequence of sequence listing upward to telomere on chrosomal short arm and 5'-terminus of this base sequence : 57524
tctgtctatctttccatccttccatctatccaccctacatccatccatccttccttccttccatccatctatatttccaaccttccattcatccatccgtatttccatatttccatccatccatccatccatccatccatccatccatccaaccatccatccatccttccatccattcatctgtccatccttccatgcatccttacatccatcctttcatctttttatcttcctactcagccacctgtctgttcgtccatccatctgtggatgacatgcagccatgtcagttgttgaactctttaaattcatcctcgctgggaggcaaactgccactgtcccaagctgcttgaatgcctttctcaatgcctccactgtcccagcccttctgccaaaccccacattccatcttctatttcagcaactaatagttg

SEQ ID NO: 5006 - DNA, 398 bp, Homo sapiens
  chr3.fa.O7frz.53824873
  Located on chromosome 3
  Distance between a terminus base of telomere on chromosomal short arm and 5'-terminus of this base sequence : 48749881
  Distance between 3'-terminus of neighbour sequence of sequence listing upward to telomere on chrosomal short arm and 5'-terminus of this base sequence : 99645
attggaatgaacaagaggtaaccgacttgatcatatattgtaatgaacagactcagcactcctgttggcccctgcaacaaagtcagcttgggtcttttctctgttacaggtatcagcgttgtggattgctgtttctagtccacagttattcctgaaatgctcttcagttgccaggtacagcacttggtccataacccaaaggggatactattattattattattattattattattattattattaacatttttttaaaaatttcttttcatagaatgcatttttgtattagagattcctctagtgggaaaataacagtttattacttatagttctatatttgtggacagatcgttttagaacaagtaaaacacatttgagaatgaagtctcagttta

SEQ ID NO: 5007 - DNA, 416 bp, Homo sapiens
  AC005669.1_19588
  Located on chromosome 3
  Distance between a terminus base of telomere on chromosomal short arm and 5'-terminus of this base sequence : 48754413
  Distance between 3'-terminus of neighbour sequence of sequence listing upward to telomere on chrosomal short arm and 5'-terminus of this base sequence : 4134
atccaattctatgatacggttctatgttgaattggcatggaaggtgatccatgaaagatgggcaattagaaagcaagatagaagattatatgtgtagtctgatttcctttctattaagtgcgtgtgtgtctgtgtgtgtgtgtgtgtgtgtgtgaggttgtgttacagagaaaaagtcagaaaggaagtatctcagaaacttaacaatggctaaactaggaaagggtgcttcaggagtttttattttctatattatgtatgttggcattttggggattttttgtgcattgtaaaaatactcctttatgatcagagtaaagcaaaaagttattttaaatgactcatcagtggatgctggtttgccttttcaaacacacctaccctctttagttctgaattagctgttactccataga

SEQ ID NO: 5008 - DNA, 416 bp, Homo sapiens; identical to SEQ ID NO: 5007
  AC024150.8_111572
  Located on chromosome 3
  Distance between a terminus base of telomere on chromosomal short arm and 5'-terminus of this base sequence : 48754413
  Distance between 3'-terminus of neighbour sequence of sequence listing upward to telomere on chrosomal short arm and 5'-terminus of this base sequence : -416

SEQ ID NO: 5009 - DNA, 447 bp, Homo sapiens
  chr3.fa.O7frz.54024697
  Located on chromosome 3
  Distance between a terminus base of telomere on chromosomal short arm and 5'-terminus of this base sequence : 48966850
  Distance between 3'-terminus of neighbour sequence of sequence listing upward to telomere on chrosomal short arm and 5'-terminus of this base sequence : 212021
gattaacatctacaatcggtttactttatggaaaggaaattattcctaatactctaggaggcccgattcctcctagagttgaaaggcgtgaatgcagaactggtttccctgaagaagaaattctgcctgtggattgcagttagcctttacctgagagttccagcctgctcttcccgatggctgccctgcagagtttggatttccctaatcagtccctacaattgtgtaagacaatttcttgcaataaatctctatctagtacctattatcatcttatctgtctgtctatctatctatctatctatctatctatctatctatctatctatctatctatctatctatctacgcatccatctatctatctatctgccatctatgtatctatcatctatcgatcatctatcttgctacctatctcctacatcctactggatatcctactgg

SEQ ID NO: 5010 - DNA, 217 bp, Homo sapiens
  Z67705
  Located on chromosome 3
  Distance between a terminus base of telomere on chromosomal short arm and 5'-terminus of this base sequence : 49037362
  Distance between 3'-terminus of neighbour sequence of sequence listing upward to telomere on chrosomal short arm and 5'-terminus of this base sequence : 70065
tgggcaaaggacttaaatcgatatttctccaaagaagagatacaaatgaccagtaagcccatgaagagatgttcaacattcctaatcattagggaaatgaaaatcaaaaccacaagaaaataccacttcacacccaatagtatggcttttagcaaaaaagaaatacacacacacacacacacacacacacgcacatacacacaccagaaaataagtg

SEQ ID NO: 5011 - DNA, 428 bp, Homo sapiens
  AC026349.11_142566
  Located on chromosome 3
  Distance between a terminus base of telomere on chromosomal short arm and 5'-terminus of this base sequence : 49037424
  Distance between 3'-terminus of neighbour sequence of sequence listing upward to telomere on chrosomal short arm and 5'-terminus of this base sequence : -155
gaagagatgttcaacattcctaatcattagggaaatgaaaatcaaaaccacaagaaaataccacttcacacccaatagtatggcttttagcaaaaaagaaatacacacacacacacacacacacacacgcacatacacacaccagaaaataagtgttagagagtatgtgaagaatctggaacccttgcgcactgttggtgggattgtaaaatggtgcagaggctatggaaagcagtatgacagttcctcgaaaaattaaaaatagaattttcatgtgatccagcaattccaattccggatatacacccaaaagatttgaaaggaaggactcaaacagatatttgtactcccaagtttatagtgcattatttgcaatagccaaaaggtgaaaacaacccaaatatctatagacagctgaatggataaac

SEQ ID NO: 5012 - DNA, 456 bp, Homo sapiens
  chr3.fa.O7frz.54211452
  Located on chromosome 3
  Distance between a terminus base of telomere on chromosomal short arm and 5'-terminus of this base sequence : 49154553
  Distance between 3'-terminus of neighbour sequence of sequence listing upward to telomere on chrosomal short arm and 5'-terminus of this base sequence : 116701
acaatgataagtttgcgtgtagcactcacccaaacttggccctttatacctctttagtcaacatctgtgcccatgttaccctcctatactttcacaaattctcaactatgtgcatatgactactccaaagagcttacacttaatagcttgtgtttatttatattgacttgtaagaaatagcaaaaatataattttacatatatatgtgtatatatatatatatacacatatatatatatatatatatacgcacacacacatacatttttatatatacaaagtcctccctcagtatctgtgagggatttgttccaggacccttgcagataccaaaattcatagatgctcaagttccttatataaaatgatgtagtatttgctgataacctacaaatatcctccagtaccctttaaatacaagtacctagattacttgtaatacctaatacaacgcat

SEQ ID NO: 5013 - DNA, 434 bp, Homo sapiens
  U95626.1_8518
  Located on chromosome 3
  Distance between a terminus base of telomere on chromosomal short arm and 5'-terminus of this base sequence : 49231524
  Distance between 3'-terminus of neighbour sequence of sequence listing upward to telomere on chrosomal short arm and 5'-terminus of this base sequence : 76515
gctcttgtatttaggtatttgactattttgagttaatttttgtacatcgtataaaataagaatccaatttttattttattttactttttgtatgtggatatccaatttccccaccaccattcattgaaaagactgtccttttcctatcgaatggtcttggcacccttgtaaaacataatttgaccatatatgtgagggtttatttctgggctctctattctattctattctattctattctattctattctattctattctattctattctattctattggtccctatgtctttctttattctagtaccaccattttgctcatcataactttgtagtaagttttgaagtcaggaatcgtaagacctccagctttgttcattttcaaggttgttttgattattcaaggtcccttgatagtccatatgaatttcag

SEQ ID NO: 5014 - DNA, 367 bp, Homo sapiens
  U95626.1_73428
  Located on chromosome 3
  Distance between a terminus base of telomere on chromosomal short arm and 5'-terminus of this base sequence : 49296568
  Distance between 3'-terminus of neighbour sequence of sequence listing upward to telomere on chrosomal short arm and 5'-terminus of this base sequence : 64610
atagtccaggtgcctaaagtagcacagctgacttgagatagatgatagataggtagatagatggatagggtacatagatgatagatagatagatagatagatagatagatagatagatagatagacagacagacagacactggtgtgagtgtgggtgtgtgtgtctggctgcgtgcatgcattcctcctgcaggagatcaggagcagtgggcagtatggagtgacaagaagattgggaggtactccttctagccctcccctctgctctgccctccactggagcagaagcaaagcatatggtgaaggggaacaaggagtctccccagcacagtacccgagtgcattagctatttatcactccacagtc

SEQ ID NO: 5015 - DNA, 448 bp, Homo sapiens
  AC068720.2_125706
  Located on chromosome 3
  Distance between a terminus base of telomere on chromosomal short arm and 5'-terminus of this base sequence : 49387089
  Distance between 3'-terminus of neighbour sequence of sequence listing upward to telomere on chrosomal short arm and 5'-terminus of this base sequence : 90154
tttcactgtcgagttctactaaacatttaaataattatcaccaattccacacaacctcttccaaaaccgaaaagaggaaatactctccaatacattccatgaggcccgtttgttagcaagagagaaaaaggagagggtcatctctgttattcttgggagaaactccctatgagatgtcagtcactttcatctgctctccccctaaacacacacacacacacacacacacacacacacacacacacacacaccctctcttcatctactctccaactctatggccctgcaaggcattaccatgggaaccatgtggctcctttgatccagctgcagccaattgaccattagagaccacccaactcaagctggccaagtaatcttttttaagttaaaaaaaactctcatatggagaaatataaaacataaatgtacaattgagcaaattatc

SEQ ID NO: 5016 - DNA, 282 bp, Homo sapiens
  chr3.fa.O7frz.54537355
  Located on chromosome 3
  Distance between a terminus base of telomere on chromosomal short arm and 5'-terminus of this base sequence : 49471878
  Distance between 3'-terminus of neighbour sequence of sequence listing upward to telomere on chrosomal short arm and 5'-terminus of this base sequence : 84341
tctcacatacagtcaaggctactgtcttctaatatggaagtagaggtgaacgcaaagccagccaacttagagaatttccttcctcttctataaacatcaccttcattttggcagtgctatctagtagagttagagcatgtcagccacataggtaacttaaatgttttcagtagccacattattattattattattattattattattattattattttggtagagacaaggtttcattctgtcacccagggtggtcttgaactcctggatgtttatgtagga

SEQ ID NO: 5017 - DNA, 281 bp, Homo sapiens
  G08276
  Located on chromosome 3
  Distance between a terminus base of telomere on chromosomal short arm and 5'-terminus of this base sequence : 49806532
  Distance between 3'-terminus of neighbour sequence of sequence listing upward to telomere on chrosomal short arm and 5'-terminus of this base sequence : 334372
atgctgtatttcaacacacaggcttatttttttttctatctatctatcatctatctatctatctatctatctatctatctatctatctatctatctatctatctatctatctatctatcatctatctatctttatttagagatggattctctgtcacccaggctggagtgcagtggcacgatctcagctcactgcaaccttcgcctcccgggctcaagcagctctccaacctcagcctctcaagtagctgggactgtggctgtgtgctaccgtgcctaatt

SEQ ID NO: 5018 - DNA, 448 bp, Homo sapiens
  chr3.fa.O7frz.54909075
  Located on chromosome 3
  Distance between a terminus base of telomere on chromosomal short arm and 5'-terminus of this base sequence : 49878531
  Distance between 3'-terminus of neighbour sequence of sequence listing upward to telomere on chrosomal short arm and 5'-terminus of this base sequence : 71718
agtatgttagactgtgcgaagtactatgggaaaaattaaaggaggataaggaggatttggaaggatgggggacacagtttttgagggtgtcctaggaaggcctcattgaggaggcaatatttgagtatagaccacatctggccgcctcttgttagcccatgagctgagaatggttgttacagaacatttgcagctgggtctggtggcttatgcctgtaatctcaatactttgggaggctgaggcaggaagattgcttgagcctaggagttcgagatcagcctgggcaacatagcaaaaccccacctctacaaaaattaaataaataaataaataaataaataaataaataaataaataaataaaattagccaggtagggccagttcctcctggatgccaagaggaggatttgtttccttgatttttatagattctagaggtcaccagc

SEQ ID NO: 5019 - DNA, 455 bp, Homo sapiens
  AC023230.2_126186
  Located on chromosome 3
  Distance between a terminus base of telomere on chromosomal short arm and 5'-terminus of this base sequence : 49993956
  Distance between 3'-terminus of neighbour sequence of sequence listing upward to telomere on chrosomal short arm and 5'-terminus of this base sequence : 114977
ggtctttaactcctgacttcaggtgatctgcccatctcggcctcccaagttgctgagattacaggcgtgagccactgtgtcctgctgggagtttcagagatttcttacatttctttttaagtttattttcaagtttttggttttgttatttattttagtgttaatgaatcattattataatcaatattatcattattttacttctgcctgcttgttgttgatgtatgtgaaggcattgatatatattagttttcactaccttatggtgattcttttatcaactgtaaaaggttttcagttgattatatatatatatatatatatatatatatatatgtaatttttttgtatatatatttggattttgtacataatatcatttgcaaataatgataatttaactttttcctttccagttgtatacctatgttttctttgtcttgactgattgtgat

SEQ ID NO: 5020 - DNA, 380 bp, Homo sapiens
  chr3.fa.O7frz.20444506
  Located on chromosome 3
  Distance between a terminus base of telomere on chromosomal short arm and 5'-terminus of this base sequence : 50005774
  Distance between 3'-terminus of neighbour sequence of sequence listing upward to telomere on chrosomal short arm and 5'-terminus of this base sequence : 11363
cacgagtgaatcactatttgtacaacagtgtgttttgaggaggccatccctatgtaaagggtttctctgtatccctatgtaaaggacttttctcagtgggatttgtgcatagaggaggggggggaagaatgcctgtttgacagagagcagctgaaggtgacgtctgttacacaggcatggtttcgtgtgccacacatgagaaaaatgccctttggggagtggccttttagcattgcctaatataggagggagggagttgggcggggagggagagagagagagagagagagagagagagagagagtgtgtgtgtgtgtgtgtgtgtgtgtgtgtgtgtgtgtgtgtgtattttgggattgaggtcactagaccttgcatat

SEQ ID NO: 5021 - DNA, 295 bp, Homo sapiens
  AC023230.2_187919
  Located on chromosome 3
  Distance between a terminus base of telomere on chromosomal short arm and 5'-terminus of this base sequence : 50013733
  Distance between 3'-terminus of neighbour sequence of sequence listing upward to telomere on chrosomal short arm and 5'-terminus of this base sequence : 7579
ctgaggtcaggagttttaagaccagcctggtcaacatgatgaaaccccgtctccactaaaaatacaaaaattacctggatgtagtggcaggcgcctatctatctgtgtgtgtgtgtgtgtgtgtgtgtgtgtgtgtgtgtgtgtgtgtgtgtatgtttatattatatatgttaatgttatatataatgttataactaagtatatttatacatacttagcttatacagcctgaaaacatttaacagaacagtctattttaccagttgggcttcttcgtaaggtttatgtgactaaa

SEQ ID NO: 5022 - DNA, 161 bp, Homo sapiens
  DISO7_10001078
  Located on chromosome 3
  Distance between a terminus base of telomere on chromosomal short arm and 5'-terminus of this base sequence : 50296945
  Distance between 3'-terminus of neighbour sequence of sequence listing upward to telomere on chrosomal short arm and 5'-terminus of this base sequence : 282917
gctgtgtatggtttattcgtgaaaaccacacacacacacacacacacacacacacacacacacacacacacacatatatatatatatatatatatatgaaaaaaagagtgaaactaagttaaaacctgggcactctgcccccaagatctgaattcagataa

SEQ ID NO: 5023 - DNA, 421 bp, Homo sapiens
  AC069495.2_131844
  Located on chromosome 3
  Distance between a terminus base of telomere on chromosomal short arm and 5'-terminus of this base sequence : 50474635
  Distance between 3'-terminus of neighbour sequence of sequence listing upward to telomere on chrosomal short arm and 5'-terminus of this base sequence : 177529
ggagaaattgatctgtatggtagtggttatttgaaatttgttgaggactcactttgtgacctaatttgtgatcactatttttaaaatgttgtgtgagcttgaaattaatgtgtattatcacctaattgatggatgtagaattcagcatgtgtacatttgtaccatctttctgtgttcatatctgctctatatcttattgagaggtgtattcaaatcctttatgatgatgtttgtctttgtttcttccctgccactctcagtttttgcttatacggttggttggttggttggttggttggttggttggttggttggttttgagatgtagtctcactctgtctcccaggccggagtgcagtggtgcaatctcggctcactgcaacctccgcctccttggttcaagtgattctcctgcctcaga

SEQ ID NO: 5024 - DNA, 234 bp, Homo sapiens
  HUMUT792B
  Located on chromosome 3
  Distance between a terminus base of telomere on chromosomal short arm and 5'-terminus of this base sequence : 50759954
  Distance between 3'-terminus of neighbour sequence of sequence listing upward to telomere on chrosomal short arm and 5'-terminus of this base sequence : 284898
atccctgtggtaactgcgttatttctgtgtgtgtgtgtgtgggtgtgggtgtgtgtgtgtgtgtgtgtggggggggggggagtggtggggggtgtaatgctgttctgtctgcacagcaggtcctcctcccttttttttcagtgtctctctctgtcacccaggctgaagtgtggtggtgccatcacggctcattgcagtctcaactacccaggctcaagcaatcctcccctctca

SEQ ID NO: 5025 - DNA, 139 bp, Homo sapiens
  D3S3640
  Located on chromosome 3
  Distance between a terminus base of telomere on chromosomal short arm and 5'-terminus of this base sequence : 50833356
  Distance between 3'-terminus of neighbour sequence of sequence listing upward to telomere on chrosomal short arm and 5'-terminus of this base sequence : 73168
gatcgcgtgacattccaaaaaaataaataaataagcacgtacacacacacacacacacacacacacacacacacacacacacacactagtcaactatactgacattatgctaattgggtctgataaatagcaagtagca

SEQ ID NO: 5026 - DNA, 126 bp, Homo sapiens
  D3S3729
  Located on chromosome 3
  Distance between a terminus base of telomere on chromosomal short arm and 5'-terminus of this base sequence : 50876920
  Distance between 3'-terminus of neighbour sequence of sequence listing upward to telomere on chrosomal short arm and 5'-terminus of this base sequence : 43425
aacaccttttggcctcagcctactattttacatgtgagatccagcattcaatcaaaaactaagacacacacacacacacacacacacacacacagagcaatcagactgagagatgacccagatttt

SEQ ID NO: 5027 - DNA, 183 bp, Homo sapiens
  D3S3560
  Located on chromosome 3
  Distance between a terminus base of telomere on chromosomal short arm and 5'-terminus of this base sequence : 50985272
  Distance between 3'-terminus of neighbour sequence of sequence listing upward to telomere on chrosomal short arm and 5'-terminus of this base sequence : 108226
ccttatgccctttgtcaagagtcatacattttaacgttttcaaattttgctgcatttgctttcttccctttgactctgtctacttctctctcttacacacacacacacacacacacacacttaacctgtaatatttcagtgtattatttccttagaacaaggatgttctcatacataactgca

SEQ ID NO: 5028 - DNA, 218 bp, Homo sapiens
  chr7.fa.O7frz.163533401
  Located on chromosome 3
  Distance between a terminus base of telomere on chromosomal short arm and 5'-terminus of this base sequence : 51097973
  Distance between 3'-terminus of neighbour sequence of sequence listing upward to telomere on chrosomal short arm and 5'-terminus of this base sequence : 112518
tggaggttgtaatgagcagagattgtgccactgcattccagcctgggcaatagtgagaccctatctcaatcaatcaatcaatcaatcagttccacaataatttgaagaggaatgagagtctgacaagctgcgctttagaaatgctgttgtaatggtctttaatacttttttctccttttactcatgctcttttgtaaaataaggaataacattgacaa

SEQ ID NO: 5029 - DNA, 215 bp, Homo sapiens
  DISO7_00013939
  Located on chromosome 3
  Distance between a terminus base of telomere on chromosomal short arm and 5'-terminus of this base sequence : 51298542
  Distance between 3'-terminus of neighbour sequence of sequence listing upward to telomere on chrosomal short arm and 5'-terminus of this base sequence : 200351
aagatgactgttcctaggtggtcagtgccagggcctggccaaagcccacttctcaagctccaagtccatggggtgttccaccagaacatcattccccagtgagcagagcctctgcctgtccccaatgctacacacacacttcaaacatatacatcaaacacacacacacacacacacacacacagagttctgctgcctccactccagtcagcaac

SEQ ID NO: 5030 - DNA, 295 bp, Homo sapiens
  HUMUT5183B
  Located on chromosome 3
  Distance between a terminus base of telomere on chromosomal short arm and 5'-terminus of this base sequence : 51539798
  Distance between 3'-terminus of neighbour sequence of sequence listing upward to telomere on chrosomal short arm and 5'-terminus of this base sequence : 241041
gcagtcaccagtcaaggagatatgcccttccccgttttctttcttttcttttcttttttcttttcttctcttctcttttcttcttttttcttctctcttcttctccctttctttctttctgtctctttctttcttttcttttctttctttctttctttctttctttctttctttctttctttctttctttctttcctgcctcactgccttcctgcctttcttctttcctcccttcctcccttccttctttcctcccgcctcggcctcccaaagtgccgggattactggtgtgagg

SEQ ID NO: 5031 - DNA, 295 bp, Homo sapiens
  HUMUT741B
  Located on chromosome 3
  Distance between a terminus base of telomere on chromosomal short arm and 5'-terminus of this base sequence : 51539799
  Distance between 3'-terminus of neighbour sequence of sequence listing upward to telomere on chrosomal short arm and 5'-terminus of this base sequence : -294
cagtcaccagtcaaggagatatgcccttccccgttttctttcttttcttttcttttttcttttcttctcttctcttttcttcttttttcttctctcttcttctccctttctttctttctgtctctttctttcttttcttttctttctttctttctttctttctttctttctttctttctttctttctttctttcctgcctcactgccttcctgcctttcttctttcctcccttcctcccttccttctttcctcccgcctcggcctcccaaagtgccgggattactggtgtgaggc

SEQ ID NO: 5032 - DNA, 157 bp, Homo sapiens
  DISO7_00001209
  Located on chromosome 3
  Distance between a terminus base of telomere on chromosomal short arm and 5'-terminus of this base sequence : 51799787
  Distance between 3'-terminus of neighbour sequence of sequence listing upward to telomere on chrosomal short arm and 5'-terminus of this base sequence : 259693
aaggcagctaagcacctcaccttcatctctggggtggtcactgtgaaaccacaggacccaggtctggagtggcgagcaggctgctaactcaagaatgctggtgtgtgtgtgtgtgtgtgtatgtcagggttcaagacccccctggagcttgataacc

SEQ ID NO: 5033 - DNA, 90 bp, Homo sapiens
  D3S1581
  Located on chromosome 3
  Distance between a terminus base of telomere on chromosomal short arm and 5'-terminus of this base sequence : 51897920
  Distance between 3'-terminus of neighbour sequence of sequence listing upward to telomere on chrosomal short arm and 5'-terminus of this base sequence : 97976
gggtaacaggagcgagactgtgtgtgtgtgtgtgtgtgtgtgtgtgtgtgtgtgtgtgtgtgtgtgtggtgggatggtttggcagttctg

SEQ ID NO: 5034 - DNA, 124 bp, Homo sapiens
  D3S2409
  Located on chromosome 3
  Distance between a terminus base of telomere on chromosomal short arm and 5'-terminus of this base sequence : 52118236
  Distance between 3'-terminus of neighbour sequence of sequence listing upward to telomere on chrosomal short arm and 5'-terminus of this base sequence : 220226
ggtgacagagactcttgtctcaaaaataataataataataataataataataataataataataataataaatactcattatcaaaactatattgtctaaagggtatgttccccaaccagaatg

SEQ ID NO: 5035 - DNA, 248 bp, Homo sapiens
  D3S3629
  Located on chromosome 3
  Distance between a terminus base of telomere on chromosomal short arm and 5'-terminus of this base sequence : 52373352
  Distance between 3'-terminus of neighbour sequence of sequence listing upward to telomere on chrosomal short arm and 5'-terminus of this base sequence : 254992
caagcagatgttgctgcctgtgtagccccctccagcccttatttcttctcatgtggacataatttctacaactgcctgtctgttaattggactggaacttgcactttagcttagttatgcctcccttgtctgttgccacaaaagaccaagaatttctcctgccactacacacacaaacacacacacacacacacacacacacacacacacacacaccccaaaacaaaaagggcaatccaggtaattcc

SEQ ID NO: 5036 - DNA, 286 bp, Homo sapiens
  AC024888.12_182364
  Located on chromosome 3
  Distance between a terminus base of telomere on chromosomal short arm and 5'-terminus of this base sequence : 52373446
  Distance between 3'-terminus of neighbour sequence of sequence listing upward to telomere on chrosomal short arm and 5'-terminus of this base sequence : -154
gaacttgcactttagcttagttatgcctcccttgtctgttgccacaaaagaccaagaatttctcctgccactacacacacaaacacacacacacacacacacacacacacacacacacacaccccaaaacaaaaagggcaatccaggtaattccaatcctcgctgctctcggaatctcttctgcaataggctttagttccacaactttatagctttttcagtttccctgtctagccaactaaaagagggactaatggaaatagcaactcaactggatcacatacaa

SEQ ID NO: 5037 - DNA, 127 bp, Homo sapiens
  DISD22_0002695
  Located on chromosome 3
  Distance between a terminus base of telomere on chromosomal short arm and 5'-terminus of this base sequence : 52491637
  Distance between 3'-terminus of neighbour sequence of sequence listing upward to telomere on chrosomal short arm and 5'-terminus of this base sequence : 117905
ctctattgcatccagaggggaaaagtttatatatatatatatacacacacagagcgagagagagagagagagagagagagagagagagagagagagagagaagggctggcccagagctctccacagt

SEQ ID NO: 5038 - DNA, 114 bp, Homo sapiens
  DISD22_0002700
  Located on chromosome 3
  Distance between a terminus base of telomere on chromosomal short arm and 5'-terminus of this base sequence : 52850350
  Distance between 3'-terminus of neighbour sequence of sequence listing upward to telomere on chrosomal short arm and 5'-terminus of this base sequence : 358586
ccctagttggtctgccttcttctttccgcctttcagaatattttttattttggagatatatatatatatatatatattccagagtttttaggtatgcactaggtgttatttgga

SEQ ID NO: 5039 - DNA, 355 bp, Homo sapiens
  Z74618.1_17004
  Located on chromosome 3
  Distance between a terminus base of telomere on chromosomal short arm and 5'-terminus of this base sequence : 53061351
  Distance between 3'-terminus of neighbour sequence of sequence listing upward to telomere on chrosomal short arm and 5'-terminus of this base sequence : 210887
ctcagcaatggtgctctacccttcaaggccctacacaaacgcctcttcctccacagattcctctggtcctccctcagcttcccagtctttgtcaggactttgacaccggccctgctgaggtcaaccacatcctgccagaacacaggtctgcgagtgggaaactggtactccacagcaggtgctgaatgtctaaaccaggcatattgtcacacacatgcacacacacatacacatacacacacacacacacacacgtgagtgcacacacacacaggcacacacatacaccctgtgccttcctctgtcatccacatccttctcaaaccagaggtctgaattaaactggcaacctctt

SEQ ID NO: 5040 - DNA, 148 bp, Homo sapiens
  D3S3615
  Located on chromosome 3
  Distance between a terminus base of telomere on chromosomal short arm and 5'-terminus of this base sequence : 53083711
  Distance between 3'-terminus of neighbour sequence of sequence listing upward to telomere on chrosomal short arm and 5'-terminus of this base sequence : 22005
tcctcccaggaagcacttcactgctcccacccccaccagccccacatcagtgacatcacttgtgtgtgtgtgtgtgtgtgtgtgtgtgtgtgtgtgtgtgtttgtgtgcgcgcgcacgcgcgcgcgcatgcttgtgctgacctttcca

SEQ ID NO: 5041 - DNA, 122 bp, Homo sapiens
  D3S1621
  Located on chromosome 3
  Distance between a terminus base of telomere on chromosomal short arm and 5'-terminus of this base sequence : 53129236
  Distance between 3'-terminus of neighbour sequence of sequence listing upward to telomere on chrosomal short arm and 5'-terminus of this base sequence : 45377
tttgagaaatgccccctgcccgacaacacacacacacacacacacacacacacacacacacacacacacacacttccataagtaaaacccttccttgggagtagcaaccagggcttgggctc

SEQ ID NO: 5042 - DNA, 288 bp, Homo sapiens
  D3S1568
  Located on chromosome 3
  Distance between a terminus base of telomere on chromosomal short arm and 5'-terminus of this base sequence : 53217260
  Distance between 3'-terminus of neighbour sequence of sequence listing upward to telomere on chrosomal short arm and 5'-terminus of this base sequence : 87902
ccatgaacagaacctccctaggcagacagcactgctctgcctggaagattttagtcgctaacccttggctttgctgcagggcccttccctgaagtgagggccgctcaatccttccatcttggggatcagcaaggtttgtctgtgaaagtttcctaaagccacacacacacacacacacacacacacacacacacacacacacacacacacacacacacactattctgatgaacttgctggttctcttcagaggtccctagggaggctggccttacagcaggacagcgg

SEQ ID NO: 5043 - DNA, 106 bp, Homo sapiens
  DISO7_10009502
  Located on chromosome 3
  Distance between a terminus base of telomere on chromosomal short arm and 5'-terminus of this base sequence : 53303817
  Distance between 3'-terminus of neighbour sequence of sequence listing upward to telomere on chrosomal short arm and 5'-terminus of this base sequence : 86269
ttctctgagaggagccttgtttgtgtgtgtgtgtgtgtgtgtgtgtgtgtgtgtgtgtgtgtagggatagatctggacaggggatcacacacgtgcaactacaagg

SEQ ID NO: 5044 - DNA, 274 bp, Homo sapiens
  DISO7_10001091
  Located on chromosome 3
  Distance between a terminus base of telomere on chromosomal short arm and 5'-terminus of this base sequence : 53632632
  Distance between 3'-terminus of neighbour sequence of sequence listing upward to telomere on chrosomal short arm and 5'-terminus of this base sequence : 328709
agtacataccatgtatttggcctactgtatatgtcatcacttattgatcctgacaaccccaataaacttcatgaaatgggtactcttatctcctcattttgtagatgaggaaactgaggcctagagaggttaactcacttgaggaagatcactacagtcagttatttcattgttcccttccctataaacagattataaacacacacacacacacacacacacacacacacacacacacacacccctgcccactgccaaatggctgttatgcctt

SEQ ID NO: 5045 - DNA, 179 bp, Homo sapiens
  D3S3667
  Located on chromosome 3
  Distance between a terminus base of telomere on chromosomal short arm and 5'-terminus of this base sequence : 53703742
  Distance between 3'-terminus of neighbour sequence of sequence listing upward to telomere on chrosomal short arm and 5'-terminus of this base sequence : 70836
tttaagaagcctttgtcagaaggagtttattttactgctatctttgagaagaaaacacacacacacacacacacacacacacacacacaccccccacagcctttttctccaaacaaaaagtattatttttgtgagaacaaagcattttgaatataaaaggcaccatgaaacatcaatag

SEQ ID NO: 5046 - DNA, 208 bp, Homo sapiens
  D3S3604
  Located on chromosome 3
  Distance between a terminus base of telomere on chromosomal short arm and 5'-terminus of this base sequence : 53736375
  Distance between 3'-terminus of neighbour sequence of sequence listing upward to telomere on chrosomal short arm and 5'-terminus of this base sequence : 32454
gcaaaatggcaaaagtccttatcagtaattactttaaatgtaaatactttaaactctctaatcacaaaatattggcagaatatatatacatatacacacacacacacacacacacacagagagagagagagagacacagagagagagagagacagagttttgcttgacacccaggctggagtgcaatggctcactgcaaccaccgcct

SEQ ID NO: 5047 - DNA, 190 bp, Homo sapiens
  D3S2449
  Located on chromosome 3
  Distance between a terminus base of telomere on chromosomal short arm and 5'-terminus of this base sequence : 53787058
  Distance between 3'-terminus of neighbour sequence of sequence listing upward to telomere on chrosomal short arm and 5'-terminus of this base sequence : 50475
ggcaacaacaacaacaacaacaaactctatctatctatctatctatctatctatctatctatctatctatctatctaatctatctatctcccaggtcctgagctccacccagccagcccttgccagttgccagttgacttagcacttagcataagaatgtgtgtttcagagggagctagtctttgaagca

SEQ ID NO: 5048 - DNA, 433 bp, Homo sapiens
  AC068701.2_89084
  Located on chromosome 3
  Distance between a terminus base of telomere on chromosomal short arm and 5'-terminus of this base sequence : 53853065
  Distance between 3'-terminus of neighbour sequence of sequence listing upward to telomere on chrosomal short arm and 5'-terminus of this base sequence : 65817
gctgaagcaggagaattgttttaacctaggaggcagaggttgcagtgagccaagatcacgccactacactccagcctgggtgacagagtgagacttcatctcaaaataaataaataaataaataaataaataaataaataaataaataaaataaaaaaattaaccgagcatggtggtgcacccctacagtcctagctactaggtaggctgaggtggggagatcccttgaactcaggagtttgaggttatagtgagctatgattgcaccactgcactccagtgtgggcaacaaagtaagaccctgtctctaaaaaaagaaaagaaaagaaaagaaaagaaaagagaaaagagaagagaagagaagagaagagaaaaaagaaaagaaaagaaaaaagaaaagtgaactcgcacaaggcttggagttcagtagaat

SEQ ID NO: 5049 - DNA, 185 bp, Homo sapiens
  chr3.fa.O7frz.58481377
  Located on chromosome 3
  Distance between a terminus base of telomere on chromosomal short arm and 5'-terminus of this base sequence : 53970886
  Distance between 3'-terminus of neighbour sequence of sequence listing upward to telomere on chrosomal short arm and 5'-terminus of this base sequence : 117388
aggacatggtacctatccttaccaggtatgaataacttttttaaaacctagtttaataaaaaacctcggacacaactcatacgctagatttcttcatacacacacacacacacacacacacacacacacacacaaactagtttaaaaagaagcaaaaattggtgtggagaatagcataggaacat

SEQ ID NO: 5050 - DNA, 412 bp, Homo sapiens
  AC067763.2_135301
  Located on chromosome 3
  Distance between a terminus base of telomere on chromosomal short arm and 5'-terminus of this base sequence : 54174685
  Distance between 3'-terminus of neighbour sequence of sequence listing upward to telomere on chrosomal short arm and 5'-terminus of this base sequence : 203614
cctgacatctgatagatttgaccataaggcaagctggaagaagagatatattagaaagatgatagcaagagtgggaaatcctcaccagatttgatgaccaaaacaaaacaaagcataagcaaataaaaaaagaggcaattaatttttataaaaacaataagttcgacaacaagcttgtctaacccacggcccatgggccatatgcagcccaggatggctttgaatgcagcccaacacagatttgtaaacttccttaaaatattatgagatatatatatatatatatatatatatatatattttagctcatcagctatcgttagtgttagtgtatttaatgtgtggcccaagacaattcttcttccaatgtggcctagggaagccgaaagactggacatcactgttctacaag

SEQ ID NO: 5051 - DNA, 477 bp, Homo sapiens
  chr3.fa.O7frz.58228234
  Located on chromosome 3
  Distance between a terminus base of telomere on chromosomal short arm and 5'-terminus of this base sequence : 54231172
  Distance between 3'-terminus of neighbour sequence of sequence listing upward to telomere on chrosomal short arm and 5'-terminus of this base sequence : 56075
aaactgtgaacttgagtcagtaacagcctaccaactaaaaaaaaacaaaaaaaacaaaaaacaaacaaacaaaaaaaaaacccaggaccagacagattcacagccaaattgtaccaaatgcacaaagaaatgaggccagtggctgggcacagtggcttacacctgtaatcccagcactttgggaggccgaggcaggtcaggagatggagaccagcctggccaacatggtgaaaccccgtctctactcaaaatacaaaaattagccaggtgtggtggcatatgcctgtagtcccagctactcaggaggctgaggcagaaggatcgcttgaacccaggaggcgcaggttacagtgagccaagattgcgccactctactccatcctaggtgacagagtgagactctgtctctaaataaataaataaataaataaataaaaagtacgctttatctttggggtacaagataccatcctgcac

SEQ ID NO: 5052 - DNA, 467 bp, Homo sapiens
  AC067763.2_96596
  Located on chromosome 3
  Distance between a terminus base of telomere on chromosomal short arm and 5'-terminus of this base sequence : 54250920
  Distance between 3'-terminus of neighbour sequence of sequence listing upward to telomere on chrosomal short arm and 5'-terminus of this base sequence : 19271
ccaaatgtttcattagtgctagcccatgtggaattccatcccagcagaaataatgtgcgaaggcccaaacaagtttggccagtcaaaatctgatatgagttctttattatattcacattccttctgtataaattactcacacttcatattaggaggctctgggttcaagtattttatatatatatatatatatatatacacacacacacacacacacacatatatatatatatatatttttttttttttttgagatggagtcttgctctgttgccaaggctggagtacagcggcacaatctcggctcactgcaacctccacctaccgggttcaagcgattctccagcctcagcctcctgagtagctgggattaaaggctcctgccaccatgccgagctaatttttgtatttttagtagagatggggtttcaccatgttggccaggctggtctggaactcctgacctc

SEQ ID NO: 5053 - DNA, 419 bp, Homo sapiens
  chr3.fa.O7frz.58870089
  Located on chromosome 3
  Distance between a terminus base of telomere on chromosomal short arm and 5'-terminus of this base sequence : 54455014
  Distance between 3'-terminus of neighbour sequence of sequence listing upward to telomere on chrosomal short arm and 5'-terminus of this base sequence : 203627
gataattgagtgctctaatggtaaggagaaattaagaccaggtggttgttaaactttagccagggcaaaaccgcaattcagcttcttacctagggttgggtctcaggctgaagactgttttctaccaccctagaagcaggaaaaacttgaactcatcttccccgctgggagcaggctcaaactctagcaaagagttacctgccttccatcatcatggaaacaaaaaatcttgccttcctttttgaaagcaagtaaaactcaaacaaaacaaaacaaaacaaaacaaaacaaaacaaaaacggaaatgtacagcaaaataaactttagctctccaccaaattttgggtgaccttctggaggggtgctcccagacctcagcaaattgtcctattggtttgagctataaagttagctcatgt

SEQ ID NO: 5054 - DNA, 233 bp, Homo sapiens
  AC027396.3_175460
  Located on chromosome 3
  Distance between a terminus base of telomere on chromosomal short arm and 5'-terminus of this base sequence : 54648077
  Distance between 3'-terminus of neighbour sequence of sequence listing upward to telomere on chrosomal short arm and 5'-terminus of this base sequence : 192644
caatgtctgccataggtagaagagttggggtttcagggtcactaagtcaaccaactctagggagactatgtaaatggaacaccctgtggttgtgcagcatggaagactgtgtcatcctttgctattcattcattcattcattcattcattcattcattcattcattcatttatagagactgggtcttgctctgttgctcaggctggagtatagtggttcaatcacagtttcct

SEQ ID NO: 5055 - DNA, 143 bp, Homo sapiens
  D3S3688
  Located on chromosome 3
  Distance between a terminus base of telomere on chromosomal short arm and 5'-terminus of this base sequence : 54669941
  Distance between 3'-terminus of neighbour sequence of sequence listing upward to telomere on chrosomal short arm and 5'-terminus of this base sequence : 21631
caccactgcactccagcctgggtgacagagcaagactctgtctcaaacacacacacacacacacacacacacacacacacacacacacaccactaacagctatcattagtattcttagacccataagagataataacaaatca

SEQ ID NO: 5056 - DNA, 456 bp, Homo sapiens
  chr3.fa.O7frz.59298456
  Located on chromosome 3
  Distance between a terminus base of telomere on chromosomal short arm and 5'-terminus of this base sequence : 54749771
  Distance between 3'-terminus of neighbour sequence of sequence listing upward to telomere on chrosomal short arm and 5'-terminus of this base sequence : 79687
gtgtttgaaagtatcaaagcaggtgtagccaaggttcactcattgacagccatttctctttctttctttctctctttctttctccctctctctctctctctctttctctctctctctctctctctctctttctctctctttctttctttctttctctttctttctttctttctttctttctttctctctctctctctctctctctttctttctttctttctttcttttcttttttgagatggagtctcgctctgtcgcccaggctggagtgcagtggtgtgatcgcagctcactgcaagctccgcctcccgggttcatgccattctcctgcctcagcctcccgagtatctggcactacaggggccagccaccacacccagctaattttttgtatttttagtagagatggggtttcaccatgttagttagccaggacggtctcgatctcctgacctc

SEQ ID NO: 5057 - DNA, 378 bp, Homo sapiens
  chr3.fa.O7frz.59596281
  Located on chromosome 3
  Distance between a terminus base of telomere on chromosomal short arm and 5'-terminus of this base sequence : 54767601
  Distance between 3'-terminus of neighbour sequence of sequence listing upward to telomere on chrosomal short arm and 5'-terminus of this base sequence : 17374
gagtctgtgtcacggtcacctgtgggggctcatctgacccagccagagacaatggggccaaggcctctaagagttgctaatgatagtctttaatgaccatgcctggaaagggatgacttcacccaggacacaccctgatgagaggaggctacagtcacaggcaggcggctcctccattgctatgagacctgcatgggcttgtctagtcagaggatggcaaagctgtgtgtgtgtgtgtgtgtgtgtgtgtgtgtgtgtgtgtgtgtgtgtgtgtgtgtgtgtgtgtgtgtgtgtctggtccctcacagagccagggcctagtgaaaagcctcagggcagcagggtggggggcccagcttctaccttgcctcactctat

SEQ ID NO: 5058 - DNA, 234 bp, Homo sapiens
  AC044892.6_125864
  Located on chromosome 3
  Distance between a terminus base of telomere on chromosomal short arm and 5'-terminus of this base sequence : 54998894
  Distance between 3'-terminus of neighbour sequence of sequence listing upward to telomere on chrosomal short arm and 5'-terminus of this base sequence : 230915
gctcagtccaaactagcattacttcagataatcaaattcacaaatgaagagatatgttccaaaagaaggacaccagtctaaaaaaaaaaaaaggaaaaaggaacagctggagaaggtggagaaaaacccaagatctcaaataataataataataataataataataataataatatctgttactaggtgacaaaatcaagtctgaaaaaaccagggtccaccgaattaaaccaa

SEQ ID NO: 5059 - DNA, 223 bp, Homo sapiens
  D3S3561
  Located on chromosome 3
  Distance between a terminus base of telomere on chromosomal short arm and 5'-terminus of this base sequence : 55029819
  Distance between 3'-terminus of neighbour sequence of sequence listing upward to telomere on chrosomal short arm and 5'-terminus of this base sequence : 30691
ggtgactggaggttcaaggtctcccaggcccagggaggccctgctccgtctctgtgtgggggaggttttgtgtatatgtgtgtgtgtgtgtgtgtgtgtgtgtgtgtgtgtgcacaaagccacaaagaggcatcttcccctctggttgagtaggggaggtgcactgtggctggtcttttggccttgggctcagttccctcacaccccatcacagtccccagga

SEQ ID NO: 5060 - DNA, 110 bp, Homo sapiens
  DISD22_0002706
  Located on chromosome 3
  Distance between a terminus base of telomere on chromosomal short arm and 5'-terminus of this base sequence : 55147289
  Distance between 3'-terminus of neighbour sequence of sequence listing upward to telomere on chrosomal short arm and 5'-terminus of this base sequence : 117247
gctaacacgacagtgcatgcatacacacacacacacacacacacacacacacacagctattaactatttcttactctttgtatttttagtctccactgatgttaatagcc

SEQ ID NO: 5061 - DNA, 188 bp, Homo sapiens
  chr3.fa.O7frz.60625425
  Located on chromosome 3
  Distance between a terminus base of telomere on chromosomal short arm and 5'-terminus of this base sequence : 55369594
  Distance between 3'-terminus of neighbour sequence of sequence listing upward to telomere on chrosomal short arm and 5'-terminus of this base sequence : 222195
aaccaatgttttccttattcttagcacactgcctcccacccccaatttaaatctaatgatgtattttgtccatgttatcatgagaaaagcttacaaatctgtaatcccagtgtgtgtgtgtgtgtgtgtgtgtgtgtgtgtgtgtgtgtataatataaaatctagtattacactttaaaccaagcctt

SEQ ID NO: 5062 - DNA, 134 bp, Homo sapiens
  DISO7_10001098
  Located on chromosome 3
  Distance between a terminus base of telomere on chromosomal short arm and 5'-terminus of this base sequence : 55483087
  Distance between 3'-terminus of neighbour sequence of sequence listing upward to telomere on chrosomal short arm and 5'-terminus of this base sequence : 113305
atgaaccatgcaaggagcaaggaaaggttaataaaccaatgtgctttgaatttgttcaagtactgatatttctgtatgtcaagatttagcatatatatatatatatatataaaacagctatcatgggaagtgaa

SEQ ID NO: 5063 - DNA, 210 bp, Homo sapiens
  DISO7_10001096
  Located on chromosome 3
  Distance between a terminus base of telomere on chromosomal short arm and 5'-terminus of this base sequence : 55638883
  Distance between 3'-terminus of neighbour sequence of sequence listing upward to telomere on chrosomal short arm and 5'-terminus of this base sequence : 155662
tggtcagcctgatatttccaaactcattatagtatgaatcattatagtatgaatagacacacacacacacacacacacacacacacacacacacacacagtatttagtatagtattcagtatatattataataatatatattacctatattcaatatagtattcattatagtatgaatttttaaagattatttatgcctgagattattga

SEQ ID NO: 5064 - DNA, 329 bp, Homo sapiens
  AC006254.10_43885
  Located on chromosome 3
  Distance between a terminus base of telomere on chromosomal short arm and 5'-terminus of this base sequence : 55836888
  Distance between 3'-terminus of neighbour sequence of sequence listing upward to telomere on chrosomal short arm and 5'-terminus of this base sequence : 197795
ctttcacctatccattcacttattcattcattcattcattcattcattcattcgacacataagtattaagcccccatggtgtcctatgcagtggctacatcctcaggggcctccaggtttaatgatctcttacagagatcacttggagattcggtggggttgaggggcatgcctcagagatacgcagagacgttaacagctgtgagatctgggtcaagaggtctaacctcgctgagcctctgtgtgctgagtgtgggtaaatagcaggctgccttgtgccctggtgggcctgcccggactgttgactgactggttgatattaactcagt

SEQ ID NO: 5065 - DNA, 370 bp, Homo sapiens
  AC006254.10_65950
  Located on chromosome 3
  Distance between a terminus base of telomere on chromosomal short arm and 5'-terminus of this base sequence : 55858717
  Distance between 3'-terminus of neighbour sequence of sequence listing upward to telomere on chrosomal short arm and 5'-terminus of this base sequence : 21500
actgttaagttttaaaggccataaatcatctattgattttaatactatcccacaacttatttaatttttcaatttgaagcatattgaaaaacacacacaaaagtaaaattttcccataatgccactacttaagaatcaaacaagaagggagtgaaattctcttctctttctattcccattccctggaagatgaccattgctagcaaattggtacatggcctttctggttttttcctgtctttatacagacataactctgtgtgtgtgtgtgtgtgtgtgtgtgtgcatgtgtgtgtgtgtgcatgcgcacgcgcacacccacagattcttaaactgaaatcaggctgttcacatggtacataacttgttt

SEQ ID NO: 5066 - DNA, 254 bp, Homo sapiens
  chr3.fa.O7frz.59909531
  Located on chromosome 3
  Distance between a terminus base of telomere on chromosomal short arm and 5'-terminus of this base sequence : 56036339
  Distance between 3'-terminus of neighbour sequence of sequence listing upward to telomere on chrosomal short arm and 5'-terminus of this base sequence : 177252
ctcagaccacagtggtactagaaacagtaataaaatttcctccagtcaaaattctaaagtctgaagtttattttgcccactccccacattttatttatttatttatttatttatttatttattttgggacagagtctcactcactctgttgcccagactagagtgcagcggcgcgatcttggctcactgcaacctccacctcccgggttcaagtgattgtcctgcctcagcctcctgagtagctgagattacat

SEQ ID NO: 5067 - DNA, 379 bp, Homo sapiens
  chr3.fa.O7frz.60843882
  Located on chromosome 3
  Distance between a terminus base of telomere on chromosomal short arm and 5'-terminus of this base sequence : 56243947
  Distance between 3'-terminus of neighbour sequence of sequence listing upward to telomere on chrosomal short arm and 5'-terminus of this base sequence : 207354
gcctatcttcatttatctgtaagtcaagttttacatttaaatttggaaaacttttggccattccttccttgtataactatctattccactttcaccctccctctgggactcattttaatgtatgtgagactggtaatttttataaattcctgaggcccagttcactttctttttccttccttccttccttccttccttccttccttccttcttctctctctctctttcttttttttgagatgcagtctcattctgttgctcaggaggtctcaaacttttcttgaattttgttctttctctttttaagattggatactttttattgccctgtcttcaagtttgctaaccctttcttctgtcaagctcatacaataaattt

SEQ ID NO: 5068 - DNA, 470 bp, Homo sapiens
  AC023893.8_8534
  Located on chromosome 3
  Distance between a terminus base of telomere on chromosomal short arm and 5'-terminus of this base sequence : 56263609
  Distance between 3'-terminus of neighbour sequence of sequence listing upward to telomere on chrosomal short arm and 5'-terminus of this base sequence : 19283
agcaacatcatagaacagtcagtgttgtaaaagactagcaagtgaggctgggcacggtggctcatgcctgtaatcccagcactttgggaggccaagatgggtgggtggcttgagcccaggattttgagatcagtctgagcaacctgatgaaaccccgtctctacaaaaaatggaaaataaatcagtcaggcatggtggtgtgcgcctgtagttccagctactcaggaggctgaggctggaggatagcttgagcctgggaggtcgaggctgcagtgaaccatgatcacacgaatgcactcagcctgggcaacagagtgagaccctgactcaaaagagagagagagagagagagagagagagagaaaaaagactagcaagtgagaaaagactagggggtagactgagagactgagatgtgttgtacagtcttgagtgtcaggatggggaaactgcatttaacttggtacatc

SEQ ID NO: 5069 - DNA, 427 bp, Homo sapiens
  chr3.fa.O7frz.61286410
  Located on chromosome 3
  Distance between a terminus base of telomere on chromosomal short arm and 5'-terminus of this base sequence : 56416711
  Distance between 3'-terminus of neighbour sequence of sequence listing upward to telomere on chrosomal short arm and 5'-terminus of this base sequence : 152632
taagtagatccaaatatggttcaggaacaaagcaggccccaaactgtgtataggatatgtgggtaatgggccagaaagctcactcctctggaaaatgttggaaagtgacctctcctgagcatcccagtgacatggctggatgccctgttgagatatgagagaaggggctgggggacaaacccatggcaagggcactagctgaaggaattcatgcagaggagaggagagggcttttccactgacgtttccttgcctctattctgtgtgtgtgtgtgtgtgtgtgtgtgtgtgtgtgtgtgtgtgtgcattcctccttggaagatgagagcttctggtctcaaggggccatgccctgtttctcagcagcctcctcatctactctcttggttttcctcattctcttcgaggtaacaagtcctcacctatt

SEQ ID NO: 5070 - DNA, 414 bp, Homo sapiens
  AC024149.15_85540
  Located on chromosome 3
  Distance between a terminus base of telomere on chromosomal short arm and 5'-terminus of this base sequence : 56509019
  Distance between 3'-terminus of neighbour sequence of sequence listing upward to telomere on chrosomal short arm and 5'-terminus of this base sequence : 91881
ataggttctagctaagcaggagttttgtcctctaccaagacctttcctgaaaatcacttatcaagacagtttcctgtaagaaaaagccatatcccagctgattttccttcctggggccaaaatctgctattattcggcctgaaagccttgatgactctgtgtgtgtgtgtgtgtgtgtgtgtgtgtgtgtgtgtgtgtgtgtgtgtgtgtgtgtgtatggatgcttgtgtgtgtgtatggggaatatgtgattaatgtgtgttggctgctgttgtctctgatttggctactgttgtttctgatttaaatctaagtaaatgtttaattaaatgtatagaatgctgtctctaatgtgaccctctctccttattaaatcctcttattaacccactcctatgagaccatcttatttct

SEQ ID NO: 5071 - DNA, 154 bp, Homo sapiens
  D3S1578
  Located on chromosome 3
  Distance between a terminus base of telomere on chromosomal short arm and 5'-terminus of this base sequence : 56509131
  Distance between 3'-terminus of neighbour sequence of sequence listing upward to telomere on chrosomal short arm and 5'-terminus of this base sequence : -302
ggggccaaaatctgctattattcggcctgaaagccttgatgactctgtgtgtgtgtgtgtgtgtgtgtgtgtgtgtgtgtgtgtgtgtgtgtgtgtgtgtgtgtatggatgcttgtgtgtgtgtatggggaatatgtgattaatgtgtgttggc

SEQ ID NO: 5072 - DNA, 293 bp, Homo sapiens
  chr3.fa.O7frz.61090901
  Located on chromosome 3
  Distance between a terminus base of telomere on chromosomal short arm and 5'-terminus of this base sequence : 56622247
  Distance between 3'-terminus of neighbour sequence of sequence listing upward to telomere on chrosomal short arm and 5'-terminus of this base sequence : 112962
aaatagacagctttcaggaaattgtatttttgaaatgttcttatcaagactgaatttactaccgtaattaccaaaaatgtccttttaactaacaggcatgcttatttccttttgttatttatcacaaaataactaaccttctttaaatttttatatatataaaaaacatctatatatatacacacatacagtgtgtgtgtgtgtgtgtgtgtgtgtatatatatatatatatatatatatatatgcatactggctttgcatttttatttaagtacatgtggacttagacgttg

SEQ ID NO: 5073 - DNA, 327 bp, Homo sapiens
  chr3.fa.O7frz.61624807
  Located on chromosome 3
  Distance between a terminus base of telomere on chromosomal short arm and 5'-terminus of this base sequence : 56829022
  Distance between 3'-terminus of neighbour sequence of sequence listing upward to telomere on chrosomal short arm and 5'-terminus of this base sequence : 206482
  misc_feature (1)...(327): n = A,T,G or C
gttcaagactgcagtgatttatgattgcaccactgcactccagcctaggcaacagagtgagaccctgtctctaagaaaacacacacacacacacacacacacacacacacacacgaaactctgatcctagaggaataaagagacatggagaaatgagtttccagctcagtgcagctgtgtgtcctgaaggtggagcccaaatgcttagattcacttgtctctacagcactttttgtatctctattgacgctttatatttttgttgaccttaagcgcagatgcaacccaatattaactntcccagtcactcaacttgtctattgatct

SEQ ID NO: 5074 - DNA, 226 bp, Homo sapiens
  D3S1588
  Located on chromosome 3
  Distance between a terminus base of telomere on chromosomal short arm and 5'-terminus of this base sequence : 56942308
  Distance between 3'-terminus of neighbour sequence of sequence listing upward to telomere on chrosomal short arm and 5'-terminus of this base sequence : 112959
ctttgtgatttgatacgatggtcaaaacagaagcatgtctaatcttccatatactaaagttactccaattttactaaagttttaagagggagaactatccccagagatatttcttagcgcacacacacacacacacacacacacacacacacacaaacacttttctgtaattaggaacttgttcagatcttgtgtcctggatagagcagtccctacccaatgaggc

SEQ ID NO: 5075 - DNA, 290 bp, Homo sapiens
  AC018353.14_32347
  Located on chromosome 3
  Distance between a terminus base of telomere on chromosomal short arm and 5'-terminus of this base sequence : 57148007
  Distance between 3'-terminus of neighbour sequence of sequence listing upward to telomere on chrosomal short arm and 5'-terminus of this base sequence : 205473
atgtaggcatttacagttatgaacttcccttccagaaccacttttgttgtatcccataggttttggtatgttatgtcttcactaccttttgtctcaagatatttttattgtgtgtgcgtgtgtgtgtgtgtgtgtgtgtgtgtgtgtgtgtgtgtgtgtttgagatagggtctggctctgtcacccaggctggagtgcagtggcacaatcttggctcattgaaacctctgcctcccaggtttaagccacccttccacctcagcctcctgaatagctgaaactacaggtac

SEQ ID NO: 5076 - DNA, 213 bp, Homo sapiens
  D3S1289
  Located on chromosome 3
  Distance between a terminus base of telomere on chromosomal short arm and 5'-terminus of this base sequence : 57188231
  Distance between 3'-terminus of neighbour sequence of sequence listing upward to telomere on chrosomal short arm and 5'-terminus of this base sequence : 39934
aaagcaacttgtaagagagcattcatagaaagaataaataaatttgtttttgtacatatatatgttcatacacttattctatgtatactttttatttctatgtatacacacacacacacacacacacacacacacacacacacacacacactcatgtgaagaaggagaaaatggagcattcatatctttattgccagtgattatatctaggag

SEQ ID NO: 5077 - DNA, 339 bp, Homo sapiens
  AC068753.13_87766
  Located on chromosome 3
  Distance between a terminus base of telomere on chromosomal short arm and 5'-terminus of this base sequence : 57295891
  Distance between 3'-terminus of neighbour sequence of sequence listing upward to telomere on chrosomal short arm and 5'-terminus of this base sequence : 107447
atgctgtagtttgtaacatgtcattgaagaataccaggtaaagaatgtgtggcatttctcttattattattattattattattattttatttgtaagacacggggtcttgctgtgttgcccaggttggacttgagctcctgggctcaagtgatcctgctgtctccacctcccaaaatgctgggattacaggcgtgagccaccatgcttggcctctttattatttcacacagttacatgtggatctatgattacctcaaaataaaaagtgtaattaaaaaataatctgcagtaggtgagaaattcttgaagagaagctttatcaaattagtgtgaacggt

SEQ ID NO: 5078 - DNA, 117 bp, Homo sapiens
  D3S3666
  Located on chromosome 3
  Distance between a terminus base of telomere on chromosomal short arm and 5'-terminus of this base sequence : 57342591
  Distance between 3'-terminus of neighbour sequence of sequence listing upward to telomere on chrosomal short arm and 5'-terminus of this base sequence : 46361
gggactggtcaaagttcaaattgatgttgatacatacatatatatatatatatatatatgcacacacacacacacacacacacacacacacacacacagtgccttacagggtatttg

SEQ ID NO: 5079 - DNA, 175 bp, Homo sapiens
  D3S1582
  Located on chromosome 3
  Distance between a terminus base of telomere on chromosomal short arm and 5'-terminus of this base sequence : 57386078
  Distance between 3'-terminus of neighbour sequence of sequence listing upward to telomere on chrosomal short arm and 5'-terminus of this base sequence : 43370
ggaacagccctatggttcacacagacatctcagggatgtgtgtatgtgtgtgtgtgtgtgtgtgtgtgtgtgtgtgtgtgtgtgtgtgttaaaaagataactccacatcttcagtgaaatatcccccctggatcaccacttcttttcctgctacaggctttcatagtacctgctg

SEQ ID NO: 5080 - DNA, 332 bp, Homo sapiens
  AC073505.4_82363
  Located on chromosome 3
  Distance between a terminus base of telomere on chromosomal short arm and 5'-terminus of this base sequence : 57569424
  Distance between 3'-terminus of neighbour sequence of sequence listing upward to telomere on chrosomal short arm and 5'-terminus of this base sequence : 183171
ctaagagttacaaatccatttcatgctcattgaagctaaaagagaaaacttattggctcaggcaaccccataatggaaaaggggcattggtggaattgatcttgggaatgaaggcattcagggacaggtaccctcccgccctttccctcttttttttcctccctccctctttatctctctcttctctgtcacacacacacacacacacacacacacacacacacacacacacacgtctctcctcctctctgttgagtttattttattcagtctcatcgcctctctgtggcaaggggacacggctgtcaagctgacattcttatagccattca

SEQ ID NO: 5081 - DNA, 399 bp, Homo sapiens
  AC079032.11_78439
  Located on chromosome 3
  Distance between a terminus base of telomere on chromosomal short arm and 5'-terminus of this base sequence : 57601069
  Distance between 3'-terminus of neighbour sequence of sequence listing upward to telomere on chrosomal short arm and 5'-terminus of this base sequence : 31313
gacagtttctttcctttgaatccaatgactataataccaaagtccataagatcaaggtaggcaattcaccccaggcagagctgaagccccactctgcaagagacaaatttagaacatcatctggaaagtagatgcacacacacacacacacacacacacacacacacacacacacaaacacacatattccaaattagatcggcagcccaaggatccctctgctaaggaatgctcaagctggatttaaattgggactgagacctggcttggcagaaatgtggccaagcagaaaggttggcccagtgagctaagctggattccttgggaatgggaaatagaaacagatgaaagaggagagaagtcagaccaagggtttatctggaatatttagaagctgac

SEQ ID NO: 5082 - DNA, 366 bp, Homo sapiens
  AC073505.4_8273
  Located on chromosome 3
  Distance between a terminus base of telomere on chromosomal short arm and 5'-terminus of this base sequence : 57601102
  Distance between 3'-terminus of neighbour sequence of sequence listing upward to telomere on chrosomal short arm and 5'-terminus of this base sequence : -366
ataccaaagtccataagatcaaggtaggcaattcaccccaggcagagctgaagccccactctgcaagagacaaatttagaacatcatctggaaagtagatgcacacacacacacacacacacacacacacacacacacacacaaacacacatattccaaattagatcggcagcccaaggatccctctgctaaggaatgctcaagctggatttaaattgggactgagacctggcttggcagaaatgtggccaagcagaaaggttggcccagtgagctaagctggattccttgggaatgggaaatagaaacagatgaaagaggagagaagtcagaccaagggtttatctggaatatttagaagctgac

SEQ ID NO: 5083 - DNA, 250 bp, Homo sapiens
  AC073505.4_58515
  Located on chromosome 3
  Distance between a terminus base of telomere on chromosomal short arm and 5'-terminus of this base sequence : 57612122
  Distance between 3'-terminus of neighbour sequence of sequence listing upward to telomere on chrosomal short arm and 5'-terminus of this base sequence : 10654
ttgcttcctagctaaggagtacgggtaggtttgagacaaaaggtagaggagagagaattataaagtatagggggatatgactagattctttggtaaatgtaagtaagaagccctttctcgtatcacggactgagttttagcagctttgggatacacacacacacacacacacacacacacacacacacacacacacacacaccattcaatgggaagacaaatccaactgctaactagtctgctatgattt

SEQ ID NO: 5084 - DNA, 194 bp, Homo sapiens
  D3S3660
  Located on chromosome 3
  Distance between a terminus base of telomere on chromosomal short arm and 5'-terminus of this base sequence : 57632332
  Distance between 3'-terminus of neighbour sequence of sequence listing upward to telomere on chrosomal short arm and 5'-terminus of this base sequence : 19960
tggcaggaagttcttcatttttcctgcaagtattactttgaaaacttttgtaagggatacaagttggcaatctgtgctcgtgtgtgtgtgtgtgtgtgtgtgtgtgtgtgtgtgtgtgtgtttctgtatcttcttttaaagtttaagtttcaaaactgctatttggtaaaaacattctgtgagtcttaaaatgc

SEQ ID NO: 5085 - DNA, 249 bp, Homo sapiens
  D3S1613
  Located on chromosome 3
  Distance between a terminus base of telomere on chromosomal short arm and 5'-terminus of this base sequence : 57667543
  Distance between 3'-terminus of neighbour sequence of sequence listing upward to telomere on chrosomal short arm and 5'-terminus of this base sequence : 35017
tgtgataaggaccaaggctgtcttcctccctccagagtctgtcagagttcttatctactgtgctccacttttcctccctccagagtctgtcagagttcttatctactgtgctccactgcctgtcaaatacacacacacacacacacacacacacacacacacacacacacacacactctgttttacataacactttttaaaaatccagataaatgtaatcatcaatatgtctcattctgcaatttgctc

SEQ ID NO: 5086 - DNA, 391 bp, Homo sapiens
  AC073505.4_24073
  Located on chromosome 3
  Distance between a terminus base of telomere on chromosomal short arm and 5'-terminus of this base sequence : 57685408
  Distance between 3'-terminus of neighbour sequence of sequence listing upward to telomere on chrosomal short arm and 5'-terminus of this base sequence : 17616
gaaatgcatatccttcagttctaggaaattttcttagattattttttaggtctttttgttttattatctgccacgttttcttttcccaacatatatctttctacttttaaattcatttgtatattttgactgttttattttaaatttcccagggtatttatttatttatttatttatttatttatttatttattttgagacggaatctcgctctgtcgcccaggctggagtgcagtggcatgatctgggctcactgcaagctctgcctcccgggttcacgccattcccctgcgtcagcctcctgagtagctgggactacaggcgcccaccaccctgcctggctaatttttttgtatttttagtagagacagggtttcaccgtgttagccag

SEQ ID NO: 5087 - DNA, 385 bp, Homo sapiens
  AC024889.15_98056
  Located on chromosome 3
  Distance between a terminus base of telomere on chromosomal short arm and 5'-terminus of this base sequence : 57740079
  Distance between 3'-terminus of neighbour sequence of sequence listing upward to telomere on chrosomal short arm and 5'-terminus of this base sequence : 54280
gtgctcattagctaaagttggtttttgttttgttttgttttgttttgttttgttttgttttgttttgttttttgagatggagtcttgctctgtcgcccaggctggagtgcagtggcgtggtctcagctcactgaaagctccgtctccagggttcacgccattctcctgcctaagcctcccgagtagctgggactacaggcacctgctaccatgcccggctaattttttatatttttagtagagacggggtttcactattttagccaggatggtctcgatctcctgacctcatgatccgcccgccttggcctcccaaagtgctgggattacaggcgtgagccaccgcgcccggccagctaaagttgtttaactaatttccagttgg

SEQ ID NO: 5088 - DNA, 197 bp, Homo sapiens
  AC024889.15_154830
  Located on chromosome 3
  Distance between a terminus base of telomere on chromosomal short arm and 5'-terminus of this base sequence : 57747929
  Distance between 3'-terminus of neighbour sequence of sequence listing upward to telomere on chrosomal short arm and 5'-terminus of this base sequence : 7465
ttcaggaaactgttaaaagttcacatccttatctgaccctaatcctggcggcccagaacactgtgattcaaggaatgatgtggaagcactcggttgaaccagagcaagagatacaccaagtctgaaatctgggtgggctgggaagagcctcagcattgttgttgttgttgttgttgttctgctcatttactttctgg

SEQ ID NO: 5089 - DNA, 201 bp, Homo sapiens
  D3S3717
  Located on chromosome 3
  Distance between a terminus base of telomere on chromosomal short arm and 5'-terminus of this base sequence : 57889202
  Distance between 3'-terminus of neighbour sequence of sequence listing upward to telomere on chrosomal short arm and 5'-terminus of this base sequence : 141076
ggtgatgcaggtttcatgattatatatatatgtgtgtgtgtgtgtgtgtgtgtgtgtgtataatttttacatcctgtctttaaatatttttattaggttttatctaatatgaaatgcttctcctatcaattagggtacttaaaagattcattttccatccacatggttcttcattatttacaattctctatgacttgagct

SEQ ID NO: 5090 - DNA, 222 bp, Homo sapiens
  AC027002.3_176037
  Located on chromosome 3
  Distance between a terminus base of telomere on chromosomal short arm and 5'-terminus of this base sequence : 57927364
  Distance between 3'-terminus of neighbour sequence of sequence listing upward to telomere on chrosomal short arm and 5'-terminus of this base sequence : 37961
ctggtacggaagactagataaactgcataagatgaaaacataattctgaccacagtcaacagaatgagagtcatacagtaaagttctaaagaaacttcatggaaagaactatttctatgttgtgtgtgtgtgtgtgtgtgtgtgtgtgtgtgtgtgtgtgtgtgtgtgtgttgtgctgtctgtccatctttaacaggaaaatggaattgagtgatagttcag

SEQ ID NO: 5091 - DNA, 372 bp, Homo sapiens
  AC027002.3_102044
  Located on chromosome 3
  Distance between a terminus base of telomere on chromosomal short arm and 5'-terminus of this base sequence : 57963346
  Distance between 3'-terminus of neighbour sequence of sequence listing upward to telomere on chrosomal short arm and 5'-terminus of this base sequence : 35760
gtttatcaacatttgtaattgctctttgaagcatttttattatgactgctttaaaatccttgtgagataattctaatatctctgtcatattcatatctctatctattgattgtctttcttcattacagttgagattttctcagttcttagtatgctgaataatattttattgaaacaaggtcatttttggtattatgattctgaactttatttaaaccttctgttttagctgtgtgtgtgtgtgtgtgtgtttgtgtgtgtgtgtgtgtgatgccacttcagcagaggtacaaagggactgtcttcttagtgcaaggttgggtaggcatcaagatttcccacttagcctctgttgtcacctgaggaagtaaa

SEQ ID NO: 5092 - DNA, 313 bp, Homo sapiens
  chr3.fa.O7frz.63301546
  Located on chromosome 3
  Distance between a terminus base of telomere on chromosomal short arm and 5'-terminus of this base sequence : 58176723
  Distance between 3'-terminus of neighbour sequence of sequence listing upward to telomere on chrosomal short arm and 5'-terminus of this base sequence : 213005
gagtagctctttccggaaggaggggaaaacggtgttaccagggtcctacaccctagaacgacccatctagcacagaaaacagtttgcaacgtgctatcatgtgtgattttaattttgggctataggctttcatttccaaattccacaataaacacataaggtggagttctgatttcaacacacacacacacacacacacacaagcacacacacacattctctctctctccctctctcttagaatcttccagtgcattcacactgaaagccgaagtcctcccagaatcttgtgagaacctaaatgatctgaata

SEQ ID NO: 5093 - DNA, 269 bp, Homo sapiens
  D3S3719
  Located on chromosome 3
  Distance between a terminus base of telomere on chromosomal short arm and 5'-terminus of this base sequence : 58203872
  Distance between 3'-terminus of neighbour sequence of sequence listing upward to telomere on chrosomal short arm and 5'-terminus of this base sequence : 26836
tcatgcagaatctcatgggttcaaacattatatagaaactgctaggaaaatctgatgggaatttgacatcacacacacacacactcacacacacacacacacacacacacacttactcatgggttaggcctataaattttattttttttttacaacctaataatgaaaagacaattacaaaaataggcttaggatgcatacggaagaatttaggccaaaatggaaaataaactacagaaattaaatctatttaagagccagtcagggcg

SEQ ID NO: 5094 - DNA, 432 bp, Homo sapiens
  AC026326.7_132182
  Located on chromosome 3
  Distance between a terminus base of telomere on chromosomal short arm and 5'-terminus of this base sequence : 58403432
  Distance between 3'-terminus of neighbour sequence of sequence listing upward to telomere on chrosomal short arm and 5'-terminus of this base sequence : 199291
catagagaatccttggacattatgggtggaatggaacccctcaactagtttaaatgaatgaaaactgagtcacacattttgttttccacatgcggacactgagacccagggcgaaggcagggcttggaagatgttgttattcaagcaggccaggagctatttacgaggagaatgacccctcagaagtttgtgtgcgtgtgtgtgtgtgtgtgtgtgtgtgtgcgcgcgcgtgtggttttgaccaaagcagcagctgaccaaggcccaaaccaaacatccgcaatgaggaaaaataagcacaagtcttgagtgggtcccgggggtctccccagccaggttcactgccaatcactgaactccttttctttgccatcaggcaccccatccccattattcttgtccttcttctatcctgtgaggtacattctattt

SEQ ID NO: 5095 - DNA, 478 bp, Homo sapiens
  AC025572.10_111329
  Located on chromosome 3
  Distance between a terminus base of telomere on chromosomal short arm and 5'-terminus of this base sequence : 58422311
  Distance between 3'-terminus of neighbour sequence of sequence listing upward to telomere on chrosomal short arm and 5'-terminus of this base sequence : 18447
cgtggacattgacaaataaccagggatgggggccaagatcccccctcattccccagctccccatttcctggttaaaaaccactgctgacagcatctttaaaaacataattccttgtagtattatgttgtgagactgagagaaccaccaccctccttagaactttacaaaagccatataaaatatcccctgaggagaactgacttaaagaaacttcaagatagcagcctgcgcaacatagtgaaatcccatctctacggaaaaacacacacacacacacacacacacacacacacacacacacacaaagtagccaggcatggtggcacgaacctgtagtaccaactatccggaaggctgaggctgaggtgggaggattccttgagcctcggaggtcaaggctgcagtgagccctgatggtgccactgcactccagcttggccgacagaacgagaccttgactccaaaatagcaatacta

SEQ ID NO: 5096 - DNA, 239 bp, Homo sapiens
  D3S1606
  Located on chromosome 3
  Distance between a terminus base of telomere on chromosomal short arm and 5'-terminus of this base sequence : 58422478
  Distance between 3'-terminus of neighbour sequence of sequence listing upward to telomere on chrosomal short arm and 5'-terminus of this base sequence : -311
aaagccatataaaatatcccctgaggagaactgacttaaagaaacttcaagatagcagcctgcgcaacatagtgaaatcccatctctacggaaaaacacacacacacacacacacacacacacacacacacacacacaaagtagccaggcatggtggcacgaacctgtagtaccaactatccggaaggctgaggctgaggtgggaggattccttgagcctcggaggtcaaggctgcagt

SEQ ID NO: 5097 - DNA, 272 bp, Homo sapiens
  Z67483
  Located on chromosome 3
  Distance between a terminus base of telomere on chromosomal short arm and 5'-terminus of this base sequence : 58525075
  Distance between 3'-terminus of neighbour sequence of sequence listing upward to telomere on chrosomal short arm and 5'-terminus of this base sequence : 102358
cattgatttttaccatctgctgtgcaatgctaatgctctaatttacaattgattaaactcatatcctggttgttagttcctctgccattctctctctctctctctctctctctctctctgtctcacacacacacacacacacacacacacacaaaccccagaattttaattctaagtatatacttcattcttttccttattaaaaaaaaatttttttttgagatggagtttcactcttgttgcccaggctggagtgcaatggggcagtcttg

SEQ ID NO: 5098 - DNA, 462 bp, Homo sapiens
  AC021129.3_44166
  Located on chromosome 3
  Distance between a terminus base of telomere on chromosomal short arm and 5'-terminus of this base sequence : 58624716
  Distance between 3'-terminus of neighbour sequence of sequence listing upward to telomere on chrosomal short arm and 5'-terminus of this base sequence : 99369
gaagtaacacggtctaattgttctggatttatctgtaacaactccctcttgagtaaggagcattctttcggtattcctgctgcatgtgattcctggcctttttccagtatatttagtcattccctcattgtaaggaaagaaaataaaggaagaagaaaagaaaagaaagaaagagggagaaagagaaagaaacagagagaaagaaagaaagagaggagaaaaagaaaaaaggaagagaaagaaagaaagaaagaagaaagagaaaaagaaagagggacggaggaggagatgaaagtaagaagaaagagacagaaagaaagaaaaagataaagagagaaaaagagagaaagagggaagaaaagagagggagggagggaggaagaaaggaagagaagggggaaaaagaggaaatgatagtcacatggtcataatcaacccctaccttgcttctacaaatgctat

SEQ ID NO: 5099 - DNA, 205 bp, Homo sapiens
  D3S3721
  Located on chromosome 3
  Distance between a terminus base of telomere on chromosomal short arm and 5'-terminus of this base sequence : 58648456
  Distance between 3'-terminus of neighbour sequence of sequence listing upward to telomere on chrosomal short arm and 5'-terminus of this base sequence : 23278
gaaacctcctgaccatcctgtttctagatactctttttcaaacacacacacacacacacacacacacacacacacacacacacacacgagagaaccaaagggcaacatttggtctcttcctgtcaagttcctgtcctgccttctagcctgacttcccctgggacttgtatttgccttccaagtctgattgacagagcaagactgg

SEQ ID NO: 5100 - DNA, 197 bp, Homo sapiens
  D3S2371
  Located on chromosome 3
  Distance between a terminus base of telomere on chromosomal short arm and 5'-terminus of this base sequence : 58860579
  Distance between 3'-terminus of neighbour sequence of sequence listing upward to telomere on chrosomal short arm and 5'-terminus of this base sequence : 211918
atggactattgtgggaccttgagatagtataagttaatgctacttaataaactcccatcatatatgtgtgtgtgtgtgtgtgtgtgtgtgtgtgtgtgtgtgtgtgtatcctattggttctgtccttctagagaaccctaacacagatttccacaactatacagatgaacctcaagtacattatgccaagcaaaaga

SEQ ID NO: 5101 - DNA, 150 bp, Homo sapiens
  D3S3588
  Located on chromosome 3
  Distance between a terminus base of telomere on chromosomal short arm and 5'-terminus of this base sequence : 58862623
  Distance between 3'-terminus of neighbour sequence of sequence listing upward to telomere on chrosomal short arm and 5'-terminus of this base sequence : 1847
ctggcgacagagtgagactccatctcaaacacacacacacacacacacacacacacacacacacacacacacacacacacaaatttaacctggtcacatttatttgtcagagttagtgtcctaagatgtagaaaatagcaactcctgctg

SEQ ID NO: 5102 - DNA, 441 bp, Homo sapiens
  AC068374.2_59708
  Located on chromosome 3
  Distance between a terminus base of telomere on chromosomal short arm and 5'-terminus of this base sequence : 58914315
  Distance between 3'-terminus of neighbour sequence of sequence listing upward to telomere on chrosomal short arm and 5'-terminus of this base sequence : 51542
taagctagtggttctcaaccaggacaatcttgacgcccagggacatttggcagtctctgtagatatttttggtggtcacaatagggaggcaggagagtgagagtggcatctagtgggtagaatccaaggaagtctccacaacaaagaattatccagcccaaaatttcaataatcccatattgagaaaatctgaaataatttaacaaaaaaactagaagtgtatctatctatctatctatctatctatctatctatctatctatccatccaaactattttttaaaggggcaggaggagagaaggggagagattccaaaaacctacaagaccttggtgtcaagaggagtttgccaggacttagaagaggtgagaagatacagaatagctgagtgttaaagaaggaacctgagataaaaagaaggaatagttggtaggaagttc

SEQ ID NO: 5103 - DNA, 350 bp, Homo sapiens
  G08284
  Located on chromosome 3
  Distance between a terminus base of telomere on chromosomal short arm and 5'-terminus of this base sequence : 58914323
  Distance between 3'-terminus of neighbour sequence of sequence listing upward to telomere on chrosomal short arm and 5'-terminus of this base sequence : -433
tggttctcaaccaggacaatcttgacgcccagggacatttggcagtctctgtagatatttttggtggtcacaatagggaggcaggagagtgagagtggcatctagtgggtagaatccaaggaagtctccacaacaaagaattatccagcccaaaatttcaataatcccatattgagaaaatctgaaataatttaacaaaaaaactagaagtgtatctatctatctatctatctatctatctatctatctatctatccatccaaactattttttaaaggggcaggaggagagaaggggagagattccaaaaacctacaagaccttggtgtcaagaggagtttgccaggact

SEQ ID NO: 5104 - DNA, 384 bp, Homo sapiens
  AC068383.2_141770
  Located on chromosome 3
  Distance between a terminus base of telomere on chromosomal short arm and 5'-terminus of this base sequence : 59029541
  Distance between 3'-terminus of neighbour sequence of sequence listing upward to telomere on chrosomal short arm and 5'-terminus of this base sequence : 114868
cttcacagtcacatcaataagatacaagattgtccccaaaacagccacttacactcagaaaaaaagttttttttttaaccatgggacgtgtctgtgtgtgtgtgtgtgtgtgtgtgtgtgtgtatgtctgtctgtctcattataaagccacatgctggatttaagttgtctttgaattctttctcttcaaaagtactttcacataaactcttttaacactccataaaactctgccttttcctaatgtaactgcttgcctcatgtagaatctcaacttctttggacaaaaagcagacccagtccttactatctgccacccaggctttgacatctccttcactgaagaaatcagcaaggaatatgataaccaggtttcatctgatt

SEQ ID NO: 5105 - DNA, 447 bp, Homo sapiens
  chr3.fa.O7frz.63904115
  Located on chromosome 3
  Distance between a terminus base of telomere on chromosomal short arm and 5'-terminus of this base sequence : 59030731
  Distance between 3'-terminus of neighbour sequence of sequence listing upward to telomere on chrosomal short arm and 5'-terminus of this base sequence : 806
gactgtaagttcatgatggaataggtatcattgctgagccctcactacttaggcatggttaagaattttgcctgtccttataaaactaacttctgttttacaaatgagaatggggtcagggaatgtttagtaactttctcaaaatcacacagccagaaaaacacacacacacacacacacatacacacacacacacacactcacatacacaccaagccagggtttgaacccaggtctctctgacaccaggattcttatccatgcctccaaagcttttgggtcttagaatttattccagacattttcattcagtagttcccaattttccaatgatgaagacacctttccaaatgacaaaacatttcataagtcaacatatgaaaagctcagcatagaatctgatacatactgaacacccaagaaatgttaggtgagttgtcaccatag

SEQ ID NO: 5106 - DNA, 230 bp, Homo sapiens
  D3S3621
  Located on chromosome 3
  Distance between a terminus base of telomere on chromosomal short arm and 5'-terminus of this base sequence : 59112301
  Distance between 3'-terminus of neighbour sequence of sequence listing upward to telomere on chrosomal short arm and 5'-terminus of this base sequence : 81123
cagccctacagtttctgagagagaagagtgcagttggggtgggggagttggaggcagcttctctctcaatctctccctccatctgcctgtctctgtctctatcaatctcaatcactctgtctctctctctctctctctctctcacacacacacacacacacatacacacacacacacacacacacacacacacacacactcttatgtttctttttaggctcaagctcccc

SEQ ID NO: 5107 - DNA, 240 bp, Homo sapiens
  AC067759.2_103123
  Located on chromosome 3
  Distance between a terminus base of telomere on chromosomal short arm and 5'-terminus of this base sequence : 59132830
  Distance between 3'-terminus of neighbour sequence of sequence listing upward to telomere on chrosomal short arm and 5'-terminus of this base sequence : 20299
tacgatcagccaataaacatatgaaaagatgttcaatcttattagtaatcagaaaaccacatgagccatatggaagccacaacaagaaagcattttataccccactctcttatccacacacacacacacacacacacacacacacacacacacacactataataatcataatagcagcagcaaaaataaataacaatagcaagtactgacaaggatgttgatcaataagaactcctaaca

SEQ ID NO: 5108 - DNA, 220 bp, Homo sapiens
  D3S3724
  Located on chromosome 3
  Distance between a terminus base of telomere on chromosomal short arm and 5'-terminus of this base sequence : 59167898
  Distance between 3'-terminus of neighbour sequence of sequence listing upward to telomere on chrosomal short arm and 5'-terminus of this base sequence : 34828
agctgtgcaaacctagtgggagagaatcattgagggtgtgtgtgtgtttgtgtgtgagagagagagagagagtgaatgtgtgtgtgtgtgtgtgtgtgtgtgtgtgtgtgtgtttaatctcactaatttacagagcatatttttaagcattattagcagccttggggcaagttttcttttaacagcatgcataatcgtctgacaattgcccacaaggtgg

SEQ ID NO: 5109 - DNA, 331 bp, Homo sapiens
  chr3.fa.O7frz.64105923
  Located on chromosome 3
  Distance between a terminus base of telomere on chromosomal short arm and 5'-terminus of this base sequence : 59200488
  Distance between 3'-terminus of neighbour sequence of sequence listing upward to telomere on chrosomal short arm and 5'-terminus of this base sequence : 32370
ctgagtgacagagcaagaatccatctcaaaaaaggaaaaaaaaaaagaagggatggacccagactgggcagtagccctgatcaaagtcaatgttcacacagtatctaagcctgtctattattagggttgactgaaaggaaaggaaaagaatcaatgaatgttcattcataatatataccataagacacatagatacatagcatagatagatggatagatggatggagatagatagatacatagacagatagatagatagacagatagatagatagatgaagaaatagattaaatgtgttttaaatttaaatgtctggatgctatctcataa

SEQ ID NO: 5110 - DNA, 390 bp, Homo sapiens
  AC024452.2_155394
  Located on chromosome 3
  Distance between a terminus base of telomere on chromosomal short arm and 5'-terminus of this base sequence : 59495040
  Distance between 3'-terminus of neighbour sequence of sequence listing upward to telomere on chrosomal short arm and 5'-terminus of this base sequence : 294221
caagcttactattgagcttaacattcctttgaaatgtctaccttccttacatgttattaaaaatctctacttgtgttaaagagttgcagacattttttccctcaaccttatatttgtgtaagtactagctattattatttgaaagtaatgataattggtacttatacatgcgcgcacacacacacagagagagagagagagagagagagagagagagaacccaaacgtggtactgtggcttgtaatttagactttcagagttaattaaaaagggcctcaggccctcttcatttaatttccacttcctcaccttttaaaaagatctggaaatgcccaatgttttcattaggaagaaacaaatcagcagtaaccattggatgtaaactagtg

SEQ ID NO: 5111 - DNA, 325 bp, Homo sapiens
  AC024452.2_13538
  Located on chromosome 3
  Distance between a terminus base of telomere on chromosomal short arm and 5'-terminus of this base sequence : 59548511
  Distance between 3'-terminus of neighbour sequence of sequence listing upward to telomere on chrosomal short arm and 5'-terminus of this base sequence : 53081
gttgcagtgagctgagactgtgccactgcgctccagcctgggcgagagagtctgtctcaaaaaaaaaagagagagagacagagagtgagagagagactgtgtgtgtgtgtgtgtgtgtgtgtgtgtgtgtgcacgcgtgtgtgttttaattctaggacatttaattgaaaggtttctagcctgtaagtcaaagactcgcaagggttttataactctgcctggaagttttatgtcaatctgactatcccatctataaacaacagactgattaagcacatatatatgaaaataattaaattctatgtagccattaaacatgaagttg

SEQ ID NO: 5112 - DNA, 234 bp, Homo sapiens
  AC024452.2_3765
  Located on chromosome 3
  Distance between a terminus base of telomere on chromosomal short arm and 5'-terminus of this base sequence : 59578415
  Distance between 3'-terminus of neighbour sequence of sequence listing upward to telomere on chrosomal short arm and 5'-terminus of this base sequence : 29579
taggaaattccacagaaacagaaaaatgattagtggttaccaggggctagagagaagggggaatgaggactgactgctaatgagtacagggtttctttttggggtgatgaaaatattctggaattagtggtggtaattccacaactttgtggatatatttaaaatcattgaactatgtactgtatttatttatttatttatttatttatttgagatgagtctcactctgtcacc

SEQ ID NO: 5113 - DNA, 476 bp, Homo sapiens
  AC024452.2_165971
  Located on chromosome 3
  Distance between a terminus base of telomere on chromosomal short arm and 5'-terminus of this base sequence : 59626831
  Distance between 3'-terminus of neighbour sequence of sequence listing upward to telomere on chrosomal short arm and 5'-terminus of this base sequence : 48182
ttacctaaggtcaggagtctgagaccagcctggccaacatggcgaaaccgtctctactaaaaacacaaaaattagccaggtgtgatggtgggcacctgtaatcccagctactcgggaggctgaggcaggagaatcacttgaacccaggaggcgcaggtggaggtgagccacgatcacgccactgcactccagcctgggtgacagagcaagactctgtctcgaaaattaaattaaattaaattaaattaaattaaattaaaataaaatgaaataaaataaaatataaattggcaccttctctcagtctagctggtgagggaaactattattgagatgctagggctggaaataatgccatagaagttgcaccgtgtgcaccaaggtgagttacaagaagacatgtggggacaagctggcattctccatgctttgcagatcattctgcaaacatggctgctaactctgcatacaacttg

SEQ ID NO: 5114 - DNA, 210 bp, Homo sapiens
  D3S2400
  Located on chromosome 3
  Distance between a terminus base of telomere on chromosomal short arm and 5'-terminus of this base sequence : 59645540
  Distance between 3'-terminus of neighbour sequence of sequence listing upward to telomere on chrosomal short arm and 5'-terminus of this base sequence : 18233
aatgcccaatgctaactctgatctctttatttcctacaaaggaaggagctacctcctagcagatgccttgctaagtataaccacctatagcttctactcaactgatctacgttcaagatagatgctgctgctgctgctgctgctgctgctgctgctgctgctgctgctgctaatgacctattaagtacttgtttggtggaagccctttat

SEQ ID NO: 5115 - DNA, 255 bp, Homo sapiens
  AC024100.23_163993
  Located on chromosome 3
  Distance between a terminus base of telomere on chromosomal short arm and 5'-terminus of this base sequence : 59851998
  Distance between 3'-terminus of neighbour sequence of sequence listing upward to telomere on chrosomal short arm and 5'-terminus of this base sequence : 206248
ctggaattacaggcatgagccaccgcgcccggcccattaaccagttttatatctgagtttgcaatcttattccagcattcttttttccataatatttttccataattcactcactcactctcactctctctcccctcctctctctgtgtgtgtgtgtgtgtgtgtgtgtgtgtgtgtgtgtgtgtgtgttcctggatggtccttagaaccagctttctcatcctcatcctgctagttcgctcattaatgagttaa

SEQ ID NO: 5116 - DNA, 384 bp, Homo sapiens
  AC024100.23_111980
  Located on chromosome 3
  Distance between a terminus base of telomere on chromosomal short arm and 5'-terminus of this base sequence : 59855591
  Distance between 3'-terminus of neighbour sequence of sequence listing upward to telomere on chrosomal short arm and 5'-terminus of this base sequence : 3338
atgataagatcaggcagtgaggatctttgtggcacccagcaaacaggagacatgcaatcatcattttttcaatcaatcccaaagtgactggactcaaagaggtattcaaaagtctgacactagggggcaaaagagagtaaattttccgagagagagagagagagagagagagagagagagagagagagagagagagagaattttttttaacctggtctcaatttgagaccccagtagagagaaacctaaaaaatgtaagttgaatagagaggaaactaaaaaatataagttgaagctaaaattggacatttgaagattttctggcaaaattttgatgacaaattcaaggctgccctaaaagtctgaggactcctttagtctagt

SEQ ID NO: 5117 - DNA, 476 bp, Homo sapiens
  AC024100.23_113228
  Located on chromosome 3
  Distance between a terminus base of telomere on chromosomal short arm and 5'-terminus of this base sequence : 59856873
  Distance between 3'-terminus of neighbour sequence of sequence listing upward to telomere on chrosomal short arm and 5'-terminus of this base sequence : 898
aaagcacagctatgcagaccctatagcccaagcttgtgcaacctgtggcccgcaggcgggcccagtacagctttgaacgtggcccaacacaaattcggaaactttcttaaaacattattattattattattattatttttttttttttttgcaatttgcttatttgctcatcagctgtcattagtgttactgtattttatgtgtggcccaagacaattattcttcttccaatgtggctcagggaagccaaaagattgaacacccctgctctagccattacaaccctccccacctcacctacccctcaactcatttcctgggatccctaccccagcatccccacacagggcctccagccctgcagaagcacttgccaccaaacagcactgaggcctgcgatgcttggtttccactgagcagctcagcctctgatgacccagccccagggccatcttctctgacaagtctttctgacc

SEQ ID NO: 5118 - DNA, 479 bp, Homo sapiens
  chr3.fa.O7frz.65252085
  Located on chromosome 3
  Distance between a terminus base of telomere on chromosomal short arm and 5'-terminus of this base sequence : 59897617
  Distance between 3'-terminus of neighbour sequence of sequence listing upward to telomere on chrosomal short arm and 5'-terminus of this base sequence : 40268
actggctagttctaggtcagagctttaggcttttcctttcccatattggcaaaaatattctgtagacaggcaccaataaaccatcaccctttaggctgggcgcagtggctcacgcctgtaatcccagcactttgggaggccgaggcaggcggatcacgaggtcaggagatcgagaccatcctggctaacacggtgaaaacccgtctctattaaaaacacaaaaaaattagccaggcttggtggcgggcacctatattcccagctactcgggaggctgaggcaggagaatggtgtgaacccgggaggcggagcttgcagtgagccaagattgtgccactgcactccagcctgggcgacagagcaagactccgtctcaaaaaacaaaacaaaacaaaacaaaacaaaacccatcacccttcagcctgtggctaggggcagggactgggggcatcgatctctgtgctctagcactgaaggat

SEQ ID NO: 5119 - DNA, 383 bp, Homo sapiens
  AC024100.23_107979
  Located on chromosome 3
  Distance between a terminus base of telomere on chromosomal short arm and 5'-terminus of this base sequence : 59929264
  Distance between 3'-terminus of neighbour sequence of sequence listing upward to telomere on chrosomal short arm and 5'-terminus of this base sequence : 31168
aactcctgacctcgtgatccacttgcctcagcctcccaaagtgctaggattacaggcgtgagccaccacgcctggcctagatctgagattttgaagacctcaaaacatatattctattgcatgtaagtttctcttctcccagaaacaaactaaaaacacagtccaaattcatgcttttttaaattgcttttttgaaacaactgcaataaataactctaatctctgtctctcaaacacacacacacacacacacacacacacacacacattgtttgtttaaaatgagagctcctcaccccagatgagttgaggtatgaatggatttgaagtttcaaatgtagtttcccaggttgttctttaagtttagaaaacaaggttccaag

SEQ ID NO: 5120 - DNA, 336 bp, Homo sapiens
  chr3.fa.O7frz.65041976
  Located on chromosome 3
  Distance between a terminus base of telomere on chromosomal short arm and 5'-terminus of this base sequence : 60032147
  Distance between 3'-terminus of neighbour sequence of sequence listing upward to telomere on chrosomal short arm and 5'-terminus of this base sequence : 102500
ttcataccttctatggctgagtagtattccatcatatatatatatatatatatatatatatatatatatatatatataccatagtttctttatccactcattgattgatgggcatttgggctggttctgtatttttgcaattgtaaattgtgctgctataaacatacatgtttatatatgtatgtttacatgtatgtgcaagtatctttttcgtataatgacttcttttcctctgggtagatacacagtagtgggattgctggatcaaatggtagttctacttttagttctttaaggaatctccacattattttccatagtggttgtactagttta

SEQ ID NO: 5121 - DNA, 212 bp, Homo sapiens
  D3S3616
  Located on chromosome 3
  Distance between a terminus base of telomere on chromosomal short arm and 5'-terminus of this base sequence : 60137251
  Distance between 3'-terminus of neighbour sequence of sequence listing upward to telomere on chrosomal short arm and 5'-terminus of this base sequence : 104768
cccctgggaagttacatcacagatttcctagcccggttgaactttttacaggtaaaatgtgtgtgtgtgtgtgtgtgtgtgtgtgtgtgtgtgtgtgtaaaatacatgtataaatatgtaaaatatacagacacatgtaaaattttattttttgggttaactggggagatattagttgttggctgtggtcacttgagtgtctctgagttgaa

SEQ ID NO: 5122 - DNA, 412 bp, Homo sapiens
  AC069438.7_124839
  Located on chromosome 3
  Distance between a terminus base of telomere on chromosomal short arm and 5'-terminus of this base sequence : 60266303
  Distance between 3'-terminus of neighbour sequence of sequence listing upward to telomere on chrosomal short arm and 5'-terminus of this base sequence : 128840
cactacattgcttctgacctacatagtctgatgagaagtctactctaagtcttactttagttcctctttatgtaatgtatcttttttcccctctggaaattttccaatttttctctgtctttagttttcagcagtttgatgtgtccaggtgtgtatgcacgtgtgtttgtgtgtgtgtgtgtgtgtgtgtgtgcgtgttttgagatgggggtctcagtttgtcacctaggctggagtgtagtagtgcaatcatggcccactgcagccttgacctcctgggctcagcctcctgatgtagctggaactacaggcatttgtagtgcccccacctcccatcatttttaacagctgtattgatatataattcatgtaccataaaatttacccttttaaattgtacaattcggtgatt

SEQ ID NO: 5123 - DNA, 237 bp, Homo sapiens
  D3S3532
  Located on chromosome 3
  Distance between a terminus base of telomere on chromosomal short arm and 5'-terminus of this base sequence : 60398299
  Distance between 3'-terminus of neighbour sequence of sequence listing upward to telomere on chrosomal short arm and 5'-terminus of this base sequence : 131584
ccgatgtggcatggtcttcccactttttcaagaaaggtaagaaatccaaagtgtgtgtgtgtgtgtgtgtgtgcacgtgcgtgtgtgtactaattttaaaatgatggtagcaagtccaaaatctgtttaaacaaaataaaacacagtgtgaaacaagcaaaacacatctacatgacacactcaagtagcaggccactagtttatgaatccaattttatagccaccctgaaaagtagg

SEQ ID NO: 5124 - DNA, 278 bp, Homo sapiens
  chr3.fa.O7frz.65655927
  Located on chromosome 3
  Distance between a terminus base of telomere on chromosomal short arm and 5'-terminus of this base sequence : 60563119
  Distance between 3'-terminus of neighbour sequence of sequence listing upward to telomere on chrosomal short arm and 5'-terminus of this base sequence : 164583
ttatgtctttgcatcctcatagcttagctcccacttatgagtgagaacatatgatgtttggttttccattcctaagttactttagaataatggtctccaattccatctagggcgctctgaatgcctttatttcattcctttttatggctgagtagtattccacggtgtgtgtgtgtgtgtgtgtatatatatacagagagtcagagcccaaaaaggggaagatggcacccacttggagacgtggtctagtgggatagagtaacctgaatgagacagga

SEQ ID NO: 5125 - DNA, 321 bp, Homo sapiens
  chr3.fa.O7frz.65840323
  Located on chromosome 3
  Distance between a terminus base of telomere on chromosomal short arm and 5'-terminus of this base sequence : 60810817
  Distance between 3'-terminus of neighbour sequence of sequence listing upward to telomere on chrosomal short arm and 5'-terminus of this base sequence : 247420
atgacattctcaaacagttcagaaaaaaaatacgcacctgtgtgtgtgtgtgtgtgtgtgtgtgtatacacacacagagagaaagcaaatgaggcgaggtgtaaactggaaaatctgggtgaagggcaaatgtgagttccttgtgctattcttgcaactcttctgcaaatttaaaatcatatcaaagtaaaaagtttccaaaaaaaaaagtttcaaaaaaaaaaaaaagtatatgtatgccgaattaactaaagtgctcagaggagacgctgagcaaaggatccaagtccttttcttgtgttaaatcaatgcaagaacttg

SEQ ID NO: 5126 - DNA, 400 bp, Homo sapiens
  AC069254.9_23585
  Located on chromosome 3
  Distance between a terminus base of telomere on chromosomal short arm and 5'-terminus of this base sequence : 60993380
  Distance between 3'-terminus of neighbour sequence of sequence listing upward to telomere on chrosomal short arm and 5'-terminus of this base sequence : 182242
cgtgattgacattaactgagactacagttcctctcccttccctgtaggatggggagtggggccgaaagttctaagcttctgatcatgacttggtctttctgttgattagccacatcttgaaagctatccgggagcccactaagagttgcctgattagaacagaagatgctcttgtcaccaaggacattccaaggggtttaggaactctggaaccaggggcagagacctatatatataatttcttactattttatacttatgttcacacacacacacacacacacacacacccctatgcacagatgtttacagcagctttattggtaagagacaactagaaacaacccagatgttcttcagtgggcgaatggttaaactgtggtacatctataccatggaa

SEQ ID NO: 5127 - DNA, 251 bp, Homo sapiens
  AF191597.1_971
  Located on chromosome 3
  Distance between a terminus base of telomere on chromosomal short arm and 5'-terminus of this base sequence : 60995092
  Distance between 3'-terminus of neighbour sequence of sequence listing upward to telomere on chrosomal short arm and 5'-terminus of this base sequence : 1312
tactgaggcttatagctgttaaagtaacctgcccaagaggtgagccttgaaatcaaatttaaattgattgccagggacacagtgtttaatgaaataaaggatactttggatttagcaaaggtgccttgtcagttgaggtttatgtatgtatttatttatttatttatttatttattgagacagagtttcactcctgttgcccgggttggagtgcagtggcacaatcttggctcacggcaacattcacctac

SEQ ID NO: 5128 - DNA, 475 bp, Homo sapiens
  AC063936.9_94972
  Located on chromosome 3
  Distance between a terminus base of telomere on chromosomal short arm and 5'-terminus of this base sequence : 61154470
  Distance between 3'-terminus of neighbour sequence of sequence listing upward to telomere on chrosomal short arm and 5'-terminus of this base sequence : 159127
tcctgaatagctgaaattacaggtgcatataccatgcctggctaatttttttattttttaggtagagactgggtctccctgtattgcccgggctggtctcgaactcaagtgatcctgccactgagccactgcacctggcatatgtgtgtgtgtgtgtgtgtgtgtgtgtgtgtgtgtgtgtgtgtgtgtgtgtgtgtgtgcgtttatataaccagttataaagttcaggctttctaagaaagcaatctggcataaaatatcaagaatctttgaaacctcatgccccttgttgacctagtaagtataattccaagaataatctgtctcaaggaaataagtagaaactttgaaaaagaatatttttaaagtgttccagccagcgttatgtgttgtttaaattagaaaaaatcaatactaactttagtgtccatgaataggaaatatattagataaactaccatatagctaggtgatg

SEQ ID NO: 5129 - DNA, 209 bp, Homo sapiens
  HUMUT439
  Located on chromosome 3
  Distance between a terminus base of telomere on chromosomal short arm and 5'-terminus of this base sequence : 61186460
  Distance between 3'-terminus of neighbour sequence of sequence listing upward to telomere on chrosomal short arm and 5'-terminus of this base sequence : 31515
ccagccagcagaattatgagccaaataaacctacatttctttctttccctctttctttcttttctttttctttctttctttctttctttctttctttctttctttctttctttctctttctttctttctttctttctctctctctctctttctttctctctctctctttctttccttctttctttttgacagcatcttgctctgttgcc

SEQ ID NO: 5130 - DNA, 246 bp, Homo sapiens
  D3S2402
  Located on chromosome 3
  Distance between a terminus base of telomere on chromosomal short arm and 5'-terminus of this base sequence : 61187690
  Distance between 3'-terminus of neighbour sequence of sequence listing upward to telomere on chrosomal short arm and 5'-terminus of this base sequence : 1021
tggacaaagcattttataatctgtttatggagaagatgaagtaatttagacttcgaaatatcagtttggtgaagtcatagaaggttaaacaacagtggcccaattttgtttaatctgacaaaatgagactgaaagcaattttttttccttccttccttccttccttccttccttccttccttccttccttccttcctctctttctctctctttctctctttctttcatctcattatgttgcccagg

SEQ ID NO: 5131 - DNA, 297 bp, Homo sapiens
  chr3.fa.O7frz.66111548
  Located on chromosome 3
  Distance between a terminus base of telomere on chromosomal short arm and 5'-terminus of this base sequence : 61231189
  Distance between 3'-terminus of neighbour sequence of sequence listing upward to telomere on chrosomal short arm and 5'-terminus of this base sequence : 43253
ggaacttacctttagtccagaggtgaacctagaaagagaaagggctcagacagttccagatacccgcaggaaacctccacaagccagtctgcacttgggctccacactcagcagtggtgaagccaggccagggagccaactccacactcacttgaggctgtcgttggaattcacacatctcagcctacacacacacacacacacacacacacacacacacacacacacacccctctgccagggtaaaagcatcatcccccagagttaatatttgtaaagttcttagaccagtctggt

SEQ ID NO: 5132 - DNA, 412 bp, Homo sapiens
  AC016137.13_138639
  Located on chromosome 3
  Distance between a terminus base of telomere on chromosomal short arm and 5'-terminus of this base sequence : 61404583
  Distance between 3'-terminus of neighbour sequence of sequence listing upward to telomere on chrosomal short arm and 5'-terminus of this base sequence : 173097
gtagttagaacgaattcagatcatgaatgtgtcttgtttaatagagtgcccagcaggtgctctataaatgttgaatgctgtggtggctgttattcctagttccaccctcatctatctcccaactgttgaggaacacacacacacacacacacacacacacacacacacacacacactcctatcttaaacaggtagtgctcaaaatctggccttgcatttgggtggctcttttctccatggttttcaaagcaccttgatatctgtttcctcctttaagcctcataaaaccttgtggagtgggaagactggaattattggtcccattttaaaatttttatagatttaggggccatttttagaaagaaggaaacaggtgcacaaagtcacaagatatgcctgtaaagattcattg

SEQ ID NO: 5133 - DNA, 276 bp, Homo sapiens
  D3S2424
  Located on chromosome 3
  Distance between a terminus base of telomere on chromosomal short arm and 5'-terminus of this base sequence : 61521973
  Distance between 3'-terminus of neighbour sequence of sequence listing upward to telomere on chrosomal short arm and 5'-terminus of this base sequence : 116978
aacctaccactggcacttcaaaatagtgacaactaactgtaggtgataaatagagatattggcaacaactgtaatgttaggaaaacatctgtgatttctattaacaaagtgtattagattagtcagggctcgccacaggaacaaaatctatctatctatctatctatctatctatctatctatctatctatctatcatctatctatctatctttattaagatgcaatcatgggagccaagaaatcccacgatctgctatctgcaagctgaagaacc

SEQ ID NO: 5134 - DNA, 272 bp, Homo sapiens
  AC016137.13_76271
  Located on chromosome 3
  Distance between a terminus base of telomere on chromosomal short arm and 5'-terminus of this base sequence : 61521977
  Distance between 3'-terminus of neighbour sequence of sequence listing upward to telomere on chrosomal short arm and 5'-terminus of this base sequence : -272
taccactggcacttcaaaatagtgacaactaactgtaggtgataaatagagatattggcaacaactgtaatgttaggaaaacatctgtgatttctattaacaaagtgtattagattagtcagggctcgccacaggaacaaaatctatctatctatctatctatctatctatctatctatctatctatctatcatctatctatctatctttattaagatgcaatcatgggagccaagaaatcccacgatctgctatctgcaagctgaagaacc

SEQ ID NO: 5135 - DNA, 156 bp, Homo sapiens
  D3S2452
  Located on chromosome 3
  Distance between a terminus base of telomere on chromosomal short arm and 5'-terminus of this base sequence : 61522084
  Distance between 3'-terminus of neighbour sequence of sequence listing upward to telomere on chrosomal short arm and 5'-terminus of this base sequence : -165
tattagattagtcagggctcgccacaggaacaaaatctatctatctatctatctatctatctatctatctatctatctatctatcatctatctatctatctttattaagatgcaatcatgggagccaagaaatcccacgatctgctatctgcaagc

SEQ ID NO: 5136 - DNA, 476 bp, Homo sapiens
  AC064830.1_84055
  Located on chromosome 3
  Distance between a terminus base of telomere on chromosomal short arm and 5'-terminus of this base sequence : 61638568
  Distance between 3'-terminus of neighbour sequence of sequence listing upward to telomere on chrosomal short arm and 5'-terminus of this base sequence : 116328
actggttaacatttaggatgaagattttcattttccatggtgtccaggtgtatacctactcacttgctcatgccctccctcaactcaaatactgaaaaaactcctgcccttgacaggcgtgtgttgaataacactggggtggggtggggtgggggtggggagtaagtgagagagagagagagagagagagaaagtgagagagagtaagttcctgccttagaggaacttggtgaacagccagacaggtcatcagtaaatgagctttcagccagacccgtgggttctaaatgtggagcatcagggccctcaaaagagcaggtgtgaaatctgtgggaatgagattatgaaagaagaggtaatgaatcttttcctagttgaagccaacaagagaaatgataaaaacaacaactgatgcctttggtttcataatcaaatcattacgatttagtgcaaaaatctggataacaggaaacagt

SEQ ID NO: 5137 - DNA, 367 bp, Homo sapiens
  AC021025.9_115491
  Located on chromosome 3
  Distance between a terminus base of telomere on chromosomal short arm and 5'-terminus of this base sequence : 61744685
  Distance between 3'-terminus of neighbour sequence of sequence listing upward to telomere on chrosomal short arm and 5'-terminus of this base sequence : 105641
acagatactgatccaggaagtcattttcactagtctatggtgaaaatgtcagcctccattcctaaattaagaccttcctactttgtgcctcgtgtgtgtgtgtgtgtgtgtgtatgtatgtgtgtgtgtctgtgtaaatgtcctttcatttaatgaaacaatcagaataactgaagtttttcttgtttgtgtgttttaatcttctgatttgacaaatttatatgtcggcaacctatggtagtcaaatttttcttaacctgacaggtctgtgaaatccaagaacctcaccaaatggctctctcaagtaaggggcaagtgctccagactctcctcttactgctaagtaagctcattagtgaagttacca

SEQ ID NO: 5138 - DNA, 424 bp, Homo sapiens
  AC022226.17_8978
  Located on chromosome 3
  Distance between a terminus base of telomere on chromosomal short arm and 5'-terminus of this base sequence : 61800546
  Distance between 3'-terminus of neighbour sequence of sequence listing upward to telomere on chrosomal short arm and 5'-terminus of this base sequence : 55494
tacttattaaagctcagtatggctgactccttccctggagtggctaacatgccagtctactgcttgccccaaccaggatctcaaactcaggccagctgtgatgttggccttttctattcatataccaccaacattgctaaggtttcaacacaggcagagtcatggggtatttccactgtgctccaaatcaagtcagctcgctctggcaatggagctgctgattttcattgactgtactgacagagctggggaaaaaaaggagggactgcagcagccccagacaaagttgccacaggctttcatacttcttctcaaggttcagtagtttgtgtgtgtgtgtgtgtgtgtgtgtgtgtgtgtgtgtgtgtgtgtgtgtgttttaataaatgcttcctaatttgttgtaagagttgatgtccatagt

SEQ ID NO: 5139 - DNA, 200 bp, Homo sapiens
  G10059
  Located on chromosome 3
  Distance between a terminus base of telomere on chromosomal short arm and 5'-terminus of this base sequence : 61833589
  Distance between 3'-terminus of neighbour sequence of sequence listing upward to telomere on chrosomal short arm and 5'-terminus of this base sequence : 32619
caggccttcagactcaacctggaactatctattggttcttctgacttttcagcttgccagactgtaggtcatgggacttctcagcctccatgaccacatgagccaattctgtataataaatctatctatctatctatctatctatctatctatctatctatctatctattgtttctgttgctctggagagcccagattaa

SEQ ID NO: 5140 - DNA, 213 bp, Homo sapiens
  D3S1766
  Located on chromosome 3
  Distance between a terminus base of telomere on chromosomal short arm and 5'-terminus of this base sequence : 61833681
  Distance between 3'-terminus of neighbour sequence of sequence listing upward to telomere on chrosomal short arm and 5'-terminus of this base sequence : -108
accacatgagccaattctgtataataaatctatctatctatctatctatctatctatctatctatctatctatctattgtttctgttgctctggagagcccagattaatataattactaatttcatgttaaattgctttggtataaatgaagcagaaaaaaaaaagtgtttacttacaatattcccttctaggtaacaacaccataattgggt

SEQ ID NO: 5141 - DNA, 193 bp, Homo sapiens
  DISO7_10001100
  Located on chromosome 3
  Distance between a terminus base of telomere on chromosomal short arm and 5'-terminus of this base sequence : 62046213
  Distance between 3'-terminus of neighbour sequence of sequence listing upward to telomere on chrosomal short arm and 5'-terminus of this base sequence : 212319
gaataggaagccaaatgtgctggctggggcagtaatagtgagttttttcctccttctcttcctccttcctttcttccttcttctctttcttttcttcctccttttcttctttctatgtgtgtgtgtgtgtgtggtgttttatttatttatttatttatttatttatttatttactttggttacatgaccttgc

SEQ ID NO: 5142 - DNA, 240 bp, Homo sapiens
  D3S1313
  Located on chromosome 3
  Distance between a terminus base of telomere on chromosomal short arm and 5'-terminus of this base sequence : 62075031
  Distance between 3'-terminus of neighbour sequence of sequence listing upward to telomere on chrosomal short arm and 5'-terminus of this base sequence : 28625
ccatgaataagccttgccatgatatctgtggccatcctacttccaattagtttctatgtccttctctatttaaatcaggcactggctgtgtgtgtgtgtgcgcgcgcgcgcgcctgtgtgtgtgtgtgtgtgtgtgtgtgtgtgtgtgtctttttgtcaatctataactggaatgttgcaaattgggtcaagagtgggctagaaataaaatccatacaacctcagtgattttccaagggg

SEQ ID NO: 5143 - DNA, 411 bp, Homo sapiens
  chr3.fa.O7frz.67656613
  Located on chromosome 3
  Distance between a terminus base of telomere on chromosomal short arm and 5'-terminus of this base sequence : 62293720
  Distance between 3'-terminus of neighbour sequence of sequence listing upward to telomere on chrosomal short arm and 5'-terminus of this base sequence : 218449
gtaaagatgcctaggtccttaaagatagtttgcaaatttcatgtagcaaataaggatggatggagaattttaaagggttctgcttgactacatggtttatttcattatgttttagtattaagcctgaataattggaaaacatgttcatagatttgtttgttattttggggagattaagtaagattttgtggtgaggtcaggttccacagtcagcagggaagttaactgcagttatatatatatggggaaaaaaaaaatacacacacacacacacacacacacacacacacagcaaaactaatcagaattaaacttgtaatacatttttcagttttctgatttccgttattatccatgagtgtgtatttatgtgagcagtggaatctctttaaatcacttggtatagcgatc

SEQ ID NO: 5144 - DNA, 452 bp, Homo sapiens
  chr3.fa.O7frz.67788896
  Located on chromosome 3
  Distance between a terminus base of telomere on chromosomal short arm and 5'-terminus of this base sequence : 62326516
  Distance between 3'-terminus of neighbour sequence of sequence listing upward to telomere on chrosomal short arm and 5'-terminus of this base sequence : 32385
ctactctggagttcttgtctatgttgtttttgcccatcctagtgttatagactgaattgtgtctccccaaaattctgatgttgaaactctaccgcacaatgtgacttttgaagatcgggccttcagagaggtaattaagatcaaatgaagttataagtgcagggtcctaatctgaaaacaaaacaaaacaaaacaaaacaaaacaaaacagaacaacaacaacaacaacaacaaaactgacattcttataagaagaggaagggacaccggagctctctctctaccatgtgaggacattgtgaggagctggctgtctgcaacccaggaagagagacctcaccaggaaccaaccctgacaataccttgatcttgcacttccattctccagaagagtgagaaaataaatttctgttgtttaagccacccagtctgtgatagtttggtaaggcaac

SEQ ID NO: 5145 - DNA, 327 bp, Homo sapiens
  HUMUT1458
  Located on chromosome 3
  Distance between a terminus base of telomere on chromosomal short arm and 5'-terminus of this base sequence : 62428970
  Distance between 3'-terminus of neighbour sequence of sequence listing upward to telomere on chrosomal short arm and 5'-terminus of this base sequence : 102002
tcaaatcaggcttacaaggcgtgcttggtttcttatttgctgattacgtcgtgttctgttttttcctcccttggtattttcatgatggtattgttttgagaacaagactttggggtcaactagttggctgttcctgttggtatctgggtaaaagtaatcctggccagcgttggttttttgttgttgttgtttctttctttctttctttctttctttctttctttctttctttctttctttctttctttctttctttctttctttctttcttttctttctttcttcctttttttttttttctcctgtactctcattctagcccccttt

SEQ ID NO: 5146 - DNA, 220 bp, Homo sapiens
  D3S3722
  Located on chromosome 3
  Distance between a terminus base of telomere on chromosomal short arm and 5'-terminus of this base sequence : 62466001
  Distance between 3'-terminus of neighbour sequence of sequence listing upward to telomere on chrosomal short arm and 5'-terminus of this base sequence : 36704
gacaggctggaggtttcctgcagtcagtttaccgggagaacgttttcagagtggggtctgtggaatgttattggctaccacatgtacataggcatacgtgcgctctctctccctctttttctttctctttttttctctctctctctctcactctgtcacacacacacacacacacacacacacacacacagtcacactgctacaaccaggatacaaaatg

SEQ ID NO: 5147 - DNA, 299 bp, Homo sapiens
  D3S3577
  Located on chromosome 3
  Distance between a terminus base of telomere on chromosomal short arm and 5'-terminus of this base sequence : 62581159
  Distance between 3'-terminus of neighbour sequence of sequence listing upward to telomere on chrosomal short arm and 5'-terminus of this base sequence : 114938
gccatccctgactgactctaagtacagaataaaaaagaattcatgaaaaaacaaataaataacttagggtgccttttcccatctgagattctaaagcaaacaaaagtcctggcttcttaggtcagtggtagatttgccaaagcaaaataaatgtctgaatctcctctggttcctgtttctcctaagcatgtgtgtgtgtgtgtgtgtgtgtgtgtgtgtgtgtgtgtgtgtgtgtaaggaagacagagacagacagatgggggctggggaggctggatggagggaatgtggcttcagct

SEQ ID NO: 5148 - DNA, 437 bp, Homo sapiens
  AC020643.4_158871
  Located on chromosome 3
  Distance between a terminus base of telomere on chromosomal short arm and 5'-terminus of this base sequence : 62631220
  Distance between 3'-terminus of neighbour sequence of sequence listing upward to telomere on chrosomal short arm and 5'-terminus of this base sequence : 49762
ctttagctgcaagatttaaactttatcttaattttaacttaagtatttatcttaggcagggtgtggtgtctcacaccagtaatctcagcactttgggaggctgaggcaggtagatcacttgagctcaggagtttgagaccagcttgggcaacatggtgaaagcccatctctacaaaataatatacaaattatccaggtgtggtggcatgcacctgtagtcctagctgcttacaggggctgaggtggcaggattgtttgaacctgggaggtcaaggctgcagtgagccaagatcacaccactgcactccagcctgggcaacagagcaagaccctgtgtcaaaaatagatagatagatagatagatagatagatagatagatagatagatagataatttaaagatttgcatatctatttaactacagataggatctggc

SEQ ID NO: 5149 - DNA, 112 bp, Homo sapiens
  DISO7_10001105
  Located on chromosome 3
  Distance between a terminus base of telomere on chromosomal short arm and 5'-terminus of this base sequence : 62729162
  Distance between 3'-terminus of neighbour sequence of sequence listing upward to telomere on chrosomal short arm and 5'-terminus of this base sequence : 97505
cagagatgtaaggcaactgcaaacacacacacacacacacacagctttggcacagtgaaaaattaaaatgcaatgccaggcttgggactattttgaagcctcaggctaggaa

SEQ ID NO: 5150 - DNA, 118 bp, Homo sapiens
  DISO7_10001104
  Located on chromosome 3
  Distance between a terminus base of telomere on chromosomal short arm and 5'-terminus of this base sequence : 62751708
  Distance between 3'-terminus of neighbour sequence of sequence listing upward to telomere on chrosomal short arm and 5'-terminus of this base sequence : 22434
agagccagtagcctaaatgtgaaatttctcatgcataccagaagcacaaggggcaaaacacacacacacacacacacacacacacacacacacacacactcacgtcaaaggcttctcc

SEQ ID NO: 5151 - DNA, 388 bp, Homo sapiens
  AC023562.3_9461
  Located on chromosome 3
  Distance between a terminus base of telomere on chromosomal short arm and 5'-terminus of this base sequence : 62778031
  Distance between 3'-terminus of neighbour sequence of sequence listing upward to telomere on chrosomal short arm and 5'-terminus of this base sequence : 26205
acgtgactcaataaacagctagataagtcattgttcctgcatggcctatggttaggctatgaagggggtaactgaggtacaagagttaatggtggtttggtgatggtagcagggtgtgggatgctaggagatgccaaatcagtgggctggtgtgctcacaaatgacctgatgtcatagttgtctgtcactgacaattctaaaaggacggattcatccgactgccctctatgtaaaaaaatttacacatacacacacacacacacacacacacacacacccgacggtgaattattcagggaggagaaagcctgctatccttggcaaattaaacaaggaggatttgagcaaagaaaagatgtgctgctgttatttcaaggaagtattcac

SEQ ID NO: 5152 - DNA, 193 bp, Homo sapiens
  Z67450
  Located on chromosome 3
  Distance between a terminus base of telomere on chromosomal short arm and 5'-terminus of this base sequence : 62778160
  Distance between 3'-terminus of neighbour sequence of sequence listing upward to telomere on chrosomal short arm and 5'-terminus of this base sequence : -259
gatgccaaatcagtgggctggtgtgctcacaaatgacctgatgtcatagttgtctgtcactgacaattctaaaaggacggattcatccgactgccctctatgtaaaaaaatttacacatacacacacacacacacacacacacacacacccgacggtgaattattcagggaggagaaagcctgctatccttgg

SEQ ID NO: 5153 - DNA, 158 bp, Homo sapiens
  DISO7_10001106
  Located on chromosome 3
  Distance between a terminus base of telomere on chromosomal short arm and 5'-terminus of this base sequence : 62792986
  Distance between 3'-terminus of neighbour sequence of sequence listing upward to telomere on chrosomal short arm and 5'-terminus of this base sequence : 14633
tgtgattcctttacaagtacacagtttgttaagttttatacttttttaagaagtagaggttttttgtttttgtttttttaaccaatggtactctgtgtgtgtgtgtgtgtgtgtgtgtgtgtgtgtgtatcctaccaaattccttagttaataagcaa

SEQ ID NO: 5154 - DNA, 107 bp, Homo sapiens
  DISO7_10001103
  Located on chromosome 3
  Distance between a terminus base of telomere on chromosomal short arm and 5'-terminus of this base sequence : 62836039
  Distance between 3'-terminus of neighbour sequence of sequence listing upward to telomere on chrosomal short arm and 5'-terminus of this base sequence : 42895
ttgatacttctcaaatcatccatagtaaagggcgtgtgtgtgtgtgtgtctgcgtgtgtgtgtgtgtgtgtgtgtatttaacctctatttacggcagtctgattcat

SEQ ID NO: 5155 - DNA, 135 bp, Homo sapiens
  DISD22_0002716
  Located on chromosome 3
  Distance between a terminus base of telomere on chromosomal short arm and 5'-terminus of this base sequence : 62974719
  Distance between 3'-terminus of neighbour sequence of sequence listing upward to telomere on chrosomal short arm and 5'-terminus of this base sequence : 138573
aaccttcattgttctctgggattttatgtgtgtgtgtgtgtgtgtgtgtgtgtgtgtgtgtgtgtgtgtgtgtgtgtgtgtgtgtgtgtgtgtgtatggtggttttcttataaccaccatattctacaaacgagt

SEQ ID NO: 5156 - DNA, 182 bp, Homo sapiens
  chr3.fa.O7frz.69739909
  Located on chromosome 3
  Distance between a terminus base of telomere on chromosomal short arm and 5'-terminus of this base sequence : 63276764
  Distance between 3'-terminus of neighbour sequence of sequence listing upward to telomere on chrosomal short arm and 5'-terminus of this base sequence : 301910
cttaagtctcctttaacctcaaacattactttgtctttctgttttcttttttaacagtacacctccatgccccaaacccctctaccccaacgtgtgtgtgtgtgtgtgtgtttcattttgtttaaatagaactattcctcatttgggggttctctgctgtgtccttgagtttagattcaggt

SEQ ID NO: 5157 - DNA, 365 bp, Homo sapiens
  AF020503.1_32337
  Located on chromosome 3
  Distance between a terminus base of telomere on chromosomal short arm and 5'-terminus of this base sequence : 63383740
  Distance between 3'-terminus of neighbour sequence of sequence listing upward to telomere on chrosomal short arm and 5'-terminus of this base sequence : 106794
gactaaactgtatttagatggcagaatgcactaaaacctcgctttatgtctcaaactaaaactgcaaaagtcagaaatcaaaaaggcttcagagaagctttttgtctactcatttttagttttaaaaatatgtattaacattaattttacataattatgtcatgctatattcatacattaaatattaatacatatacaaacctatatatatgtatctgaatgtatatatatatatatatatatatatatatatatatgtgtatacacacacaccacagacgattagacagcccttaccaaggtatttttcttgcttttcttaaatggtattgaacctaactcttcctacagttaactgaaagtca

SEQ ID NO: 5158 - DNA, 344 bp, Homo sapiens
  U66722.1_100403
  Located on chromosome 3
  Distance between a terminus base of telomere on chromosomal short arm and 5'-terminus of this base sequence : 63618279
  Distance between 3'-terminus of neighbour sequence of sequence listing upward to telomere on chrosomal short arm and 5'-terminus of this base sequence : 234174
gtgcctgtaatcctagctactcaggaggctgaggcaggagaattgcttgaacctgggaggcagaggttgcagtgagccaagatcacagcattgcactccagcctgggcaacagagtgaaagttcatctcaaacaaaacaaaacaaaacaaaacaaaacaaaacaaaacaaaaccttactctagcacattgcgattccccagttcccatgcacacaccctaaactgaaactcttcaagcttgctattcacaagacccacccacttaaaaatagaccgcaacaatagccttcttattgcctcattctttcacacacaccacagatcaccagaaatttaatatgaca

SEQ ID NO: 5159 - DNA, 435 bp, Homo sapiens
  U47016.1_467
  Located on chromosome 3
  Distance between a terminus base of telomere on chromosomal short arm and 5'-terminus of this base sequence : 63914143
  Distance between 3'-terminus of neighbour sequence of sequence listing upward to telomere on chrosomal short arm and 5'-terminus of this base sequence : 295520
gacaactgttccactgttctactccttgctttttctcactaaagaatatatcttgtattctagatattatattagatctatatacatattctaaatagagagatgatagattagacagataaatgcaaagaggaaggaagggaaggaaaaatggatggatggatggatggatggatggatggatggatggatggatactacacttcattgatttaaagataaaacagttttccacattttaacatttctgaaataggctgtcttatacttgacagcattttagatttgctaaaatgcagtagatagatatatagctatttatggatggattgacagttcacacatagctctgccacttgagaagtagtgcaggatagtagttaagagtatattaacacattgcttattaatgagatactttcgtacttgaggaat

SEQ ID NO: 5160 - DNA, 217 bp, Homo sapiens
  AC016965.11_62729
  Located on chromosome 3
  Distance between a terminus base of telomere on chromosomal short arm and 5'-terminus of this base sequence : 63917344
  Distance between 3'-terminus of neighbour sequence of sequence listing upward to telomere on chrosomal short arm and 5'-terminus of this base sequence : 2766
attaagacagattctggcataaagaaattgcagtagtagtagtagtagtagtagtagtagttagtgctgaataccgtatctattttctttcatcagaatctgctggttccatttcatagttcagaggtctcacaaattcaggcaatattcacagctgtggacatagtaacttaggcatattttgcattattaaacgattgatgctatctttaaattt

SEQ ID NO: 5161 - DNA, 277 bp, Homo sapiens
  D3S3631
  Located on chromosome 3
  Distance between a terminus base of telomere on chromosomal short arm and 5'-terminus of this base sequence : 64043476
  Distance between 3'-terminus of neighbour sequence of sequence listing upward to telomere on chrosomal short arm and 5'-terminus of this base sequence : 125915
catgatgatgaaaatgatggtggtggtagtggtggtggaagggtgtgtgtgtgtgtgtgtgtgtgtgtgcatgcaaagaatttaaatggaactctctcagtggcgaataagtattctatagaatgcagaaataaaaatccatgtttggtaaatgggtaacacacaaaagggtatcattaaatgcgactttttgtggtgccaacttaatccttattgtcctttatagccagttaaaggaaaaatatatttgaaaaatgtctggaggctgttccctgcc

SEQ ID NO: 5162 - DNA, 422 bp, Homo sapiens
  chr3.fa.O7frz.70590149
  Located on chromosome 3
  Distance between a terminus base of telomere on chromosomal short arm and 5'-terminus of this base sequence : 64270755
  Distance between 3'-terminus of neighbour sequence of sequence listing upward to telomere on chrosomal short arm and 5'-terminus of this base sequence : 227002
agataggtggattaactgaggtcaggagttcaagaccagcctagctaacacggtgaaaccccatctctactaaaagtacaaaaatttagccaggcgtggtggcaggcacctgtaatcccagctactcaggaggctgaggcaggagaattgctttgaactcgggaggcggaggttgcagtgagctgagatcgcgccactgcactccagcctgggcgacagagtgagactctgtctcacacacacacatacacacacacacacacacacacacacacacaaagaggtcaagggaggtagagctcaagaaagagaaagtgcttagtggggcccaatattaccaagggtagggggttggctcataagcctcagaaagtggtgggcactgggattcaggcagtgtctatttctaaagcaagagatcc

SEQ ID NO: 5163 - DNA, 409 bp, Homo sapiens
  chr3.fa.O7frz.70945726
  Located on chromosome 3
  Distance between a terminus base of telomere on chromosomal short arm and 5'-terminus of this base sequence : 64359422
  Distance between 3'-terminus of neighbour sequence of sequence listing upward to telomere on chrosomal short arm and 5'-terminus of this base sequence : 88245
tagcctattgctcctaggttacagacctgtaaagcatgttactgtcctaaatgctgtaagtaattataacacgatgataagtatttgtgtatctaaacatctaaacatataaaaggtatggtaaaaatatagtattataatattatggaaccatggtcctatttgcagtccatcattgactgaaatgacattatgtggcacacaaccatacttgttgaataaactaatacaagcagattctatcatctttgtgtacatctttgtgtaaatctaaaaatgtgtgtgtgtgtgtgtgtgtgtgtgtgtgtgtgtgtttgtgtgtgtcctggctatccaaaatgcgagcaagtcagaacccaaaagttcttgttccagagtatagatatctagacaatagtcaggaatagcc

SEQ ID NO: 5164 - DNA, 303 bp, Homo sapiens
  AC073064.1_130092
  Located on chromosome 3
  Distance between a terminus base of telomere on chromosomal short arm and 5'-terminus of this base sequence : 64390192
  Distance between 3'-terminus of neighbour sequence of sequence listing upward to telomere on chrosomal short arm and 5'-terminus of this base sequence : 30361
ggttctaaatggtcaagtgttagtggttttggaagcatgtacgttaatacttggaacaccgtatacaacaatcccatatctaacacttagaacagcatatgcaatcaataacaacacacacacacacacacacacacacacacacacacacacacacacacacacacacaaaccctagacttctttctttactaaatatttctagtccaggttgcagcaggtggacacaggccggcagccatgaacgcaggtccacatgggagttgtagttccgagtcaagcggctgctctacagaacggcta

SEQ ID NO: 5165 - DNA, 349 bp, Homo sapiens
  AC019113.6_128555
  Located on chromosome 3
  Distance between a terminus base of telomere on chromosomal short arm and 5'-terminus of this base sequence : 64426018
  Distance between 3'-terminus of neighbour sequence of sequence listing upward to telomere on chrosomal short arm and 5'-terminus of this base sequence : 35523
gagctagatccttctagttctgagacttctagcctcagaactatgatacaataaatgtctgtggttacagccacctagactaaggaatttcattgggacagccctatccaactaatacacaattctctcatcacagaattgtgaaaagaaaagattggaaacaaccaaataaccattaatggggaactggttaagtaaattaaaggtataatgaatttatatatgtatgtgtttgtgtgtgtgtgtgtgtgtgtgtgtgtacatatatattcatttattgaataccatacatcattttaaaaagaaaatgctttttgaattaatatagaaatagctccaagatggatag

SEQ ID NO: 5166 - DNA, 376 bp, Homo sapiens
  chr3.fa.O7frz.70864198
  Located on chromosome 3
  Distance between a terminus base of telomere on chromosomal short arm and 5'-terminus of this base sequence : 64444594
  Distance between 3'-terminus of neighbour sequence of sequence listing upward to telomere on chrosomal short arm and 5'-terminus of this base sequence : 18227
gaggttatggaagtaatttgagaggtctcagcagaccaaatgcaaatatacttctgttcaaaaaataaatatgtatgtgaagagcttctttgaaagaacttgttttgttttgttttgttttgttttgttttgttttgttttgtttttttgaggcagagtctcactctgttgccgaggcgggagtacagcagtgtgatctcagctcactcagcctcgacctcccaggctcaagccatactcccacctcagcctcccaagtagctggtactacaggcgtgtgccaccaagcccagttacttttttgtatttttagtagaggcgacgtttctccatgttgcccaggctggtctcaaatgcctgagccttaactcaagca

SEQ ID NO: 5167 - DNA, 457 bp, Homo sapiens
  AC019113.6_58519
  Located on chromosome 3
  Distance between a terminus base of telomere on chromosomal short arm and 5'-terminus of this base sequence : 64447475
  Distance between 3'-terminus of neighbour sequence of sequence listing upward to telomere on chrosomal short arm and 5'-terminus of this base sequence : 2505
gtggcataattcatacttcaagaaatactgctgtgaataggagtgaataaaagcatgggctatagagttggccatatctatatttaaataatggaccctccactcacggacatggtgtcctgagttgaacaacataatctctctaagcctcagcttctatatccatgaaataggaggataacaagagtatcttgcagagttgtgagagtgtgtgtgtgtgtgtgtgtgtgtgtgtgtgtgtgtgtgtgtgtggagagagagagagagagggggaaagagagagaatgtgtgaatatatatataattactatttgaaaagaggaatcctgtaggctctaaaacccttgctggcttgctctatttctcagtcttctctcaaggatattgattcacctttgcatttttctcttagttaatcttccatgagtattaattgtagtttgctttgatcatgaag

SEQ ID NO: 5168 - DNA, 393 bp, Homo sapiens
  chr3.fa.O7frz.71031112
  Located on chromosome 3
  Distance between a terminus base of telomere on chromosomal short arm and 5'-terminus of this base sequence : 64658842
  Distance between 3'-terminus of neighbour sequence of sequence listing upward to telomere on chrosomal short arm and 5'-terminus of this base sequence : 210910
atattaagttcattggaatttgatcacactgtagagggaatgtaactgttttaatccttttttgcaggaaaacattagacggtagtggtgatgattagcctgggttcattttgagtagatctaagaagaaccttgggagatgaggcaagtttttaaaaattggagttaaaacacacacacatacacacacacacacacacacacacacatacgcaggacttttataaggctgctttttctctgaaatccctttagtaaaatgaatttgtttccagttccccaacatttccactattgaatatctctagctttaatacggtcataatagcactcaagttttctctttgtcactaaggggctctctgttgagtgttaaattgctcatttcacttg

SEQ ID NO: 5169 - DNA, 300 bp, Homo sapiens
  AC068384.2_16251
  Located on chromosome 3
  Distance between a terminus base of telomere on chromosomal short arm and 5'-terminus of this base sequence : 64787776
  Distance between 3'-terminus of neighbour sequence of sequence listing upward to telomere on chrosomal short arm and 5'-terminus of this base sequence : 128541
gtcagacaaataggtttatttgagtcaatgatttttttatagcgatatggcaatgttttatggaggctcagagttatcttgcaagtctgggccaagttgtaacttgaaagaaaacccaaagctaagatggtgaattgtaaataaatacacacacacacacacacacacacacacacacacaggcacaaatatattgaagactttgtttttctaggctgggttctggtaaaagggttcatgcttgtaattcctgcactttgggaggctgaggcgggaagatcattagattgctggagttta

SEQ ID NO: 5170 - DNA, 304 bp, Homo sapiens
  AC068384.2_4104
  Located on chromosome 3
  Distance between a terminus base of telomere on chromosomal short arm and 5'-terminus of this base sequence : 64844582
  Distance between 3'-terminus of neighbour sequence of sequence listing upward to telomere on chrosomal short arm and 5'-terminus of this base sequence : 56506
gctgtaacagattaccacagactgagtaatttataaggcacagaaatttattgtcttatggttttggaggctgggaagtcaaagatggaggggctggcgtctggtgagggctttcttgctctgtccttccatagcgaaaggtggaagagcaaagagagagggcaaaacaaatacacacacacacacacacacacatgcacaaaagagggccaaactagtctgtttataatgaactctctcccttcataatccattcatgaggctgatgcccccgtgggccaaatacgttcattaggctctacct

SEQ ID NO: 5171 - DNA, 439 bp, Homo sapiens
  chr3.fa.O7frz.71287573
  Located on chromosome 3
  Distance between a terminus base of telomere on chromosomal short arm and 5'-terminus of this base sequence : 64934752
  Distance between 3'-terminus of neighbour sequence of sequence listing upward to telomere on chrosomal short arm and 5'-terminus of this base sequence : 89866
cctggtatctacagttgattgtgtgtgtgtgtgtgtgtgaaaacgatgatttttagatttactgtcttgagggtagtttagcagtggtcctgaccattcattcattcattcattcattcattcattttgtcaatccatctgtgagccattcagcaaatatttattttccaccttcttttcaggatgtgatcaatttttcttttgtatgtaataatctttcacactttgaagatcattcaaaacgggtatgtacatttttgtggtgtaatgaaaacccaccagtttaagcccagatttgtcattaaacttcctaagtttccacatactgcctctatttgttccttttttgtaatagaggttgaagattatttgaaacagaaatggatgcctttgctcaccaaaagtcagattcatcctatctaggtttccagataactcc

SEQ ID NO: 5172 - DNA, 450 bp, Homo sapiens
  chr3.fa.O7frz.71410772
  Located on chromosome 3
  Distance between a terminus base of telomere on chromosomal short arm and 5'-terminus of this base sequence : 65035397
  Distance between 3'-terminus of neighbour sequence of sequence listing upward to telomere on chrosomal short arm and 5'-terminus of this base sequence : 100206
cctctagatgttgaggtaggaggatcacatgggtctgggagatcaagtctgcaatgtgttgtaattacaccactgtattctagctgggctgggagacagagtgagaccctgtaggtaggtaggtaggtaggtaggtaggtaggtaggtaggtaggtaggtagaattgtgttcatattgtagaaatccatatatctgagttagatttttaaaacgctgtctgactactgttgctcctggctacaacattaaaaaaaggtgtcctggttttcttttcaggaaagagcgatatttttatttttttcatagaaaacagaattaaaccaataaatgaagttattacacttttgagttggacaacttaaaacacacaatgtttgaaattataaagcatttttgcaagaagttgttatttggggtaacatattctgtcacagtatgctacttattcc

SEQ ID NO: 5173 - DNA, 258 bp, Homo sapiens
  AC004695.1_102310
  Located on chromosome 3
  Distance between a terminus base of telomere on chromosomal short arm and 5'-terminus of this base sequence : 65141806
  Distance between 3'-terminus of neighbour sequence of sequence listing upward to telomere on chrosomal short arm and 5'-terminus of this base sequence : 105959
catatgtttctgatagtctaggctttccgcctgcctgcccgcccgccttccttccttccttccttccttccttccttccttccttccttccttccttccttccttccttccctccctctctccctccctccttctttttctttttctttttttgatggagtctcactctgtctccaagctggagtgcagtggtgcaatctctgctcactgcaacctctgactattctttgtattctgttggactcgatatgtctttct

SEQ ID NO: 5174 - DNA, 421 bp, Homo sapiens
  AC004695.1_50786
  Located on chromosome 3
  Distance between a terminus base of telomere on chromosomal short arm and 5'-terminus of this base sequence : 65193344
  Distance between 3'-terminus of neighbour sequence of sequence listing upward to telomere on chrosomal short arm and 5'-terminus of this base sequence : 51280
gctgtatttgaaagtagcttctagaatgcagggattttttggattctttgtttcacttgctgagcttcctattatttatttatttatttatttatttttattgagatggagtcttgctctatcgcccaggctggagtgcagtggcatgatctcagctcgctgcaacctccgcctcccgggttcaagcaattctcatgcttcagcttcccaagtagctgagaccacaagcgtgaaccaccacgcctggctaatttttttgtatttttagtagagatggggtttcgccatgttggccaggttagtgtcgatctcctgacctcaggtgatctgccctccccagcctcccaaagtgctaggattacaggcgtgagccaccatgcccagccccagcttcctattatttaaattgtatcctggaatg

SEQ ID NO: 5175 - DNA, 347 bp, Homo sapiens
  AC034147.4_108362
  Located on chromosome 3
  Distance between a terminus base of telomere on chromosomal short arm and 5'-terminus of this base sequence : 65215602
  Distance between 3'-terminus of neighbour sequence of sequence listing upward to telomere on chrosomal short arm and 5'-terminus of this base sequence : 21837
aaggtagaagcctgttagaaagaagtgagagaagatgatagagttcagagctcaaagaagctcaaaaagtaacggagttgcaaaatggttttataatgtgatacacagacagacatacctgtgtatgtttgcttaaaaccggtaatgattttagggggtgtattagtcagggttctccagagaaagagagccataggatcgatgtctctctctctctctctctctctctctctctctctctctctctctctcacacacagacacacgcacacacacacacacatgcacgcacagagtaactccggcctataattcatgaattttagctaagttactctagctaagtt

SEQ ID NO: 5176 - DNA, 354 bp, Homo sapiens
  AC024885.11_144792
  Located on chromosome 3
  Distance between a terminus base of telomere on chromosomal short arm and 5'-terminus of this base sequence : 65376057
  Distance between 3'-terminus of neighbour sequence of sequence listing upward to telomere on chrosomal short arm and 5'-terminus of this base sequence : 160108
atgaggatttctctatccagatacacctcctttctaaccagagaaatcaggcaaggatatgtatacatctgtgccttatatatacatacatacatacacacacacacacacacacacacacacgtatacatctgtgccttatatacacacacacacacacacacacacacacaccattctctccaccagagcatcctttacttctctaatgtcaaacatcacttactgccttgctaaaagtattgtggcaaaaaaaggaggagaaaatcaaagcaactaatgtgtgatgtgcccaaaggtcatggtgttttgctagaaaaccatcatctctggttaaatgtgaattgcactttc

SEQ ID NO: 5177 - DNA, 279 bp, Homo sapiens
  chr3.fa.O7frz.72130613
  Located on chromosome 3
  Distance between a terminus base of telomere on chromosomal short arm and 5'-terminus of this base sequence : 65444652
  Distance between 3'-terminus of neighbour sequence of sequence listing upward to telomere on chrosomal short arm and 5'-terminus of this base sequence : 68241
ttaaattgtcagcttaaggtttagatgaagataatctttaactttgtttacaatttttgctattttgcattatccccctttttccataaaaaataaagtgaatatgtgtgcatatttattttgaatcagattagacttattttgagattattttgtcacttctgagataattggagacacgtgtgcacgtgtgtgtgtgtgtgagagagagagagagagagagagagagacagaaaccaagggttgctgtcaccaattcaagaggaagatactaagctt

SEQ ID NO: 5178 - DNA, 223 bp, Homo sapiens
  D3S1312
  Located on chromosome 3
  Distance between a terminus base of telomere on chromosomal short arm and 5'-terminus of this base sequence : 65529355
  Distance between 3'-terminus of neighbour sequence of sequence listing upward to telomere on chrosomal short arm and 5'-terminus of this base sequence : 84424
tgggttctgcctccaatggcgccctttcctcttgctttatttttactctcaggaaaccgtattctcctctttctacttctcactgcatatgactctattttttttctctttatgggagggagaacgaacacacacacacacacacacacacacacacacacacacacaggcacacacacacacacttgccagatcacttacccaaaccttaccctggggagcc

SEQ ID NO: 5179 - DNA, 421 bp, Homo sapiens
  AC074341.2_32037
  Located on chromosome 3
  Distance between a terminus base of telomere on chromosomal short arm and 5'-terminus of this base sequence : 65618555
  Distance between 3'-terminus of neighbour sequence of sequence listing upward to telomere on chrosomal short arm and 5'-terminus of this base sequence : 88977
tatcctcactgaatcacagctccttcatctgtaaagggtgcaaaaataaagacttctttatgagtctaaggttaagattgaatcagaagcccttagcacagggccaaggcccataggttcataggtggctgctctcttctctctttctctccccacctacccatcattcatccatccacccacccacctatctacctactctcctctcctttcctctcctctctcctctcctttcctcccacctacctatttctgcatctatctatctatctatctatctatctatctatctgcctgcctacctaattatttctgtctatatctatctgctgtctgtctacaaatcatcatctgtctgattttgcaaatccttgccatatttggaggaaaaagttgttttatttcaaattccagtggaatc

SEQ ID NO: 5180 - DNA, 288 bp, Homo sapiens
  AC074341.2_116865
  Located on chromosome 3
  Distance between a terminus base of telomere on chromosomal short arm and 5'-terminus of this base sequence : 65630525
  Distance between 3'-terminus of neighbour sequence of sequence listing upward to telomere on chrosomal short arm and 5'-terminus of this base sequence : 11549
ctaagctggactatgacctcagttcagctaccaggacaccctcctctggaatccttacgttgaataaatgatacaaggctagaataaacagacggaatttgcttgttccagcagctgtgccttgaccagactgtccttacaggtcagtagtttttgatcttgtctgtttcttagaattgtgaaaggtcgcatcctcaaagctctatctatctatctatctatctatctatctatctatctatctatctaactattgagacagggtctcattcagcctaaggtggagtg

SEQ ID NO: 5181 - DNA, 442 bp, Homo sapiens
  AC048336.7_20189
  Located on chromosome 3
  Distance between a terminus base of telomere on chromosomal short arm and 5'-terminus of this base sequence : 65641217
  Distance between 3'-terminus of neighbour sequence of sequence listing upward to telomere on chrosomal short arm and 5'-terminus of this base sequence : 10404
ttattgctagtaaatggaagaactatgatttgaacctagattggcctaacttccgagcttgccctagaagccctgcttgccatttattttaagtttcttgaaaggagaagaaagttagtgccctttgtgtgtgtgtgtgtgtgtgtgtgtgtacgtgtgcacataccaccgaaggaatgaagacaggcagatcctaaaagcaagactagccataaaccattgccagtgccatttcttaaggatcacctctagacacacgaacacacacttacctgttcccatggacatgggatgcacagaaggcaaagctgtagtgaagaagggtggggtcgatcatggcgccattttctgcccgttcaagcaagtctctgaggtagcagagatgtcggtgacacccccggactccatttcgggcgcaatactcgtctagtacaaacacctg

SEQ ID NO: 5182 - DNA, 448 bp, Homo sapiens
  AC048336.7_65585
  Located on chromosome 3
  Distance between a terminus base of telomere on chromosomal short arm and 5'-terminus of this base sequence : 65691497
  Distance between 3'-terminus of neighbour sequence of sequence listing upward to telomere on chrosomal short arm and 5'-terminus of this base sequence : 49838
caaatcaggtagttcagtttctagcagagtgaatgaagagaatgtgggaaatgggcattcatccaatagggaaaataatacctgtgtcaagtggttgctgtggagagtaagtgacacaataaaactcctagtacagtgcttcagagagaactcgaatgtaggttgaggcactgatcatttttttaaaggaagtttaaaaaaagcactttagaggacagatacattcattcatattctgttctttattttctctctttgatctgccctaccctctttgtctctctctctctctctctctctctctctctctttctacgtctgttctgctcactcatgtgctggttcctttagcaaatatttatggagtatttatgaggcaggattttgctaaagatgaagatcttctcttgtgtactacagaaacctaactgaattatcaactcctttg

SEQ ID NO: 5183 - DNA, 315 bp, Homo sapiens
  chr3.fa.O7frz.72646377
  Located on chromosome 3
  Distance between a terminus base of telomere on chromosomal short arm and 5'-terminus of this base sequence : 65897744
  Distance between 3'-terminus of neighbour sequence of sequence listing upward to telomere on chrosomal short arm and 5'-terminus of this base sequence : 205799
atgtttgtaaaccactacatcaaggaatattaaaaaaacactgcaaaatgatttttattttttgctacaatcccaaggttttagtgatgatgctcacaacatgttggaagaccaaattttggggtaaggtttaaagcaatgacaatctgtgtgcgtgtgtgtgtgtgtgtgtgtgtgtgtgtgtgtgtgtgtattacagtaaagggtggattcagcaggtctatgatgtccaaattctacacattccaaagaaaggcatggcccccccttcatccgcttatgagagataacttctaaactcttggaatatcctgc

SEQ ID NO: 5184 - DNA, 423 bp, Homo sapiens
  AC055709.7_13504
  Located on chromosome 3
  Distance between a terminus base of telomere on chromosomal short arm and 5'-terminus of this base sequence : 65921838
  Distance between 3'-terminus of neighbour sequence of sequence listing upward to telomere on chrosomal short arm and 5'-terminus of this base sequence : 23779
aatattgaagattcgaggctatgaaacagaaatatctgagatttctatgttaaagacaattatcttgtgtgtttttgtaatagaaatataactgaattacaaaatacccccaaataatagtgatatatacaagatggcagttggggtgtgtgtgtgtgtgtgtgtgtgtgtctatgtgtgtacacatgaaaactaaagctggaggaaagcagcataacgttggactcaacctcatctgggtgccaagttacttccattatgttgctccattttcaaaacaaaactcctgccttatagtacaagacagccactgaagctccagccagtcagtcctgctttctagccagctagaaggaggaaggaggcagaggccacttccttaaatgacatttcctggaagtcactcagatacttctgctttat

SEQ ID NO: 5185 - DNA, 410 bp, Homo sapiens
  AC012519.9_132380
  Located on chromosome 3
  Distance between a terminus base of telomere on chromosomal short arm and 5'-terminus of this base sequence : 65924355
  Distance between 3'-terminus of neighbour sequence of sequence listing upward to telomere on chrosomal short arm and 5'-terminus of this base sequence : 2094
tagatgagtgatatggtttcactctgtgtccccacctaaatctgatgttgaattgtaatccctaatgttgaaggagggacctagtgggaggtgattggtttaggggggtagatttcccccttcctgttctcatgatagtgagttctcacaagatctggccgtttgaaagtgtatatcatttccccctttgctctctctctctctctctctctctctctcctgccaccatgtgaagacatttttgcttcccattctcccttctaccatgattgtaagtttcctgcagcctccccagccttgcctcctgtacaacccgtggaactgtgagtcacttcagcctcttttaaaaataaattacccagtctcaggtagttatttatagcagtgtgagaacggactaatacagtaag

SEQ ID NO: 5186 - DNA, 203 bp, Homo sapiens
  AC016900.4_159985
  Located on chromosome 3
  Distance between a terminus base of telomere on chromosomal short arm and 5'-terminus of this base sequence : 66165562
  Distance between 3'-terminus of neighbour sequence of sequence listing upward to telomere on chrosomal short arm and 5'-terminus of this base sequence : 240797
ttcaaacctgtctcattctattacactttatgagaaaatgctattaaataccacctgcacagctctattgtgtgtgtgtgtgtgtgtgtgtgtgtgtgtaggaggtggagggaggacatctgaagtcatctcttgaagagtgagtgtcccagatttaacccttttctttatagccttatttgtcatttagatggtttcgactt

SEQ ID NO: 5187 - DNA, 270 bp, Homo sapiens
  D3S3698
  Located on chromosome 3
  Distance between a terminus base of telomere on chromosomal short arm and 5'-terminus of this base sequence : 66223709
  Distance between 3'-terminus of neighbour sequence of sequence listing upward to telomere on chrosomal short arm and 5'-terminus of this base sequence : 57944
ggttaccagggtctgggggaaaaggggacatggggagatgctgatcaaagggtataaacattcaattataagatgaataaattctagaaatctaatgcttagcatgggtactgtcattgataataatacattgtatatttgaaatttgctaagagagatcttaagtattaccacacacacacacacacacacacacacacacacaaatggtaactatgtgaggtgatgaatatgttaattatttaatggcttcattatggtaatctcttc

SEQ ID NO: 5188 - DNA, 300 bp, Homo sapiens
  AC068372.2_147016
  Located on chromosome 3
  Distance between a terminus base of telomere on chromosomal short arm and 5'-terminus of this base sequence : 66298064
  Distance between 3'-terminus of neighbour sequence of sequence listing upward to telomere on chrosomal short arm and 5'-terminus of this base sequence : 74085
taagttctgaaattatttggacagcattaattgccttctactaaatttccatttattcttctactagaatacattgtgtgtgtgtgtgtgtgtgtgtgtgtgtgtgtgtgagtgaaggttcagaaactgtaaaagaatgaaaggaaatgtgcatgtattcacactttttaaatttaagtaccacacaccatagttaaaacgtattttcatgtaacattctgggaaaagtgcaccacttatttcacttcatttgcagctctgaaaggataacatatagtcacattaaattgctttagaaag

SEQ ID NO: 5189 - DNA, 253 bp, Homo sapiens
  chr3.fa.O7frz.73080974
  Located on chromosome 3
  Distance between a terminus base of telomere on chromosomal short arm and 5'-terminus of this base sequence : 66384865
  Distance between 3'-terminus of neighbour sequence of sequence listing upward to telomere on chrosomal short arm and 5'-terminus of this base sequence : 86501
caattgatcagttacctaagaaagctttgtcaagtgagagagagagagagagagagagagagagagtgtgtgtgtgtgtgtgtgtgtgtgtgtgtatgtgtgtgtgtgtgtgtgtgtgtgtggtatattttataaagaacattagcaccctcttctgggtgacttttgattctgtaatgggaatattctgacaatcttttcccattttctaacaatgaacagtctgaatattcattaaatttgctcctgatta

SEQ ID NO: 5190 - DNA, 198 bp, Homo sapiens
  D3S1600
  Located on chromosome 3
  Distance between a terminus base of telomere on chromosomal short arm and 5'-terminus of this base sequence : 66473567
  Distance between 3'-terminus of neighbour sequence of sequence listing upward to telomere on chrosomal short arm and 5'-terminus of this base sequence : 88449
tgcttgccttgggatttagtcaagagagatcaggtacacataataatagccattgtcattattgtctttcatcagcccttctgttgaagttcagcctaaaatttccaggcagttgtctcaatgaagtgtgtgtgtgtgtgtgtgtgtgtgtgtgtgtgtgtgtgtgtggacacacgtggacaggcagatgatggtgat

SEQ ID NO: 5191 - DNA, 342 bp, Homo sapiens
  chr3.fa.O7frz.73317876
  Located on chromosome 3
  Distance between a terminus base of telomere on chromosomal short arm and 5'-terminus of this base sequence : 66619837
  Distance between 3'-terminus of neighbour sequence of sequence listing upward to telomere on chrosomal short arm and 5'-terminus of this base sequence : 146072
ccaaatacatttgactgtagaaacttcttcttcactgagtatccaagaggatctgtatactatggaacacatccttaatatttatatattaagtgtatatatatatatatatgtgtgtgtgtgtgtgtgtgtatacatataaagtgaactgttcctagtctaagacaaagatgactcagttcataggtgatgaatcatcatagagacgtagcattgataccaatattcttaatagtttttaagagtagagctgacaaaagttgcaaataccttgctcaagtagatactctcctaactaactaataaaagagtagaaagctcagaaatattaagcacgtaatc

SEQ ID NO: 5192 - DNA, 450 bp, Homo sapiens
  AC025683.3_73322
  Located on chromosome 3
  Distance between a terminus base of telomere on chromosomal short arm and 5'-terminus of this base sequence : 66765888
  Distance between 3'-terminus of neighbour sequence of sequence listing upward to telomere on chrosomal short arm and 5'-terminus of this base sequence : 145709
tacctaagtggtagcttactgtcttgggtatacattgttccaggaagcagtatgaggggagggtgagaacttaggttgggcttcaaacccggtttgaatcctggctccaccacctatgaattataggaagttgaccaagttccttaatgtgttttagttttctcaactattaaatgggtataataattatagctacttcctagagaaactgtgaatatgaagttaatacctagaaagctcttagaatagcacctagcactggtagacactctataggtgttttcaacattatgatattccacttagttatagctcttagagatgttccttttgacatagtattcccttgtgtgtgtgtgtgtgtgtgtgtgtgtgtgtataccatcatttatttagaccaaaaatcagcaaattatgggcccaaagccaaatccagtcaaccacttagtt

SEQ ID NO: 5193 - DNA, 101 bp, Homo sapiens
  DISD22_0002738
  Located on chromosome 3
  Distance between a terminus base of telomere on chromosomal short arm and 5'-terminus of this base sequence : 67004114
  Distance between 3'-terminus of neighbour sequence of sequence listing upward to telomere on chrosomal short arm and 5'-terminus of this base sequence : 237776
atttgcctcttatcgctccttcacacacacacacacacacacacacacccccacacacacacacacaccccaactcctgtcaaccggagtactggacttta

SEQ ID NO: 5194 - DNA, 117 bp, Homo sapiens
  DISD22_0002746
  Located on chromosome 3
  Distance between a terminus base of telomere on chromosomal short arm and 5'-terminus of this base sequence : 67075715
  Distance between 3'-terminus of neighbour sequence of sequence listing upward to telomere on chrosomal short arm and 5'-terminus of this base sequence : 71500
aagcctcttacaatgttccttagacacataaacacacacacacacacacacacacacacacacacacgtatgattaattttaatttgaaataaattcctcaaacaaccacaagtcta

SEQ ID NO: 5195 - DNA, 242 bp, Homo sapiens
  AC007944.2_65027
  Located on chromosome 3
  Distance between a terminus base of telomere on chromosomal short arm and 5'-terminus of this base sequence : 67228602
  Distance between 3'-terminus of neighbour sequence of sequence listing upward to telomere on chrosomal short arm and 5'-terminus of this base sequence : 152770
cctaacttattctatgaggccagcatcatcctgataccaaaacctggtagagatacaacaacaacaacaaaaagtcaggccaacatccttgatgaacattgatgcaaaaattcttaaaaaattactggcaacccgaatccagcagcacatcaaaaagcttatccaccacaaacaagtagactttatttatccttgggaacaagtttgattcatcatatgtaaatcaataaatgtgatgcctc

SEQ ID NO: 5196 - DNA, 254 bp, Homo sapiens
  AC022504.19_22803
  Located on chromosome 3
  Distance between a terminus base of telomere on chromosomal short arm and 5'-terminus of this base sequence : 67277630
  Distance between 3'-terminus of neighbour sequence of sequence listing upward to telomere on chrosomal short arm and 5'-terminus of this base sequence : 48786
tgaagccacttatattagtcaaagcaagaaaaatacgttgcaaggaatacaatggtattaaagctagtttgacttcaggggaaaaatggcaaactgttataaaggtgtgtgtgtgtgtgtgtgtgtgtgtgtgtgtgtgtgtgtgtgtgtgtgtgttttgttttgtttttgtttttagaaacttagccatgtatataaaagggtctcatgaggaaatagaatatgccactggaaggtgattgtaccaagtttct

SEQ ID NO: 5197 - DNA, 385 bp, Homo sapiens
  AC022504.19_47376
  Located on chromosome 3
  Distance between a terminus base of telomere on chromosomal short arm and 5'-terminus of this base sequence : 67314298
  Distance between 3'-terminus of neighbour sequence of sequence listing upward to telomere on chrosomal short arm and 5'-terminus of this base sequence : 36414
tcaatttcactttcaggtagttattgtatagaaacataaatgatatttatattgatgttaaatcatacaatcttgctaaaatcatttattagttgtattagtttaggtacttgtgtgcgtgtgtgtgtgtgtgtgtgtgtgtgtgtattctttagaattttctatatataagaccatatcatgtgcaaatagagagttttactttttcctttttaatctgatgtcttttatttctttatcatatcttattgccctggttagaacctccagtacaatgttcaacagaagtagcaagggtggacatctttgttgtgttcttgatcttaagggaaagcaccagtctttcagcattaagtattatgttagccatgagttatttgtacat

SEQ ID NO: 5198 - DNA, 104 bp, Homo sapiens
  D3S3635
  Located on chromosome 3
  Distance between a terminus base of telomere on chromosomal short arm and 5'-terminus of this base sequence : 67469740
  Distance between 3'-terminus of neighbour sequence of sequence listing upward to telomere on chrosomal short arm and 5'-terminus of this base sequence : 155057
tgcatagccagttttagcaaatttggggtgtgtgtgtgtgtgtgtgtgtgtgtgtgtgtgtgtgtatactcaccatgtttggaaaatgaattcctagaaataga

SEQ ID NO: 5199 - DNA, 238 bp, Homo sapiens
  D3S3571
  Located on chromosome 3
  Distance between a terminus base of telomere on chromosomal short arm and 5'-terminus of this base sequence : 67508987
  Distance between 3'-terminus of neighbour sequence of sequence listing upward to telomere on chrosomal short arm and 5'-terminus of this base sequence : 39143
caggcaaggttatctgggaggggaggattcactcataaaaagaaacgctggaaccaggacctctaactgtgtgtaggggtgtgcgcgcgcgcgtgtgtgtgtgtgtgtgtgtgtgtgtgtgtgtgtgtgtgttaaacctccccagcagaatatttaaccaaggacacattttcccctgctctaattccttagccgttcctcctcctctgtaaatcttctaaacattgcagagcctcag

SEQ ID NO: 5200 - DNA, 369 bp, Homo sapiens
  AC015948.3_123786
  Located on chromosome 3
  Distance between a terminus base of telomere on chromosomal short arm and 5'-terminus of this base sequence : 67656851
  Distance between 3'-terminus of neighbour sequence of sequence listing upward to telomere on chrosomal short arm and 5'-terminus of this base sequence : 147626
cagattactgtactctggcagttaacacctggaattctcattgcctgtttttctcatctatgttatcagttatttaaggtcaggaagcttgttcaccagaatcttctctatcatttaacatggtacctacaacatcaaagatacctgttaaatgaatgaatctgtgaatgaatgaaggaaacaaaataatggatgggtggaaggaaagaagaaaggaaaggagggagaaaggaaggagggaaagatggaagcaaaaaaggaaggaaggaggaaggaagaaagggagggaggaaggaaggaaggaaggaaggaaggaaggaaggaaggaaaaaaacatagaacagtgcctgctaattgatggactttcat

SEQ ID NO: 5201 - DNA, 455 bp, Homo sapiens
  AC023597.12_127098
  Located on chromosome 3
  Distance between a terminus base of telomere on chromosomal short arm and 5'-terminus of this base sequence : 67778580
  Distance between 3'-terminus of neighbour sequence of sequence listing upward to telomere on chrosomal short arm and 5'-terminus of this base sequence : 121360
cagaaactttacatggtcaaacaaaattcttgattccttctctctctctttcatagagagagatttgcacatggcctggaactgatctccagcagtgcagtccaaaatctagaagtcaagtaaaggagggggagttagcaaggaagactgaggacaggcttgtgggattagaaagaaaccaggagagtctgtctctctccatctctctctctctcactcacacatacacacacacacacacacacacacacacacacacacacacacacacaaattcccttccaacccaggttctatttcagttaatgccactagtcctagtcctaatcccttgtcctgaaatctgaaatcctctttgcttcctttaacttcttattccctcacctccaaacctgcaaaccaacaacaaatccattagattttcctttgaactacttctcaaattcattgacttc

SEQ ID NO: 5202 - DNA, 462 bp, Homo sapiens
  AC023597.12_135866
  Located on chromosome 3
  Distance between a terminus base of telomere on chromosomal short arm and 5'-terminus of this base sequence : 67927416
  Distance between 3'-terminus of neighbour sequence of sequence listing upward to telomere on chrosomal short arm and 5'-terminus of this base sequence : 148381
aagttcagaattagaagcaacactttccttattttacaaatgagaacacagagcccaaagacattaacttaaccagtgaccacttttcttgttagtcacagagctaagccaatatgttttcattaccccatgccttccagtacacacacacacacacacacacacacacactcacaaaacaaactgtgggcatgaatgtggaatggagagatggcagggaagcctgtagaaacaaaaggggttttctctaaatctcatcctcctcattgccccttccccatttctccttccttttcctttccttaattccaggcattgttgacttctctcatcttccctggtgcttattctgcctttctctacaattacccatcccaaccaaacacaactctatcttagtggatctcagggcggtcctcagatgatagaaatggaaaagtagataagcacaagtcatgtttc

SEQ ID NO: 5203 - DNA, 311 bp, Homo sapiens
  chr3.fa.O7frz.38830075
  Located on chromosome 3
  Distance between a terminus base of telomere on chromosomal short arm and 5'-terminus of this base sequence : 67954892
  Distance between 3'-terminus of neighbour sequence of sequence listing upward to telomere on chrosomal short arm and 5'-terminus of this base sequence : 27014
cagaataggcatgctgtctattttgttcactttgtaactctcttggctagatagtgcctggcatggggacaagtacatgaatgaatgaatgaatgaatgaatgaatgaatgaatgatgaatggctgaatatcataggtatcagtgtttccatttaaaatgtaaggaaaataagagttttaagattttacccgaaagaatttaaagtctttcccaaggatgcatagctcctcagtagaaccagggctccaagtgagcctcttgactccaaaagtactgctacttctaccttatgacattacctgaggtagaa

SEQ ID NO: 5204 - DNA, 172 bp, Homo sapiens
  D3S3644
  Located on chromosome 3
  Distance between a terminus base of telomere on chromosomal short arm and 5'-terminus of this base sequence : 68081671
  Distance between 3'-terminus of neighbour sequence of sequence listing upward to telomere on chrosomal short arm and 5'-terminus of this base sequence : 126468
gctcaaatgctcaaaaagtagcacccaaggaatacttgttgaataaatgaaagaatgaatataccccacccctggtgtgtgtgtgtgtgtgtgtgtgtgtgtgtgtagatatcctgtcactggtctatgataatttattctttaattacatgataagccatagagcccccat

SEQ ID NO: 5205 - DNA, 471 bp, Homo sapiens
  AC072021.4_58821
  Located on chromosome 3
  Distance between a terminus base of telomere on chromosomal short arm and 5'-terminus of this base sequence : 68134966
  Distance between 3'-terminus of neighbour sequence of sequence listing upward to telomere on chrosomal short arm and 5'-terminus of this base sequence : 53123
gatttcattagacctgacaactacaaaatgaattaataaagtatagttccttagtcctccaaatttgaattgcatagtgagccttattctgaaagatcctgacatttattaatttcacagacacttataccaataataataataataataataatggtatttcacatgcattgaagacttactctgtgtagccacaaagataaacactctacattaattgtttcatttgctgtccacaattttccagagaaaccaggtgttattcaagaaatcatcatcaaatacgtactgagtgcagggcatgtaatggtgctgcggaatataaagatgaacaggggccttgactcaaagtaacataatgtctaaaagaggagacaaatattaagcaaagagccacagaagcaaatgtaacatttacaactgcattaaatactgcctaccagtgggaggtacatggtgctattaaactgg

SEQ ID NO: 5206 - DNA, 236 bp, Homo sapiens
  D3S1285
  Located on chromosome 3
  Distance between a terminus base of telomere on chromosomal short arm and 5'-terminus of this base sequence : 68264355
  Distance between 3'-terminus of neighbour sequence of sequence listing upward to telomere on chrosomal short arm and 5'-terminus of this base sequence : 128918
atttagaaaacccatacagcatggcatcatccaattacacacacacacacacacacacacacacacgattgtatagaaaaaacagtgtggaggtacacaaaagactcaaagatgagactacttctggggaagttctagggatggggagcaatagccaagagaaccacccatcattcaaaaaatattatttagcaccttctctgtcaggcactgatgctacccctgtgatgaacaga

SEQ ID NO: 5207 - DNA, 394 bp, Homo sapiens
  AC068089.3_8237
  Located on chromosome 3
  Distance between a terminus base of telomere on chromosomal short arm and 5'-terminus of this base sequence : 68311710
  Distance between 3'-terminus of neighbour sequence of sequence listing upward to telomere on chrosomal short arm and 5'-terminus of this base sequence : 47119
ctatcaatggataattggataaagaaaatgtggtgtgtgtgtatatatatacataaatagggggtggggatgggtatgtgtgtgtgtgtgtgtatatatatatatatatataatcattttgctagacaagttctatattttattccccgatgtgctcaaatactgtgtgtgtgtgtatgtgtgtatctttaagtaaatgtgtgccaaaattccatgaggagacaattgcacaggggaaaaagtcaagaatgtgaaattccctgaattatatttcttctgttggatttgaaactccagggggcaatgactatctatgtatctatctatctatctatctatctatctatctatctatctatatacacacacgctatggaatactcttcagctgtag

SEQ ID NO: 5208 - DNA, 466 bp, Homo sapiens
  AC022499.9_11785
  Located on chromosome 3
  Distance between a terminus base of telomere on chromosomal short arm and 5'-terminus of this base sequence : 68627026
  Distance between 3'-terminus of neighbour sequence of sequence listing upward to telomere on chrosomal short arm and 5'-terminus of this base sequence : 314922
gttatgctaagtgaaatagaccagtcacagaaagacaaacaccgcatgattccacccatatgaggtatctaaaatagtaaactcagaaacagaaagtgcaatggtggttgccaggggctagggagaggggaaaaggagcagtcgtgttcaaaggatgtagagttccagttttgcaagatgaaaaagttctagagatctgatctgttagacagcaagttgcaaatagttaaccctattgtatgtaaacttacaaatagttaagatggtacattttacgttataggtttttgaccataatgagagagagagagagagagagagagagagagagagagagagagatgtggactcaaggagtgctattaagctgtgagtgtttcagaatctgcaccagttttcagccaagaccacccagttcccaagcacattccagccaagcgctcactaacatcagatgcctctacag

SEQ ID NO: 5209 - DNA, 151 bp, Homo sapiens
  chr3.fa.O7frz.75181784
  Located on chromosome 3
  Distance between a terminus base of telomere on chromosomal short arm and 5'-terminus of this base sequence : 68733637
  Distance between 3'-terminus of neighbour sequence of sequence listing upward to telomere on chrosomal short arm and 5'-terminus of this base sequence : 106145
cttgattcgtgacatttctagtctttctgtgtgtgtgtgtgtgtgtgtgtgtgtgtgtataactgtatgggtatatgtgtacgtatatatagtttttatgaaaaaatgggccattagcccttactatgttatgaactgttcctttacctta

SEQ ID NO: 5210 - DNA, 467 bp, Homo sapiens
  AC026268.2_114740
  Located on chromosome 3
  Distance between a terminus base of telomere on chromosomal short arm and 5'-terminus of this base sequence : 68791246
  Distance between 3'-terminus of neighbour sequence of sequence listing upward to telomere on chrosomal short arm and 5'-terminus of this base sequence : 57458
tgttattcctcaaatatcatgattatctacatagaaaatcccaaggaatctgttttaaaaacaaaaagcctcctagtactaataagtgaatgcagaaaagtcacaagataccagatatacatctgaaaatgaatgtatttcttttttttttttcttttttgaaacactgtcacctaggctgaagtgcagtggcactatcacagctcactgaagcctcaaccttttgagctcaagcaatcctcccacctcagcttccagagaagctagtactacaggccgtgtgtgtgtgtgtgtgtgtgtgtgtgcgcgtgcgcgtgcacacagacagggtctcattatgttgcccaagctgttcactaactcctggactcaagggatcttcctgcctcagcctcccaaagtggtgtgagccactgcacctggccttaatgaatgtatgcctatatattagcaatgaacacaatgaa

SEQ ID NO: 5211 - DNA, 234 bp, Homo sapiens
  AC026268.2_54064
  Located on chromosome 3
  Distance between a terminus base of telomere on chromosomal short arm and 5'-terminus of this base sequence : 68903290
  Distance between 3'-terminus of neighbour sequence of sequence listing upward to telomere on chrosomal short arm and 5'-terminus of this base sequence : 111577
gcaggtcaaactctcaacatagggtctggaatactgcacatggaaaataaatgctaaccactgttactatgattgttgtcatcattgtcttcaacttcctcctcctcctcctcctcctcctccccgtcctcctttataatgtccagctctatgtctagctcacaggaggttcacaataaatgtctgctgattaataattgtttatgacacactagatactgctctaagaggcag

SEQ ID NO: 5212 - DNA, 346 bp, Homo sapiens
  AC025589.11_53959
  Located on chromosome 3
  Distance between a terminus base of telomere on chromosomal short arm and 5'-terminus of this base sequence : 69062742
  Distance between 3'-terminus of neighbour sequence of sequence listing upward to telomere on chrosomal short arm and 5'-terminus of this base sequence : 159218
ctacagttgtgccactgtactctagcccaggtgacagagcaagaccctgtctcaaaaaaaaacaaaaagaaaaaacaaacaaacaaaaaagaaacaaacaaaaaatgcttacacaagagaaggtatcaggaggtaacttggatatattttcattctctcattctctctccttctctctctctctctctctctctctctctcacatttttcaagttagaaaaaggcaacgttcccccattcgaggctttgttaacagtgaccattatacacggctggaataatttctctcatacagtctgtcagcctgcttcctgatatctaactactgctttgaacactagaactc

SEQ ID NO: 5213 - DNA, 373 bp, Homo sapiens
  AC010937.4_73404
  Located on chromosome 3
  Distance between a terminus base of telomere on chromosomal short arm and 5'-terminus of this base sequence : 69112508
  Distance between 3'-terminus of neighbour sequence of sequence listing upward to telomere on chrosomal short arm and 5'-terminus of this base sequence : 49420
ctatgtctgtgcacagtaagtgagtgatgctctttttgttattttggtttttccttttttgagacagggtctggagtgcagtggtgtgatcatagctcagtgtagcctctacttcctgggttcaagatcctcccaccttagcctactaagtagctgggactacagacatgggccaccatcccagcatttttattattattattattattattattattattattattattattattgagacaaggtctccctatgtttcccaggctggtctcaaactcctggactcaagtgatcctcccatctcagcctcccaaagtgctgggattacaggtgtaaggcaccacgcccatcctaatgtcttaatggacaaata

SEQ ID NO: 5214 - DNA, 212 bp, Homo sapiens
  D3S3697
  Located on chromosome 3
  Distance between a terminus base of telomere on chromosomal short arm and 5'-terminus of this base sequence : 69298174
  Distance between 3'-terminus of neighbour sequence of sequence listing upward to telomere on chrosomal short arm and 5'-terminus of this base sequence : 185293
ctggcccaggttggaaacagagtaggtcaaaactcccatgctgatcagtagtgggatagtgcctgtgaatagccgttacactccagcctgggcaatgaaaaaaaagtgtgtctttaagaagactccctgtttgttaaaaagtgtgtgtgtgtgtgtgtgtgtgtgtgtgtgtgtgtgtgtgtgtgtgtgtgtagtttgacagcagggggcta

SEQ ID NO: 5215 - DNA, 393 bp, Homo sapiens
  AC069512.9_143812
  Located on chromosome 3
  Distance between a terminus base of telomere on chromosomal short arm and 5'-terminus of this base sequence : 69551218
  Distance between 3'-terminus of neighbour sequence of sequence listing upward to telomere on chrosomal short arm and 5'-terminus of this base sequence : 252832
aataccagctagccagttatattcaaatgtccccaactgtcccaaaggtgtctttgtacaacttaattgtgcacatattgcacttgatgattatttctctttcatctcatgaaagttcccccttccctttctttttttcatgctattaacttgttgccacacacacacacacacacacacacccccacacacacacgcatacacacacaaagtcagctgtcttacctcctgaatttatctgattgtttgcaaagcatgaaactgtttgactagttaactctccctcctggttggctccggaggcttgattaggcttcactgtttttgacaataatatgtcatacttgggttgtatgtttcacatattgcatctcgtcaggagttatctaaggt

SEQ ID NO: 5216 - DNA, 368 bp, Homo sapiens
  chr3.fa.O7frz.79688336
  Located on chromosome 3
  Distance between a terminus base of telomere on chromosomal short arm and 5'-terminus of this base sequence : 69686842
  Distance between 3'-terminus of neighbour sequence of sequence listing upward to telomere on chrosomal short arm and 5'-terminus of this base sequence : 135231
caattgcctgtatgattatcacccagttaaagctggtttaagtgcatatgagcctccctggggttcccagaaacactttgggatatatgtgtgtgtgtgtgtgtgtgtgcgcgtgtatgtgtatgtgtgcacacgcacgcatatgaagaggaggggttcccatgtgtctctctgaccccattcctcactggaatgtgctgaggcccgaggccattcaggttacatgtgaacatagcaaaacggccattctgttgctctgtgctcacagttgtgcggaaggcctccgttgctctcacacaagtgaacaggagtgctttgtctcctggaagccgaccctgatcctgtgtgtgaagcatagactttcagct

SEQ ID NO: 5217 - DNA, 338 bp, Homo sapiens
  chr3.fa.O7frz.79582783
  Located on chromosome 3
  Distance between a terminus base of telomere on chromosomal short arm and 5'-terminus of this base sequence : 69726784
  Distance between 3'-terminus of neighbour sequence of sequence listing upward to telomere on chrosomal short arm and 5'-terminus of this base sequence : 39574
cttgttctactttccatccttttagatttttccgtgtcctgagaggctgacacatatgggtcacttcaacaggctcctgtgccctctggcttccaggggatttcagccactggggaacccaggaagatgatcggaggggaggtggacagtgaggtcggggatttttctcatctctttctctatggatttgggacatggtgggtaaaatatctctctctctctctctctctctctctctcactctctctcccgtttctatcgccttccctgtctcagttccacttccttctcatgtcttttcaggcctagggatagtgaaactctcaacttattcagtg

SEQ ID NO: 5218 - DNA, 89 bp, Homo sapiens
  D3S3545
  Located on chromosome 3
  Distance between a terminus base of telomere on chromosomal short arm and 5'-terminus of this base sequence : 69745022
  Distance between 3'-terminus of neighbour sequence of sequence listing upward to telomere on chrosomal short arm and 5'-terminus of this base sequence : 17900
taggctaaagagcaacaccttctctctaaacacacacacacacacacacacacacacatacacacaagcaaacattttttaagacaagg

SEQ ID NO: 5219 - DNA, 247 bp, Homo sapiens
  chr3.fa.O7frz.79300184
  Located on chromosome 3
  Distance between a terminus base of telomere on chromosomal short arm and 5'-terminus of this base sequence : 70010946
  Distance between 3'-terminus of neighbour sequence of sequence listing upward to telomere on chrosomal short arm and 5'-terminus of this base sequence : 265835
aacatagtatgagcacaatgaataaagtgataatattccttttggctgtcttaggtgaaaggtgattttaacacacacacacagacacacacacacacacacacacacacacacatttatatacctatttgtaaaggtagattcaaaacaaaggcttccttaacagtgtcctgctcctaccccttcctcatccccaataggattcagatgtttattttcagatgaggaactatgtcctactctgatt

SEQ ID NO: 5220 - DNA, 264 bp, Homo sapiens
  D3S3524
  Located on chromosome 3
  Distance between a terminus base of telomere on chromosomal short arm and 5'-terminus of this base sequence : 70221904
  Distance between 3'-terminus of neighbour sequence of sequence listing upward to telomere on chrosomal short arm and 5'-terminus of this base sequence : 210711
cccacagaatgtgcttgataaacatcaggtgtctatttgtacatgtgcttcatttcaggttatccagacaccattaatagccattgtacaggcaagtccagcagaaaaggactctgtgtgtgtgtgtgttatccagacaccattaatagccattgtacaggcaagtccaacagaaaaggactctgtgtgtgtgtgtgtgtgtgtgtgtgtgtgtgtgagagagatggcaccctgcaagggaatggcatcctggttcctggcaaa

SEQ ID NO: 5221 - DNA, 279 bp, Homo sapiens
  Z66953
  Located on chromosome 3
  Distance between a terminus base of telomere on chromosomal short arm and 5'-terminus of this base sequence : 70257417
  Distance between 3'-terminus of neighbour sequence of sequence listing upward to telomere on chrosomal short arm and 5'-terminus of this base sequence : 35249
ccctgtctcagaacaacaacaacaaccaaaaaaaaaaaactgttaaaattaaatatgtattaaatatgtggtctctcccaggctgagcatatatatatatatacatacatacatacatacatatatatgtgtgtgtgtgtgtgtgtgtgtgtgtgtgtgtgcacgctccatctgcataaagataataattgaacctatgatcatgaatgagattatccaaggagggggatcaaaagagaggccctaagattcctgaggaattgctatggctaatgggct

SEQ ID NO: 5222 - DNA, 247 bp, Homo sapiens
  DISD22_0002769
  Located on chromosome 3
  Distance between a terminus base of telomere on chromosomal short arm and 5'-terminus of this base sequence : 70360415
  Distance between 3'-terminus of neighbour sequence of sequence listing upward to telomere on chrosomal short arm and 5'-terminus of this base sequence : 102719
ccaggaagtagctagggatcaaaactgtgatgtccctcccatatatgaaaggaagaaagaaggaaagaaggaaggaaggaaggaaggacagacagacatggagggagggagggaagaaggaaggaaggaaggaaggaaggaaggaaagaaggaagagacaaagtagaaaatggaaatggaggtgcaaacaaagaatactctgattatttccttcacttttctgcaagctgctgccacctaagcagac

SEQ ID NO: 5223 - DNA, 218 bp, Homo sapiens
  chr3.fa.O7frz.79019591
  Located on chromosome 3
  Distance between a terminus base of telomere on chromosomal short arm and 5'-terminus of this base sequence : 70600598
  Distance between 3'-terminus of neighbour sequence of sequence listing upward to telomere on chrosomal short arm and 5'-terminus of this base sequence : 239936
agtcagcctatgtctttagctcaggcaaacaaacaaacaaacaaacaaacaaaaaacactatagacacaaagatctggtgaagagagacagaaagctacaggcccatgcaatcagagaaagccttctgcaagggagtcacagaagtaccatcttttaaatattaggggggaaaatccttttacttaaagggcaaatctccacttgattctagagtcct

SEQ ID NO: 5224 - DNA, 413 bp, Homo sapiens
  chr3.fa.O7frz.78536093
  Located on chromosome 3
  Distance between a terminus base of telomere on chromosomal short arm and 5'-terminus of this base sequence : 70786423
  Distance between 3'-terminus of neighbour sequence of sequence listing upward to telomere on chrosomal short arm and 5'-terminus of this base sequence : 185607
ctagtccgttagctatggattttctaggtttttgcctaaaaacttctatttcatttttatatttgtattatagtttgactagttatagaattcttggctgccagtgttttgtttttgtttttttttcttgattactcagtatgttgaatatgtaagtcgaatgtcttctggtctgcattatttctggtgataaatcagcaattgatcatattgttgtttttctcttgctactttctgcatgtaatgtattgtttttctcttgccatttttaaggttttctgaggtttttatgttttctttttaggtgtcttgctgtagcgtactgagattggattgttggtgtgtgtgtgtgtgtgtgtgtgtctttatattatttgggtttcattgaacttcttgagtgactaagttagtgg

SEQ ID NO: 5225 - DNA, 186 bp, Homo sapiens
  DISD22_0002772
  Located on chromosome 3
  Distance between a terminus base of telomere on chromosomal short arm and 5'-terminus of this base sequence : 70905458
  Distance between 3'-terminus of neighbour sequence of sequence listing upward to telomere on chrosomal short arm and 5'-terminus of this base sequence : 118622
gctctaggacaggcagtctctccccagctagaaagtttttgtttctttttaagatgccaacacatcattatatatagaatatatatatatatatatacacacacacacacacacacatatatatatacacacacaagaggtattttaaagtccttgttctctctttccactaaatccatcagctcc

SEQ ID NO: 5226 - DNA, 426 bp, Homo sapiens
  AC024724.3_126208
  Located on chromosome 3
  Distance between a terminus base of telomere on chromosomal short arm and 5'-terminus of this base sequence : 71033708
  Distance between 3'-terminus of neighbour sequence of sequence listing upward to telomere on chrosomal short arm and 5'-terminus of this base sequence : 128064
gtgatttgctaatacctgacatacaatatgctgtttagtctcttgaatagagactagtctcatccttatattttgtcatttttttgtggaacatacacaaaaattcaaatttttcatgttcaaaatttgactataatccctcttaggtagaacagatactttaaccacacacacatacacacacacacacacacacacacacacacacacacacacacattttgtaaggggatactgaggcccagggacttactcatagtcatgaagttactggcatttgactctggaaggggtgatagagatttcatcctatgacctcgctttacagaacaagtaatgaagctgagagaggctgggccacttgctcaaagagttacagcaagtgagtggaggggcggggggcggtcaggactcaaagtcacctat

SEQ ID NO: 5227 - DNA, 266 bp, Homo sapiens
  AC040915.2_22922
  Located on chromosome 3
  Distance between a terminus base of telomere on chromosomal short arm and 5'-terminus of this base sequence : 71246928
  Distance between 3'-terminus of neighbour sequence of sequence listing upward to telomere on chrosomal short arm and 5'-terminus of this base sequence : 212794
caattaagcctctttcctttataaattacccagtcctgtgtatgtctttattaacagcataagaatggactaatacaggtggtatacacacaagccttctacatgtgacaaagttgtttagaactaaatacacacacacacacacacacacacacacacaaatacacataaaatgggggaaatttgaacaagataagtagattgtatcattatctatatatctatagatatatatctatatactggttgtgatattgtagtttagc

SEQ ID NO: 5228 - DNA, 149 bp, Homo sapiens
  chr3.fa.O7frz.80212535
  Located on chromosome 3
  Distance between a terminus base of telomere on chromosomal short arm and 5'-terminus of this base sequence : 71292256
  Distance between 3'-terminus of neighbour sequence of sequence listing upward to telomere on chrosomal short arm and 5'-terminus of this base sequence : 45062
gactgtgatcaaatttaagcagcacagttcctaaaatatacccagccttatctgctcccacttgctgataaacacacacacacacacacactcacacacactcgcacacttttgctccagaaatgctgaactaatagttgccagaatac

SEQ ID NO: 5229 - DNA, 185 bp, Homo sapiens
  D3S1261
  Located on chromosome 3
  Distance between a terminus base of telomere on chromosomal short arm and 5'-terminus of this base sequence : 71455987
  Distance between 3'-terminus of neighbour sequence of sequence listing upward to telomere on chrosomal short arm and 5'-terminus of this base sequence : 163582
ggcaagttaggtggcagaagtgctttgaccctctgttagagggcaccaggcctggctggcaaatcttcaagcactcagcaccacagtatgtgtgtgtgtgtgtgtgtgtgtgtgtgtgtggatatatatatatatatatccactctcacatcacctccttcatttatttgctcccatttcaccca

SEQ ID NO: 5230 - DNA, 384 bp, Homo sapiens
  chr3.fa.O7frz.80584706
  Located on chromosome 3
  Distance between a terminus base of telomere on chromosomal short arm and 5'-terminus of this base sequence : 71563936
  Distance between 3'-terminus of neighbour sequence of sequence listing upward to telomere on chrosomal short arm and 5'-terminus of this base sequence : 107764
cctattaataccactaatgcagagagataagtcataggaattgctcccaacaaaaagacaaacagaaaaaaaaaatacagctgttgcagaaccaagagtagatatagatgaaaaaacatatcctaccaagtgttagaaagcctaaactaagcctgtttttgaatcagatttgtgtctcaatacacacacacacacacacacacacacacacacacagacacacagtctttttgtcctcagcacacagggtctgagagataaataatactttatatgcttgtaaaataaaggacagattccatagttattcagataaattagagattattttgtgctgggagttcagcaggaaagactcaaagaggtgaagatcttagctaggtc

SEQ ID NO: 5231 - DNA, 348 bp, Homo sapiens
  chr3.fa.O7frz.80859686
  Located on chromosome 3
  Distance between a terminus base of telomere on chromosomal short arm and 5'-terminus of this base sequence : 71762340
  Distance between 3'-terminus of neighbour sequence of sequence listing upward to telomere on chrosomal short arm and 5'-terminus of this base sequence : 198020
ggtttagactttaaagctccagataaaccttgaaccaattcctctcagttataataaaacttggaaaatttagaacatcatataacttttctatttcctagaacctagttgttgccaatccttctttcagttaattaaaattcttttgcagggatatactttttaaaaatgaattgttcgacatactcttctggaaattttatttttcttttcccagttgcctatgtagtctttggaatggttctgtatgtctgtgtgtgtctgtgtgtgtgtgtgtgtgtgtttgtgtgtgtgtgtaagattgttactttcaaatagacttgctttctagtcattagacatccaatt

SEQ ID NO: 5232 - DNA, 376 bp, Homo sapiens
  AC027666.7_19524
  Located on chromosome 3
  Distance between a terminus base of telomere on chromosomal short arm and 5'-terminus of this base sequence : 71792770
  Distance between 3'-terminus of neighbour sequence of sequence listing upward to telomere on chrosomal short arm and 5'-terminus of this base sequence : 30082
gacagtcctacagaatgttctaatttgcttttatcacatgtagttgctacattttaggaaaacatgatttaaatatgaaacatgtaatataaattaatatagtggcatgatttattcaggttctcgatgcatataacctggaggtgactaaacgctgatctataacatggtcctatagcttggtactgagaatcacaactctgcgtgtgtgtgtgtgtgtgtgtgtgtgtgtgtgtgtgtgtgtatgttttgcatgttttcctttcctaccacaaacagtgttataaccagattatggcaaataaaagaacagttgtaaatttacccaaatatatcataaacaagttggaacactctggaattacagtcatatgat

SEQ ID NO: 5233 - DNA, 254 bp, Homo sapiens
  AC027666.7_125414
  Located on chromosome 3
  Distance between a terminus base of telomere on chromosomal short arm and 5'-terminus of this base sequence : 71820165
  Distance between 3'-terminus of neighbour sequence of sequence listing upward to telomere on chrosomal short arm and 5'-terminus of this base sequence : 27019
cttacttcaggacataaccattattgtgtatcctgctaggactattctatgcatcttcaagcatatatctctgtgtgtgtgtgtgtgtgtgtgtgtgtgtgtgtgtgtgtgtgtgtataatttttctacataaatatatgttattactatgaactaatgttaatctttcaccagagatcagttaacatgcatgtaactcttttttctagtttattttaaaatattagaatttctcagttgtagatttagccaga

SEQ ID NO: 5234 - DNA, 101 bp, Homo sapiens
  DISD22_0002773
  Located on chromosome 3
  Distance between a terminus base of telomere on chromosomal short arm and 5'-terminus of this base sequence : 72032677
  Distance between 3'-terminus of neighbour sequence of sequence listing upward to telomere on chrosomal short arm and 5'-terminus of this base sequence : 212258
gaggcagattaggagaccactcgtccggtgtggggggtgtgtgtctgtgtgtgtgtgtgttcgcgcgcgcgcaagacgtggaagccaagtgtgctgaaatg

SEQ ID NO: 5235 - DNA, 471 bp, Homo sapiens
  chr3.fa.O7frz.80932245
  Located on chromosome 3
  Distance between a terminus base of telomere on chromosomal short arm and 5'-terminus of this base sequence : 72162849
  Distance between 3'-terminus of neighbour sequence of sequence listing upward to telomere on chrosomal short arm and 5'-terminus of this base sequence : 130071
ggcttactgtaacctcaaactcctgtgctcaagtgatcttcttgccccagcctcctgagtagctagaaccacaggcacatgccaccatgcccagctaagggtgagctcttaagagttgagttgctatcctcctcctccttctcctcctcctcctcctcctcccctcctccttctcctcttcccctcctcctcccctcctccttctcctcttcccctcctcctcccctcctccttctcctcctcccctcctcctctcctcctcctcctcctcctcctcctcttccttcccacttctgcagaaaagggagctgaggctgtctgtggtctctaccacagagcacctcataagccctacttgcttttccacattttctgtcttttcattattaccatatttatatacacatcaaaagagaaaagatggccaatactattttaatttgccaagcctgtcttcagattgctgattta

SEQ ID NO: 5236 - DNA, 102 bp, Homo sapiens
  DISD22_0002788
  Located on chromosome 3
  Distance between a terminus base of telomere on chromosomal short arm and 5'-terminus of this base sequence : 72484608
  Distance between 3'-terminus of neighbour sequence of sequence listing upward to telomere on chrosomal short arm and 5'-terminus of this base sequence : 321288
tttacacagttggttcttaaggaggtgtgtgtgtgtgtgtgtgtgtgtgtgtgtgtgtgtgtgttttaaaaagaaagctgttctgttcgccaaggaaagtga

SEQ ID NO: 5237 - DNA, 102 bp, Homo sapiens
  DISD22_0002793
  Located on chromosome 3
  Distance between a terminus base of telomere on chromosomal short arm and 5'-terminus of this base sequence : 72555229
  Distance between 3'-terminus of neighbour sequence of sequence listing upward to telomere on chrosomal short arm and 5'-terminus of this base sequence : 70519
ggcatctgaattgaatactggaatatcgtgtgagtgtgtgtgtgtgtgtgtgtgtgttttactaagattcatgccactcaaagtgtgacccatggactggac

SEQ ID NO: 5238 - DNA, 445 bp, Homo sapiens
  chr3.fa.O7frz.81869601
  Located on chromosome 3
  Distance between a terminus base of telomere on chromosomal short arm and 5'-terminus of this base sequence : 72679692
  Distance between 3'-terminus of neighbour sequence of sequence listing upward to telomere on chrosomal short arm and 5'-terminus of this base sequence : 124361
acttcctgtaatgcttctgatctgactgtcagctttttcctacttttaattttcttcttaaattgtaatatacaataatcaaggcctttcttttttagacctatttgaattatttatattttccctagaagtataactgtaggatcccttaaaaacatgtaaaagtagaaagatttccttttggaacaagagagaatattctgggcaaaatcaaaagcaagtaagttgaaaattggggcttttcatctccgggggatctgcagcaataccttcacccacatttctgtcctgatatttaccagtaaatagtcatttcacagcccataagaatccttcatctttagcttcccccacttacacacagacacacacacacacacacacacacacacacacacaattaacgtgttatagtggtgttacctgaagattagacatttgccta

SEQ ID NO: 5239 - DNA, 466 bp, Homo sapiens
  chr3.fa.O7frz.81730591
  Located on chromosome 3
  Distance between a terminus base of telomere on chromosomal short arm and 5'-terminus of this base sequence : 72693459
  Distance between 3'-terminus of neighbour sequence of sequence listing upward to telomere on chrosomal short arm and 5'-terminus of this base sequence : 13322
gacttgaaatggttaatactgagtgtcaacttgattagattaaaggatgcaaagcattgatcctgggtgtgtctgtgatggtgttgccaaaggagattcacatttgagtcagtgggctgggaaaggcaaacccacccttaatctggagggcacaatctaatcagctgccagtgcatctagaatataagcaggcagaaaagtgtgaaaaagagaaactggcctagcctcccagcctacatctttctcccgtgtggggtggttcctgccctcaaacattgggctccaagttcttcagttttggaactcgaactggctctccttcctcctcagcctgcagacggcctattgtgaaaccttgtgatcatgtgagttaatacttaacaagctcccctgtgtgtgtgtgtgtgtgtgtgtgtgtgtgtgtgtgtgtgtataggatcttttgtaataacagcttagctatgcg

SEQ ID NO: 5240 - DNA, 241 bp, Homo sapiens
  D3S1566
  Located on chromosome 3
  Distance between a terminus base of telomere on chromosomal short arm and 5'-terminus of this base sequence : 72893363
  Distance between 3'-terminus of neighbour sequence of sequence listing upward to telomere on chrosomal short arm and 5'-terminus of this base sequence : 199438
gctgctgaagcaccaaatctctcacgttctattgattaattctactctcttaggatataatttgtaacttgtaattttactattgccagcgacattttttaggtaattgagaagtcatgccctgtgtttttattgttattgacaatattcggtatttttcttttaatgaatcacacacacacacacacacacacacacacacacacacacaaacacaaacctcagaatgatttccaacgag

SEQ ID NO: 5241 - DNA, 251 bp, Homo sapiens
  D3S2454
  Located on chromosome 3
  Distance between a terminus base of telomere on chromosomal short arm and 5'-terminus of this base sequence : 72985327
  Distance between 3'-terminus of neighbour sequence of sequence listing upward to telomere on chrosomal short arm and 5'-terminus of this base sequence : 91723
ccaggcagtgcataactttcaagtgggtggtgccacttgtatgaactgcaatgtgaatgggcactctatcagtcatacaaccactgggagatctctctctctctctttctgtgtgtgtggatagatagatagatgatagatagatagatagatagatagatagatagatagatagatagagagatgtaaaggggtctgttacagggatttgaacttacacaatttggggagctggttaaacagtccctgta

SEQ ID NO: 5242 - DNA, 437 bp, Homo sapiens
  chr3.fa.O7frz.82186337
  Located on chromosome 3
  Distance between a terminus base of telomere on chromosomal short arm and 5'-terminus of this base sequence : 73115459
  Distance between 3'-terminus of neighbour sequence of sequence listing upward to telomere on chrosomal short arm and 5'-terminus of this base sequence : 129881
tgatctgttggttacaagaaacactcttgaaatataaagacccacatagactaaaaaaaaaggatggaaaaaaatatgatattccatgtcaatggaaaccaaaaaagagcaagaatagccatacttatatcagacaaaatatatttcaagacaaaagctataaaaagagacaaattcattatgtaatgataaaggggtctatcagcagaagaataaaacaattgtaaatatatacatacacaacactggaggacagatatataaagcaaatatcattagagctaaagagagaaatagatcccaaaacaataatagctggagatttatttatttatttatttatttatttatttatttatttattttttattgttatactttaagttttagggtacatgtgcacattgtgcaggacagttacatacgtatacatgtgc

SEQ ID NO: 5243 - DNA, 376 bp, Homo sapiens
  chr3.fa.O7frz.82408168
  Located on chromosome 3
  Distance between a terminus base of telomere on chromosomal short arm and 5'-terminus of this base sequence : 73338593
  Distance between 3'-terminus of neighbour sequence of sequence listing upward to telomere on chrosomal short arm and 5'-terminus of this base sequence : 222697
tgcctgttatagcaaacaatacatatatatatatatgcacacacacacacacacatatatatatacacacacgcacacacacatacacacacacacacacacacacacacacacatatatatatatatatatatataactcctaatagaggtagattgctttgttctttatacaaatgaaaacaggggaatggtttggattccaagggaagaacagagaaatgagctggggaattgacagtggaattggctatatgccaacactttttaatctatgctttagtaagctttttgccaatatggaatacaataggcttctttgcatacttgatgttattctggatagcagcccaagctttaagaaatctaggctggac

SEQ ID NO: 5244 - DNA, 242 bp, Homo sapiens
  AC012019.10_124171
  Located on chromosome 3
  Distance between a terminus base of telomere on chromosomal short arm and 5'-terminus of this base sequence : 73386961
  Distance between 3'-terminus of neighbour sequence of sequence listing upward to telomere on chrosomal short arm and 5'-terminus of this base sequence : 47992
cttccattagtaatgcagatagagttgcaggagagagtaaaaaggaccacaggacacaatttgtcttgtgtctaatggggaaactgaagctaaaggaaaagacccaataatatggtagggagataaagaaaagctaatgaacacatacacacacacacacacacacacacacacacacacacctttctccaaagcattttgactttgcatccagagctgtatctcacgtaagaattagcatc

SEQ ID NO: 5245 - DNA, 439 bp, Homo sapiens
  chr3.fa.O7frz.82620140
  Located on chromosome 3
  Distance between a terminus base of telomere on chromosomal short arm and 5'-terminus of this base sequence : 73549076
  Distance between 3'-terminus of neighbour sequence of sequence listing upward to telomere on chrosomal short arm and 5'-terminus of this base sequence : 161873
agaagtcaaaacagactgcacatgcacatagatgggagagatgcatccaaaaaaaaaaagagagagagagagagagagaaatgtttgtgcccgcattcttcattccatctggcacacgattggagtaaacttatctgggcaaatgtcgggctccgatcattaccctgaaaaccctagggcccttttggagaatgtcagcgaggccatcggtgtcggtgtatgggtggacggtgcatgtaccacagagccaaatgtgaaccctacacacgccacccagaaaaacctgggcttttcccaaaaggaagtgaagacagaccgcacgctcacggaaatagcgtttgtgccttcctgccatctggaacaggagcccggcaggagtaaactgacggggggagtaaaatgctgctttttcccaatacgtagttacgttagatctgga

SEQ ID NO: 5246 - DNA, 368 bp, Homo sapiens
  AC069425.7_142497
  Located on chromosome 3
  Distance between a terminus base of telomere on chromosomal short arm and 5'-terminus of this base sequence : 73652633
  Distance between 3'-terminus of neighbour sequence of sequence listing upward to telomere on chrosomal short arm and 5'-terminus of this base sequence : 103118
tatgaacttgtttaagatagccaggaaggcagtggtaggataaacacaagggataggaatgtatcaaaaaacagattaacacacacgcacgcgcgcacacacacacacacacacacacaaaacctgtacaaaatgctccaatcaatgagaacagaaaaaagaaatcttcaactatgttacagtttaaaagcagaaaaaaaaagttagggagtttctccctcccacatgtcaggaaatgtcatccaatattcttaaagcaaggataactaaataaaatacatgtgcagcatattctgcaattccgttacatacagtagttttttttccaaagctatttttttttagtatcgttaatataaagcagttgc

SEQ ID NO: 5247 - DNA, 368 bp, Homo sapiens; identical to SEQ ID NO: 5246
  AC069298.5_48293
  Located on chromosome 3
  Distance between a terminus base of telomere on chromosomal short arm and 5'-terminus of this base sequence : 73652633
  Distance between 3'-terminus of neighbour sequence of sequence listing upward to telomere on chrosomal short arm and 5'-terminus of this base sequence : -368

SEQ ID NO: 5248 - DNA, 466 bp, Homo sapiens
  chr3.fa.O7frz.82851061
  Located on chromosome 3
  Distance between a terminus base of telomere on chromosomal short arm and 5'-terminus of this base sequence : 73744577
  Distance between 3'-terminus of neighbour sequence of sequence listing upward to telomere on chrosomal short arm and 5'-terminus of this base sequence : 91576
tctggtaaccactcatggttttacacttgaacatggtgtgtgtgtgtgtgtgtgtgtgtatgtatgtatctctgtgtgtgtgtgtgtatctgtgtgtgtgtgtgtgttcagataatatttttctggtataaagatacacatctaattaaacagtaggcttcttaaatactcaatattttgagaaatatatgaaattacatttgtaattgcataactgaaatatataattaaatgttttttcactgagccatttttattaaaaaacacaatacagaatttgctttctcctgagagaaatggcatttactgtcacatactacttttacggtttctttacctctgtgtgtggaagctctgcctatgaaatatatagaaaacagtttaggaatagcaaacaaaaagttttcaattttaggggcattgtattttctattcttgaaaagcacttcaacagtggtattaatgc

SEQ ID NO: 5249 - DNA, 439 bp, Homo sapiens
  AC022074.16_67178
  Located on chromosome 3
  Distance between a terminus base of telomere on chromosomal short arm and 5'-terminus of this base sequence : 73795330
  Distance between 3'-terminus of neighbour sequence of sequence listing upward to telomere on chrosomal short arm and 5'-terminus of this base sequence : 50287
cctacagaagtgaacaattcactgtagaatttgcaacccatctggcatatatcaaagattcagagacgataacataggtatatgataacataggtatggccattctaaatgcacttcgctctgaaatgcatagggggttgacaactgccactctctgcccatctactaccatcagaaagcctcagtattatataaaattcaattttttgtgtgtccagaccactgtaggatctcacaagtaataacccaaaccaacatcatcataatataatgatcagaacaacagctataagaagggcaggtaacattttgagctacaggtgccagattctgtgtgtgtgtgtgtgtgtgtgtgtgtgtgtgtgtattcttaaattaatcctctgaattaatctgctgggtagacatttctactttatagaagctcaaaagtgagctt

SEQ ID NO: 5250 - DNA, 466 bp, Homo sapiens
  AC069425.7_133878
  Located on chromosome 3
  Distance between a terminus base of telomere on chromosomal short arm and 5'-terminus of this base sequence : 73819674
  Distance between 3'-terminus of neighbour sequence of sequence listing upward to telomere on chrosomal short arm and 5'-terminus of this base sequence : 23905
gtttggttgctagttggaaaggcagagagagggactatagatgacagtgcagagaaaaatatggtggggaagaggagaaaggttacacacatttaaggctaaaataaagcaagcaaagaaaaacaaagtaatgaagactctatataacttaccacattccaccaaatactgggagaatgggcactcaattattattattattattattttatttatttatttatttatttatttatttattttggagacggagtctcgctctgtcacccaggctggagtgcagtggtgcaatctcagctcgctgcaacctctgcctcccgggttcaagcaattctcctgcctcagcctcctgagtagctgggactacagacgtgtgccaccacacccagctaatttttgtatttttagtagagacggggtttcaccatgttggccaggctggtctctaactcctgacctcaggtga

SEQ ID NO: 5251 - DNA, 186 bp, Homo sapiens
  D3S1562
  Located on chromosome 3
  Distance between a terminus base of telomere on chromosomal short arm and 5'-terminus of this base sequence : 73879232
  Distance between 3'-terminus of neighbour sequence of sequence listing upward to telomere on chrosomal short arm and 5'-terminus of this base sequence : 59092
agcttagtttcttcatccataaaatgtgagtctggatcatctaaggaattttagaaatgctatgactctacagataaggaataaggagcaaagcgaatacacaatgtatgcacatgcatacacacacacacacacacacacacacacacacacacacacacacacacaccccaatataccccaggg

SEQ ID NO: 5252 - DNA, 466 bp, Homo sapiens
  AC069204.3_182407
  Located on chromosome 3
  Distance between a terminus base of telomere on chromosomal short arm and 5'-terminus of this base sequence : 73932802
  Distance between 3'-terminus of neighbour sequence of sequence listing upward to telomere on chrosomal short arm and 5'-terminus of this base sequence : 53384
caagtcaggcagaagtaaattaacttggctgatcaattatttatatgaagcagaataaatgcccttaaagaagttggtctcttcataaaaggatgtgtaaattaaactaaacatagttttgtaaaatatgtttctatttctatggggagaagagaagttaatggtgaaatcactattaggaaaattattagagtaattacacagtccaccccccatccgaaaagaaaaattctctttctcattgttcatccatgtgcagagaaaaaaggaagatggcatgcaattctgaagagataacagaagctcatggaaaaggaaggaggaaggaaggaaggaaggaaggaaggaaggaaggaaggaaggaaggaaggaaaagaatgtgaatttcactgtgtagatttcattattttggaaatattgaacacatgcctcttactttattgtcagttaactccatgcagttagt

SEQ ID NO: 5253 - DNA, 278 bp, Homo sapiens
  AC069204.3_41179
  Located on chromosome 3
  Distance between a terminus base of telomere on chromosomal short arm and 5'-terminus of this base sequence : 73959843
  Distance between 3'-terminus of neighbour sequence of sequence listing upward to telomere on chrosomal short arm and 5'-terminus of this base sequence : 26575
cctactgaacctcacaactcacctctagccatgaaagtttttgcagaccacctccaccaccagatctggaagagccccatcaagttttatactaaactcttgcagagtaatcattatactacattctagttttctgaatgtttacctgtaagctagggatcatgtcttgcccctaacaggataccaggcagtttgataaataatttaatgtcagacgagtgaatgaatgaatgaatgaatgaaatattatacagctagaatgaaagacctggtaactg

SEQ ID NO: 5254 - DNA, 462 bp, Homo sapiens
  AC011319.15_188270
  Located on chromosome 3
  Distance between a terminus base of telomere on chromosomal short arm and 5'-terminus of this base sequence : 74028708
  Distance between 3'-terminus of neighbour sequence of sequence listing upward to telomere on chrosomal short arm and 5'-terminus of this base sequence : 68587
gccagtaaatatgataggagtgagattcaaacacaactaactcttactaaggtcatcaatgacttccatattgacaaatccaatggtcagttctttgtcatcatcttttttgaccacttggcagaatttgatatggctcacaactctcttcttatttatttatttatttatttatttattttttgagatggagtctctctctgtagcccacgctggagtgcagtggtgcgatcttggttcactgcaacctccgtctcccgggtcccagttcaagcaattctcctgcctcagcctcctgagtagctgagattacaggaatgagccaccatgccgagctagtttttgtatgtttagtagagacagggtttccccatgttggccaggctgatcttgaactcctgacctcatgatccgcctgccttggcctcccaaagtgctggtattacagtcatgagccactgt

SEQ ID NO: 5255 - DNA, 448 bp, Homo sapiens
  AC011319.15_23593
  Located on chromosome 3
  Distance between a terminus base of telomere on chromosomal short arm and 5'-terminus of this base sequence : 74067424
  Distance between 3'-terminus of neighbour sequence of sequence listing upward to telomere on chrosomal short arm and 5'-terminus of this base sequence : 38254
gatacttctaaccactgctttcagtctaagcaagtttgaccaacaataccagcatggcccttgaagcagccttcatattaagggcctataaagaaatctcctacaaatgtattattattattattattattattattattatcactattttagaggtgggtctcactatgttgtccaggctgaagtgcagtggctattcacaggcatgctcatagcacactgcagcactgaactgccaaagcaatcttcccacctcctccccacaagaagctaggactatagggcatgtgtcaccatatctggctcaaaatggcattattttgtatgaaacatctgtgggatttgaatggagaagagaacgcctgatgaatgtattctttgtataccaaatatacagtggactttaacacttagtgataaaaatgtaatgatttacattctgctgaca

SEQ ID NO: 5256 - DNA, 194 bp, Homo sapiens
  D3S3568
  Located on chromosome 3
  Distance between a terminus base of telomere on chromosomal short arm and 5'-terminus of this base sequence : 74265621
  Distance between 3'-terminus of neighbour sequence of sequence listing upward to telomere on chrosomal short arm and 5'-terminus of this base sequence : 197749
aaaacaatgctctatgtgtatggtcattagtgctgtcttatttgacttctaatattttaaagtaaccaggcatatctaaaaataaagggtgaatcaccactgtggtgtgtggaagtgtgtgtgtgtgtgtgtgtgtgttgttaagaattcaacagtcacaggactgaattccatcttcatggaaccccatagct

SEQ ID NO: 5257 - DNA, 249 bp, Homo sapiens
  D3S3516
  Located on chromosome 3
  Distance between a terminus base of telomere on chromosomal short arm and 5'-terminus of this base sequence : 74423780
  Distance between 3'-terminus of neighbour sequence of sequence listing upward to telomere on chrosomal short arm and 5'-terminus of this base sequence : 157965
aggctggtgaggaagataaggtatatatactacatatggggtattttcattatatgtttttcttttatacacacacacacacacacacacacacagttttgagtgactagtgaaaaggtcacaaattatatgtttcacgtggaatttttaaaacattgaattagttgctaacatttatttgtatttatttatttgagatggggtctcactctgttgcccaggctggagtacagtggcatgatctcagct

SEQ ID NO: 5258 - DNA, 459 bp, Homo sapiens
  AC026973.3_166599
  Located on chromosome 3
  Distance between a terminus base of telomere on chromosomal short arm and 5'-terminus of this base sequence : 74579257
  Distance between 3'-terminus of neighbour sequence of sequence listing upward to telomere on chrosomal short arm and 5'-terminus of this base sequence : 155228
gatgtaccttgcaattaatcagggagctttaaaaaaaatcctaacacttaggcctcatcctataaaaatcaaatcaaaatttttcagagtggtgggtgatggaaaaaatgggaactgtacttcaagaacagcatcataattgcatgtctaattttgggaaatgtgtactctgaaagtaccctaaaaatatatacacatatgcatatatatatatatatatatatatatatatatatatatatatatgggggataataaagtttatttaaagatcatgttgttaaagactgtcatctttgaaatacattaaaaaatcctggaacgaagatatatcatacaacacagtgactacagttaatactgtatacttgaaaatcactaagagatattaactgttctcattgcaaaataatgatgtgtgaggtagtctatacattaattagctcaatttagcattcc

SEQ ID NO: 5259 - DNA, 427 bp, Homo sapiens
  AC026973.3_119516
  Located on chromosome 3
  Distance between a terminus base of telomere on chromosomal short arm and 5'-terminus of this base sequence : 74626455
  Distance between 3'-terminus of neighbour sequence of sequence listing upward to telomere on chrosomal short arm and 5'-terminus of this base sequence : 46739
taaatgctagctgccattatcccacagtgtattagtcagggttctccagggaattggagccagcaggatacgtgtacataaatacccgtgtgtgtgtgtgtgtgtgtgtgtgtgtgtgtgtgtgtgtgtgtgttcatataagagagatatattactctgtatcagtaactcactcttagctttaagtaactcttacttacggatgaatacagagttacatatctctcttatatgagtatacacacatatatacacacatagatgtgtatgacagagagaaataaaaaggtgggagagagattgagattttaaagcattggctcatgcgatagtggaggctggtaaatccaacatctgcagggtggcccagctggctggaggccttagggaagagttggtattgcagttcaactttgaagacagtctg

SEQ ID NO: 5260 - DNA, 239 bp, Homo sapiens
  AC027486.3_80487
  Located on chromosome 3
  Distance between a terminus base of telomere on chromosomal short arm and 5'-terminus of this base sequence : 74875306
  Distance between 3'-terminus of neighbour sequence of sequence listing upward to telomere on chrosomal short arm and 5'-terminus of this base sequence : 248424
tgtactgaaactcctgtctcagagtctgctgctcgggggcgggtggggtggaagatagactcggtgggaggtagggttccttattctggaagaacttacatattcttatggagaaaacacacacacacacacacacacacacacacacacacacacgcatgcacagagaagtagagaaataacaaagactgtctcctgaaggtagaactgcgtggtatcatgtatcaaagatagaatgg

SEQ ID NO: 5261 - DNA, 426 bp, Homo sapiens
  G10117
  Located on chromosome 3
  Distance between a terminus base of telomere on chromosomal short arm and 5'-terminus of this base sequence : 74924148
  Distance between 3'-terminus of neighbour sequence of sequence listing upward to telomere on chrosomal short arm and 5'-terminus of this base sequence : 48603
gattttggcaaaatgaggtgccaacctttgaaactatcaaatcctcccctcctgtagaatttctccaccactgacaggacacatatttctcctatccttgccctgcaatatcccttctaaaactagatagatagatagatagattatagatagatagagagatagatagatagattatagatagatagatagattatagatagatagatagatagatagatagatagatagatagatagatagatatggtttggctttgtccccacccaaatctcatcttgaattctcacgtgttgtgggagggacttggtgggagggaattgaatcgtgggggcaagtcttccccatgctgttctcatgatagtgaaaagtctcacaagatctgatggttttaaaaagaggcgttcccctacacaagctctctca

SEQ ID NO: 5262 - DNA, 304 bp, Homo sapiens
  AC069212.10_86822
  Located on chromosome 3
  Distance between a terminus base of telomere on chromosomal short arm and 5'-terminus of this base sequence : 75034337
  Distance between 3'-terminus of neighbour sequence of sequence listing upward to telomere on chrosomal short arm and 5'-terminus of this base sequence : 109763
cttattctggacattgctgaagagggtcaaggcatgctttcggtttgatctagggtttctgtcagtgatcgctagtgattcatgtgatactgtaagaagtcagtcagggccttggtgttgacaaggttagatgattgattgactgactgactgactgactgactgactgactgatggtcactgtgggtttcactgtagctggctggctgtgatctggactgaccaggccatggactgtgggagcttgtgactatgactgggccaactgcaactgggctgatggattcagtggattgaacatgac

SEQ ID NO: 5263 - DNA, 413 bp, Homo sapiens
  AC069212.9_117815
  Located on chromosome 3
  Distance between a terminus base of telomere on chromosomal short arm and 5'-terminus of this base sequence : 75208098
  Distance between 3'-terminus of neighbour sequence of sequence listing upward to telomere on chrosomal short arm and 5'-terminus of this base sequence : 173457
atagtccaggtggatgctaaatgccccttcttcagggaggacttccctgactaggacatcttacatagcataatccccagtcactgccaccctcaccctgctttatctttctttacacccttagcatgacctagcactgtatgatggtgtgtgtgtgtgtgtgtgtgtgtgtgtgtgtgtgtatgtatgttttggcctggttcatccagtagaatgtaatatttgttgggacagggactttcctttgttcaatcctagtttgtgggcctgtctccctgtgagtttttgccatagcagtccagccacacatgccagagcccaggaaatggatgatgaactttagtacattccagtttgagccttgtgaatattcaggtgagtggttccctatgatggtatgatttccttcagtt

SEQ ID NO: 5264 - DNA, 301 bp, Homo sapiens
  D3S1598
  Located on chromosome 3
  Distance between a terminus base of telomere on chromosomal short arm and 5'-terminus of this base sequence : 75355084
  Distance between 3'-terminus of neighbour sequence of sequence listing upward to telomere on chrosomal short arm and 5'-terminus of this base sequence : 146573
agctatggctgacatcttgcttgcaaactgatgaaagacccagaagcaggggacctggctgaactgcgcccagattcctgacccatggaaactgtgagataatgagagagagagagagagagagagagagagagagagagagagagtgtgtgtgtgtgtgtgtgtgtgtgtgtgtgtgtgtttaaatatatatatttttcgtagagatggagtcttgctttgttgcccaggttgatcttaaacttctggcctcaaacgatcctcccaaagtgctgggattacaggcgtgagccaccatgtc

SEQ ID NO: 5265 - DNA, 436 bp, Homo sapiens
  chr3.fa.O7frz.84455869
  Located on chromosome 3
  Distance between a terminus base of telomere on chromosomal short arm and 5'-terminus of this base sequence : 75357375
  Distance between 3'-terminus of neighbour sequence of sequence listing upward to telomere on chrosomal short arm and 5'-terminus of this base sequence : 1990
tagctgtaatcctgtttccagaatgtgcgttggcctcttcccttctttctttgttggaagtccaaacctgcccaccagcatgtgcacccaagtctgagagttgacttaggggcagctgtttgaaggacagcggggatggacatggagtttgaaggacatggatatgcagctggagtgtccacaaacgagagagagagagagagagagagagagagacagagacagagacagagacagagagagaaagacagcatgcatgagtgagggacattcttcacaatgcaaaatggaacgagaggtggaacagaaggggagtgggtggagtcagggctgctctccctgcaagatcacatttgggtgtggaggaccaaggagcccgagaaatctaaagtccatcctggtgttgcagggcattaggaagatacatttgtccaag

SEQ ID NO: 5266 - DNA, 384 bp, Homo sapiens
  AC068222.2_145491
  Located on chromosome 3
  Distance between a terminus base of telomere on chromosomal short arm and 5'-terminus of this base sequence : 75394588
  Distance between 3'-terminus of neighbour sequence of sequence listing upward to telomere on chrosomal short arm and 5'-terminus of this base sequence : 36777
tgtgcagaaatctagatggtagaagactgcggcattttcaaagaaaacagaagcaatgtaaccaaagttcatgttgctggtgtgactggtggctagtgggtgctggctgtggcgagcaatatgactggacagttacacaggggctatgtcaggcacggccttgtacaacttttgagtttagaacttggacattataacaatggggcactatggaaagctgtgtgtgtgtacacgtgtgtgtgtgtgtgtgtgtctaatcagggtagtgactgggacaaagttaagtccttaaaagatgcttctggctagagttcacttattcagtaaataccttatgagcatgggaaagcaaactggtccaactactttggaaagctgtactga

SEQ ID NO: 5267 - DNA, 413 bp, Homo sapiens
  chr3.fa.O7frz.84772065
  Located on chromosome 3
  Distance between a terminus base of telomere on chromosomal short arm and 5'-terminus of this base sequence : 75600757
  Distance between 3'-terminus of neighbour sequence of sequence listing upward to telomere on chrosomal short arm and 5'-terminus of this base sequence : 205785
ccacgtgtctatgttcttaaacatacttcccagggggtgtgtgtgtgtgtgtgtgtgtgtgtgtgtgtgtgtgtgtgtgtatgtttgcttgagcaaagagaaggctgtaaactgacatatatgaggtagtagtcaatgaataacttgggtgggaaagatatttttggctatgtctatattagttagaatgttttcaactgcacggaagagaatacttgaataacaatggcttaaactagggctttctaactttatggtgtggatgaattatctgaggatctcataaaattgcaggtatgaatgtagtatatctgggcataacctgatattctgcacttctgacaagctgtagtaacctgttagatcctgctgctgctgctggtccaacactttaattagcaggatttgaataa

SEQ ID NO: 5268 - DNA, 419 bp, Homo sapiens
  AC026918.3_141967
  Located on chromosome 3
  Distance between a terminus base of telomere on chromosomal short arm and 5'-terminus of this base sequence : 75650526
  Distance between 3'-terminus of neighbour sequence of sequence listing upward to telomere on chrosomal short arm and 5'-terminus of this base sequence : 49356
tttgaatgcaagatagaatcatttctgaataagtgtcctccaagagtgagaggtgtattttgaatgtggctgttatttttctagttaaaacaggaatgtagagtgcaggaaaattagctttctgttctctacaaatgttgcttttatcttcttcagtagtttaaggaactttaaaattagtatcttaataaaatagattttatcttggtagaaaatatgagtgcacatgccaaaaatggtgtgtgtgtgtgtgtgtgtgtgtgtgtgtgtgtgtgtagccccttttagcctctttgtggagatgcagtatcctgaatttcctactcatctgcttgtttttctttgctggttgagttcaaaaattttttcctttattgaaattttactaaagtctgtagtacttgcatacctagcacaag

SEQ ID NO: 5269 - DNA, 366 bp, Homo sapiens
  AC024660.2_105228
  Located on chromosome 3
  Distance between a terminus base of telomere on chromosomal short arm and 5'-terminus of this base sequence : 75717098
  Distance between 3'-terminus of neighbour sequence of sequence listing upward to telomere on chrosomal short arm and 5'-terminus of this base sequence : 66153
gtcttggaaccagttcctaaagtataccaagggatgactctgctgtcatagtcgttatgttatgttatgttatgttatgttatgttatgttatgttatttatgttatgttagtatccgaaacagggtcttgctctgttgcccaggctggagtgcagtgatgtgtccatggctcatggcagcctcaaccacccgggcacaagcagttctcccaccccagcctcccatgtagtgtcttggtctttaaaattttttcttcacctaggttcttcttacctttccagtcttctctttccaccatttgtaactttttcacattacttgaagttcactgaatatgcagtgttctactgtgctggtgttaaatt

SEQ ID NO: 5270 - DNA, 240 bp, Homo sapiens
  AC024660.2_85290
  Located on chromosome 3
  Distance between a terminus base of telomere on chromosomal short arm and 5'-terminus of this base sequence : 75898127
  Distance between 3'-terminus of neighbour sequence of sequence listing upward to telomere on chrosomal short arm and 5'-terminus of this base sequence : 180663
caggtaactgtttgctatccaggtctatagagatctcctctacatgaggggccggaggtctgggtggaggggcttagcagaggctttgatgaattctgctgctgtttctaaaccttcgtctttccaggggaaaacaaaacaaaacaaaacaaaacaaaacaaaacaaaacaaaacagcatggaatggtggcacaagtgaagagtttagcattatccttagtagaagcgaagtcacttgtc

SEQ ID NO: 5271 - DNA, 318 bp, Homo sapiens
  D3S2406
  Located on chromosome 3
  Distance between a terminus base of telomere on chromosomal short arm and 5'-terminus of this base sequence : 75988081
  Distance between 3'-terminus of neighbour sequence of sequence listing upward to telomere on chrosomal short arm and 5'-terminus of this base sequence : 89714
ggctggatgatccactttaaagatagcctttacagtcacatacctggtactgcagtgtttcttgacattatctatctatctatctatctatctatctatctatctatctatctgtctgtctgtctgtctgtctgtctgtctgtctgtccgtctgtccgtccgtctgtccgtccgtccatccatccatccatccatccatccattatttatctaattttttctaaagcctctccatgtggctcagcttctcagagcaagatggtttcagggcagtggtactttttgcatggtgactgactttcaagaagcaggaactgg

SEQ ID NO: 5272 - DNA, 428 bp, Homo sapiens
  chr3.fa.O7frz.85266269
  Located on chromosome 3
  Distance between a terminus base of telomere on chromosomal short arm and 5'-terminus of this base sequence : 76097913
  Distance between 3'-terminus of neighbour sequence of sequence listing upward to telomere on chrosomal short arm and 5'-terminus of this base sequence : 109514
caaagtttctaccatttccttctctcaagtttcaaccctaagggcagaggaaggagcgaattgagggctctgagctgttaagtctctgtcttgctttctctcttgagctgctgcttctggtgtcttgatatctccctgctctgtggacttcattgttgtgggggaaactgccttttcctttcccagttagcatcatggcttagccttagtggtgaaagggctgaagggaaaataaaaagaaaaaaaaatcacaaggaaaaatacttagtaaaatatcctttgacacatgcaaaagctgcttatttcctgcaatatagaagaaacatggtgagtgtgtgtgtgtgtgtgtgtgtgtgtgtgtgtgttttattggagacgcagtaaaaatcagctctcattctacctggtccagttatcaagaacatcaa

SEQ ID NO: 5273 - DNA, 269 bp, Homo sapiens
  AC024102.11_960
  Located on chromosome 3
  Distance between a terminus base of telomere on chromosomal short arm and 5'-terminus of this base sequence : 76236165
  Distance between 3'-terminus of neighbour sequence of sequence listing upward to telomere on chrosomal short arm and 5'-terminus of this base sequence : 137824
gtgagttactctgatgctgtctctcaaaccatgctaacacttcgctcagtggttacagttgaataatattttaagatattcatgaggcaacgactagtgccaattctctaacggtccatatatctgtgtgtgtgtgtgtgtgtgtgtgtgtgtgtgtgttttaagtccatgcagttgtctttaacttgttcttctgcataatttattgggcagctgtcaaacacacatgttctcctgtctcacagctgacatttgtacagtgataaatg

SEQ ID NO: 5274 - DNA, 102 bp, Homo sapiens
  DISO7_10001116
  Located on chromosome 3
  Distance between a terminus base of telomere on chromosomal short arm and 5'-terminus of this base sequence : 76365700
  Distance between 3'-terminus of neighbour sequence of sequence listing upward to telomere on chrosomal short arm and 5'-terminus of this base sequence : 129266
gaaaccaattgctgtctggtttgaaagcaattgccattctgtgtgtgtgtgtgtgtgtgtgtgtgtgtgtgtgtgtatgtaagattagaggagctcaccttt

SEQ ID NO: 5275 - DNA, 108 bp, Homo sapiens
  DISO7_10001117
  Located on chromosome 3
  Distance between a terminus base of telomere on chromosomal short arm and 5'-terminus of this base sequence : 76369541
  Distance between 3'-terminus of neighbour sequence of sequence listing upward to telomere on chrosomal short arm and 5'-terminus of this base sequence : 3739
ggctagtgcacaagtaaagttgttaataaataatgataaggacaatcatcatcatcatcattatcatcatcatcatcatcatcatagcaaagccttatactaagagcc

SEQ ID NO: 5276 - DNA, 292 bp, Homo sapiens
  chr3.fa.O7frz.86135908
  Located on chromosome 3
  Distance between a terminus base of telomere on chromosomal short arm and 5'-terminus of this base sequence : 76390123
  Distance between 3'-terminus of neighbour sequence of sequence listing upward to telomere on chrosomal short arm and 5'-terminus of this base sequence : 20474
ctactccttacaggccattaacccaaacccagctagatattttcttcttcttcttcttcttcttcttcttctttttttttttttagagagagggttgcccaggctggtgtgcagtggcacaattataacgatccttcttccttagcctcccccagctgaacagttctaattggctagagaagaaaaagctagtttgaatgaccaacctctttcctaatttctcattcctaaagatattgaggaaagaagaagagatgtcttgacatgtctgtacattaccgtgatcagtttc

SEQ ID NO: 5277 - DNA, 363 bp, Homo sapiens
  AC073518.3_135059
  Located on chromosome 3
  Distance between a terminus base of telomere on chromosomal short arm and 5'-terminus of this base sequence : 76681682
  Distance between 3'-terminus of neighbour sequence of sequence listing upward to telomere on chrosomal short arm and 5'-terminus of this base sequence : 291267
cctactcatacagttgtcctgtgtgtgtgctgctgttgttgtacttatcagtttggtttgctttataattgtgtgtgtgtgtgtgtgtgtgtgtgtgtgtgtgtgtgtgagagagagagagagagagagaggaagagagagagagaaagattggttgaagcaataaccacaatttactttggcttccaagctgacttctaaaagcatgcaaagcaaaagaaaaaaaaaaaaactaccacacacagaagacaaacaaaaattgtgtgtcaggtaaaaaggcaaagggattggatttaaagaaagaaaagatgtggaatttcatgtcactgccactgtcccatctacattctcataacttgcgac

SEQ ID NO: 5278 - DNA, 156 bp, Homo sapiens
  D3S3581
  Located on chromosome 3
  Distance between a terminus base of telomere on chromosomal short arm and 5'-terminus of this base sequence : 76725208
  Distance between 3'-terminus of neighbour sequence of sequence listing upward to telomere on chrosomal short arm and 5'-terminus of this base sequence : 43163
attaatcatgaaccaatggactgtgtgtgtgtgagtgtgtgtgtgtgtgtgtgtgtgtgttttaatgtaggataaagatccatagtcattattcttgggtcttagacataagaaatctggaaagatgtaatctgtcaaaattccagtttatttaat

SEQ ID NO: 5279 - DNA, 474 bp, Homo sapiens
  AC016930.11_22830
  Located on chromosome 3
  Distance between a terminus base of telomere on chromosomal short arm and 5'-terminus of this base sequence : 76904068
  Distance between 3'-terminus of neighbour sequence of sequence listing upward to telomere on chrosomal short arm and 5'-terminus of this base sequence : 178704
atgcctgtatcaatgtaactttacaacaactttgtaagttggtactgttttatctcaacttatagctgggacacccacccaaaaagtttggtacttggctgggcacggtggttcatatctgtaatcccagcaatttgggtggcagaggtaggaggattgcctgagctcaggagttcgagaccagcctgggcaacatagcaagacctcatcactactaacaacaacaacaacaaacaaacaaacaaaaaacagctgggcttggtagtgcatgtctgtaatcttagctactcaggagcctgaggaaggagcatctcttgagtgcaggagatgctggttgcagtgagctatgattgcaccactgcactccagcctgggttacagagcaagaccttgtctcaaaaaaaaaaaaaaaaaaaaaagaaagaaagaaaagaaagaagaaaaaaaaataaattaggttcctaagtccatgtc

SEQ ID NO: 5280 - DNA, 433 bp, Homo sapiens
  chr3.fa.O7frz.87548575
  Located on chromosome 3
  Distance between a terminus base of telomere on chromosomal short arm and 5'-terminus of this base sequence : 76904328
  Distance between 3'-terminus of neighbour sequence of sequence listing upward to telomere on chrosomal short arm and 5'-terminus of this base sequence : -214
ggtagtgcatgtctgtaatcttagctactcaggagcctgaggaaggagcatctcttgagtgcaggagatgctggttgcagtgagctatgattgcaccactgcactccagcctgggttacagagcaagaccttgtctcaaaaaaaaaaaaaaaaaaaaaagaaagaaagaaaagaaagaagaaaaaaaaataaattaggttcctaagtccatgtctttcttaatataatgcactgccttctcttatactgtgtgaagctcagaccagacctttcatgcttaaaaataaatgaacacataaatcttttttgactacattctatttgaatattaagttaaaattaataaaagaaaaacccctctaccacccttccactctatgtttcagttagagactacatgtttcctgaatcacatctagtgagcatctttgac

SEQ ID NO: 5281 - DNA, 364 bp, Homo sapiens
  AC024222.10_98443
  Located on chromosome 3
  Distance between a terminus base of telomere on chromosomal short arm and 5'-terminus of this base sequence : 77064029
  Distance between 3'-terminus of neighbour sequence of sequence listing upward to telomere on chrosomal short arm and 5'-terminus of this base sequence : 159268
ctgatttgttcaaccaatatttactgaagacctactatgtgctaggtgctgcattaggctgtgtgtcacagcagtgaagatagagaaaagggactctaggaggagaaaaataatgaacaaataaatatatgaaccagataaattcaaacagaacaaatgctgagcaagccagactatgagattataagtgggagaatgaaggggagatatatatatatatatatatatatatatatatatatatatatatatataaaattaaaaataggaacaaagtgttaccattaatattgccaattttctgtaagtattgctgtgttctatacaattttgctcaaaaatgtttacataaggccagatcatt

SEQ ID NO: 5282 - DNA, 270 bp, Homo sapiens
  AC016950.8_138407
  Located on chromosome 3
  Distance between a terminus base of telomere on chromosomal short arm and 5'-terminus of this base sequence : 77118168
  Distance between 3'-terminus of neighbour sequence of sequence listing upward to telomere on chrosomal short arm and 5'-terminus of this base sequence : 53775
ttgaatgagtaaatgacggtatgcctttagagagtcactgtaaaggagttggggctagtgaagctgggttgcaaggcactgacaccttataaataataagcaaatagattcagaaagtgtgcagactaatacaaacacacacacatatatgtgtgaactaattggatacagatagatagatagatagatagatagatagatagatagatagatagatagccagccctccatatctgcggtttctgcatctgcagattctgtagattcaac

SEQ ID NO: 5283 - DNA, 286 bp, Homo sapiens
  AC016950.8_145248
  Located on chromosome 3
  Distance between a terminus base of telomere on chromosomal short arm and 5'-terminus of this base sequence : 77125060
  Distance between 3'-terminus of neighbour sequence of sequence listing upward to telomere on chrosomal short arm and 5'-terminus of this base sequence : 6622
aaattatgagtaagtcctctccagggatcacaatataggaggcagaaatcatcattaccaatctgtattttccacagaagtgcaatggaaacggcacttcactcgacatctcatttgacatccatccatccatccatccatccatccatccatccatccatccatccatccatccatgcatccactcacctgacctgtttccatgaagggcttcagggagggggaagaacatactaaaatatagcacactccatattttttaatagaaagcctcaagtagaaatct

SEQ ID NO: 5284 - DNA, 415 bp, Homo sapiens
  chr3.fa.O7frz.86749837
  Located on chromosome 3
  Distance between a terminus base of telomere on chromosomal short arm and 5'-terminus of this base sequence : 77155545
  Distance between 3'-terminus of neighbour sequence of sequence listing upward to telomere on chrosomal short arm and 5'-terminus of this base sequence : 30199
ccacttacaatgaaagtcacttactatatacagtatatccagccaagtctcagcttgtgttttaaatccaaaactgggaggtgagatgccttactggtttcacattgcattatgcatgtgatgtgtactgtgggattcacatttgcatcctccatatggagaaacagtttatctatttctatttaactgcaaccatgggaagatttgtctttccatttctagctcataaaattacttttttataaatgaaactgaaaagaaactatggttatttagcttttacagataatgtattcatctaagttttctcttttatgtgtgtgtgcgtgtgtgtgtgtgtgtgtgtgtatatatatatatatatatatatatataacttgctcagtatgaagtgtagttcagtaccaaatcactt

SEQ ID NO: 5285 - DNA, 381 bp, Homo sapiens
  chr3.fa.O7frz.88021857
  Located on chromosome 3
  Distance between a terminus base of telomere on chromosomal short arm and 5'-terminus of this base sequence : 77258247
  Distance between 3'-terminus of neighbour sequence of sequence listing upward to telomere on chrosomal short arm and 5'-terminus of this base sequence : 102287
ctccgctgtactggtgtagagaccagaagagaattaaggggaagtgacttggctaaaatcatggggccagtgtgggcagacccagagccttctggcgacaaggctgggatgttacgtaggcgtctcttcaaagggaaccagtctccaccaatggtgcccatggtgaccgctccaggacaaacacactgtcagctgacccacatcctagatccttgacaactgagaaaaactaaagcagaacagagacaagccaggtgaaaagggcaacacgtgtgtgtgtgtgtgtgtgtgtgtgtgtgtgtgtgtatttcaattcattccaaagccaaacaaattattctagctcatctctggcctctagactctatcagtttctgctca

SEQ ID NO: 5286 - DNA, 250 bp, Homo sapiens
  chr3.fa.O7frz.86557879
  Located on chromosome 3
  Distance between a terminus base of telomere on chromosomal short arm and 5'-terminus of this base sequence : 77373351
  Distance between 3'-terminus of neighbour sequence of sequence listing upward to telomere on chrosomal short arm and 5'-terminus of this base sequence : 114723
tgattgtaaggtgtattccaacttcagagatggcaaaatgaaaaataattccttagaatagagggagacggtaatttctgtgttgttggtggtgaatttgtgcatgtgtgttttttatatatatacatatatatatatatatatacacacacacatatacgtgtatatatgtgtatatatagacatacctatatacatatacatatatatgtgtatatatggtgctgcagtggtacaatcatagctcgtt

SEQ ID NO: 5287 - DNA, 417 bp, Homo sapiens
  AC067827.2_78118
  Located on chromosome 3
  Distance between a terminus base of telomere on chromosomal short arm and 5'-terminus of this base sequence : 77467158
  Distance between 3'-terminus of neighbour sequence of sequence listing upward to telomere on chrosomal short arm and 5'-terminus of this base sequence : 93557
taaggatgttgctgtgagtaagagatgatgttcagcacaatacctaacgcacagtcaggtctccttaagcttgaacctgcatcgccatgacctctacatctcaggacagaaaggctcacagccagtgtatcagttcccagtgaaaagtggatcccagaccaggctgaacagcaggatccctaggggataccccaccctactgagtcagaatcaccagaggtagagcctgggtttgtatgtatgtatgtatgtgtgtgtgtgtgtgtgtgtgtgtgtgtatgtatgtatgtatgtatgtatgtatgtatgtatgtatgtatgtataagagacagggtcttgctctgcagtccaggctggagtgcagtgtcacaatcatagttcactgcatcctcaaattactcctgtcctcaagctat

SEQ ID NO: 5288 - DNA, 133 bp, Homo sapiens
  DISD22_0002812
  Located on chromosome 3
  Distance between a terminus base of telomere on chromosomal short arm and 5'-terminus of this base sequence : 77583037
  Distance between 3'-terminus of neighbour sequence of sequence listing upward to telomere on chrosomal short arm and 5'-terminus of this base sequence : 115462
tgcttacaaagcactgtggaaaactttgaggaaagttcttcctcaaagattataaagtcacaactatccactatttttatgtgtgtgtgtgtgtgtgtgtgtgtgtatgtattccaaatcacttgtgctagct

SEQ ID NO: 5289 - DNA, 133 bp, Homo sapiens
  DISD22_0002819
  Located on chromosome 3
  Distance between a terminus base of telomere on chromosomal short arm and 5'-terminus of this base sequence : 77850929
  Distance between 3'-terminus of neighbour sequence of sequence listing upward to telomere on chrosomal short arm and 5'-terminus of this base sequence : 267759
tgcagacattatttattgacagtgtaagattactagacacaatctagcacactctttaaacacacacacacacacacatacatacacacacacacacacacacacacgcagttttccatgtgctaccagttgg

SEQ ID NO: 5290 - DNA, 309 bp, Homo sapiens
  AC055114.2_149924
  Located on chromosome 3
  Distance between a terminus base of telomere on chromosomal short arm and 5'-terminus of this base sequence : 77962364
  Distance between 3'-terminus of neighbour sequence of sequence listing upward to telomere on chrosomal short arm and 5'-terminus of this base sequence : 111302
gataattacaaagcaatatggaacttagcaaacgtgaattttgacagtttcctgcagcttagtaaattctgcaaaaaattaagatttaacacaaaagtatagaaaaattttaatggcacagcacctttcttcacaattccttaaaccaaataattccctgttcttctaactctctccttatactatcaaccaggcttcttattcaatgaacggtttaagtctaacacacacacacacacacacacacacacacacacacacacacgtcttatccagctgcagatctcatgtttgaaggtacattgaaag

SEQ ID NO: 5291 - DNA, 425 bp, Homo sapiens
  chr3.fa.O7frz.89099055
  Located on chromosome 3
  Distance between a terminus base of telomere on chromosomal short arm and 5'-terminus of this base sequence : 78009126
  Distance between 3'-terminus of neighbour sequence of sequence listing upward to telomere on chrosomal short arm and 5'-terminus of this base sequence : 46453
cattcaaaataggaacctactttattttacgcacatacactctgagaatcttgagcaggtctcatcagtcatagagtattagaacagagagttttcaaagactgaccacacatgacttacctttcttgctttcctttctctctctctctctctccctccccttccttcccttccttcccttaccttccttcccttccttccctccctcccttccttccttccttccttccttccttccttccttccttccttcctctctctttctttcattctttctttctgtcttctttctttttgacagagcctcactctgttgcccagcctggagtgcggtggtatgatctcggcttactgcaacctctgcctcctgggttcaagccattctcctgcttcaggctcctgagtagagtagctgagattccagg

SEQ ID NO: 5292 - DNA, 436 bp, Homo sapiens
  chr3.fa.O7frz.89305161
  Located on chromosome 3
  Distance between a terminus base of telomere on chromosomal short arm and 5'-terminus of this base sequence : 78256054
  Distance between 3'-terminus of neighbour sequence of sequence listing upward to telomere on chrosomal short arm and 5'-terminus of this base sequence : 246503
ttcttatccatatcttgcagatacatttaaaggcaattaaaataactttatggggtagcagctcacgtttgctaaatttatttgaaatatcgccaagaaataacagagacactgaatttctgctgacatctctgccatttattagttgtatactctgaggcaaattatctgacttctgtgattctcacattctcacagtgctatttcatgtggaacaaacaaggtcatatatgcaaagtaactagcagtgtagcagtggtctttcaataaatattttcttcaggaaaaactatactcaaatcttttacttattgttagtattacacacacacacacacacacacacacacacacacacacccctaaaggctaattgctgggattcatggagcatttcttgtgtgccagcattgtgttaaatgctttccaagtataa

SEQ ID NO: 5293 - DNA, 466 bp, Homo sapiens
  AC026962.3_61785
  Located on chromosome 3
  Distance between a terminus base of telomere on chromosomal short arm and 5'-terminus of this base sequence : 78376485
  Distance between 3'-terminus of neighbour sequence of sequence listing upward to telomere on chrosomal short arm and 5'-terminus of this base sequence : 119995
tttgctgaatacatattgcatatttttttagtgtcacttttatggtaggaaatgtggctataggtttatggaagaagtgatacacatgcgcacgcacacgcgcacacacacacacacacacacacacacacacacacacattttatcagaccacagagaaatgttgaaatggtttggctgtgtccccacccaaatctcatcttgaattgtagttcccataatctccacatgtcgtgggagggacctgatgggaggtcactgaatcgtgagggcggttacctccatgcttttctcatggtagtgaatgagttctcatgagatctgatgggcttttccccctttgcttggcacttctccttcctgccatcacgtgatgaaggatgtgtttgcttccccttctgccatgattgtaagtttcctgaggccttcccagcctgcagaactgtgagtcaattaaaccttttcc

SEQ ID NO: 5294 - DNA, 381 bp, Homo sapiens
  AC026962.3_166382
  Located on chromosome 3
  Distance between a terminus base of telomere on chromosomal short arm and 5'-terminus of this base sequence : 78422994
  Distance between 3'-terminus of neighbour sequence of sequence listing upward to telomere on chrosomal short arm and 5'-terminus of this base sequence : 46043
ctcatagtctatgaggaaagtcagaaacgtaaacagatactttaagcatagaatagagttcactaatttggtcatggaaaatttttgagtgactactacatgcttagcagttttatcctaggcattgggtataccatggtgaagaacacacagacacacacacacacagacacacacacacacacacacacacacacacacacacttgctgcatcatggatcttcaaagttccagaaaggacagacattgaagaagtaattacaggtgttaaaatgttatgagaggaaagtataggtccatgggtagagttgctagatttagcaaataaaaatacaaaggtgcccagttaaatttcaatttcagatacacgatgaataact

SEQ ID NO: 5295 - DNA, 381 bp, Homo sapiens; identical to SEQ ID NO: 5294
  AC026877.9_72553
  Located on chromosome 3
  Distance between a terminus base of telomere on chromosomal short arm and 5'-terminus of this base sequence : 78422994
  Distance between 3'-terminus of neighbour sequence of sequence listing upward to telomere on chrosomal short arm and 5'-terminus of this base sequence : -381

SEQ ID NO: 5296 - DNA, 142 bp, Homo sapiens
  DISO7_10001118
  Located on chromosome 3
  Distance between a terminus base of telomere on chromosomal short arm and 5'-terminus of this base sequence : 78470555
  Distance between 3'-terminus of neighbour sequence of sequence listing upward to telomere on chrosomal short arm and 5'-terminus of this base sequence : 47180
caagaaagtcactggatggacttttcttactgttgtgtacatgaaatcttttttgtacatgtatatacaattatatatatatatatatatatatatataattttttgtctacatgttttgggttcaagtgctaagatatgtt

SEQ ID NO: 5297 - DNA, 178 bp, Homo sapiens
  D3S3653
  Located on chromosome 3
  Distance between a terminus base of telomere on chromosomal short arm and 5'-terminus of this base sequence : 78534916
  Distance between 3'-terminus of neighbour sequence of sequence listing upward to telomere on chrosomal short arm and 5'-terminus of this base sequence : 64219
cggctgctccagatttcgtggctcctgcagaccatctggacatatgtgtgcaggtcacaggggttataatggctgagctttggctcagaggcctgacagaactcacacacacacacacacacacacacacacacacacacaccatattcatacacatgtgggcaagtgtatgtatgca

SEQ ID NO: 5298 - DNA, 284 bp, Homo sapiens
  AC016942.8_5037
  Located on chromosome 3
  Distance between a terminus base of telomere on chromosomal short arm and 5'-terminus of this base sequence : 78552131
  Distance between 3'-terminus of neighbour sequence of sequence listing upward to telomere on chrosomal short arm and 5'-terminus of this base sequence : 17037
ttatccaaagttagaacttggaaaagattcatgaagaggtacccaggagcatgtcaaaaaagaagaagaggaagaggaggaagagtaggaagagagaagaagaagaagaagaagaagaagaagaagaagaagaagaagaagaagaagaagaagaaagaaggagaaggggaaggggaagaggaagaggaagaggaagagggaaaagaaaaaatagatccctctcatcttgagttgaaaatggtcagaaacaagaacacaatgtatgaagtatgcttaatgccaat

SEQ ID NO: 5299 - DNA, 186 bp, Homo sapiens
  DISO7_10001122
  Located on chromosome 3
  Distance between a terminus base of telomere on chromosomal short arm and 5'-terminus of this base sequence : 78580157
  Distance between 3'-terminus of neighbour sequence of sequence listing upward to telomere on chrosomal short arm and 5'-terminus of this base sequence : 27742
ctggattatttcctcaccgagaaaatttaaacgttgaatatttagtaactaaacattaaagtatgaaataactaagcactagtgagaaaaaggaaggtaatgaaagtctttttttgtagactagggagagaaattttagtggtgtgtgtgtgtgtgtgtgtgtgtgcatgcaagaaaccaagaaca

SEQ ID NO: 5300 - DNA, 247 bp, Homo sapiens
  DISO7_10001119
  Located on chromosome 3
  Distance between a terminus base of telomere on chromosomal short arm and 5'-terminus of this base sequence : 78721509
  Distance between 3'-terminus of neighbour sequence of sequence listing upward to telomere on chrosomal short arm and 5'-terminus of this base sequence : 141166
ttgtgaaatcaagtgaatattaaggtatctttacttttgatttgaacttcaaatttgacctttaaatttatatatataaatatatatatatatacacacacatatgtacacacatgcatatgtatatacgcacacatatatgtacgtgtgtgtatatatatataaaaaaattataatcaaggaaaatttttctgaatttgtgtctttattttcatttatactactagcacaagaactaacactaccc

SEQ ID NO: 5301 - DNA, 369 bp, Homo sapiens
  AL162871.2_40342
  Located on chromosome 3
  Distance between a terminus base of telomere on chromosomal short arm and 5'-terminus of this base sequence : 78832169
  Distance between 3'-terminus of neighbour sequence of sequence listing upward to telomere on chrosomal short arm and 5'-terminus of this base sequence : 110413
aagataatgacatgctcagacttttttttcttttttccttccttccttctttttttcttttcttccttcctttctttctctttcttttctttctttctttctttccttctttctttctttcctttctttctctcttttctttctttcttttctttctttctttcctttctttctctcctttctttcttttctttctttctttctttctttctttctttctttctttctttctttctttctctctgtctctccttccttctttccttccttcctttctttctctctctttctttctttctctctctctctctctctttctttctttctttctttcttgtttttttcttgagacaaggtcttactatgtca

SEQ ID NO: 5302 - DNA, 119 bp, Homo sapiens
  DISO7_10001129
  Located on chromosome 3
  Distance between a terminus base of telomere on chromosomal short arm and 5'-terminus of this base sequence : 78911819
  Distance between 3'-terminus of neighbour sequence of sequence listing upward to telomere on chrosomal short arm and 5'-terminus of this base sequence : 79281
cttggcataagaggcaaagggacttgtacttgggaagaaaagaaaaagaaaaagaaaaagaaatttgtattcattttatcatgttgccagttttctccactatttcacttctaacagtc

SEQ ID NO: 5303 - DNA, 323 bp, Homo sapiens
  chr3.fa.O7frz.90189023
  Located on chromosome 3
  Distance between a terminus base of telomere on chromosomal short arm and 5'-terminus of this base sequence : 79129693
  Distance between 3'-terminus of neighbour sequence of sequence listing upward to telomere on chrosomal short arm and 5'-terminus of this base sequence : 217755
gcaatttggttaaatgattataaccacacttattaagctttattttatgtgtaaaattttgagagaatcatcttgtctgtgtgtatgtgtgtgtatatatatatatatatatatatatatatatatatatatgtatctgtgtatatatatatataatctgtatatatatatatatatatatatatctgtgtgtgtgtatatatatatatgtcacctgagtgctttcttttgggggtaaagtatttgactgagacactaaagatttgaattgttgttctccattttactattgaccatgggccttaaggaagtcatttagctcc

SEQ ID NO: 5304 - DNA, 363 bp, Homo sapiens
  chr3.fa.O7frz.90511598
  Located on chromosome 3
  Distance between a terminus base of telomere on chromosomal short arm and 5'-terminus of this base sequence : 79317507
  Distance between 3'-terminus of neighbour sequence of sequence listing upward to telomere on chrosomal short arm and 5'-terminus of this base sequence : 187491
ctcgatgtaggtctatttcctagatggatggttgaacaatttctcaattgacatagtgtagagctttcttttcctttatttatttatttatttatttatttatttatttatttatttatttattttgcatggattatctaaggtaactgattagatttccactgcatattttcacagtgtagaaacagactatgaatcttcccagaaggcaggtcaaattcaattacatttttcatactggatgtttcagtctctgatttctcaggtaccaacaattcataccaaatgtccatatctggccctaactttcatctggccctgatgttattagaaagccttctaatggagtaataagcaatttga

SEQ ID NO: 5305 - DNA, 184 bp, Homo sapiens
  D3S1296
  Located on chromosome 3
  Distance between a terminus base of telomere on chromosomal short arm and 5'-terminus of this base sequence : 79475917
  Distance between 3'-terminus of neighbour sequence of sequence listing upward to telomere on chrosomal short arm and 5'-terminus of this base sequence : 158047
tgagaaggtgtgttagggtgtgtgtgtgtgtgtgtgtgtgtgtgtgtgtgtgtgcgtgctggaaattgtcaacagaatttttttaaagcaaaattgaagcgtactgtttttccccttattatagtccctatggtaaattgttatttggtttgttgatttccttatgaaaattacacccttcagg

SEQ ID NO: 5306 - DNA, 480 bp, Homo sapiens
  chr3.fa.O7frz.81251414
  Located on chromosome 3
  Distance between a terminus base of telomere on chromosomal short arm and 5'-terminus of this base sequence : 79546694
  Distance between 3'-terminus of neighbour sequence of sequence listing upward to telomere on chrosomal short arm and 5'-terminus of this base sequence : 70593
gtaaactcttagaagtgcaaacagtaaatcaaaagatatacactttatactttattattattttattattattattattattattattattattattttgaaagagggtctcattctgtcacccaggctggagtgcagtcttggctcacagcagcctcgacctccatactcaggagatcctcccacctcagcctccgcaggttcacaccaccatgcccagctaacttttgcattctttgtagagacagaatttcatcctcccaggccttccaaagtacaatgattaaaggcataagctactgtgcccaagcccactttttacatttttaattcataactagtttcttaatatctacataattgattttgccaaagacaatgtaggggagcttcccgttcttcctggtttgtggtgaacagtgggagttaacgaagtggtgagatggtgagacgtttgatacaactttcctaggtcaacag

SEQ ID NO: 5307 - DNA, 266 bp, Homo sapiens
  AC009972.5_100861
  Located on chromosome 3
  Distance between a terminus base of telomere on chromosomal short arm and 5'-terminus of this base sequence : 79551863
  Distance between 3'-terminus of neighbour sequence of sequence listing upward to telomere on chrosomal short arm and 5'-terminus of this base sequence : 4689
cttggactacaactataccatcagctctcttaggtctccagattgccaactacagcatccataactgtgtgagccaatttcttataatctctttctacacacacacacacacacacacacactcacacacaccacatacacatcctattggttgtttttctggagaactttggctaatacagttaccatctaactcatgctattttaaagaaaagacagtgaaatgttgtttctttcaaattaagtaatggttgcaaagattaaca

SEQ ID NO: 5308 - DNA, 141 bp, Homo sapiens
  DISD22_0002832
  Located on chromosome 3
  Distance between a terminus base of telomere on chromosomal short arm and 5'-terminus of this base sequence : 79694503
  Distance between 3'-terminus of neighbour sequence of sequence listing upward to telomere on chrosomal short arm and 5'-terminus of this base sequence : 142374
tcatcaggatctatcaggacctaatctccctgtctctctctctctctctctctctctctctctctctctctctttctctctctctctctctctctctcactctctctctttcatctttcacctgtactcttctttatgctg

SEQ ID NO: 5309 - DNA, 255 bp, Homo sapiens
  DISD22_0002836
  Located on chromosome 3
  Distance between a terminus base of telomere on chromosomal short arm and 5'-terminus of this base sequence : 79825743
  Distance between 3'-terminus of neighbour sequence of sequence listing upward to telomere on chrosomal short arm and 5'-terminus of this base sequence : 131099
ctaagttatggctgctgggggattagaaagctgcacaagaaattttggggcattttattatattttattttatttttttattttatttcattttattttattttattttattttattttattttattttattttatttttgcacaataagagaaaccttttatcctggactccaagaaataaatatatccctaataatgataataaaataataataatttaattttcctccctttcttaaccactcatacacatg

SEQ ID NO: 5310 - DNA, 194 bp, Homo sapiens
  DISO7_10001127
  Located on chromosome 3
  Distance between a terminus base of telomere on chromosomal short arm and 5'-terminus of this base sequence : 79983922
  Distance between 3'-terminus of neighbour sequence of sequence listing upward to telomere on chrosomal short arm and 5'-terminus of this base sequence : 157924
ctggtaagtagtctcagggtaccaaagataggagagagagagagagagagagagaaagagaaaagagaggggaaggaagggaaggggaggagattagaaaagagagagaatatttgacttttagaagtgtggacacaaaaaaataaaataaaaatgtactcttgatgttgtcaaatataatcatacagtctggc

SEQ ID NO: 5311 - DNA, 164 bp, Homo sapiens
  D3S3679
  Located on chromosome 3
  Distance between a terminus base of telomere on chromosomal short arm and 5'-terminus of this base sequence : 80019809
  Distance between 3'-terminus of neighbour sequence of sequence listing upward to telomere on chrosomal short arm and 5'-terminus of this base sequence : 35693
gatcatgccactatattccagcctgggcaatggagtgagactctggctctaaaattgtgtgtgtgtgtgtgtgtgtgtgtgtgtctagacagtgaaaaaaaacctaaaagtttaaagaatacaaaactaatacactaaatacacaccaggtactgtacaaggca

SEQ ID NO: 5312 - DNA, 379 bp, Homo sapiens
  AC025677.3_51515
  Located on chromosome 3
  Distance between a terminus base of telomere on chromosomal short arm and 5'-terminus of this base sequence : 80039758
  Distance between 3'-terminus of neighbour sequence of sequence listing upward to telomere on chrosomal short arm and 5'-terminus of this base sequence : 19785
gaaacaggttaagtgatagtcaaaaaacagaattagagatacattgttgccatttatcattatttgttgcatttgttgcacttgtttctaggtagacatactctacacttttaacgtgtgtatgtgtgtgtgtgtgtgtgtgtgtgtgtgtgtgtgtgtgtgtgtgtgtttgtgtatgtagacatatcttgccatcttacccaggctggtttgaaactcctggactcaagaaactctcctgactcagcctcccgaagtgctgagattgcaggcatgagccactgcacccagcctaatttttatttccatgtttttacacttttatatgaatatcttctatattttatcaccattgggatcctattccagaaactttgtt

SEQ ID NO: 5313 - DNA, 419 bp, Homo sapiens
  chr3.fa.O7frz.91454167
  Located on chromosome 3
  Distance between a terminus base of telomere on chromosomal short arm and 5'-terminus of this base sequence : 80050003
  Distance between 3'-terminus of neighbour sequence of sequence listing upward to telomere on chrosomal short arm and 5'-terminus of this base sequence : 9866
gttgataggaatgcaaattagtagaaccagtacagagaacagtttggaggtttctcaattcactaaaaatagagctaccataggagccagcaatcccactgctaggtctatatccaaaagaaagaaaatcagtatatttaagagatatccacactcccatgtttgttgcagcactgtttacaatagctaagatctggaagaaacctaggtgtccatcaacagatgaatggataaataaaatgtggtatatacacacacacacacacacacacacagtggagaactattccgctataaaaaaaaaatgagattctgtcatttgcaacaacatggatagaaatggaggtcattatattaagtgaaataagccagggacagaaaaataaaaatcatatgttctcagttatttgtggaattta

SEQ ID NO: 5314 - DNA, 368 bp, Homo sapiens
  chr3.fa.O7frz.91576066
  Located on chromosome 3
  Distance between a terminus base of telomere on chromosomal short arm and 5'-terminus of this base sequence : 80222480
  Distance between 3'-terminus of neighbour sequence of sequence listing upward to telomere on chrosomal short arm and 5'-terminus of this base sequence : 172058
agaacagtgtctagcctaggatcagcagctgtgccttattcaaaattcctgccagggatccgctgtttttggtgagtaaagcatataaagaagcctggtactttaagtgaaaatatattaaatatatatttaatttttaattattatattaaataattaattaaataattaattaattattaaataaataaataaataattatattatctattaaatacaaatatatttaatatatactacatagacatatataaagcatataaaagcccactaagtttggcattttaaaaaatcacagaattctttgtatgatcaagtatttatacccaatgacataattaacctgtataggcatacttgaaatgat

SEQ ID NO: 5315 - DNA, 420 bp, Homo sapiens
  AC013496.3_101231
  Located on chromosome 3
  Distance between a terminus base of telomere on chromosomal short arm and 5'-terminus of this base sequence : 80344363
  Distance between 3'-terminus of neighbour sequence of sequence listing upward to telomere on chrosomal short arm and 5'-terminus of this base sequence : 121515
cagatcacgaggtcaggagttcaaggccagcctcaccaatatggtgaaacctcatctctactgaaaatacagaaattagccgggcgtggtggtgcacgtctgtagtcccagctgctcaggaggctgaggcaggagaatcatctgaacccgggaggtggaggttgcagtgagtcaagatcgtgccactgcactccagcctgggctacagagcaaggctatgtctcaataataataataataataataataataacagctttgaatatttttaatatgttaatatttaaacattttcaatgattaaaaattttgtttaagcacagaaaataacattaatgcaaacatatgacccaataccataaaactacacaacttactaaaagacactgaatgtttgaattgttaaagactcatgctgat

SEQ ID NO: 5316 - DNA, 382 bp, Homo sapiens
  chr3.fa.O7frz.92800740
  Located on chromosome 3
  Distance between a terminus base of telomere on chromosomal short arm and 5'-terminus of this base sequence : 80497059
  Distance between 3'-terminus of neighbour sequence of sequence listing upward to telomere on chrosomal short arm and 5'-terminus of this base sequence : 152276
atctatccatctgacaaaggtctaatatcctgaatctaccaggaacttaaacaaatttacaaaacaaacaaacaaacaaacgaccccatcaaaaagtgggcaaaggatatgaacagacacttctcaaaagaagacatttatgcatccaataaacatatgaaaaaaaaagttcatcatcactggtcattagagaaatgcaaatcaaaaccacaatgagatactatctcatgcctgttagaatggcactcattaaaaagtcaggaaacaacagatgctggaaaggatgtggagatacaggcacgctttttcactgttggtgggagtagaaattagctcaaccattgtggaaggcagtgtggtaattcctcaaggatctagaact

SEQ ID NO: 5317 - DNA, 142 bp, Homo sapiens
  D3S2392
  Located on chromosome 3
  Distance between a terminus base of telomere on chromosomal short arm and 5'-terminus of this base sequence : 80510671
  Distance between 3'-terminus of neighbour sequence of sequence listing upward to telomere on chrosomal short arm and 5'-terminus of this base sequence : 13230
tcaatgtgctagtctcatatgctttaacagatgtgaaaccaaacgtgttagatagatagatagatagatagatagatagatagatagatagatagataaatatatttagatctctttctttcttctcagctacactgtcata

SEQ ID NO: 5318 - DNA, 439 bp, Homo sapiens
  chr3.fa.O7frz.92701960
  Located on chromosome 3
  Distance between a terminus base of telomere on chromosomal short arm and 5'-terminus of this base sequence : 80598360
  Distance between 3'-terminus of neighbour sequence of sequence listing upward to telomere on chrosomal short arm and 5'-terminus of this base sequence : 87547
agtagactttgagtaaagcagattattctccataatgtggacaggagacactcaatcagtggaaggccttatgagaaagtctgaagtcctctaagtaccctaaggaagaagaaattctccctgacactgcctctggacatgagctgcaacagaatctctttgggtctccagcctaccagcctgccctgcatttttcaaacttgccagaccccaaaattacttgagccaatttattaaaataaatatcgatcaattgatctatctatctatctatctatctatctatctatttatctatctatctatctgtctgtttcttcattttgtctccctggaggcccctaacagttcctttatccctggttcattcttctgcatagcacttgtccccttttaatgtatgatataatgtatttcatttgcatgtttctttattgtc

SEQ ID NO: 5319 - DNA, 416 bp, Homo sapiens
  AC018361.11_72680
  Located on chromosome 3
  Distance between a terminus base of telomere on chromosomal short arm and 5'-terminus of this base sequence : 80715929
  Distance between 3'-terminus of neighbour sequence of sequence listing upward to telomere on chrosomal short arm and 5'-terminus of this base sequence : 117130
atttacttgtaagaaggaatggaggggtagttagatgggggaagaatagcaacgattatatctttgactttgaactaagttctacagatatgatcattgaaatttgagaaaacgagaacacaggagatgtaaagatagaaagatagataaataccatataaatcattgcctccatatgtatatattcatatacatacctatatttatatatatatctgcctatctttttatgttaagtgcaaaaagtaattaatatactgtgcatttatatatgtgtgtatatatatatatatatatatatatatatatatatatatatatacacacacacacacacatacatgtcatttgctcccaagtggaatacatgaggaatgagattgtgtgatgatgtttgctatagtgaatatttggaa

SEQ ID NO: 5320 - DNA, 332 bp, Homo sapiens
  AC018361.11_128345
  Located on chromosome 3
  Distance between a terminus base of telomere on chromosomal short arm and 5'-terminus of this base sequence : 80784137
  Distance between 3'-terminus of neighbour sequence of sequence listing upward to telomere on chrosomal short arm and 5'-terminus of this base sequence : 67792
cagatactgagtagaagctttcatacacaattttcaaagtattctgatggagagggtattttaaaactcatgttacagacaagaaatctgagttttgggaatattaaggaaccccctgacattccacaataatgaattttgtgtgtgtgtgtgtgtgtgtgtgtgtgtgtgtgtgtgtgtgtgtgtatttttacataaaccacttgattttgaagaccacataattttaattgctaagacacaatcttttcttttaatcatgcttttacctaccaataagaatgtattaggtgccttctatgtgccatacttggctagatgctaagattgta

SEQ ID NO: 5321 - DNA, 147 bp, Homo sapiens
  DISO7_10001157
  Located on chromosome 3
  Distance between a terminus base of telomere on chromosomal short arm and 5'-terminus of this base sequence : 80880451
  Distance between 3'-terminus of neighbour sequence of sequence listing upward to telomere on chrosomal short arm and 5'-terminus of this base sequence : 95982
acattactcactgatgtattggaactatatatatatatatatatatatatatatatatatatatatgtataataagtttgtagctaccattatttgagggtaaatgccaacatttatgagaaaacacatctgactaaatggctggtc

SEQ ID NO: 5322 - DNA, 111 bp, Homo sapiens
  DISO7_10001158
  Located on chromosome 3
  Distance between a terminus base of telomere on chromosomal short arm and 5'-terminus of this base sequence : 80887022
  Distance between 3'-terminus of neighbour sequence of sequence listing upward to telomere on chrosomal short arm and 5'-terminus of this base sequence : 6424
tctgcgtgtctaattatgtggtacacacacacacacacacacacacatatatatgtatatatatatatgtactagaaactttgaacacatgatgatggtgaacaaagacag

SEQ ID NO: 5323 - DNA, 252 bp, Homo sapiens
  DISO7_10001159
  Located on chromosome 3
  Distance between a terminus base of telomere on chromosomal short arm and 5'-terminus of this base sequence : 80922624
  Distance between 3'-terminus of neighbour sequence of sequence listing upward to telomere on chrosomal short arm and 5'-terminus of this base sequence : 35491
aatcctgcaaagatgtcaagggcattgatttgtatattaacaagtacatgtacatttattacaaagaaaaataataattcacctttgcttcaaagcaaagtgagagaggggaagtaatcatggttaagaatattaaaaatttaaaataaaagtccacattctatttaaaataatgcttatatatgagtatatatatatatatatatatatatatatatatatatatatatgaatattgccatcagctaagag

SEQ ID NO: 5324 - DNA, 186 bp, Homo sapiens
  DISO7_10001151
  Located on chromosome 3
  Distance between a terminus base of telomere on chromosomal short arm and 5'-terminus of this base sequence : 81055880
  Distance between 3'-terminus of neighbour sequence of sequence listing upward to telomere on chrosomal short arm and 5'-terminus of this base sequence : 133004
ttgttgcagacttcaagctcaaattttataactagatattgtggctctactgacattttttgaatcaattacaaaatgtgtgtgtgtgtgtgtgtgtgtgtgtgtgtgtcttgctggttttcatggtttacacatattgtcaaaatatatatttttattatgaaataactgtctcagagtctcaca

SEQ ID NO: 5325 - DNA, 194 bp, Homo sapiens
  D3S1276
  Located on chromosome 3
  Distance between a terminus base of telomere on chromosomal short arm and 5'-terminus of this base sequence : 81089530
  Distance between 3'-terminus of neighbour sequence of sequence listing upward to telomere on chrosomal short arm and 5'-terminus of this base sequence : 33464
gaggagcctactaggcagaatcagttactttggaagaaataaatgtgtgtgtgtgtgtgtgtgtgtgtgtgtgtgtgtgtatgcatacacatgacaatagcatgttatttcaaaatttagagtttgttcatcatgtgtttaaaatacttgcgtgaaacatgttttaatgcaaatgcacaatctgccttcagaat

SEQ ID NO: 5326 - DNA, 101 bp, Homo sapiens
  DISO7_10001152
  Located on chromosome 3
  Distance between a terminus base of telomere on chromosomal short arm and 5'-terminus of this base sequence : 81089542
  Distance between 3'-terminus of neighbour sequence of sequence listing upward to telomere on chrosomal short arm and 5'-terminus of this base sequence : -182
aggcagaatcagttactttggaagaaataaatgtgtgtgtgtgtgtgtgtgtgtgtgtgtgtgtgtgtatgcatacacatgacaatagcatgttatttcaa

SEQ ID NO: 5327 - DNA, 479 bp, Homo sapiens
  chr3.fa.O7frz.99663880
  Located on chromosome 3
  Distance between a terminus base of telomere on chromosomal short arm and 5'-terminus of this base sequence : 81149436
  Distance between 3'-terminus of neighbour sequence of sequence listing upward to telomere on chrosomal short arm and 5'-terminus of this base sequence : 59793
ataaccataggtatatggactcaagtttgaaagaaacaaaactaagtagaataaaactttactaaatattggtcaggcgcagtggctcatgcctgtaatcccagcactttggaaggccaaggtgagtggatcacttgagttcaagagttcgacactagacttgccaacctggtggaactggaaccctgtctctactaaaaaaacaaaaacaaaacaaaacaaaacaaaacagaacaaaacaaaactagctgggcttggtggtgggcgcctgtaaccccagatactcctgaggctgaggcagaagaatccctggaacccaggaggtggagattgcagtgagcagagatcacaccattgcactgtgcctgggcaacaagagtgaaactccatcccaaataaataaataaataaataaataaatctttactaaatattaataaagaaattcaaaaacaattgtatttgtccactattcaaat

SEQ ID NO: 5328 - DNA, 446 bp, Homo sapiens
  AC023600.19_112368
  Located on chromosome 3
  Distance between a terminus base of telomere on chromosomal short arm and 5'-terminus of this base sequence : 81298855
  Distance between 3'-terminus of neighbour sequence of sequence listing upward to telomere on chrosomal short arm and 5'-terminus of this base sequence : 148940
gagaacgtaccttatgttagtcactatacaagacataataagtattttatttatttatttatttgtttatttatttatttatttatttatttatttattgagacagagtttcgctctattgcccaggctggagtgcggtggcgcgatctcggctcactgcaacttccgcctcctgggttcacgccattctcctgcctcagcctccccagtagctgagactacaagtgtgcaccacccagcccagctatttttttatatttttggtagagacatttcaccatgttagccaggatggtcttgatctcttgacctcgtgatctacctgcctcggcctcccaaagtgctgtaattacaggcgtgatccactgcccctggcctgaattattccaaaaatgttaaactatgccatatttatagtattagtcttacgaatttaccatcagtta

SEQ ID NO: 5329 - DNA, 475 bp, Homo sapiens
  AC023600.19_51245
  Located on chromosome 3
  Distance between a terminus base of telomere on chromosomal short arm and 5'-terminus of this base sequence : 81359932
  Distance between 3'-terminus of neighbour sequence of sequence listing upward to telomere on chrosomal short arm and 5'-terminus of this base sequence : 60631
atagtgaacagctcactttatgacattttgggagttgaaataacgtatataatatcctttatcttatttagcttacaacaaattttatttattttttaaaatatttatttatttatttatttatttatttatttatttatttattgagatagaatcttgctctgttgcccaggctggagcacagtggcacaatcttggctcactgcaacctccacctccggggttcaagtgattctcctgcctcagcctcccgagtaactgggactacaggtgcacgctgccacacccagttgattttttctattttagtagaaacggggtttcaccgtgttgtccaggctggtctcgaactcctgagttcaggcaatccgtccgccttggcttcccaaagtgctaggattacaggggtgagccactgagctcggccaaactacatattttcaaaaattaaattagatattaccaaggatcaaga

SEQ ID NO: 5330 - DNA, 268 bp, Homo sapiens
  chr3.fa.O7frz.99368127
  Located on chromosome 3
  Distance between a terminus base of telomere on chromosomal short arm and 5'-terminus of this base sequence : 81459719
  Distance between 3'-terminus of neighbour sequence of sequence listing upward to telomere on chrosomal short arm and 5'-terminus of this base sequence : 99312
taacctatggaatgttaaacaaagtatctcgaaaaaggaagaagaaagaagatgaagaagaggaagaagaagaagaggaaggggaagaagaaggagaaggagaaggagaaggagaaggagaagaagaagaagaagaagaagaagaagaagaagaagaagaagaagaagaagaagaagaagaagaagaagaagaagatttctatgaaatacgttttgttttgctgtttcagtccgtaatctattcttctagaattgaaacctacatgca

SEQ ID NO: 5331 - DNA, 285 bp, Homo sapiens
  DISD22_0002844
  Located on chromosome 3
  Distance between a terminus base of telomere on chromosomal short arm and 5'-terminus of this base sequence : 81546368
  Distance between 3'-terminus of neighbour sequence of sequence listing upward to telomere on chrosomal short arm and 5'-terminus of this base sequence : 86381
gatcaattgacccattcttgttttgaaatacaagcttatatcatttaattctattaaattgtctttcatatatatatatatatatatatacacacacacacacacacacacacatatacataatagttctcctattagactacaatattattaagaaaagtagtttctataattgggcaaaacacagagtagggtttttttatttttagctcttaatgatggttaatattaaagaaaaagccctcaacatctgaaaacaaacaagaagtagaacgtaagagtcca

SEQ ID NO: 5332 - DNA, 123 bp, Homo sapiens
  DISD22_0002848
  Located on chromosome 3
  Distance between a terminus base of telomere on chromosomal short arm and 5'-terminus of this base sequence : 81667023
  Distance between 3'-terminus of neighbour sequence of sequence listing upward to telomere on chrosomal short arm and 5'-terminus of this base sequence : 120370
tcacgagatcacagctcgctgcagccaggcacatacacacattagctgtttgtagcacccagctattgtgtgtgtgtgtgtgtgtgtgtgtgtgtgtgtgtgtagaggtgaggctcttgttga

SEQ ID NO: 5333 - DNA, 464 bp, Homo sapiens
  chr3.fa.O7frz.99151191
  Located on chromosome 3
  Distance between a terminus base of telomere on chromosomal short arm and 5'-terminus of this base sequence : 81788917
  Distance between 3'-terminus of neighbour sequence of sequence listing upward to telomere on chrosomal short arm and 5'-terminus of this base sequence : 121771
tgacattaaagcttcaagaaactggatatcttgttaaaagataatgcaagctgggcatggtggctcactcctgtaatcccagcactttgggaggctgagacgggcagatcacctgaggtcaggagttcgagacaagcctggccaagatggtgaaaccatatctctactaaaaatacaaaaattagccagacatggtggcatgcaccagtaatccaatcaacatgggaggctgaggcaggagaatcgcttaaaccctgggggcagaggttgtggtgaaccaagatcatgccactgcactgcagcctgggcaacagagcaagactacttctcatatatatatatatatatatatatatatatatatatatatatagcaactggtgaaattaagttgaagccaatactcatttacaatttcaaaaattctagggcctctaaaattatcctaaatctactctgcctgt

SEQ ID NO: 5334 - DNA, 259 bp, Homo sapiens
  chr3.fa.O7frz.99067120
  Located on chromosome 3
  Distance between a terminus base of telomere on chromosomal short arm and 5'-terminus of this base sequence : 81873826
  Distance between 3'-terminus of neighbour sequence of sequence listing upward to telomere on chrosomal short arm and 5'-terminus of this base sequence : 84445
ttcgaactacagcaatttctatatataattttatatatatacatctataatatatatatcagttctcatatatatacaaaatatatatatcagttctcatatatatataaaacattatatatatatatatatatatatatatatatatatatatatatatatatatataaaatgtggccgggtgcagtgactcacgcctgtaattccatcactctgggaggccgaggccagcagatcatgagatcaggagatccagacc

SEQ ID NO: 5335 - DNA, 441 bp, Homo sapiens
  AC073985.1_119890
  Located on chromosome 3
  Distance between a terminus base of telomere on chromosomal short arm and 5'-terminus of this base sequence : 82004295
  Distance between 3'-terminus of neighbour sequence of sequence listing upward to telomere on chrosomal short arm and 5'-terminus of this base sequence : 130210
attatggtcattcttggatctcattgtattttcaatttgcatttccctggtaattagagatgttgagcatattttcatgtgtgttggccatttggataactttttctgagaattgtctgttcatgtcctttgcccactttttaagtttaatttaatactaatcctactattatatatatatatataagaatagataaatattattatatacataacagtaggatataaaagaataaatatattcttatatatgtaatagtagaatatatacataatagtaatatatatatatatatatatatattcttttttagagacagaatctcactttgttcccagactggagtgcagtggcacaatcagctcactggagccttgaattcctgggctcaagcaatcctcccacataagccttctgagtaattgcaactacagacactc

SEQ ID NO: 5336 - DNA, 230 bp, Homo sapiens
  D3S2445
  Located on chromosome 3
  Distance between a terminus base of telomere on chromosomal short arm and 5'-terminus of this base sequence : 82175791
  Distance between 3'-terminus of neighbour sequence of sequence listing upward to telomere on chrosomal short arm and 5'-terminus of this base sequence : 171055
tttacatttcattcctcattttgtatctatctatctatctatctatctatctatctatctatctatctatctatctatctctctctctctctctgtctcacacacacacacacacacacacacaaccaaattcagggtaatgttgactttaatgtgttatagtactagacagtatacctgaaagcagttgtataatatataactgaatggtgcttgaatgtttacagaca

SEQ ID NO: 5337 - DNA, 439 bp, Homo sapiens
  chr3.fa.O7frz.98245073
  Located on chromosome 3
  Distance between a terminus base of telomere on chromosomal short arm and 5'-terminus of this base sequence : 82328512
  Distance between 3'-terminus of neighbour sequence of sequence listing upward to telomere on chrosomal short arm and 5'-terminus of this base sequence : 152491
ttacatcattaaccatagccaccatgttgtacattaagttttcaaaatttattctttctacaattaaaagtgtgtaccctttgaccaacatctcttccaccactcaagcccctgatcaccaccattttactgtttgtaataataagtttgactttttttcttttagattctacatgtaagtgaaatcatgcactacttgttttttatgtttggcctattttacttagcacaatctcctccaaatgtgttcatgttttcatgaatggcaggatttcctttttaagagctgaataatattcctttgtgtaagcagaaagataggtagatgatgatgatagatagatagatagatagatagatagatagatagatagatagagatagagcttgagctagaactatatcacatttactttatcaattcatctgttgtaagaca

SEQ ID NO: 5338 - DNA, 460 bp, Homo sapiens
  AC073030.2_101588
  Located on chromosome 3
  Distance between a terminus base of telomere on chromosomal short arm and 5'-terminus of this base sequence : 82567320
  Distance between 3'-terminus of neighbour sequence of sequence listing upward to telomere on chrosomal short arm and 5'-terminus of this base sequence : 238369
tgtacttggcactatggaagaccataagaatataataatgatataaaaaagatggttcttgccctcatataatatgtcatgtaagaaatagacaattaagtcaatataacatgttgagagagaacttttctgtagttccacaactagtaactgttatccaaaaataaataaataaataaataaatcaataaataaaaaagacaaaaaagtgctaagtagccacatgcaagccttcaaaatttggtgccagagtcctctccctgtgggtttgtaaggagacacaagtaacctactgtaaataactaccacctcccctgacttcaccttttcatccagtcaataggagagagctgggtttagagaatgatgagaggagtagggaactctctgatctcagtgtggcttggcaggttcatgtgagttttccgttggtggaagattgtacagacattaaatgtgc

SEQ ID NO: 5339 - DNA, 458 bp, Homo sapiens
  chr3.fa.O7frz.91048659
  Located on chromosome 3
  Distance between a terminus base of telomere on chromosomal short arm and 5'-terminus of this base sequence : 82618927
  Distance between 3'-terminus of neighbour sequence of sequence listing upward to telomere on chrosomal short arm and 5'-terminus of this base sequence : 51147
accataggcagcctagaacttatttttagaaaaaggagtaaaatcatttttactcttctcaaattttgaaggaagatatgtatattctgatatttgtttatatgtttctggggtctgtatttacattcataaatgtaagaaaagtaaaataaaataatatctatcagttcccatttttgtgctaattattcatttctgccttggattttgccctgtgctctttatcgtagccgataaaaacaagaaagtgttagccatggtgaagtattcccatgtgtcggattaagagaactaaaatggtctggtaaatgtagaaaatagcaaagcaattttaaattctaaattgagtgtgtgtgtgtgtgtgtgtgtgtgtgtgtgtgtgtgtattccccctaaatcctctaccctagaaagaactgaaaactatattttcaagtgtgacttgacacgtatgtcaa

SEQ ID NO: 5340 - DNA, 413 bp, Homo sapiens
  chr3.fa.O7frz.90821793
  Located on chromosome 3
  Distance between a terminus base of telomere on chromosomal short arm and 5'-terminus of this base sequence : 82749623
  Distance between 3'-terminus of neighbour sequence of sequence listing upward to telomere on chrosomal short arm and 5'-terminus of this base sequence : 130238
taacctaattacatctgcaaagaccctttttccaaataaggtgacatgcataggttccagagattctgttgtggacatacctttttgggggccaccattaagttcactacagggcaggaaagtaaaagccatgatcactaacttttgtcctcagcagggtcacccctacagcagggggtggggtggggcaaagacttctctaaaattttttgggggtgggctttttgggttctccagagaaacagaacaaatagagtgtgtgtgtgtgtgtgtgtgtgtgtgtgtgtgtgtgtgtgtgtacataagggggaagagagagagaacaggagagagttttttttgtgtgttttttggaattggcattgttttatgtaattgtggaggtggaagtttaaattcacgtgttagactgg

(The sequence listing continues in the following parts.)

What is claimed is:

1. A method of identifying a DNA sequence fragment comprising a microsatellite in a human genomic region in which a gene associated with a phenotype exists, comprising:
   selecting a combination of DNA sequences comprising SEQ ID Nos. 1-27088, wherein each of the sequences comprises a microsatellite genetic polymorphism marker;
   collecting DNA samples from subjects affected with said phenotype and control subjects not affected with said phenotype;
   performing polymerase chain reactions (PCR) on the DNA samples using forward primers consisting of 15-25 nucleotides wherein the forward primers consist of the same nucleotide sequence as the sequence extending in the 3'-direction from the 5'-terminus of each of the DNA sequences in said combination and reverse primers consisting of 15-25 nucleotides wherein the reverse primers consist of the sequence complementary to the sequence extending in the 5'-direction from the 3'-terminus of each of the DNA sequences in said combination to produce DNA sequence fragments, wherein each of said DNA sequence fragments comprises a microsatellite genetic polymorphism marker;
   analyzing alleles of the microsatellite genetic polymorphism markers of said DNA sequence fragments; and
   statistically comparing allele frequencies observed in the DNA sequence fragments produced from the affected subjects with those observed in the DNA sequence fragments produced from the control subjects to identify microsatellite polymorphism markers found positive whose allele frequencies observed in the DNA sequence fragments produced from the affected subjects are statistically significantly different from the allele frequencies observed in their corresponding DNA sequence fragments produced from the control subjects, wherein the DNA fragments comprising at least one microsatellite polymorphism marker found positive are in a human genomic region in which a gene associated with a phenotype exists.

2. The method according to claim 1, further comprising the step of mixing the DNA samples obtained from the subjects affected with the phenotype to provide pooled samples for affected subjects and mixing the DNA samples obtained from the control subjects not affected with the phenotype to provide pooled DNA samples for control subjects before performing the polymerase chain reaction.

3. The method according to claim 1, wherein the DNA sequence fragments produced by PCR comprise all or a part of the DNA sequences of SEQ ID Nos: 1-27088.

4. The method according to claim 1, wherein said analyzing of alleles of the microsatellite genetic polymorphism markers is carried out using a DNA chip and a mass spectrometer.

5. A method of identifying a DNA sequence fragment comprising a microsatellite in a human genomic region according to claim 1, further comprising:
   selecting secondary DNA sequences containing at least one microsatellite polymorphism marker found positive through the method of claim 1 from the combination of DNA sequences comprising SEQ ID Nos. 1-27088;
   collecting DNA samples from affected subjects different from the subjects affected with the phenotype of claim 1 and control subjects different from the control subjects of claim 1;
   performing polymerase chain reaction (PCR) on the DNA samples using forward primers consisting of 15-25 nucleotides wherein the forward primers consist of the same nucleotide sequence as the sequence extending in the 3'-direction from the 5'-terminus of each of the secondary DNA sequences and reverse primers consisting of 15-25 nucleotides wherein the reverse primers consist of the sequence complementary to the sequence extending in the 5'-direction from the 3'-terminus of each of the secondary DNA sequences to produce secondary DNA sequence fragments;
   analyzing alleles of the microsatellite genetic polymorphism markers of said secondary DNA sequence fragments, and
   statistically comparing allele frequencies observed in the secondary DNA sequence fragments produced from the affected subjects with those observed in the secondary DNA sequence fragments produced from the control subjects to identify microsatellite polymorphism markers found true-positive whose allele frequencies observed in the secondary DNA sequence fragments produced from the affected subjects are statistically significantly different from allele frequencies observed in their corresponding secondary DNA sequence fragments produced from the control subjects, wherein the secondary DNA fragments comprising at least one microsatellite polymorphism marker found true-positive are regarded as a region in which a pathogenic gene or a gene relating to human phenotypes associated with a genetic factor exists with higher probability.

6. The method according to claim 1, further comprising:
   analyzing said DNA sequence fragments comprising at least one microsatellite polymorphism marker found positive through the method of claim 1, based on allele frequency of known single nucleotide polymorphisms.

7. The method according to claim 5, further comprising:
   analyzing said DNA sequence fragments comprising at least one microsatellite polymorphism marker found true-positive through the method of claim 5, based on allele frequency of known single nucleotide polymorphisms.

* * * * *